United States Patent 11,549,145 (METHODS AND COMPOSITIONS FOR INHIBITING AND TREATING NEUROLOGICAL CONDITIONS) - sequence listing, part 35

SEQ ID NO: 598 - DNA, 568336 bp, Homo sapiens
tgtatcaaggaaatggacattttattgaaaggaaaagaagggtgggtaattactaagtacagagcaatgtgtcgtggaacagcaagcttggggatggtgccattggagagtttgggatagcatgactggacatttgagggtttggagaaaatagtatttggtgtgtgaatagagaagaaaaggagggagaacattcccaaactgcctttcaaagatagtgagttggtagagttagtctttaatcccggaagaaggaagaaatttccttgtttgttatcttagccctagggcccagaaaatgagccaaaacaatgctaaatagtaactgtagattaaatagatttttaaggctagtctaggtacctaacgaccacttattacaccatgggagaacgaatctggaggtccaagttgtttcatttctaaagtttcagaataaacgttttcataaatgcagggatacctccacttattctgcattaactgccttcatttaaaaattacttattaataaatgcagtagcacaatctgccaatatgttttgggaaatatcacaaaaataattcatagagaacttacgcaacataatacaattatctctcaaaccctagcaagaaaatattttgagagaaccactaataatgtgaattactagttaatattactaacattactaattattagttaacattgattactaatattaactaataatatatgaaatatatatttcctctgctatggaaatatgctgtcatagtaattcttttaacaatgtatgtgcctattaggtacaaagaacagtcagtgttactatcttttactcatttgattaaaaacaaaatattacaaacaaaacaaacaaaaaactcaagaaacaaaaacacagagtcagatagttgggatgtttgaaacactgcaaacctcttttactgcatttgctctatataagtctaataaatacagaagtagttatgagcaaatagatttttattgcctgcaagctgttatactggagcaggagaatatggtatcttgacggaagcacacttgctaccccacacctggggattacttatagttgaaagaagaaatgttgagaatggaacaaagacacaaacccattggataatctagtctatatttgggtttggcaatcctttcatcccaggaatatacctgtagaccaattcaaagtactaagaaccaagattaaagattttatacacatcacaataatagcaaattaagtacaaaacgaacctggcacataaattataatttgtaaggtacacaccattttaacaaggatacgacagtgttggtgcagtggtccgaactgacttctcacaatgctgcattatgagaaatatgtatctcgctttacacagaaaacatcattttgatgtgattacagaaaaatgctcaaatcttctttaaaaaaaaaagttcatgttctgatcacaagcagagccaaggttcatttttaggtcaaactacacaaaagaggatgctcttctccaaaaaaacaaacaaacaaacaaacaaaaaaaggaaacaaaaaaaccccaaaatcttggcatttccccttttactctacattcaggcttactttttaaagaaatacaagcatttttatttggccaaaacaaacaatgaatgtaattacaaggacaaggttaaaaaaataaaaaacaatgtcgatcaaggtcttccttccttctgcaaagctgtgtgatatcagccttcttcttcttcgtcactgtctttcatagtaatgccctgaagtcctcctccttctgaaacagaggctgtggcctcctctactgttaaacgtctgtgcacagtatcataagtcttactgttcagtgttccttccaacacaccctgcaatcgaaagtccctgtaggttttctgaagaaagaagataaaatttgcttagctcacttagattatatgcgtgtacatagatatatactcagttggcatttcaaaaatgatcttggggaatccactgataggttcatgtggctgtccatgccaatcatcttcttggtgtatttctggggagtaaatggaatgacagactctggctattgcttcaaactacaattactatgactacatcaaaatgttgttactatcagatgacaaattcactttcccctcagaacattactaattgcacacaatttaccttttgaacaacctgtagcaaaaataaaatatgtacctgtgtaagtttttaataagaaattattagtttttttaattgagggggctttcctttaatactgaaaaatacattatattttataaaatgcattaattttgaggggtcagttgtgtggaggaagaagattaatcctattatcggtaaaagaagttcacattttcagcatttcagtgaattataaaatttatttacatgtaccactggataaaaatttgtgtacatctaaatgtctggatgaattttgcccttttcttttgaaattcccttgggatgtgaagtgccaaattctgacataaagcttccatagatgggacagcaaaacaagtatttacattttttcttaaaagaatacattaaaatttgctgtattatgtatcaaaaatagagtaccatgttattgtttgtacaatgattttcaagacaacaaaatccaacaatatttttctgtggcacttaaaatattaatctataatgtttcccttatgtttacattgattgattgattgactgattgattgactgattgagacaggtctcactctcttacccaggctggagtacagcggtgtgatcattgcttactgcagcctcgacctcccaggctgaagcaatcctgccaccttagcctcctgaggagctgggaccacaggtgtgtgctactgcgctcggctaacttttaaatttttttgtagagacaaggtcttgccatgtagcataggcttgtcttgaacccctggcctcaaatgatcctcacatctcagcctcccaaagtgccgggactacaggcctgagccactgtgcctggccatgtttacttttttcttttcttttttttgtttttattttgacatggagtatcactgtgtcatccaggctggagtgcagtggcacaatcttggctcacagcagccttcgcctccccagttcaagtgattctcccacctcagcctcccgagtagctgggattacaggcacatgccaccatgcccagctaatttttgtgtttttggggtttcactctatcggccagactgatctcaaactcctgaactcaggtgatccgcccaccccagcctcccaaagtgctggcattacaggcgtgagccacagcactcagccatgttcactttttaaagtgtaatcttcttcacatataattttctgcagctaaacatgactggtattttattactactgatttttaaagtaggagaaaaagttcagttagttaaatggggaaacaacaaatgaagatatttcattttgtgggatatgattttgtcataataagctcattctaagtcataagttattatgactaaggtagtactctcttacaccaaaactcactgtaatttgcatcagaaccagtgagataattctgaaaggtatgttttgtctagataatctggaaactgataaacatggcattattaccacaaagatttgtgtttattcctataactctcttgtaattaaacatgtcaaacataaagtattcacctacagatgatgcatctaatgtaaagtattattgttccactaacaattatatactgagtttttgagttcaactttcttattttattggaatgactttcctttgacttagcttaattaccagtaagttggccagagcagatttgaattgtggatctgcagtcctgaaggctttctaatttatatataattaagaccgctttcttattcaattagcaagcaataaccagttgggtgagatactaggcagctagccttgcaatctctttctctgtctttagaattcataaaatgttattgacacttggatgttccctgtggcttccacaaaggtttggttggctcttgcttaagacaagtgcctgccacagagttctgttcactttttctctcctagcaaaagaagcaggtgatttatgttaactgcatttaatgtcatgtggccactatggagaacacaaacacaaccattttgactatttgagggtttcacttttcccctcccccaaaaaatcattctaaggtaaaaactttgcaaataatttcagtctttaattttttgtgtaaccctttctgggatttgtttttttcttagtgtgcaacatgaatgaaccaattggtgtataagtgtctttgtttagggtaaagttggctattacataaattttgatggcatctaggtctccatgggcatagaagaatggcaatccctgtgagtagtaaggacaagactactaacagcaagtagtttgggtcctgggtagaatacactactctgctgaaccatgcaggccaagtctaagtgacctggatggaaggaaagtctggttatgggccttcacaattctctacatgtgttattcaacagcttcttaaattcactgggaaatgatcattataagcaaaaccatgtaagttctgaagaataatgaatctatgtatgaaattggctaaaagtctgtttatattcaaagtagaaaaaacaattagaacattaaattattaattcactttgagttttattgtgaaaataattatttctaattattaaatagagccctatgacttgattaaatgtatcagcccaagaacacattggctaagcctggagacttgcctgtgaaaagtaaaacatggaaaatcaacatattcatgaaaattaatttcatatttattggtcaaatattgatcattaggaagaatatattaaagaagatatactgacttacagtaaaatggaaatgtcactatataattaataaaattattgttcttttatgctaaaatattcactagtgagaatacttaagatctactctcttagcaaatttcaagtatacattaataagtcacactgtatatcttgagtatataaaaatttttacttttaaattatacctcaataaaatgaaaaaatttcactcttgcttaatctttaactataaagatgtgtggaaatgaggaataactttgaaagaaacaaatcatgggctaatgtggagattgttattctcaaaacaaagagcttaataatctatcagctaacaccaggaggctgaatatgtaacttctgaaatcttgaacacagtaggcattagcttgaaaatatggtttatcataaggataaacagctaattgtaatattaatcactgcataaagtacaactgttatgtatgtgtatatatatgcatattatatacatatgtatattttatatatatatatatatatatatatatatatatatatatatatatatatggcaaatacattatcctgactctcttttctgaagaacaaacttcatttgaaagctcttcaagtcacatttatagaaacaagaaacaatggagaactaagccaattatgaacctatcatattgtcctttcagtttctttgtaaaataaataacaccatataagaagtgttctggatcaaaattattttctccattgacatgtaatgtgtagctatagtattaaaattttgtgagtggctataattttacttgttatttatgagtaatcataattgctattattgtggcattttaggtctggttctactttccagtagatttgccaatttctgactttggaacagaactttcctatttgtgggcctaacaagatcaacaagcaggcataaaaataatttgtattctaattagactgtaggaaccaaaggaataaagaaaatattttaatgtggctagaaacatcttttaatgatgtaacacagtgggtctttgaaaactttagcatgttttcatgtattagaaccatctggaggacttgttaatctatagattactgggttccaccctcggaatttctgattcagtaggtctggggtggggcccaagaatttgtggttctaacaagttcccaggtgatgatgatagtggtaggtgaggaatgacactttgcaaactactgtgtatactcatatatacacacattatgtgtgtgggtacatacacacatatatactactaataaatggtactataatgaaagtaaaggtcttttgtttaaataaataggtgattctcaatagcttagagttatgttttctgccataaggtgaaatttctgtcccaattttaagaaaaggttaaacttggggtaaattttgtacttacattagaatttacaaagtgtgaaaaattatgcataatatattattttatagatcttactcactaaatatgacatgtaatttattagcttttctcttcaagagctaaagtcaaaatggccttgccgaacttatgtgatgtctatgtcagtagttttgggtggtctccaacactcaaactgattaccttttacatataagaggcatgcttccaaaaggatttgggcaatgacaatgtattactttcgtaccagcatataataaaataactgagactctccttattcttctggcaaatatagtacaaaagccctcacaatgatatatgatcctaataaatatgaagtaattgtattatgataaaacattcatatgcttaagaaaattaatgtaaaattattgtgaacctacttccttcaggtaactgtgctggggctttatgtatttaatctcaaactgtgagtatttgctagcaaattttttttattagtgcaaaaaagataaatttatattcatttattaatctaactaaacgtggaagtaaacagtagcacatcattgctaataagtgatactttttagttacatcaaatacagttttcttgtatgtcagtatcttgccattattccttatagcttagtgggcaattcatatctaaacacattttgtttaccttcacaatcttgatgagcgtcttcagctggtaaatatggagttggaggtctaatctatcagtcaaccacacgcaaatgactttcatggaactgctgtaccattgctagaagggagaattggggcacaggggaggagaacaaaaaaagaaaacaacctctgcagtattcatttaacagattcgataatgagggggtaataaaacactctgaaatgaccacagatcagcacttgaagtcaataatgctataatttcctgttaacagaattgtatgctttgctagaaaatctgttaagttgacctaggctgttctttaaatgaattaacgttacagtctttcagctgtaacatattcacggaaacagtgtttttgcactttgcagcctagtggcctgctttgtaatttgtaaataacaaaggatcctaaatacatgttataggactgaatggacagccaagcagcaggaaaaaagaggtaaattattttcaaaggaaaattttctattagcctgcatgttacataaaaatcaaaaagaagatgtgttatgctataagtcatgtagtcaatacctaaaattacattttaaagtagcgatggcaaaaaaaaaaaaaaaatctacaacttaaacagtaatcctcaatcacacctttatcaattaaatatttaccaagctcttttaaaaccatctaaaataaagatttattgagatcttaggaagaaacattatcaagattgaatttttgtaagaatcacaaaataggtgtcagttgatcaaattatgaatgaaaaggatgtgtttcattttgtatttttggagggtccataatttttctgtttattacaactctcttaagagaaaaactgaaattcttctttaatgcaattttctgctcctatatgtctgtcagtctagtaaaagaaaatattgttcctgttttcaaaaaaagacaatctgccattacaaataacatttttaagggacacagtgattcagagctaggtttagataacactctaagaataatgctactcattcagataaaagtgagaaatatcaatgtccactcagcatttagaaaatgacaaaagagttttgaaagacaggagattttgtgccttgcttgtatacacaaacataatgacagtccagatcacatatgtgtgtgcatacgttctaaagaatttaaacaccgaaaaaaaattagaaaaaaaattttctctacataataaaaccataaattcaacttctaaaataaattttcactgatccaagtctgaaattcatctggatttatatttattaacattgatccaatacaatttagtttaacaagaaatggtattttaagtataaattaaaaatgaattttacattttaccatgcttatttccattaatttgttagtataatgaacatatatgcatcaaatgagataagctaatttaaatggataactgatatactaaataatagcaatcaaatggataaataaaagcttcaagttttaaaaatgtgagatggaccatgattttttaaaaatatgttattcctgtatctaattttgctccttcctaatgagcactttcctaatattcaggacatgtaaaaatttcagcagttctataaaacaagacagtcatactccaaaatccttaaaaaagtaaacttccagtaaattcaatactttaactggcacgttaaatctcaaaatcttttatagatactttaatttccgacactaaattctatgctacttatttcaaataatttacagcttcaacttcttgatttctattttaatacaggcactcactcacaagtattggtgatattgaatatgagtacagtcaattgaggcccttctaccacaccacactctagataatttgaaagtgaaaatattgtcataatggatgtgactcttaaaaattacagttattttgcaagggatagtaaatatttctttcttgttgaaggagagaaactatatatattttacgaagcctaacataacatactggttactctgttagactgcacagttactgtaacttggtaagttgtataaatttgagggaaatgaaaaaactttcttaaaattactctatatgcatctttatgttcttgaaaatccttatataatttaaaattaacttcatttttccattatatataaaatggtacttataattaagtgataattgaaaagacatataatgtaacacagaaatcatttatatataacttatttaatacaatgccaaaataataattttagagaaaaataatcttagagaaaaagaatttgggaataaaatgatctaaagttaactgcaaaaacagaaaaagagaactattattaagtaaaatgtttaagctatttatcatcatcttactttgaaggacaataaattgttctatcagcaaaagcttctaagaaaaaaattattctatcaaataagaaaaaattattctatcaaataagaacgtatattttggctcctaagtcaaagcattttcaagacacacttcaaattaagcaaatgattaaggaaaagcagcaacttagctcagaatatttgctgccactaagaatagcctaacaacaacaaaaatcccattatgactgctttcttgtatacagtaaaatgcagacacacacacacacacacacacacacacgcacgcacacaccttaaacaaacaatgaaagccaccagacagaaacctctagcactttcttatttctagtgctgggattaatacgtcctccttttgagtactgaatatggtaggtcccattttctcacactgagaaaaaagtcaaagataggttctctccattccccaatcccctccaccaaaccaaaccaaacaaaaaattggaaaagggtgaatgtgcagtaaagtctccatgttagaaagtgccttttcactttggaaaagttaattttataaaacaacttggttgaccattcacttttctccacaggggatgaaaaggaaggggtgccgcagcttgcacagaaggtatgggaatggcattactgctttattctttgccttggtctacacaggaataaagcagtaagtgtatattttacaaattttttctacatcaatccatgacagcagcctaccactttagcaaaaatatgtttttttcttctttttgtggttcattcaactcctgtaagggcatgcgttactcactgcattttcttgagatatctcttttaaagcaaaaatagaagaaagggaaaggctagggttgactctgtgagacccctgtatttattcacacttattgtgcatgactgtagactggtaaatcatattagcagcccgcctccccatcaagctgctacttgctttccagccctgggaaggttcaacaaatcaacaggagcacggaaaacagaacatcagtctaatctagtgtttaaggtgaggttttcaaacccaatctaagaagatctttagagcaagcaacaagctgaagggctcagaaggtggtattgacaatgaaagagtgttgaaatattgagaagcgcagcacttgtgcatttttaataacaagagggtcaacaaggacacagctccctcagtgccaggagttgccactgactatggaaattgccacaccagggctataaacgcttgcagttcatcagctttcttaaacagttcatcagctttcttaaacaccctgaaccccctcagtggacctttagtcttgaattaacaaaccaaagcaatgaaagagggtgcagtctgaatggctggcattgatccccaactgtgtcagcactgctacaggccctgaaaaactctttccattgtcaatagaaattgacaaacctcatctcctaaatagtgcagctgagccgggcgggatccacgcagctgtaaagggctctgctcttggggccggggagcactaacaatagaacaagcatgagctctttgtcagtcccagactcggcaattttctaacaaggattaaagttgtttctccgcagagctggtgaaaagagatttagcaacataccgtgctttcttcatgcaagttaaagagaagtagttaaggaatttcattattctgttaactagtggaaatacaaaacaaatatattaaatatgcacaactctcctttttacctaatttataacattttgaggatgattcaattaaatataacacgtattgcctggaaacaagcacttcacctttattttggaagttttatttttaaaaagtccagctgcttgccacctggaatgaggtctcaatacatactaatgcacaatgcctttagaccctccaaggctgatattcctaaatctgaatcacaagaccacatagggtttatatatcacggctgcttcaagcaaatgatttttgtcagaatgcggcttctgatgatgatggcaaggtaaaaatagctgcttcgctagggcacaaatctgtgatatattttctacttaagtgtttagctttttattgattatgaattggtacaactagttgatgtatttttattcttctccagctatgcttgtctcaataggtgacaaagaaaaggaaagaaaaagaaccaacactttttagtgaattaagacctgaaatggctaagtttccagattatgtatttcttcatttatttcaaaagaatctgtatgtttggcaagagttgagtcattgtgttaaaatgaaataacgccaagaaaatctcaccttaggaaatatgtaccttttaaatataaagttaaatgaaagaacaaacaatatttgttaaatgaggaaggcttggataaatttgataaatataagccattcttcaggatcatttagtaaagagcaacaaaatatttagaaacattaatgcactacaatttcaccagtatatttctatttaatgcaactaaatttgtggctctgtttcactcatttcccatgtctaaacactaaaacgcaaatgttatattaatggtaaatttaatataataatgtcaaggtttttctaccctgttcaaggcaccccactgaaactatcatacctgggttccataaaaccagacccccaggcacaagcattttgcaagttctgagtgtgaatattttcctggcttggaataggagtaagggctatatttaaggacaagtgaaaccagcctattaggtttaaaaatacaggaagtgtttaacccaacctatgccaatcaacattcccagctcaatccagaggcactcatggtgggggaagagaagagacttgcatctggacatggcagccgtgggctggttgtcaacacaccagggaagaacacaaatgcagaccccgtgagggtgggcagtgctagccccatttatgctactatttgctggattgagtctgttacgcaccttctctatgcctcagctttctcatctgtaatatgtggggtagattatatgaatctatctttaaaatactaagatttgaatgctctatagaaatactgtgagtttaaatttgacttacaggaaaaggcatgatgagcttgtgattcttgtaaaaatgaatggaagagaaaaacccagttgtcattctgtttttatatgttgcttcaatacagctttattcttccagaataaagaaaaatcatctagagttccagaactttctattgtctgttattttttttttaacttattcatctggcctcttaatgtatagacataaaaatgaaacaataaagtatactgaggaatgagatttataaagaactgtgaattacagatactgtttttattagtattatttttatgaattctaattataaaggcatctgatatttattttatccttcataagaagttcaagtgattcagttaaaatttcatttaggccagtgcctgtaatcccagcactttgggaggcagaggtgggtggatcacttgaggccaggagttggagaccagcctggccaacatggtgaaacctcatctctactgaaaatacaaaaaattagttgggtgctgtgacgtgtgcctgtaatcccagctacttgggaagctgaggcatgagaatcacttgaacctgggaggtggaggttgcagtgagctgagatcacgccactgcactcctgcctggttgatacaaggagactctgtctcaaaaaacaaaacaaaacaaaaaaacaaacaaataattcatttaatgcttatgataactttgatgaagtgggtgtaattattcccattttgcatatctggaaaccgagtttacagaggcacaaaactgagtttagattaagcaatttacttattcaagtttatacaatgagtatgacttaagtggtagggtaaagatttatatcttatatttatactccagagtctgtgctcataactcctgtgttatttcacttctctatagaaggacatctggatttctgttttgtcaataacacctttgatgcttaagagtagttcggtgcttctagcagaagaaaactaggaaaagtgtcattagcatttgtggtccttactgacagtcactgcaacataggattatgcacaaatagagaaggtacctattaattatttccaaaaaagcccattcaattttttttgcaggttgaagcaatccacatttctaaaggttaaatgtatctgtaaatccaataacgtaatatacaatgtaaataaattctttgaagaatcacactccctattaggataaccagtcaaatggctattaggttatacatctcatatactctcttaagactcattttaaagtgctatataccataatgattaaaaacactggaaaatatttgttctactgtagtaaaacaatgtaatgtggaaagacgatccttggttcttccatagtagaactctatatatgtgactttcttcatcatcttttttttttttttttcaatcagaacagagaagcatgtgattcatgctgcttttttccatgttgaataaagtcatattcagggcaattttcattttttaactccatcaggcagtttgtaaattaagagtatcatgtctattaaggaatgaaaagtgtaaaaagtgctaacattgggaaggttggtataaaataggcacctaataaatgcttgttgaatgctgaaaaactttcctatctttggcattccatacttcatcttttaaaaaatacatgaatataataacagatatttccagatgaattagatcctcttcagttacataacacaataagttcgaaaacaggacaagttctgtaaattgggagctgcacaagctctttccagttcactactactttcaaaatacccttcattccaaaatgtcctcaaagagataaactacctctttcttcaaactacatgaaaaatatttaaaaaataatgttctttattatcaaataagcaagtgcctctgcaagtttattctgtggctcctttcctagcactaaaaagactagtaattggaaagtgaaaatttcagacaatcagttgttctgccctccctttcttagtgtccttgatgggatgcatactggtttgcctaatcttttgagtgaagtcaccagttaatggtttggctcattgataaatccagttataatggtgtatgtactagtttggggtgcaaacatcacctttatgaatgattcgtttaggcaatatgaaattttcatctggttgacttattttgaacatagtatataaaattctggtaaatattgctttttaaatccataatgtaggatttatataaaagtatattggactcttggaactgctattaaatggtacaacttagtcttgagatgaaactcatgcctgagaatgagctgttagcatgtctttctgcttcagtttccttataaaaatgggacacattccaaaatcttcttttaagagtgtcctaaggacgggagtagacagctacctttctgtctctgagtcacggtgcagtcccccaggaacctttttcagcaaactgacccacctgcagctctgccacatgctaggcttctctataccttcggtctctgggcatgcccattcctctgtgtggactttattcccaactacatctccctgtccagattcatgtcagcctttaagactcagctcaatcattcattatctctgcttcttagccaatactatctcttactaggtacaattaggggctcacctattttctcctcctagaactctatacaggtgtctataaaaatattgcacaatgtagttcatgtctccctcaatcagctgtgagtatacacaaggctttaactgaatcttacttgtattgctatctccagcccttagtagaatgtctggcacagagcatgcattcaattttcatgaaaagactgcatgcatttaaatatttataaatataaatttatatatatatatatcatatctataatagcagacaggcagcttttcaatagacaaaggacagatgaataccagagccagattcactgttgacttgaatcacatatttccttaacagaaaaataattaaatacacgttaaagctgtagaaatcattgaaaagtaaacagttgcatttggccaaaaaaatttaagacaggactcaaatggggcttaaaatgtgacagtctaattttattttaggtgatgaatgaaataaaagagaaagtactataaattgataaactttcatatctatgtacatatatgagaatacacacacacacacactcactcacaaagctatgctaacactatgagttcagatgttgatgtactcagccctccagaggctgtcccccaagcagggagctgcctctctagcatatgctcaggtctattggtacccactctgaggccatggggtgtattaggaggcatggctggatgtgctgcctgtgcattttcaccactaagtgacatgtcctgggtgcgttctacacttgttggcttcgttgagctgtttttaaagaaaggcagaaaaatattgttgctgtggaaatagtgagttctgtctgtagggatataagagcttgtttgggagctgatataagcctggcttttgagctaagaacccaggaagaacagagagcaagagtgtgctcttatctcacagtcacgtcatttgatgcaggtgctagaactggatacaaactttgtgttggctctaaacctttagcaagtttacagtcatccacttgaagcagagggagaaataaataaacaatttaatagattaattattagtatctattttgaaacagtattgactttcagttcaccagagtacttccatttaaaaaaaaatctgtggatagctattctgcagataaaaaagtaaaacattttatgtggaaataaaaatttttcaaaaatacccatttggtaagctcccttggggcaaggacttggtctatcttgtttaatactgtattcccagcctctagcaaagtgtgtggtctaaaaagtctttgataaatataggttcaattaataaataattaataagaggggtttcaactttctattctcactagattcctattgagtaattgtgacatagatagccatctctatgggcaaagccaagacctgaagttttaatctcaacatttcccaccattttttacacatagtaattgaatgagtttgttttctagatcttctaatgtaaaacaccaatgaaatggatattctacatgaataaacatgtacttttactgcctcaaaaataaatattctacatcattaaacttatacatttattgcctatctttttttgagatggagtctcgctctgtcacccaggctggagtgcagtgacacaatcttggctcactgcaacctccacctcccgggatcaagtgattctcctgcctcagcctcccgagtagctgggatacaggcatgtgccaccacacccggctactttttgtatttttaatagagatggagtttcaccatgttgaaagttcacatgttggccaggctggtctcaaactcctgacctcagattaatgcctatctttaagttatgtagccagtgagagaaaaagtcaacaaaaacaaatatagggaatatatggaactatagaggtcagtagagcaaaagtatgggaaagttatatattagaatgaataaatagaaggcttgaaagaatcttgttcagccacgttcaaatactgcatcctatccttgactctaaaccctaagcatgacagagaacactttgagaagtttcaaaggacagccacaaagatgattaaagggctagaaaaaaaggcctacaaagtgcagttaaacaaatagggattatttatcctggagtagacaagtatgacaggtaccttaataacagtcttcatatttaggagggattattccttagaggatgctggctacctgccttttgttctccaatgagagaaaaaagagaaatgggtttaaaaatcagcatgaagaatgtaggtgaggtacgggtgagaactattttttcccctccagtgaaatattttgtccatattaagacagcaaaatttagatgatgtgttatctagggctgtgctaagatcaagaaattcagggttctctcttacaggttaggtgtttatatgaaagcttaaaattattttatatatagtttcctgccaatgcattcaataatcacatgtaatgatagttctgctggttccttacacagattttttttcttggatttagccaacactggtgacctggctgccactgctgtgcccacttgtgaatggtctgaccttgcagaaggcgtgattcacagagggggagtacaaaaggccagcacagaaaatggctttaaagccaccataccatttgtttaagaagttaggatggaagagatggagggtagtagctatctgttctatgaaaacattgcagtgatcaactgatagaaatgctggtctcaggggaagcctggacatttccatgaacaaggcactagagaccagttgaaatgcaagcatgcaaagtcacaggctctacatatagaggtcagaatttctagaccatcttaaagatgaaagatacatgaaagcaatgctaaataactttcaaatgctcaacatgttccttataatcaattcaacagtctcttataaaattggtagagagaatattctaatttcttgagtgacttaagcctttgttactggctcaggtggatgaatgcaaatatacattatgcaattggtgtttagaaaaatttctccacgaaaatgaaagttgtgtcaccttccattcatcaaagacagttttaccattggtaagagagcttaggtgatcaacattttctttttcctattcaagcaaaatcctctggtcagtttgcatgtggaatttctttttttaattctgagcacaattaaaggtgagttaaggctctggtggaaatctaaagagcatcagcaaatctgagcactgctcagcttttgaattgcttttctacttctcagttcttttaaatagttttctatggcaggaacatttttcttaattagtcacagctaattagtgttctggcatagacaagtaatcagaaatgtcagagctgcaaggctacatctccctaatcctttgataataatttagcctcctgggagggccccaagctgcggtaagtagtgactgacaataaggcaaaattaggtgggcagcagaccattaggatagaaaaataaaaagcactaccaaatcctgctgagcaccatcaggcaactaactgcactgccagatgaggtgcctgtttaagcctctgttgttaattagctgattctaccagacctgccacatatgtccaggtgcctcatgcaaagatgtgtatttctgggaatgtgccaaatgacaattgtgttccacgatcacatttcaagaatctaagcaagaagcccacatatttcttgaacattcttttgaattatcaaagaaataagaccaacaagctattaatacactttctggttgagtttcttttaggcaattgggcatgcttatctcaagtttctcaggttttaattcaccaaagctctgattcaaatgagggcctttggcctctctgaaccacgtctggacttgccaaagctattttggcatacactatacatcaaaagttgatccttttataaattcttacacttacaaataataacttaacattacaatgaggattattaactcaaaggaaccagacagcggtaattcgagagcagaggttttaaagagaaacaaactttaaggaaaaaaaaaaaaaaaagctgaggagcagctctgtatggcatctactgaggcagagaagacaatatagaaacaggcttgactatgactatcttaaaagaggtcaaacaacttcagtgtgagtccaaataccataagtaaaccaaagcaggattatatacaatgaaacacaacaatgacaacagctggaaaacaatgtgttaaaagcagctaagtaacagattgctacaacatgtgagatgaataagacactgctgctatcatatatataaccaattagtcaaactttttatccacctttagtacacaatgaggtactgaggtacacaacacaacaatgtttataaataaattgcctcagctgggtatggtggctcatgcctgtaatcccagcattttgagaggctgaagtgggcagattgcccgagctcaggagctcgagaccaccctgggcaacgtggtgaaaccctgtctccactaaagtacaaaacattagccaggcatggtggcacgcacctgtagtcccagctacttgggaggctgaggaagaattgcttgagcccaggaggcagaggttacagtgagctgagattgcgccactgcactctagcttgggctacagagtgagactctgtctcagaaaaaaacaaacaaacaaacaaacaaataaataaataagtaacctcaaacagcctcaagtacctcactgtactcatatcatacatccctttctattgatggaaaaggaaaataatggctatgacatgggaataatattagtatttgagtgttgataggaaaatcatggttggacatactggtacaacagttaattatttatatttgagtacttttatataaaaataagaccaaagtgaaaataccctaatgggaatctatactaatttgtgaagaccatataacaactatacagttattaaaaagtgaaaaataattgaaaagaggaaaactgctattttaaaactgacattcacatataagaaagcatcccatttttctttttgagacagggtcttgctctgtcacctaggctgtagtacagtgtgtggtcatagctcactctagcctcaaactcctggacttggatgatcctctcgccttagcctccgaagtagctaggactacaggaacatactatcatgctaggctaattttttttttttttttttgtagagacaaggtcttgcaatgttgctcaggctgttcttgaactcctagatgtaagtgatcattctcacgttgacctcttgaagtgttgggattataggcatgagccatcctgcccagctagaattcttctataatatcgtagaattataagacatgcaagaaggcaaagatggtcttccatctcagtgggttccagcctgcattcctagtaaacaggctgattacatacacaaagaaactggctcaaataatatgactgaaaaagtacattatcagctctaaatacatacaaagaagtgtattgtgaaagttctatttaatggtcacttttatccatgttttgttgatttcaactgtgtattgtgaaagttctatttaatggtcactcttatataaccaagtgtattgtgaaagttctgtttaatggtcacccttatccatgttttgttgatttcaactgtgtatcgtgaaagttctatttaatggtcactcttatccatgttttgttgatttcaactattcttaggaaatcaacattgtaataaacagtctttaaatacattaagaatagcagtgttaatcttaccaagaatgagtaaattctcacttcaaaaagtttgggcattgatgtgaagcactagctcaaaagttccgggcaggccgggcatggtggctcatgtctgtaatctcagcactttgggaggtggaggcagacagatcttctgaggttaggagtttcagactcgtctggccaacgtggggaaaccctgtttctactaaaaatacaaaaaccagccaggtgtagtgctgcacacctgttgtcccagctactctgcagctgaggcaagagaatcatttgaacctggaagtggaggttgcagtgagccgagattccaccattgcactccagccttggtgacaagagtgaaactccatccaaaaaaaataaagttctgggcatttccccctttcttaaaatttgggagtccagaggcaaacaagagcatgtaagtgcaaaatcagtttcattttgagaagcacattcacttataatattttcattattttctttttatcttacattaatagtctactgaatccatttatatagtataggtcaattttactcaaaatgtttaatttagagtttcttcactggaaagtaagcattcttttcacagaaagtcctgggaaattaagcctttataaaacgctgtttggatgaatataactgattaactatcatttaaagaattactttaaatattacaagacatcataacattaaaaaaatcttgtggagatgaaactcctccacaattaaacatttaatcaatttataacaaagagcatgtttaatctgcatgatttaccaattaaacattgtaccctgatgtgtcttcagcaacatgagagctaaaatgagatagtttccaagggattcaaggtgggcagtgcccaataaatgcacaatggtttagagagttaggtaggtttagtgtctatcttgaaaaataagatgcgcttcagtcaactctcaactgcctccacatttcaacattcttggaccttagaaaatgacaagagaagtgctgttgtggtcattactacagatgtcagttttgacttctgaaaaatcacccctttccagcccagagagccaaagctctgaagaaatgtaccaggatctctgctgacacatggacacctgtggcttgtgctacatgttctgaaacctgagagagtgagcagccactctgcctgggaagaaacatcacagtaggcattaaaaatggaattgaagaattagaaaatctttgtcatactttttatattgggatcaggttgaagatggttttgatttgataaaaattttaaaaagactgctcacaatgatgccttatgtgttaaaaaaaaaaaaaaaaaaggacattggtgtaagagagagaacctcaaagcagaaaaactttcttttggtatattcatgatctttcctactacaggataacttctttcagtttttcttacccaacaagtcacttttttaaaattggaaaagtaaatgtaatatctagattataaacttagcatgtgcctcagtggtcacgtgagaggcagagatatcctctgtttaaaacatcctggtcagctggaaacactgagtctgaatacagaatatacatattgcaactttttaaaaaaatttgggtttcagaaccacagtgatagatatacacaatgtcatatggcatagctacttttgtagatagattttcttttctattaatctactgcacatgctactgcttctttggtgggacaccttgttttcacatggctatcacaaaataacttagaaattactatactgaagtacaagaccctttatgcaatcagtccagtaatttcggtcatcattgctaacattaaaactaaaaaaaaaattggtttaaaatctggaagagtttcagaaatcatctggagttccagaccaacatctttagtttacacgtactaagtaaactgagtcttacacagatggcataactttttcaaactcacccagatatttaatggcagagctgtggttggaactcaagtttctgcattctcagaccagagctcttcccataacactactttatcatttcaaattttgttaagtcagaggtaaggtagagagagcatagactttgaaacttgagaaatacgatttcaaagtttgactcaacaatccacaagtcacttatcttctctgagtgggagatgttttaacctaaaaatagggataaaatgggattgacgggatctagcctaggagcttggaaatgatataggtgaagcacctagaacatttcctggaacaaggaggtggccaggaaatggtagtggtgaaaactacagctattattttgataggttgaaaagatgaaggatgtaccttaaacaaacttagttttccctgttaacatcatggacctgccataacttatttatacttttaaaaagttatttctgttttaagcaaaaagtgttttgtaaatgtgactacttatgaggtgaatataatgccttcacatttgtcctaatgttagcttttgtgaccctcaaaggatacttttaattttaatatttcaagatttgatgtaaaaaaattaaagattatcctatttatgacctttaaggtaatgcagattttatttatttcctctctcatactttgacattaatgacttattattggagatgggaatgatagcagcagtgcagaataccccagaagcagattttatacggtaaatggctgtgtaggttgtacactgaaaactcttgaagatatcaatctcattccaaaaacaatgggcacgaatctaggccaatgtcatgtttttggtcttaagcaatagcagcttatttaaaccaaatcctggggtatttcatcacaaaaatcaggaacaatcaaggtgtttaaatgatcaaaaagttatagaggtcagggatactgtgagtagttagttactacactcagggaaagttccacaaactttttaacacagctgcatcacctgcaaagattatttagtattacatgctttccaaaaatgttgggggcagggtgaatatgttttgcagactaattgttttatataaaaatagtgttatatgtggcatttccaaaactaagtgaatttcttgaagagtttaagccctcatgttgcatgacccagaaactgtagcccttgttttctaatctgggttggttaaaaccactaagttttaattcagtataatgtgtgtgtaaccatgttttcacttgcatctgaagttaacaagatccatttacttacttatataggaaatactctaattggaatagcaaaagttcgtcatgatgcctgaatgaaatttttctcttcaatcttttatctgtaataggctaaggttgctaacagtatttatagggtcattattttcaactgttttttgacacctaacaatattattttaggctccagccaagtggatttccaataattacataatgtctctcagtaatgatctgttgcttaagatacacattctactttgcctttcaacacgtacttgataacctctcattttctaactgtaattgaggcaaattcagtcttggctgattaggggcttttagtatcccctcatacatgttattcctgatgacaaatcaatagaattagggtctatttttatttttaaataaagtaataaaaatgtgcaatttaaaaatattagaatgtttaaggacactacaattattttacaaataacaagtccagtgttctaccggggatattcaaaatacaaaaccttcacaaccaaaacagaatggttgcttattaagggttacttttagacccatagccatgtcagatgcttaggcattgaatgaaagtatatataaccaaggcaattaaactagtgttatattttaatgttggcctccttagagccactttagttccctctgtctgttatcattgccacatagaaagtcttccaaagaacttcagtgaatgaagaggagttggaagtagagaataacttcaaggagaaaaaacttctacctttataatgaactgatggcaagaatggattgcagtaaataggtcaccgagtcaaaaaactgaagatgttcagaaagttcacccattccccttgacaaatctatctatgatggtctacttatagaatggctttaacttttcaacatagaagacgtgctttagctattctaagaagaaacataatgggaataacatcaactcaatttccctcttctgttcaacagttttgaaaatcaccacattagcagaaaaagtaaaagagaacttggaaatgaaacatatgcttgtaaattcagagcaataccaaatggaagcagaagttgctaatatggtttcagtattttgtaaaagagccagctggatggatgataatttttctacccctgcagggcatcaaagcttttagaaaatcatttttttcacacatattaacacttagcttattaaaacaggcaatactttttattgtatgatagcctgagtaaagggtagaaacataaagcatgaaagataaaattcattttgaccacccaaactgacagtgaacactgacacgagagaccacggcagagaggatgacgtagcaggaccttctgcaactgccacagctgaagtgtcaccatgaagcccgtgaattgctgttacgaaaacatttgccgtaacttgcataattaagtgaaactgccagaaaagcatttctaaaatgcagagaagatgtacataaataaataagcttcaaagcaaatattacatttaggaatctgtattgtggtgaattatgcaaagttatgtcacaagcaaagtatcatttcctttgaactgactgtaaaataattacaaatgaatgacaatattgttatttaaattgactgctctgttagtctcctttacagatactgaataaatgaaacatgacgatcacagtatacaaaaccacagtcctcatttttaggcattgtcatgcctaaatgaagaccttagtgctgataaaactgtaatactgcatattttagcacatatcagtactttaaatcaagataaaaatgttcaacagtagagtggcagatatttggctttactgcagcttatttgtttgtttaacagtagaatatcatattgacttaaaacatcttatagtagggaccacatccattagaacatgattctgtttatggaatgctgcaaaaggcaagtgaaaagatgctgaacaccatggtaaaattattattatctggctttttataactaacctcaggtttttgagactcattctaatggtgacaatttttatatagaaaaggaagctaattaaggcctccagcagtcaaaagaagtataaaaattatcaactatattagctgcaaatgaacaggaattggaaatggggaataacttcaaggagaaaaaacttctacctttataatgaactgatggcaagaatggatttcagtaaataggtcaccaagacaaaaaactgaagatattcagaaggcaccccgccatccccccggcccacacaccaacaaatatacctttgatggtctatatctagaatggcttcaactttttatttttttatttagtcatttttttgagagaaagtctcactctttcacccaggctggagtgcagtggagcaatctttgctcactgcaacctctgccttcccggctcaagcgattcttgtgctgcagcctctcgagtagctgggattacaggcatctaccactacacccagctatgtcttttattttttcttgtatttttagtagagacggggtttcgccatgttggccaggctagtcttgaactcctgacctcaactgatccaccggtctcagcctcccaaagttctgggattacaggcatgagccactatgcctggccagcttcaactttttagtatagaagatacaggatcacaaaaaggagactatgctttgcaaacataccatcaaaattcaacttttctctttgcagtttatctatggtgtcagcataccttgcaagggaagctacttacatcaaataacttttctatatacatttcctcattgaccttttctcgaagaatatcttggttttgccgaacaaacataatataggtgtctgccagatccattcctggtttctgttgtgaaggaaaagcagggggaacaaaataatatcaggtctcaattgtgaaattattatttaatcataccctgaaaaataattttgaaaattacagtcataacaaggagcttaaaactaaaccaaaagtgagcatcttcaatacattccataattaaagcaaataaaagtttattactgatgttcacaacttgagatcaaattgaaaatacagagttgtagatccgtagatatcttttttttttttttgttaaatggctatcttgaaaggccagtatgtcaagcagtataaatgaataaatttttccaaaaattttccatgtgtaattataatttcccagttgcaaatacaatttactttgcatcatctctggctggcttatcaataatatttaaaaatgcgctgagtgccatggctcatgcctgcaatcccagcactttgaaaggctgaggcaggtggatcgcttgggcccaggagttcaagaccagcctggtcaacatgatgaaacctcatctctacaaaaaataaaaaaaaatagctgggagtggtgttgtgagcctgtagccccagctagccaggagggtgaggcaggagaattgcttgagcatgggtggttgaggttgcagtgagctgtcatcatgccactgtactccagcctgggcaacagagccagaccctgtctcaaacaaacaaatgaaacaaaataaaaccaaaccaaaaaatgttagctttccttagggtgcctccctcaactactatgggcgttcaaggaatacaaactaaattttttattaagctgagtaaaatattttgaagaagatattggggaaaatatttactatattacaaaatgaaatgtaaaatatcttgtggattatccattgcttctactcaatatttaacaacattatctgaataatttattttcttttagaaatgtggcaagagtatcaatgaactagtttcctatgtacagccgaagatgtggattaaatacctttccaaagttatttaacatttggtgtcttctaatagtagaggaggtaatacaatttctccttgctatagatgctgcaaagtcagtactagtaagggatagatgcctgcatggctgttaaagacttttttctaattgatttatgtttagctctttcttgaacttcatatagctggactagataatgaaagcacttacttgtgtcatctacacctgggcttggttcctaatctgtattgagttgttgattagagtatgacattaataagaacaaaatgataactatctatcactaggtagatctgctaccaatttgataggtagatctattaaattagatagatccatcgacctaatgataggtaggtagaactgatgcccaaataagccagttagccttgcatcatttcgtattcacagaaagcatttataacctttgtcagcagactcatttgcaaaagtaaatactataagaaaattaggttaaagaggatatgggtcatttaactattaccattgctggaaaaaacaactcaaggtaaacatgtgagtgatgctaggacagtagtcacatcttctccctaaatgaaagagagttcttgccatttttttttggagggggcatattttatataacataataaaattgaccatctcttaaccaatatatagtataggcagtgagcatgtcttacttattccatttataaaaattaatgattttttgttacaaagttatttctgtgcagtaagaattactgcaatctcttactgttcttatatttagtctaaaggtaaatatataccacataaattcaaggatcctttcaacatgaccctgatacaacaacattagctgtaacttgaaataactatataaatgtctttactggtctctccttcagtagcattcatacacaatgttggctatctattttcaacctaatggaggcaatttatcaaattcattccttcactatttcaataattctcatgagcaatgtttgaaagtttaaacaattacaaggataaacaataaaaaagctagactgttttcttctttgggtctagcaagattatacattggctcttccagtgaagaggcagggtaatttgtacaaagattactactattaatacttgaaggaaactaactcctaagatacatatttctctctgtgcctctcaaactttgtcaaaacactgacaatgagaacattcaaaaaacctgctgctgcagaacgaaagtgacatgagaacaattttcaatacacaatagcaagttaactcagtatctgagtttcaggcaagtatccagaaacaggatgctgtaatgtacaaaataccaaggtagttgggtacagcccagttgaactgggagttgaagaacagacaaatgggacgcttgtctttactactatttctccccaccccaaccccatttttgtttccatcttttaaaggccactgcttagacattcagttcagtcagtcactagacctatcagtctcagtggaaactaagttatggccaggaagactgaataatgactttaaacatttaccatagacactacggtaatttcttttctgtttccttgatcacttataagattagactatcatgaaacactgtccaggaagagtttattttccaccacctgaaactaacactttacagtttaagcctgaaagaaaacgaaatgcttttcctattggcagatccaagggatataatactgaaatttctaagttgagacagttccacaactttctaaggaaataaaaatctctggctgaggatacacttgattgttgtaaaaaatcaagtgtttcctttttttaaaaaaattgcattttcttcccttttggcaaattaagatccacttgcctaaaaaacaaacccagaattcttacattcttcactggaattatttcttcctttatcattgagctgtttacctattcttgaaattgtgacatatgggaatttcacacctagtgaatacattttcatgtagcttgtggcatgagtgtataatcattaaaagaatatacacaagtaagagtaactgcaacagctggtgacatttaccaattagaattgtagttctttaaaacactttatctttcatttggtgtatgaagggtaattatctctgataaattgctgaaaaagatgtaattttccttttaaacagtttctacatacagtacaaatgtgtttggatagaagacattatcgctggttcaatgctcccatgtgctaagactctgttttattatggtggtaaaatttacacaccgaaagtcactgcatctaatttgaatcattattaagtgttataagaatatgaagtttagtgaaaataataactaagtatgctagtacatttttgtggggttttttttggtgtgtacatgaagacaatgcatatgattgcattgtaaagacaaactataactacacattctgatacaaatgcatgactaccaattatatcaaaaaagtggccggttaaacttcaacagctgtggattcagattagtttttattaagaatattgtattctagagagctatatttagaaatctcttctaaattggtaatcatagttttcttaatatgagaaaaataacaaaaaccatatagtaagtactctatgtattaaatgccatttcggagtaaattatttttttcatactcccatttaaacctccaggatccttagttcactacacactaactcttccatcttgtttattaagatggtaatctctaaatgaaaatagtagttcctaaattacttttaatctcattcagaaaataatagaatctgtctagcaaagttatagtgaaacaacacaaaaatctaaaaaattcccccatgagcacaaagggatcaagaactatgggaggaaatgaagtattttaaggtgagttcctctgacactgtataagtaatcaaatacatcagtgagtgaacgaatttaagaaagggtgcagactccagcacttttttcccaagcgttaatcactagttaacctagtaagatgaacacgctgtttaaagagaaaaaaattccttgttaattatatgctgcaaacgctcttgcttcctgctgctacacctaatcccacaggtgcaagtcttcgctttccctattcatgggtagatgggtgcaacactgcagtcatttttcacggcaacagatttagacacagaagaagctgcttaaccttccactgaaggttagcaatacactacacaaacactgtcatggtgcctatttaacaaggagacaaatttttaaatatactattccagcctcaaagcttaactagaagctacagtgtaattgacttaatttgaaagtgcacttctcataacctagaaaagcttgccttgaagaaacaatcaagagtggaagtgtaatatcctgcgttatgattatctgcttgctttgtaaatgaaatacctgtgtctggccattcattaccatttgagaaaaaaggatcatgtaagatataagacaataaataacatgtcttcgaaatttgaaattgtagtaggagcaatttatatctcaattctggcatttaagattcagtaaaaatttataattgatcatagaacatagttctacaaacatgtaatttatctcaggtattgttaaaaacaatatttttctttcactatttaatatatctttaatgctctggcatttatcaatttctgtatttttatatttgaataaaaatctcctgaaatttttcaaaagcatttgaagtagtttaaataagttatatgttctcacataaaaaaggttttttcatatattcatgattatgttgtaaaaaactaaatacagtttgccaagtttttacaaagtagattatattgtattcccacagaaaaccagatggaaatacacagagattacagagccttctaattacatttatgccaacttaaatatttaataaatatgatgggaagagaaacagttgataaagagggggctggatgcagtgacttatgtctatattcccagggctttgggaggctgaggtgggaggattgcttgaggccaggggtttgagaccatcctgggcaacatggcaagaccctgcctgtataaaaaagtaaaaaattagccaggcatggtggtgcatccctgtagtcccagctgcttaggagtctgaggtgggaggctgcggtgaactatgatcacactactgccctctagcctgggtgacaaagtgaaactctgtctctaaaaataatttaaaaaggggcagagaggaagaaatttaaacaacgaacaagtcacaaatatatgcattttaaaaatagatttttaaaaaccatgaatgaaaaaaaatctcattgttattccagactgggcgtggtgattcatgcctgtaatcccagcactttgggaggctgaggtgggcagatcacgaagtcaggagataagagaccatcctggctaacacggtgtgttactaaacatcgtctctactaaaaatacaaaaaattagctgggcatggtggcgggtgcctgtagtcccagctacttgggaggctgaggcaggacaacagcatgaacccaggaggcagagcttgcagtgagccaagattgcgccactgcactccagcctgggtgacagagcgagactccgtctcaaaaaaaaaaaaaaaaaaaaaaaaaaaaaaattccaaactattatttcaagaatgaagcagccagttaacttttttttttgttaaatttagcggtattcaaaattctattaattattatatgtttaggtagttttgactccaaactgggagtagacaattctgaattaaaaataatgacactcacatccttttgaaaacagcttttagatttagagcatgtaacatgtgttttaagtaggtacatttgattcaatcccacatttctaaggggctgttccattactgcagagttcttgtcctggatcagggtcctctgtctgttacttgagtatagttggtaaaaggcagaatcctaccttaatgctatgaaggtatctgatatcagaatctattataattaatgctactaaaacttaggtagtcatattacttttattcttaacagtcacatgaatgtttcacactatttcttctaagtagttacataatttatacatttataggtctagaaacagttatgtagcattagtatgttacattttattatatcaatggggaaaatcctttcaaagagaagtttcttttaaatattaaaataaatactgaatgatagtttaagatattagcctgaactactcaaggggacaaggtaattttcaattgagatctatgggtttacaatgccttccccatttgggactatgaggatcaagtatcttgctatttctgatctacggttagatcactaacatcccagagtttagaggaatagctgctaatacagtagcaccaaacacaaaatgtgctaatgtgtacactacctatgagctttatactattatattcataagtagcaatcataatgatgatggttttaaatctctcagttcactagcctttccctcatctacagttgtgtcaattagaaaatactacatgaggacttgaagaagtaaaattaaaatgctgcattatttcatttttagcttttaaagtttagatggactgggatgggtttactcagctcaatttggaatgattcagattttggcttaagtgacgactcagggtgctagaattccagtgtctggaggcagctcatggatttatcttacataagagagaaaagccagacagacaaaacacaaaggaataaagaagcaaaacattcatctggaaagcacaacacacaacctcctccactcctagacgagtgaggctcttaatctggtcctggtgtgcatccctctctctaggtgaatatgcccctgtgggcaagagctccattccccgagttctgtctggctctcatgctgatgtaaagctccgagtattcaggtgtggttatctaagtagtaaacaacatgagaagcaaggaagcaaaagaaggaagagggaaaacactaatgtcactgaactgactgattataccctaaaagccaccagtgtgtactattctaaaagggaacataaatgaaaaaataaaaagctaatattgttcactctgtggaaggcaactggtttttcttttggtaactggtcacgttcttaagtagtgagcaggaactagggagtaatgcatgggagccggaagcatcattccaggtagaaacaataacaatttattgcaacagtgctttacaattcaaagcacattcacgttaatgtgctcatcgaattctgaattctcataatgagggaggcagcacagggattataggttggtgcagaagtgattgtgttttttgccattaaaagtaatggcaatacttttaaatactattatcctcactgcatgggtgggaaaatggaagcccacagatcaaacagctagataggagcaaggtggaaaatgaacggagatcctcgaccccatatcaagtctgtgcagtacagaggtgggtaagaaccaccttttggggattttgaaatgagaaatctttagcaagtatcataaagatgagagaatatttgagagaattcctaatgaagataagagaaagattagccatctcctttatcttaggacaaaccaccaagatcaggcatcagtacgattaagccaatgaagagagacagtttcttcttccttcctcattgttttggtcttttcttggccacagtaatctttatcgtatcctccaagtctcttcagctgtttcaccttagtgtctagcatagagttggtatgcagcgtgtgtgataatgttaataagaccattttaaatagggattttaaaaatcaacatacatccttaaaccccaaaatgtcctgtttaactagaatgacaatagaataaaattccagaatcagagttggaaagaacctttaatgtcatcttgtcctatttcccacataatgcagaaatcttcagtaccacacctggcaaacagtggtgcagcttttactatgtcacctttgtaaataacttttttttaaagttttgtcttacactgatttcagttctgctcccacttgtttttagtcattgttcctagtcctatcttcttgactgatacaggctcaggctgttcctttttccaaacaggagccctttacatattgatcagggctaccttatctcttagattttttttccctctttctaggaacagtcagatttctttttttttccttcataagccactatttccagatcccattaactagcctggctgctttctataggaggaagtaaagtaaaaagaaaatgttgccttgaaagaattcagatgtgacttgttcacaatcatacagatgcgatcaatatggtataagtgaaatgattatttcctacaatgtagatactagattttattgtaatcaataataataataatgtatgataatagctagcatttattgtgcactaattccattctaggaactgtgaaaactgcttaacatattcacaataagcctataagaggtgtaattacatctccattttacagaagaagaaactggtgcctaaggtcacactgataatagatgaagtgatggagcaaggattcaaccgccagcagttcggttcctcagcctgtaagtaacccccctgttatgcagcctccatagatctatatacctgattttttcaaaaagtactccatattattgtcaaacatgatcttttatacaactttttacatacatttgctatcagctacatcttacccaccttacgggtgagcaaaactttttttttgggggggaggggttagtataataatttaaacctgcagaatttttggttcttagtattcctatccgcaaagctaatatgaacattttcatcctcgtcctgcatctaatttctgtcagatctgagttcccttctaagttactattgaacaggacagactcacctagtccaggtcttgctttttctttctcactcttttttcaaatgtctgttgtctttgccaccatgagcattccaaggttctatgatggggccataaactgtataactgccacagaactcctccccaagatagggttgtctagccaagagcaatctatcaaactatactgaaggacacagttcatcatctagatcagaaagatatcaaggagaatcctaccaacttctttgtgaagaggcacgtgcctggaatttatttctgttcaggactacactgaagcatttttctcctaagtatgatttttttttcattcataaagtgtcatgagaagtatatgttacaaagatacaaaagactatgtttattatatttaaatggtttgatttgggtcattttctgttaactcatacatcttcaactgtgctataattataaggaatatctgacaagtatgttctaggaacatgaattcctccttttctgcataggaatgccacttaacttcagttgtaattttcacgttatagaatcaatttatttattgctttaaaaacattccagccaggcatggtggcatatgcctgtaatcccaggactttgggatgccgaggcaggcggatcacctgaagtcaggagtttcagacagcctggccaacatggtgaaaccccatctctattaaaaatacaaaaaattagccaggtgtggttgcacatgcctgttttcccggctacttcggaagctgaggcacgagaatcacttgaacccgggaggttggaggttgcagtgagccaagatcaggccactgcactccagcctggggcacagagtgaggctgtcttattaaaaaaaaaaaaaaaattccgacaagtgacggtattataagaaggtattgccttcttatccagaaaattttttctagctctttatcttctcatcatcttccaggtggaatttttgggctctgttgtctcatagagagaactggacaagaactcacatggtgacagaacattacagttaaaagaactaatgcagttatgtagcttattcactcattttatagatgactagactggggccacttaagtaatgcccaaggtcatacagtttcaagggcacatagccagataaaatgaattaacagtaaggtattattaagtccttggccagtgcttttttcttttaataaacattttattttagaaaaattttagatttacagaaacactgtggaaatattagtttcatataacccacacccaatttcccctattattatcatcttacattagtatggtacatttcctacaattaatgaacatatattgacacaatattattaactgaagtgtgagctttattcagtttcccttcgtttttacccaatatcctttttctcttccatgatatcattcaggataccacgttacatttagtaatttggtctccttggactcctcttggttgtgtcactttctcctactttccttctttttgatgaccttgaaaattctgaggagtattctcagatattttgtagtgtatcacctattgagatatgtctgattttttttgatgattagactgcagttacaagatttttagaggaagaccatagaggtaaagtgccattttcatcacatcctgtcaaaggctgatattatcaatatgatttatcactgcagatgttgacctttgatcaactggctggggtaatatttctcaaatttctccattggaagtttattctccccatcttcctttgcttattgtactcttcggaaggaagttactatgtacatcccacacttaaggagtagggatatatgctccacctccctgagagggaagtatctatattaattatttggagttcttctgcatgggagagctgtcttttctccccattatgtacttcaatatttacttgtatcagtatggaccaatggatatttattttatgctttggattataatccaatattactttacatatttgctcgctcaaattactctagcttaggccactgggagctctttccatcatctgctgtgtctctttgaaacacagagtttccagttttgtgttttttgtgaacatctcctttctgttgctacaagatgctccacgttcatcttgtatatttttcagcaccagccatttctccaatgagccctggttcatttcattaaagattagagaacaaatttgagtgctatgtgggcttgttgctactggggcatcactgtttctaggctctctgagctaacagagcaagaaaatgtatgtgagcacattaacgcatgcatatacatatatctaaaaatactgttaaatgtaaccagctctatctgtactaagctaaagacaaattcacactgatatttccaactctaatccattacaggatcattctagtccccttcctttgcttgcctctaacctgactctaacggtgagaaacctggctcctaccaaccaccatccatttacttaattgttcaattccaatacacacgtatagtggcttcaaaattgttaaactgtggagaaaaactttatcaaccagagtacaatgcttatttataagttccatttccccttattcttacagactccactaatttccaaagttactcagatcagcactttcctcgctcctctttcagtgagtttatctcatacattcacaatagaattattttattatagtttcctttccatcctgggattctatgatcacttaattgatttttaaataattgaatatactcaagttcactctttttgctataaagtttggttttgacaaatgcacagtgtcatgtatctaccattacaatatcatacagaatagttgctgtgttccaaaaaatcccctgtatttgaacaattcagccctccctgaccttgaactcatggcaaccactaatctgtttatagtctttatagttttgccttttgtagaatgtgatataaatggaatcatacagtatgcagccttttcaaattggctacttttggcaatatgcatttaagattcatccatgtcttcatgtgagatgagagctcttttctttttgctgaatagaattacattgtatggacgtaccaatggttatttatacattgacgtactacaggacaattttggttgattccagtttgggtgattataaacaaagttgttatgaacatttgtgcatagattttggggtggacatatgtttcaaatcagttggataagtgcagagaactgtgattggtgggttacatagtaaggctatatttagctttaaaagaaactggcaaacagttttccaaagtagctgtagcattcctaccagcaatgaatgagagttcctgttgctctcttatcctcgtcaacattttgctgttgccagtttgtttttggattttggccattctaacaagtacatagtggtatcttcttttaatttgcattttcctaatgacaaatgatattgagcattttttcataagcttacttggtatctgcatatctttcttgttgcagtgcctgtttggatcttttgcccatttaaaaagtttggttgttttcatattgttgaatattaagggttcttagaacactttggatacaagtcctttatcagatatgtgttttgtaaatagttcttcccatttgtggcttttctttctcttaacaatgaataagagtatacttatcaatttttaagttcaatttatcaattttttttctttcatgaattatgtggggttgtatctaaaaactcatcaccaaatccaaggccatatatattttatcttatattttcttcttgaagttgtatagttctgcattgtatgtgggtctaggtctgttttcagttaatttttgtgaaaggtgagccagcgctctttttctcatgagactctcttaagagacagcttcagagaggcatacttgctggagtttgagtataaaaaagaataacggccaacaagaccttacagcttttaaagttaatattcacaggcatcaacaatagaagtgtaatgtccataactgaagaaggaattcatcactttgtaatctgccatggtcaaaccacatctatggtatagtatgttctgctccagggggcaacttgatttaatgctgacactgataagctagaattcctctaggttagtaactggcatgatgaagagtctggatatgattgccatagaagtgtgcataatgatatgtctgtttccctatgtcttttgtctttaatattgtgaaccatttgagggcaagaaatgtacgtctcatcatgtatgtccaggatctagcacttagtatgtgctaaataaatatttaagtagtgggtttagtgaataaattgagaatgtttaatctagaaaataagcgttcctcagacaacatatgcctgtgaatagccaccacacctcctgggaagaggaggcatgaaaattgtcattaaatatgcaaagagctatcatgcagaagagagattagaacgaggattaatgggtaaaattcacaaagatacagaatttcaactcataatacttaacagtaggctgccatatggtcatcctgtaaccactgaaataattaaacagcacccaagtgaatctttgtaagggatgttagagaggggttacttgcactgagaagggaagtaaatgaaccattttctgtctccttcaactctgaaattctatggagagaataaactagtatagggccaattaaaaacctcaaaatctctaagaacatgaataattttggtgtcacagtccatttgtaattcaaaatcaaacaaaaactatgtgtgttacaaagtccaatgtgatatatacaagattatttgtgccttcctttttaagatatcaaacataaaatctccccttaattctccctttcatgctgctgctttgtggggctctacatatgtgatttttttctacttatggtccagcactgattccttgattctaggtacaggacgaggagggtatgaagacttctttgggaaacatttgtaaaataaaaagtccagttccaaagaaaccccatgcaaaggtagaaaagtccagggccttctcatttaaaatactcatttataactacagcagcaataaagccagagacaaaatgtggtggtgcatcctaaaaataagagctatctacaactgatacataaagcttgccagcactcaaaactgctaccatttctaatggcaatgtagagatataatgttcttcaaatacaaagagagaatttatattccatctagtcttaaatcttaatttatttttcattgtgctctaattctaattctttgaaaattgacatatatgccaaaataaatgattaaacagaacaccttaggccttgatcatataggtgataatagaatttaaatcaaaaactaatttggtatgatgattagcttaaaaatgctgcacaacttgttggttatgtttaccatgtgaacgttctcattgtagctaagtcagtttcatgatttctgctcatggaatctaaattttggaacaaatttatgagttatttcccaagaattctatgaaacaacaaatgttaaaataagtaactactgatttatataacacttgtgtatttagaaaactaattctttaactggttcatctttatcattattctaccttctataagaaacccattacagctttcatagaaaggggaggaaaagcgagcagtttttctataaatagtgtgaggcatttttctaccccatcctagagtgctataacttccctctgcaactcaggtgatatgttcttatgatgaactgatctccttaagagtttctgagttacaacagaaaaagtcaacgaaataaccttgctatgtcttgttatgaaggttagtgcttgcttaaggaaaataaactactccctaagggaatggcactggtttaaagatttgaaataaacccatgatgaactgcaatttttttttaaagaattccatacagttttaaaaagcagataaaaaatacttactggaacatcaacatattttgcagctgctttcaccttaagtgtgaaagaaagagataatcatgagaattatttttttaactgccatataagtactatgacaacagttaaaagaccacagaagagaactcattcaaatacttacagtgaatgacagaatggatgaaaagaaagtgccttcatcataccttgacagcttagacaacacgccttccaacactgaaacaaactataatacagttatagtgagtatttagaatgttactatgcatacaaactaatagcaggacaaacaattcctgaatcaatttcttccatcgcacaaaaattcacaatgaatgaactgacagctgaggtcagactaacttgtgatgtttactctttcattctgaacatgaactctactgtccttttctttcccatggctggaaataatacacttttttttttttttttttttttaaaatgagatggaggcttgctctgtcacccaggctggagtgcagtggcgtgatcttggctcactgcaacctccacctcccgagttcaaactattctcctgcctcagcctcccgagtagctggaactacaggcgtccgccaccacacctggctaatttttgtatttttagtagagacggggttttaccatattggccaggctggtctcaaactcctgaccttgtgatccacccgccttggcctcccaaagtactgggattacaggtgtgagccaccgtgtctggccaataatacacaatttttaaaaaaataaaagataatgtgtcataggaatctagtcactatacatatgagaccactgaagccattcataaacaatcttaggtccatgagatttttccttaaaacatttttcaacttcaatgtggatgttaagaaacaatggcaggcaagcttaatcagattcctttctattttatattacttgccatccttcaactttttctacatctacacaggaggttgaatataaaagaacagataatgggccaggcagggtggctcatgcctgtaattccagcaccttgggaggccaaggtgggcggatcgcctgaggtcaggagttcgagaccagcctaaccaacatggagaaaccccgtctctactaaaagtacaaaatcagcagggcatggtggctcatatctgtaatcttagctactcgggaggctgaggcaggagaattgcctgggaggcagaggttgtggtgagctgagatcatgccattgctctccagcctgggtgacaagagcaaaactctgccttaaaaaagaaaaacaaaaacaaaaacaaaaaaccaaaaaacaaacaaacaaaaaaaatgaacagataatgaaagggaggtggtgtaacatatgagctcttgtaactatgacacaatggctgacattagttaacaagcatttaccaggcagttctaattggcacatataaggatcatccctgcttcccaaagcttacgtagcagttatggagagaaaacagatacacactgcagagtacaatggaaaagagcactggactcagaatgtatatcccaattccatcactcagtagaatgcaagctcagtttgaccaccttacttctcaggcttcctccatcagttaaatggactagggtgaggggggtaggatgtggaattcaaattagtctcaaaagtggtttacatttctaaaactttatatttctatgaaataaaaaaacacatacactataatacagtaaaaatgtgaagcattttactttatttagcatgaaaatcgatgaataagagatcttaagaatgacatactgccctacatctctcctccttagaactaaaataatatgaactattgacacattatagattcccaaagggaaaatgctgacaaggttttttcaataggaaaagggaaattaacgaagactggtttttgttcacatagcagcttcttcaacaaagtgataatagttctagggacacagcttattggtctctggtgaccagagaactcgctgtgagtgcataggagataatcttttctttatggctgatcaattactacaaaatagtttatgcaaaagaaacaaaaacttccctataggtttctccatcacatcatttgcgacatgatgtaagaacacagaaacaaaaccatgcagactgactgtgaactataagtgcatttttaaagaatgagaataacgtatgcttgggtagctatcctaaaggatgcctagggaaaaaaaatccacccacaaaattgcgaattgctcacatgtagaagttaatttagcactttcttcctgcctgttaggatttcttaccaatcatgactggctaactcaacttgatgtagtttgcaaggacccagaagatgaatactctagggttatgtcagaccagggaaagggaattccaaacttaatggccctctgtggaaaatgcctcatctcttgtaactcaaatcttggagcaagtgtgtactgggtgatctcatttgccacgaggacagcggcaattgctatggttactagacagcttgaaccatggaggctgtagcccagcacctgattcttggtgcttgctagtgagtctgtgcatacacacatgtgtgttgctgagggacaaagcaagatagaggcaggaagcctgttgatgaatttgctgagggacaaagcaagatagaggcaggaagcctgttgatgaatttgctgagggacaaagcaagatagaggcagggagcctgttgatgaatttacttcttggctcaagttgcagctctgccgctgtctggctacgagataaatgtcaagtcattttgcttctctctcttcattgtacttctcagtaaagtggggaaaaggacagctatcccgcccaccttacaagaatggtctgaagatcagtggaggtaatttatgtgaaagaactgtgaaaatggccaaacactaaagaaatgtaaagaattaatattatccatatgattagcaaaatcactatctgtgtctaaaaacctgaatacattaagtcacaagttaatgggggctgccttagaattacttagtgacaaagaggaatgagtttggtccttaagctaatgggtctaattcaattaaatctatggggcttctatggaggtagaatagagctgaggctttaagtcagaaaaccactgggattccgcctgtttcaaggttatttggcagacggcagaaggaggaaggctttaaacacaggtggtcttgatccaaagcccatgctctttacccatcatgctacagaactgtaagaattaagtgatacgccatatgcaatgtgcccagcatataaatactcaagggttcaggtgtggtggctcacacttgtaatcccagcactttgggaagccaaggcaggagtattgcttgagtctaggagttcaagaccagcctggacaacatagcaagatcctgtctctacaaaaaaaaattaaaaaaattggctgggcatggtggcgtgtgcctgtagcttctcaggaagctgaggtgggaggattgcttgtgcccaggagttcaaggctaaactgaacaatgattgtgccactgcactccatcctggatgacaaaggaagaccctgtctcaagttaaaaaaaaaaaaaaaaaaaaaaaaagaacttggccaggtgccgtggctcacggctgaaatcccagcactttgggaggctgaggtgggtggaacatgaggtcaggagatcgagaccatcctggctaacacagtgaaacctcatctctactaaaaatacaaaaaagttagctgggtgtggtggcaggtgcctatagtctcagctactcaggagactgaggcaggagaatggtgtgaacccaggaggcggagcttgcagtgagccgagattgcgccactgcactccagcctgggcaacagagtgagactccatctcaaaaaaaaaaaaagagcccaataagtgtcattttgttttaattattaatgagtacctaggataagacatacaaaaacacaacagtcttagatctttccctttgggaaatacaaactagtgggagagatagacatgaacataactgcacatgacacaaggcagaagtgttatgggcagtgtagacagtaagcagtatagctgaaaccagaagaaggaaataatgtctttgactacaggatatggggtcagcttcacttatgagttggcacaggagctgagccaaaggatagcagagatagagtggctaaaatgactctctgggaaggttgctggcaaatgcatttagggcagaattttctccatgtggcatctggcagcctgtttggctcatcttcttcagagcacgaagcagcattggcttatatacaagttagtcctaggtgtgaacctgtggtctgctgcattcatgtctcagcattctttgtctccatttcaaaagtagtggagagtctttcctcagcttcctccctatccctaaaggtccctggggaggctcaatacagctgggaatctaagtgcttacatggcagtgagcagcgacagcacctgtgggattaaccagctgaggtgtacagttcctacaggaaagttttctttgtaagatttttgttgaggcacacctagtagaagagctaccttaaaaatcaaactctattataaacatcaagattgactagtaacgatataccttccacctggcttttaattgcataaaacagcaagattccaaagaaacccagttaaatgttgggtttagttgctgcatctttaactgcttcctgtgaactttctctgtacagctcagggagtatataaacacttatgggtttgcctttgtgctgtctgttctcctgagggtgtcgggttggaatgaaacactgtaatctctttgttgccctgctctttattactgatgccattaactgggcttgtttgaaaaatatttaacacctaaagtctgcctgggtaattactgactttgtctcatgaaactcttggaagtgactggtagaaggaaacatgaagagtgcttcaaggcatgtgcatttacatttcttgttgattttgacagcatataagattcatatggaaggtagaaccataaactctaagtgacgggaggattccagctagggttcaaaacgaacagttcttgcatttttagctgtgacacttcatgaaataaacaaggaatatttgcatcatttacactgcacgttataaaatcttccacagaaaacacaaacatccctagtatggctgataatgaaaaactaagtgttttctgtgggggaggatgggatagctgttttgtttttttttttgttaagatcaggactaactagtattgttaaaaatctgcacatgtactccatgaatttagttaaaaaacttttaaaaattaaaaataaacttgttttagtaacatattcttaaaaaatgtgaacacagttccagaatatcatgaactaggagaaaataggttgtcttccctaaatcagaacgttaatatatgataataaaataatacgaggcggccaggtgtggtggctcacacctgtaatcccagcactttgggaggccgaggtgggtgaatcacgaggtcaggcatttgagaccagcctggccaacatagtgaaaccccatctctactaaaaaaaaaaaaaaattacccggccatggtggcgggcgcctgaaatcccagctactcaggaggctgaggcaggagaatcgcttgaacctgggagatggaggttgaagtgagtcgagattgcgccactgcactccagcccaggcaacagtgcaagactccatctcaaaaatacacacacacacacacacacacacacacacacacacatatatatacatacacacatacatatatatatatatacgtatatatatatatacgtatacatatatatatacacacatatatgtataataacacaatacaattgtctctttcccatcctctttctgtgaatccagctgcgaaactacttatttgaagctttattccaactgactcctaaaaggccttaccagatcctgcacgttataggaaggagggagtgtttgacagcaggtatttattcataacataccttgttctgcaaagtatctaggacaacttctaaaacagcacacttagaccagatgttggtgaattcaccacactgttttctctcactcttcctttcattgttcctccacaaataaagtgaactattttactttgcattctctctctgctaaaggctcctaatatcgtatgctattccttttgggcacatacttggattttaacagatgccttctgaatatatggccttgatccaaacaagtaaattgagtaagtttaatgcaattaatttcaccaggctaaattaacaagaaactttaattacataatctaggcagtcagatcagatttatcttctatctatcctattcttaagagaaatccaggggaaaatattctaagttatgagagagagaaagcgagagagagagagaatgtatatatacccgtatatctgtatcaatatagttgtgggaaaagtgtatattatttcctaaatcctttttttttggcaataattgagaatctaggaagttggatattacagaaatgatcttttaattcatacccagaagtgatggaggccctgttcagcagtgctttctgagagttgtcatttttttcactcttggctctgttaaccatattctaaaccttcccccagtttttttttttttttttttttttttaagacagtcttactttgtcacccaggctggagtgcaacggcgtgatctcagttcactgcaatctctgcctcctgagtgcaagtgttcttgtgcctcggcttcctgagtagctaggtttataggcatgtgcaaccatgcccagctaattttttttttttttttttttttttttttgcttaaaacaataaaagtttattatggtatagttctgtagttcagaagcctaacaaaggcttcactgggctaaaattcaagtgtcaatagggttgagttcctttctggaggctctaggggagaatttgttttcttcacttttctagcttcttgcctgcattcatggttcatggtctctatcctccatcttcaaagctggcaacatagcatctctctaaccctgcttttgccatctcatctttctctctgactcttttcttttgccatctccttccccttttaaataccttgtgattacattgggctcacctgaataattgttatctcacagggttttgccatgttggccaggctggtctcgaactcctgacctcaagtgatctgcctacctcgacctcccaacgtactgggattacaagtgtgagccactgcacccagccttggcattttcattgctatatataaggtatcccattttcatctacctgacttagagttgccccacctggttactctagctggactctacaagctggtctcacagaatgtatgcatggagggacccacaggctggctggtacaacccagatataaaagggacacaagaggactggaggtgaagctatcactctttccctccctggtcttgctgagttctgcatggtgttgtggagagatcataggcttagggaccacaggggccaaatcctggctctgctgacatctattgtgtggccttgggcctctgtttcctcatctgtgaacagggagactggactggtgactagtcctgccttgaaacatgaggccacccaggtagggccccaggcctcctttcccttcttaatcagactgacatcaatgctttgattggtgttatattttgcagtgctaatatacatttgagacattaatatattttataaacatttttaaagcatataaaaatgtatcttaaaactataaaaatgtttgaaaagtccctagtagatgacctcaggactcttccaaatccagcattccgtgcgccatgagtttctagagcctggagacaacagatgcaggccaccagcaggctccatgcagatatgtgcgtaggacttttgttctagattgagaaaaggctgtcagtttttaaaaaacccaatacccccactttttttgatgaggaaaataagtcatgtgaggacacccagctggtaacataagaaaatgggactagaatccaacttttctgatgatcccacacttcggttggtttaattttaatataaagtggcaataaatatgacatttcttgtaccctttccttggtaagatttaatgctcctattttttttcccttggtaaaaattattgaagtctttctggctagaagaatttttgtttccccccccccccccctttttttttttttgagtctcgctctgtcgcccaggctggagtgcagtggcgcaatctcggctcactgcaagctccgtctcccgggttcacgccattctcctgcctcagcctcccggtagctgggactacatgtgcccgccaccatgcccggctaattttttgtattttttagtagaaacggggtttcagcgtgttagccaggatggtctcgatctcctgacctcgtgatccgcctgcctcagcctcccaaagtgctgggattacaggcgtgagccactgcgcccagtcttcccctttcttttaaggttactttccctcttttccataggtgttccagttacagcaccttggcctgagaacagtggctgctgatacagtccttttttcaattgttgaaatcttataatcacatcaatattttgaccccatatccctcctctgagctccagacccaaatagttaatatcctccttgacatctcctccctcaggtgtctcaaaggcagctcaatctcaacatgtccaatactgacatcatggtctttctctccaaatctgtttctcttccaggacagcctgcatctaggaatgatactaacattcaggccataaacctaagagtactccttactatttcccttttcattgtacatctgaaatgtctttggattagttcaacagagaccaagtaacagcttctacactatcccctctccaatctgtttgctacaggcagtcagatgaatcttcttataatgcaaatctgattaattccctacccacactctccaacctttcagtgacttcccattgctcttgggataaagactttaagctccttagcacttcctacaagcttctgctcacttctgcagccttgtcttgctccaggccctggtttctgcagtttctcttacttaaatggtcctttcatctctcttctcctggttaactctttcattcttaggaactcagctcaagcttcacttgcttgggaaaacttttcctgtcctccctgactaaatgagttactcggtcacagattatcctacatgacacatttgtatggcttgcattttatgtttgttagtgtgtctcctccaagggttagcaaactccttgagggcagggaccctgctgttttgcttagcactgtatccctggcattgagcatactttctggcacagagctgcatcctgaaactctacattgcctcatggctgtgaatttcaatcctttttaaaaaatgaatattgccctttttcatttggggcagagtcacagtatataattttatgcaaagtactttatgttctaggttagagacaagaactggagtattgatgccagagcacattcctttagcattttccagatttactttcatctactggattatatgacaagcagtgtacaaagaataatagataaagaggattcagagacacacacataaccatgaagaaatggcagagaaagtgggcacagagggcattgggtaaggagagggctaaatttgcttaggaagatgtaagatgtcttctagaaaggagagcaaaccaagacttttctagttgaattatcagaagaaagcaaaaaagggctcttcaagtagggggcagaagtgaaaaggcacaagggtctggaaaaactatgaaaccaatagaactttggaatagctagagtttaagatgtgggggagagtgttatggggacaagagcaattatactgtgaagggacttgtaggtgatgctaaaaagtttttcttgtgggtcaacctttcacaaactatattctaaggaatattaattcctgcaagatattattaggaattccagaataaagggccccaggacaggttaagtgtaggaacactgcactctcaaacactacatcctgaactacaaggaatacagtgttccccaaatgggttagtaacctcatctcatgggacatcaacaaaactcaagtacaaggtgtcctgagacacaatttaggaaatgatggcacagggaataaggaatgcctacaacatatgaagcatcggcaataaatggtcaaatcggtattttggaaagatactctggcttcagggctgtattagtctgttcacacactgctatgaagaaacacccaagactcggtaatttataaaggcaagaagtttaattgacttatagttctgcattgctggggaggccttagcaaacttacaatcatggcggaaggcaaaggaaaagcaggcatcttcttcacagggcagcaggatggagtgagtgcaagcaggggaaatgccagatgcttataaaaccatcagatcttgtgagactcactcactatcatgagaataacatgggggaaaccacctccatgagccaattacctccacctgctcccacccttgacacatggggattatagggattataattcaagatgagattttgggtgggaacacagccaaaccatatcaagggtgaagtgggggaccatggtggagatcagtaaggcaagaatttaaatgaggaaatgatgagggcctgaagactatagtactgccagtgagaatggaatgaggcagaaaagggagtgtttaggagactgactcaaggccctgatgtcctcctgtgtgatgtgcttgagcagattctataaagacagggacactaggatgacgagattttacaatggggtgatcagtactgccaatggagacagcaaatgcaaaacaagaggcacctggggtggggtggaggtgatatgggtatttttagactctgaccttgtagagatgtacagaaagcaactggaaatacgggattttaggtgataaaaattagaggaacaataataacaatatcaactaatatttaacaatgcattggccactgttctaagactctatctgtattaacatacttactattcactaacactaataaatgctactattatattactcctactttataggagaggaaaactgagccacagaaagcttgtttaagtaacttgactaagatcagacagctagtggaggagttgaaatttgaacccaggtcagaagttgggcttttaattgctattctgcactgcctttcacatacagagctgggaatcacaagcatagagttaaagctggaagtggaaaagtcacagaaatttgtagaaaaagttcaatagaggaccaatgatggtggcccaagaagtaacagcatttagttgccagtggagagagaagggcacagagagggaaggccaagaccttttctaggcacataaaatgtgtatatagtagggagggacacatactgtttagtactgtgtgtgattgagaacttgggctcgttctcatgttatttgtggaaatatgtgaggtaagaagaggatctaaaggtagccttgaagaggagaggtaaaaagaagaaagtgcagtttatttttatccagatgtagcaaatatatttgtgaatatgcacagaacaattaaaatattgaaagaaatatctgggatacgagaaattcactgttattttcatctactttatgttgagttaattattatgatataaaaatgtctacgacatgactcttagaatttgacagtgtagtaacagttaatatagaaaccgcatattttaatttttatgggctggttgctctttacagatttcccagagacgtagaatcagttaagtgcattggattaaggatctgaagctcagaggtttggatcctgattctcactaattaattaggtgtttgatgctcatcagtttaataaaggactttgagaactatgttcctatcagtgactgaggataagactgcccatttcattagaggcagagtcacaatatataattttatgcaaactactttattctatgttcatttcataggttttataaggcttaaataaagtcacaaatgtacagttacagtggcagtttcacagtaggtacttcataactcttttaaaaaagtcatttcttccttggtaaaaacaagtgtgaacaaactgtcttataggctattttttttttaatatcctgaagtttaaaggtttacatgccagtctggatgaagattcaccagagcagtgtttctcaaagtctggctcatggttccctattgtaaaataaccatggtggctggttaaacatgcacattccttcccctcttcccaaacttaagactcagcatcactggagattggggtatggaaatctgcattttaacagttctcaggtaatttttttgtgtatgtgtgctaacatttaagaatcattgccttacaagatgttttagtttttcttaatgaaataaaaccacaatctatcctgcctgtggaccctggtatcacgcctgcccaaaggccctaacagctggcccacacaacatttctagctggggtgagtgatccagggcttttcctgctgaagtcaatcggtaaatagtggaaaaggtcactgtttttccaaaggtgcagataccaatgtaaggctacagggatcatgaagaatcagggaaacatgacaccatcaaaagaataaaataaagctgaccaataacaaataaggagactcaatctgtattcaaaaacctctcaacaaagaaatggcttcaaaagtgaattctaccaaacatttaaagaagtgaattccaccaaacatttaaagaagaattaatgccaattctctttaaacactaccaaaaaaaaccccaaaaaacagaagagggaacacttccaaacttattctatgaggccagcatcaccctgataccaaagccagacaaaagatactgccagaaaagaaaactataagccaagataaacatggatacaaaaatcttcaacaaaatactagcaaactgaattcaacagcacattaaaaaatcatacaccatcaccaaatgagattgatccctaggatccaaggatgtttgaatataagcaagtcagttgttatgacacaccacattaatagaatgaaggataaaaatcaccaagatcatctccatagatgcagaaaaacacttgacaaaactaagtaatgtttcatgataaaagcattcaaaatattaggaacagaatgaaattatctcgacataataaaggctatatgaaaagctcacagttgacatcatattcagtggtgaaaaaataacttttttctctaagatacagcatgagacaaggatgcccacacttaccacttctattcaacatagtactgggagtcctagccaaagtaagtagacaaataaaataaaataaaataaaataaataagtaaagaagaaaaagaaaagaaatacaaggcatgcaaatcaggaaagaacaagtaaaattatctctgtttgcagattacatgatcttaatatgtagaaaaccctaaagactctacaaaaaagaactgttagaataaacaaattcagtaaagttgcagaaaaaaaatcacagacaaactatcacaagatcagaaaaccaaacaccgcatgttctcacttgtaaatgggagttgaacgagaaaacatggacacagggaggagaacatcatatactggggcctgtcgggggctgtggggataggggagggctaacattaggagagatacctaatgtaggtgacgagctgatgggtgcaacaaccactatggcaggtgtatacctatgtagcaaaagtgcacattctgcacatgtatcccagaacttaaagtataattttaaaaagtcattcatatatctgtatactaacaatgcactatttggaaaggaagttcagaaaacaatctcatctacaatagcatcaaaaataatgcagtacttagaaatatacttaaccaagaaggcaaaaaatgtgtacactgaaaagtataaaacactgaagacattaaagcagacaacaaataaataaaaaaatcccatgttcatgaattacaataattattatagtcaaaatgtccatactacttaaagtgatctacatatttaatgcaatctctatcaaaatcctaatggcattttttttaaagtaacagaaaaagcaatccaatcctaaaattcatctggaaccacaaaaagcttcaaataaccaaaacaattccgagcaaaagaataaattggaggcaccacacttcctaatttcaaaatctattacaaagctaaaataatcaaaaaagtaaacaatgttaacttttttaagtaaactttttaatgtaaacaacgttactggcataaaagcagatgtataggccaatagaacaaaacagagagctcagaaataaacccacacacatacggtcaactgatctttgacaagagtgtcaagagaaaaggatggtttcttcaataaatagtgctgggaaaagtggatgtacacatacaaaagaataaaagaataaaagttgacccttatcttacaacataaacaaatggatcaacaaaaccatcaactaaacaccatcaagtaaaaatggattaaataacttaagacctcaaaccataaaacttctagaataaaacatagggaaaaagtttcttgacattggccgtagcaatgacttcttggctatgatacaaaaagcacaggcaacaaaatattttttaaaatgagattatatcaagtaaaacagcttttgcacagcaagggaaacaatcaacataatgaaaaggcaacctacaaaatgggaggaaatgtttacaaactatttgtctgataaggagttgacatctaaaactcaatagccaaaaaaaaaaaattaaaaattaaaaaaatgagcaaagcactacatctctaatgaacatgtataaatggccaacaggtatacgaaaaggagcttaacatcactaatctttggagaaatgcaaatcaaaatcacagtgagatattagctcacatctgtttggatggctattatcaacaacccaaaagataacaggtattagtgagaatgtgaagaaaatgcccactgttggtggatatgtaaattggtgtagccactatgggaaatagtgtgtagaatcctcaaaacatgaaaaatagaactaccatatgatttagcgatcccattaatgggtatatagccaaaggaattgaaattagtatatcagagagatatctgcactctcatttctttgcagcattcttctcaataggcaagacttggaagcaactttaatatccatgagacaggtgaatggataattaaaatgagttatgtgcatataatgaaatattattcagcctcaaaagaaggaaatcctgccacttgagacaaacagatgaacctggaatatattatgctctgtgaaataattcagacacagaagattaaatattacatagtaccaattatatgaggaatttaaaatagtcaaaataacagaagcagagggtaaaatgttggtttctcagggactgaggggagggagaaatggagagatatttgtcaaaagcagtctcagttatgcatgatgaataagtcctggagagctactgtacagcatagggcctatagaaaacaacactatttgctaagaggattgatcttatgtgactgttatcacacacagaaataattatttaagagggctggaggaaactttgggaggtgatggatacgtttatggtacagtttgaggtgatggttttatgattataaacttatatggttgtatacttacctacaaactcatcttgtatatattaagcatgtacaatttttctgtctgttaatatctcaataaaatggttttaaaaatatcataattatggagattaatttgcatcatctttttaaaaaacatcaattattgtcatctcttatagaagcttgagatgtttggttcaacctatcaagtaaacttattttatacttttcaaccaaagaattaaagataagtacgatttgacagcaggagaaattaggcatagaggaaaactataacctagtgctgatttctaaatataatatccagtattatacgaggctcttttaatcaaaattaaattaaaaatttaatttctcagcttcactagccacatttcaagtactccacaaccacatgtggctagtagccactggtggactgtgcaggttattttagaatatcttttccttacttagctcaaatacactatttttaaaattaacctgatgtatttgatatagaaaaatttaagtgtcttactttgccagaaatggatgcagagatgacatgcagccccatctgccttctctgtactcttccttcccactcccaaagcaaaacttgctggactttttccttgctgcctgataaaccttatatcatctatagctagcatgtaattgaatgatgccgattatgcaaacttctcacaaaaggcaacttccgcatgaggactatgttcacgggttggttatatctggataaaatttccctgaaggcctcacagagaagaaggtgcaaagttaactttatttcactgtagtgcgttgactgcgtggtgatgcaagctgctgtgctgggctcctcagagggtggaaatctcactgctcttcctcaaagaacttgattctccagtagttcaccccttccccccatggttttcctattatttttttctctatctatccacttgttggtgagtgtgtgaggtatctgtatctgtaggtatttggtgcagtggtaaaaatcaggagaacaaaaataagctggtgaggtggtgtgattctaacatcgtttttctttgtggttgttttccactctaagacatgccatgagataatttgaaaactacaaaaaaaatgaagatgaaatgaaaaatgaactatactcccattacccagagaaaagctctgttaacattctggtgtttatcctaacagtctttttcctataagatgcaaattcagatcatattttacacttttaaatattcagctgttttcacttaatactatattacgaaactcttcatttatcattaatagtctttgaaagtatcatttcttaatacagatgtcccataatttgctttaccttttccctcattagaaattaaggttgtttccaaatattggtaagacataatgtgacaagtaccaataatatatattttgtgcatctaagcagtatgacaaaatagaaaaaggtgaaaaggtattaatgtacttgatgtatttccaaactattttccagaaaggctgtaacaatttatactcccctatgtaggaaaggtgagtgtcttgcctcacctgaaactgaatgttactttaaaaacatgtatgctaatttgctagagaaaatagtatactattgtagcttactttgcattccttaaattattaatgaggattaacatttttcatgttcatggggcagctctattttttcttttctaaacaggatgtcttttgtctgtttattaaattgggggcggttttacctttgcttcttgtcatccttccagttgttttatgaagaagcctgatttggggctttttgatgaagccttgtgagagcatgggatatatctgcttataggaaagtgcctctaggaacatgaccattctctctgttcatcctcttaaactcctggtgctctcatgttctctcttcctttccttatcagcccccgatctcatatgctactcatgaccatctgttacaccttagagggaatctaaatcatctaatcactaaatgatgcgcccactgcttcatctctacttatacagtgaaagatcatcgctttcatcaaaggtattttgagcatcaaattggaaatcctgggaaactcctgggcgtggaggacctcagatgtcaccctgcagctttctctgtctctgagaacagatctagagccttagtgccatcgccactacagatgggctaaattcaaggactgatgactactcaaggctgctatggagttaaaataaatagcataagaacatgaatgtgacacaataaggttttactggaagaagagttagttttaaaatgacaacaattgtaggaaaagccaaaatttattatatacaaaaaaacaaaagctgttgacatagtgttcctaacctttttttgctcccaacttttctgaaaattctaattttttcctgccctaatcttttaaactacattttttctcaattagatatttaaaaacattaaaaaattctccattgacaatttttcactttgatttaaaaaggtgaataaataatacattacctttgaaactaacagtgaaatgatttcttttacactgttgtcgatcagatcatctatttttgaatggtactgttgctagatattaaaagataaaaactcattagttgacatggacacaaaacttttgtcatcagtcataaatgctctaaatctactagttatgacctatcagatttatttaaaatgatcatttagaacattaaaagaacaaaaccttgaaaatgatccacccagtcaacactttttacattgtggtttgaaaattttcccatgtgcactgttgagttaagcagctaatggggttattatttagatgaattgagttcttattcttattcaggcagaggaatgtgaaggatactttttgtcttctcctctataattaaggtggccatgtatttttctaaagggttggtttagctggagaagcaaaaagactagaaaaagatttaattaatactgcatttcatgtctgacaactctcattcataagttattttaaatgtgctctagaaataaaatgagctcccaattgttcactctaaaaggactttttgtcagcacagggagcagcagtttatacaattcttacaatatgctcgagcaagggcaaaattagaatttcatcaacaaaggtgaatagatggtaacaaattaataggccataaaaggtataatgaaacatcactcactccccatagttttattaccgcttcctcatgaaaaagatgcctttaaataaataccaaaaaaagatgtatttaaaatcaacctgaaagacttttttttttctttctttagagaatactagagggctccattcttaaattagcagaagctttggcttccaaggcttgtgaaggcacatccatttaaacagtaattcttcctttagaagcatttatctgacaactgattgtccccaatagccacttcacagaaaatgtgacttgtaaagactaaccctatcttgatggttcaaggcttcttggaacagctaacaaaatgcatagagtaaaagtactcaggtcaatataaacattagaccaacttcactgctggttgaatggtttcttaagatgtaagtttttgaaagctattttttttttttgtgctgaaaacatgtctcaaagtttccacacagtacaaaacatcaacttaggtctgctttggaatactcaggaatgacactccacccctctccccaagggttctgacagttacaagtggttatcataaacctgcataaataataaagaaaggaaggataattttggagtgtctgaattattttctttttctgtgtgagtctgagtgtgtgtgggtgtgaatataagtgcataatgatgagtgatctaaaattaaccacactgatgtgaatgtggaattttctgggcacatattgcacccactaaagcatgtctgtctcacttaaagcctttattgattcccaagtttgtgctccccagaggataaatggaattgaaacatagagagtggatttctattccagtagtgctgatatttttgctttcgagatagcttgaagagaaggaaaacgggagagaaaaggggagagaagacagaaaaacaggtagaagaaaaagagcctgaaaaagctggctggcagttaaacttctgatccagtctaaattattaataattttctgagccagacaggtccacacatgaacatatctgagaccagctgaacaattccagtgcactggctgatgggtagggtaatccctccacagacacacttacaaaaaaggccccccagctcctggctgaaagctgtgcagctgactgtgcgatggagaagcttatgcaaatgagctctgcctggctctcccactctgccactcttgtttcacgtccttcttgctccagatcagtgtattcagcaagaggaaattaaatgccacgtgatacacctctttaggggtagaagaggaaagagatacaggagttgggcttcaagcatctcacttccctcttacatggaaagtgctccaaagcatgcaggcattgaggcacccagacttccaggcaggttcctaaacatgccttatccccaatgtttttctctgttttcataacttccattttttgaattcaaagtgatcaaatgtcatcagaaagctattgtatataaaatacagagcttctacatgttaaacttttgggttgaattgattctggcaaatcttaaaatcaagggacgagccacaaaagaggtcattgatacccattttcttgaaaagcagtgaaagtcagtggacactaggaaccattaaattctcctataatacactcccgtagattgttgcttgctttgatacctgatctagccataagcagagacaaagagaaaaagaggaagagatggggagggagggagagaaaatgagaatgaatgaacaaaaacaaacacatacaatgttaaaaacaaaggaataaagaagtatacatctgaaatttaatacccaaggggtaaatccaaatagtgtgaggtttttagatttgcataatatgggattctgctattgtaaatgtatctggttagatatgacttacactaatattacaactgctgggaactttcagaatctgctctggctgtgcagttggtggaggtcgtataggcacatgagtgtgagagaaaagatggcccgagaattcccattttacatatatattctgcagacaataactcacatatgccatacataggtatacaaaattagctagaaaaagtcattcattaggggacccaggtaactttctttttcttcttctgtgttttttaatccttgctaaaaaatgtattaaataatgtatttcaggaaaatgacaaattaacataaaaggaagttgtagaatgaaggaacaaggatgaaaccagaaattgaaatatgtcaataaatgtaattaatgattatctgtaaaagtaatatttgtgtgtgcacgcatttaaaataaggcaagtcaaaaactgccaaaataacaatggttattgtgtgttcatctggggtgggtacaggagtgttcagtggatggttaaaacattctaagatcagtggtgtgcttaaactagttcataaaagcagctttttagaaattttcagataactttcaaagacaaacatgaacatgcaaaaagagatcacaggtaaaagtttatctgcatagacatttttaagttaaaattgataggttttttttcccatttagtataacagacaacatttttggtacattaatgtttccaacaataaaaacctataaaatttttatcagaggctgggcatggtggctcatgtctgtaatcccagcactttaggaagtcaaggtgggaggatcgcctgagcctgagttcaaggttgcagtgagctatgaatatgccactgcacttcagcatgggcaacagaaggagacaaaaaaagaaaaaatactgagaaaaggtaatgcttatacactgttggtgggaatgtaaattaattcagccactgtggaaagcagtttgaagatttctcaaagaacttaagacagagctaccatttgaatcagcaatcccattactgggtacatatccaaaggaacacagatcactaaaccaaacaaacgaaaacaaaaacaaaaacaaaaaccacttgaacttgtatgttcattgccatgctattcacagtagcaaagacatgaaatcaacctaggtgtccatcaatggtagaccagataaagaaaatatggtacatatacaccatggaatactagacagccataaaaaagtacaaaatcatatcctttgcagccacatggatgcagctggaggctataatcctaagtaaattaacacaggaacagaaaatcagatactgcatgttctcacttataagtgagaattaaacactgagaacacacggacataaacatgggaacaacagacactgtggactagtagaggggagagggagggagggagatgtggatggaaaaacgacctattgagtactatgctcaatacccaggtgtaacaaaactacacatgtacccccatatcgacaacaaaagttgaaatttaaaagaagaaaataaaattcttcgaatacttcaagttggattgataatcttagattctagggctttgttagatttcaattcattcttaagttaagtttctccacatctgccctcaaaggcaaactgtgcctgctttcccgcaggtgattctgaacttacattaagataaccattcaggaatccttacttcatgaagcccagggaaatcacaggtcagacacagtccaaaatcctggcctctctacaatcaggtgaacagcaccacttcacctgactgctgttacacaaagacactcatgaaatggctaatcagatgccagtgaattccagctttcttaaaagattttggaccttgtcttggggtatataatattttaaaggtactggattgttagttccagaaatggatgcattttaatttaactgagaacaaatttggcccaagtagggccccttgctcccccgaattgccatattaatgtgttttcaccttcatcctcaactaatgggaccatggaatgaagtggttctgagggctgatgaatgcctacagcccaggtagtcatctgcttttgtgcagttacggataatgaggattctaaacactgaggtggctttgtgatctcgacatctgtccctgagggactggcctgagactgctgactcatttcacacagctgtcacatgagcagatcattcacccactaatcactccattaaaccctattctgggcctcagtggaacatgtttgcatcatcatgtagcatgtaagaaaaacaggatcataatttagaagcacagaagggaatgcattgtgaggaaggagttgggaaagttttatcccagcgatgacaatataacacatttactagagattttggagaggtaatttctttataatttagaaaaaacattgctgctatgtttaactatgtagtatatatttttacatggttccaaattgtctaatgatctagtttttttcaacaactttgttgctttttataaatgaggtccgctggctcacctgtatatgtaatgtatatactaattttcaacaattccgaaacttatctcagcatatatacagagggaaggcctatgcaattatgtgggtatgtttactggagagaaaaagcgaagtataaaattcttttgcaatgaaattcttgtttaccactttttcagggttgctaatgggttttacacctgcacattctgaactatgttaattgtgtgaaagttgtggggaactaattgtctctggtgtgaatgtacaggtgcacacataatgaacagtagtagattactcttcaaaaccacccacctattaatgtaaagaatcatttgacaatgtaacaatgttcatcatttgtgtgtgtgtgtgcctgtttttccttttaagtactacagcaagttgtttcttacaggggaggatttttaaagcagtgacaacaaatctgttcatccactcagcaaacatttactaaagtgcctactgcatgtcaggtactgcagtgtatgttaaaataagaacaaacggataaacccagtatgaatggaagatgattccacaaaccagatgagaaaagaatgggtttatgaggaaacctaagataatattctcaggcagacaatcaaaggcttacatctggttattaaaaaaacatgaggaggtaaataggagccactggtatctaagctagctgcctacttattcagataattagatataataaatcatgttgtaagtgatcagagaatggtaattactgaacattctataacacatatcagttacctgatatatgtgtaaggttgtatgctatggtaatataaatacatttttttttctgctgaattgctcaaagaataaaattgtgtattcatgcataaatataaattatggccaaatagctaatgtctatacctggggcaataggtatagaattcacaagtagtaggccttcccatctattttcacagttaactaagcccctctgcttagatgagaattgtcagcccaggaagagtcaccctgagtttgattcccaattgtcaactgtaagacttgtaagatgtaacttacctacaggacacaaagacattctaactcacgacaaaaaaaaaagtatacactagtcaatcctttacgcataaaggttttctaaccttgtacctcagggattctggggtagtattttaggacgaactgttgtggaggagggcagaagtctcatgacacaggcctgcctcttccttacctctgatgatggtcacatcctaggccatgagtgggaggaaagactgtatcactggtgggcttgtacctcactgaaatccaccactgggttcatctgtatgaagtgactttgggtgtggcctcctggttcaagtttttaggggctatatgtcatctaaagctccaaacttgaaattcttttggtattaaaagtatactgtagataaatgcttgaaaaatgttaattatcactctgctcctatagttattcagatttcaatttaaaagaaggtgaattaatttggttttaaataattttatctttaaaattctaagaggagtttataaattctgcagactaacaggggagaaacatttccctcgtcattatttaaggtataagtatttagtgttttcatgaatctttggactattgctatgttattgtaagctgttagccttatatatgcgaacacagaagccaaaaatctgaaaataaatttatataattttaatttgaaaagatgaaaataaaaaatatacatttacaaaaataataactcaaatgaaatgtgcttttagaaaaaaaaatgagacttacccattgactaccaaactggatcatgccatgggtggaaaaaaaaagatgatgaaagagaacagaagggaagaataaagaaatgaagaaaaagtaattacaatgggaaaaaaaggcaacaaaatcaacttaaaacagataattgaagaaaaataaatcaattttcacccaatcaccactctcaacaaaaaatcatggggtaaaataaaattgtacttctgaatataaaaccaaacaaaatataaataaaatagaaagaataggatatttattgataagaactaggcctagatttttaagtctatttcaacctaaatttttaaaaatggaagctactgtgtaaataaactatttcacactttttcgtgtgtcttacttttatagatgcaaactctggatactctagatttgtataaacaaaacaggtagctttccagctttctcatttgcttgtaaaaagcaaggtttatgtaaatgacacaacacttcagctgttaaaagctatatctaaaattcatggccactaatgcaattttagaccatatttatatcaaaaaggagaaactgacatgagcaaaggataaagggcattctgttattatagtaaagatcaaacgtttggtgctagagaacttggtcttttcaatccaatcaagagaatgccttgtggaaagggcatttcccatgccaaggcaccctgtgctgcctttccccatgtggcacattctacatacctcttgtcctccatccagggcacagagtttggtgctttgctttttggcatcgactaatacattaaacatagtgcaaacggaagctggaatgcgcaagtcagttgttttgcttgccttttgtagcttgagttcaaatgcagttcttgttctagtttttaaaacatgaattcagagtaagaaattctgctatacagctcacctgttttgtaaaaagtgaaatcaacactacaagatgctaatttaaaacatgcaaataaggagtaagcagtgtggcagtgcttgggagctaaggggtgggatgcttttcttttcaagtgtctcaatgaaagatcagattgtcatatttttatattaagcctagcttcatgcagtcactcaggcagtattgccacccaaatgaagctttttgttatatctagagtaccacatttaatggaaaaaaaactcataatttcacttaattgtctgaattaattgtctgaatttccaagtagaaaaatcacacacttgtatgcatttaagcagaatatatcctctatgtgaggtcttaccaaattagaaaaaataagcacaaacctagaaaaccctaaaacatggtaatcaatgtacaacagacaatgtgtaattcttttatgtcacttacattctctttcaaaaacctaaaattgcaggcaggtttttgaaaggaactgcatcatgagcaatttggaattggttttgctgaagtatcctatgaaaatccacagaatcgagacatcaaaatcaaagatgatttttaaaaaacattaaactacctaatccagggccttgccttaaggggccactgaacattattctaaagacagattttttcttggtttcaagatttcagaaatatccaattggtctaaccagtgtttgaacacttttctaatatgtggctccatattgtccttgtatatataatgaacaaggacaatgggaaaaaaatgcttgaccaattaggatgcaaagctgattttttaaaactacgataaaatgaaagcacatttggaagaatatgaagcctcataacttatttccagttaagtgataaagaatgtaagcagatagttggaactcatctgatgtggacagaaaatagttagtaatcccagaacaactgatggtgctgatcctattttgagtttactatgccatttcacagcacacagacacagtacataatgcatacagaacataacagacctttttcatacgtctcaggagatattaccttgggaatttaaagcatagtattcccagagagataacaataagccctaaagaaaccattaatatggtatagatgttactgattaaggcaatagttgggagacctgaaaaaaagtatccagccaatttcatcaattacatgggtccccagaatttaatcaagataacctaatactcattaaatgttggaatagtggtgcataatgaaacctttgctgtgacaataatatattaggtacttgataaaaagtgatatttttgggtgctggcacattaagcagcaatttgaaaatacatgtctaccttttgacacaggcctctagcatatcactggccattagtttaagtctttgctctaagtggtgggcaaattcctgttctggccagtgcagatcaaagacaaacatttgcagtgcatcaagcttccaaaaaaggtcttctgatgttgctgagccattgctagaagaaaaaggaaaaatgaacatcatgaactccccgttaattaggtataccattaatacattgttttttcttttctgcatcaattgccatcagtgaaaaaaataccatataaagtctctaatgatccaatattttctttgttcagccttctaattgttcctctacaattcttaataaggcagggcaaggagaacaaaatagaaataaatatggtggtagggtttcatacaaagaggtaaaatggatatgtatactttactaaggaagttatattgtgtacataagaacaaacattgtaactgttctttaccaatctctaggataaagattcttgcaaatccccaaaattatgttttatgcaagaaaatccttatgttagtaaccagtacctttgccgttattcatgcatatgtgcctctgtcaccatggtggtttctgtctatctacacgtgtgtagaacatagggtccttgaatttctcaattacaggtaaagatgagacaggaactggaaataaaacgggctaggtagggaagcaatcttttattttcattttttgctttttctggcttattaaaacccaacttagtgcaaggtattgtctgacagagaaatgacattcagggtgctctgaagatggagaaaaacaatgcgtttcaggtccttatatctaactgtggagccaagatttgctaagcattcactattatggtaaaattactctacaggagtgctatcaccccatgtatgaagataacttatagaagagttacagtaacttatagaagttaccttctagaaggtaacttatagaagagtacatataatattttggcaaatggttattactttccattatgcaagtacataggctaatacagaaacaagtgttttgaaagtaaaatattcctacattaaaacatattgaaatttaaccataaaaagcataaaagcaaaagcaaaaaaaagctgctgtatgattcatttgttctcagctttcccacaattgcttcacatatactaacttaaaatttatatttctagtttacaaaagaaaattaaagaaataaactcatttattacaacagcacaggggaaaatacctatgtaacaaacctgcacattctgcacatgtatcccagaacttaaagtaaaattaaaaaaaaataaattgtttaaagcaccacattgtttcgctaaatatatctttatgagctagcttagaaaaaaaggcacctcttgctcttgactaatgaaaagcttattcctgccctccaccctggcctcagcgtcaaagctctatcacaaacctacactgcttttctcttctcattctgccagtaattcctcctgatctccttgtctagccaaaatgccctcagacttaagttctctagggaccaatcatagcaaagcactgaacactcccgtagcactttactcacttaaatctcttcaccgtaatattcagtgcctcaaatgcaccattaaataagagaactagacaacaccattctgatactacagtgaaagtgttgaaaaaaacactacctttatttctccttttgccatatatatcatacaattaagagaaaacaaacaaacaaaatctcccttcacatccacagtgtacagcttggtagattagaggaactgagttttaagaataactgaatacaattggcaaagaagcaaatctgcttcttataatatttttactttggagaaatgtaactatttggaatgtatatattctttaacaacacaatgacaaggaaaaacatcataaaaacaaaatctctaatggtaaaggcagaattctactaaaaatagattttctaataatacatggcaatcttcatagagaatatggttacatttttcttctgtttgattctatggtaagattcttgacaataaatgtgtttaattgggaatgtaattaagataacaagtgtttgttataattagatagatatatgaaaaaaatgtgagtaggctttctctggagttggtacatataacctgcaatttattcagagctttttcattttaaaattatttctaattggtggcctattcctaaaggtattattaacagattaaagaattcgaatgtgagtagtagactctgagataatttcctaaaaatgccagcaggaaacttaacttgctggcattcatttctagagaaaaaaaaacagaataaagatttatatacagatacatatgtcgatgagcaatccttgcatgatttatgcattggtaggcagggatgtatcttcaaaaccatggttgcttttatattcttcttatttaatcagcagttgtatttttaattctttatgttaaatataaatgtttctttttattaatgtttcaaacttcaaaaaacaaatggcaataacatcataacattatgagtaattctggacactctgacaaagaacctaatgttgataaccttggtaggtaaagataatggtgatcaacttgtaaaacacatttttaaatttccccagaatggtgaaagcacaatcactttacttacaaagccccaatttgtcattattcctgtcctgaaattaacatactttaaaaaagggccctcaataagggattcagagtttgtacaaatcccaaagttaataaaagattactaacaaaaaaataaatttcgcaggataatgcccatgatagtgttcttggctaaaatcaagcgttaaatagatgagaaattaggaagaaaaggagttaaattataaaacagtgtaaaaaagaacaaaaaaatcatacacttagaaaggttcattatagtttgtaggcaattttctgagcacacacagacaccactttacacactctaatgaccaaaagcatttgcctgtaagaaaaaaaattcacatgtaacataatatcctagtgagtattatgaatgcagttatgatgttaaacttggagaaatattgccaaattactttgcaagttattctctttcttggtcttttcctatttcttttcttgattgtgtgcatacctgactgggtgtggatttgcagttggtggtgggataggtagaaaagtagcaagttcttaaacacaacgttctatgacagcagaacaaattaatgataggagtgaggaatttgtagtcaaacgaacctgggttcaaattttgcctctgtcacttatttgctgtgagatattgggtaagtttggtttcttagtttctttatgacttagtttccttaactgtaaaatggggataatgatatgaggttgttataaagattaaatgagataaataacttggcactgtactggaaacagtaaaatctcaataaatggaagctatttttcttcctctcatgattattctttctagttgatttcatatgagatcttgggcaaagcaggtaactgcccgagttttcccatttgtaaactagtactattacttggttctgattgctgtgaggctcatagttttaaaaactataccattataaattataatgatgatgcctgatgatagtaataataacaaaaacaacaatgtagagtagtagtaattatcatttactgggtgcctaggatatgccaatagtactaataatttactgagagcctaggatatgcctcaatacagttttttttttttaaatcatcacaaaaacatctttcatttaggtgtcataattgttttagagttgaggaaaaaactcaggctaagaaggatttacaattaataagctaagatctaaattcagaactgatcaatttaaaagcccattcctgttcacttcagtggttcttagttgctgattctgcaataggcaagctcatcatgatgtgaagttaataaatatggtttttgatgatataaagactatttaaaaataccaagatgtaccaactatataataaaagaacaaaagaagaacttcctggttttggcaatgaaagggcctgcaatgatgcagtactgttttttaaaagttgagactaagataaaaatagaaaaatattatattcttgaaaccattcttccaaaggttttctacttgcacaagataagtcatctgggcagtaataaagctggagctaagaatcctcaaaatgctttgtatacataaggagaactctgattattttacttagggtacaatgtcaccaaatgatttacttagggtagaatgccaccaaattattcctgtcccacagattatatatgaactacattaaactagcgtgttttttctttttaattgacattattcatcacagatatgctaagcttagcttactagcttaaaaactcaaataaaaaaaaaaaaacagtattcctcaaccaacgatgacaaatgccatgcagtctaaacacatctgcgcagaacacagcccaggccatgcaccagctaacacaccaccaggaaataagtgaggaatacacacgtggactcatataaagaaggcatccacgaagcagtagaaatgttaggaatctgtggaagattaagaggcagacttggaacttttggaagagctacattgggaagactgttggcgatattcctgtaaagaaacaaacaacgtgggaagggaccaccataagcgataactacagatggccatgtgtgaagtcataaggtcagggttgaagaggcaggtgctctacggacactaggtaagatacctacttgacaggctgccatgtctcctgctcaaaacctctgtgaattgactgggcgatggaagactccatgagatccacatagcggacaaccaagggtacaaagatttcttgcaagtgtttgtgaaattttccattacacaaaagtgctgaaatagccaagcagaaacagtgtttgtcagagggataatatcagacatttggaaaatatgggccaaaaaaacacgttttctgagagagtctgacacagaagaactgataaaatgcagatgagagtagatcataccccccatattgaatatcatatcatggaaattgatcaaaaagtataattagccttctatatatggctgtcaaaacacaaatagattatatctctctaaaattctcctggcaggtggtatgtttttattttctaagaggtttaacacataggcacatgaccactcgctggaaattcaagggagctgccagctcccctgaaggtcctgacacatgtaaatacagcaattaagcagagttacaatctctgtgctatgctgtgtatcacagaggagctaaaccttctcaattctaagaggtaagcttgatgacttgtaaaagctattcttgttcactaggagggtgtctgtgggtttgggaatatctattttgattcatgaacattatagttatttgtggattttctttttagtcattcaattttgcatatctgtatttaaaaacagcacatgacctggattttttagttttccatttgtctttaataaatggtagtatggaacatcctacctaaagtagtgacagaaatcttagaatttgtgctacaaggctgctgggcaaggtatactcacctttttcaggcgatgaatgttttctatgcagatgatacaattttattaaaatataggtgagtatatgcctaagtttcaccattaaaaaatagagaatctatatgaaaacagtaatgctaagtaatatttaacaaagactttattttagatgacagtactatagattgtaaatatttctcaaagaacatgtcctaagccccattgtggccctcaaagtgaaaatgtgctgatttaaaaatatactctgtggtcaggaaaggtattcctgaagagacagaagaaccttccatggaagacttaaaggggaggtttccaggtagagggaacagctagcaaacaagttttgggaaggaataagcttgggtctttgcagaaagatgaaaggccagagtaactgcaatagactgagggagggggaggggcagcccatggcagggtctagatcctaggactgagtaaggagtgttgctcttagtgggtgtgatgggaagctttatgatgcttatgattatgcagaggagtgacatgatatgatctctctggctgctgtgtggaaatggagtaggtagccaggagtgaaaacagagaaaaaggttaatactcagttgtttactgcaatagactaggtaaaggatgataatggctttgactagggtgaagaggtagaagctggggaaaagttagtaatctcattcacttttatggatttgaatagctatatatgcttatagttactaaatctaattactagcaactccaatagcagtgtcttataaaatattcactatgacaacttcccacattatcttcttcagagcaaaaacatcccaaaagcctaatagtgttttagctcttgtcaaagtacatgatgtttatcactgtggcatgtatatgaagatggcttcgatatgttactttatgcgtttctgaaatttctctgaggctggacaactacaggcacataaattggtgtgggaagtaattctaaacacagaaggaaatataacagatttttttttctacctctaattgatatgggttagtattttttgtggttaaatactcttttcccagctcagctatatgctaaaacatttcccattaaattgtgaacaataatcatatttaatgataggtgtcttatttaggagactaatgttatcttaatgatgttttcattagcacactgaaagaagctttatttattcctggagattcaatcatcgagctagaaggtactatagctcaaataattcagttccttttatcaaatgccacctaaataagcatgctaaactttaaggataaaatattctcactcaaaccatctaattcactgtagtatgcaaattaaaaaatatactgatatctgaatttattgggtctctacttaagaactctcattctcttcttcctcctcctcatccctagcatatttggagtaccaagcactatgtgaagtcctatatgtgccttatctcatttaatcatcacagaaactctacgagggaggattttttttttctttttttttttttagagacggagtcttgctattgttgcccaggctggagtgcaatggcacgatcttggctcactgcaacctctgcctcctgggtttaagcgattctcctgcctcagcctcccgagtagctgggattataggcgcatgccaccatgcccagctaatttttgtatttttggtagagacagggtttctccatgttggtcgggctagtctcgaactcccgacctcaggtgatccacccgcctcggcttcccaaaatgctgggattacaggtgtgagctactgcgcctggctagaactatttttttaaacttatcaataaggtaactgaggcatagagagtttaagatacttgtttaagatcatttagtcattagtagaaccaggatttgatagaaaaactccttgttaacctctataaaactaccattcctcactctgacaaccaattagtcatcaagactggtgtattttatatccttaatatctttcagtaagttaccgtgctctcttcatcaccactgctgttgcaatagtccagccctctcatctcctgtcttgattaatgcaataataacctaactggtctttaggatcctaatatttcctctgccaatccatcttctcaaaatcataagcagaggggcttgctgaaatatgaaactaagaatgtcactcctaaagattataatcctttagtggatcattatgacaagcttgaaaagcctgagcatggtatgaaagctttccaagacctgtctacaagttacttctccagctcatttctgttgtcttacctttcatttcctgtgatacagtcataatgactttcacgattcaatatacacctgctcctcaaatcctttctagaaatgcttccttctgctgtccccttgcccaattactggcttctcttgtttactctctaccctggacaggtttccactgtggttcttgtcatacaagtggtcttctcctgctgacatatttcttgctgacatatttctcgctgcctacaaggatgtaaggttctcaaggcaggaactatgtctgtattctaagttccagaaaagtccctggctcagagcaagtaatcaaatgtttgttggatgaatgaatatttgaaggctaagattattacattattattgtattaaatggcacttataaaacctattgaggcctgtgtatacgcctcatactttgtataaaatatatagcattaaataatacagctataagttctatttttaacccatatgtacaagatcggactgctaaaaattctaatgaatataaaagttggttattttatgtttcttattttaatgaatgtggcaaagaaaggattttctctggtcagttatgaatcttgacagcaaatgattatatcctgcagaatttaaagaaaatgaagattacctatatttcctatgaactacaaaaaatcttaaattctagccaaaagtttgctcagaattcagcaaagagttattttttatttgaaaaaaattataaacccacacttgaaaattttagaaaattggcagtattatttcattggtaattagagagaaaggggaaggagggagtgggggagaaatgggggagacaaagagaaaatgatggaggggagagggagaggaggggtgggggagggactagaggagaaagaaagagaaatacacaaagagggggaaagaaaggaaagagaatatttggtttccaaagacaagctacagaaatacaccctacactacacttgtctatgtaaatgtatgctccttccttcgttgtccatatggcagcttgcattccactcctatcagacactgtcaaaaggccctcttaatatgtagcctgaggcatcagagtaagtgcttctatcttctccatatggtttaataaggataggttatgatttggggctgtcacctgtccaaatcaagcctttacaaagcacccattacaacagttcattgtaagaggcaagttcttaatgcggccacatccaagaacacttctgacaccatactcaagtatgagagagtgaaaagggctgctcagaatgagtctcaaaaagtgattaccgcctgaggggaaagccagcacctatttttcagataaaaaaataacttttttcccgaaaagattccatgtttccaaatatcaccttgttagaaaataatgaggcatcaatgacatcgagccctatggtacaattagaaatggcaaaaagaaaacaaatggcttaaatataagctaaactcaggatgcaatatgcccaattattttgaaaatccccgataataaattagtgttgattattttcatatgaaaaagcctctttcatttacaaaagtacttgtcataggcttttagtagtaagatttcaacagagaatttaaatttaaactatgatccaattaataacaattactgagacaataatcactgggtaaaataaagaataagcaaataaaagaattcatatattgtttttagggtaaaaatatgctgctgactcttgaacccatataatccaattttatagtgctcatcctcttccaattagctagctttagtggattactagaaagaatgatttttctcctcaaacttctcattaggcatttcagaaggaaatgggtaattcattagcagcaaaacaaacagacaatacaaatcacaataaaatcaacagactttgccataaaacaattatttaagagactaaaaattatatcaaccctgagcaatgcaagcacagtggactaagaaaattaataagtcgctctccatgttgacaaatgcatataatgaagacctccatcacagaaacagaaaatatgaatatgggcttcaggagaaaagccagcagaactgcagtctagaacagcattatgtaaaaggaaaacactcttctctctctctctctctctctctctcccgccgccctccccacccctcaccccttcctccctccctgagatttaggaatagcacccagccaagaatctggcacattaagtaggcactctataaatgtctgattattgaataaatatcaataaaaatctacctcctaagggaaactccaagaacatcccatttaagtagactaggaaacacactggattctattgtccttttaattaaaaatttgacaagtaattttatatttggtaatattaatgtatacattaactagtataataacccctaaaaccacacccagttcttccttttcccttggggcacttgctaatatatatttatacacctatacatctacctagggagagaaagtgacaagaagtgatagaacacagctgttaaaatgtttcttacttttttgggcaacacatccaaatttaaaactataatgaaaaaatttcatagaatggcacacataatttgagttatacttctacaatctactgcatcaagttatttgtgtatatatgtgcgtatcctccactagattttatgtttttcaaggggaggaatcatttcttatttatacatgtatttgcaaggagcctaggatttgtaaattgtaggcattaggcacttgtttcttgtgaaactaattcagaaaagcttaattaaccgaagcttataaggcaaagataagtaaagaagtcttatggtccagcagtcctcatgctgttttttaaatgaaattatgtaatattaaaggcaaatagaaaagtctgtaattttactcaagctatgcatagccttctaatctttgagttaatgtcccacaatacttgccccatcaatgggaatgattgagtacagctatatcatgatcgataactctctcaagggtgggtttcttttttttttttttttttttttttttttttttttttttttttttgagacggagtctcgctctgtcaccaagtctggagtgcagtggcgcgatctcggctcactgcaagctccgcctcccgggttcacgccattctcctgcctcagcctcccgagtagctgggactacaggcgcccgccactacgcccggctaactttttgtatttttagtagagacggggtttcaccgtggtctcgatctcctgacctcgtgatccgtccgcctccgcctcccaaagtgctgggattacaggcgtgagccaccgcgcccggccaagggtgggtttcttgatgcccatggttttcagaagttacaggtgttcctgtgatctgttacaagaaacacactggcattttagaataggtgattatctttaagccactaaaccctatgaaaatataaaaagcagattaaaatttttaaaaagtctacaagtaggaaagaaactagagcaggcagggcgcagtggctcacgcctgtaatcccagcactttgggaggccgaggcgggtggatcacttgaggtcaggagtttgagaccagctggaccaacatgcagaaactccatctctaccaaaaatacaaaaaattagctgggtgtggtggtgcatgcctgtaatcccagctacttgggaggctgaggcaggagaattgcttgaatctgggaggcggaggttgtggtcagccaagatcactccattgcactccagcctgggcaataagagcgaaactccatctcaaaaaacaaaacaaaaacaaaaacaaaacaaaactaaacaaaaaaagaaaaaaaagaaattagaacagtactgtggaattcaactgaggggaaaaaggtagtgactccttgcttttatatttcatttaccatactggtcagtaaaacaaattctgacacaccattttgaatccaatcaactctggggattagagttaaatacattctcacattttggcccttatttcatcatttgtaaagtgcatacttataaaactaatctggcatgcacagatttgctgcaatctagatgttataccctttctgcattgtccctggtttatgtatatccagatatatctataaacaccaattcgtgaatttcagatgaacagctcatttaagcacttgaaagagaataacacgcaggtgtcagccttccatatttcaaagcttgaagattaacctaatatacaatatggtgacctaacagtccttcatttgaaagaaatctgaaaaataatctctgatacagcctaagtgtgagaataacccagcaggatttccacctcttcatttcttaatgagttttttgataatgagaggtgactttgccagtcactctgggctctattatggctaatttgactccacttcactctccttgttaattattaacactagcctttttatcctcatgagaccacattccaatttttcctttttcgatttttatgagcccatctttacgaaggtgaaagtcttcgagaataggttttcacttagtgtagagcaggaacatttattattcgtttaggcagagatgctgtgacattgattatataagcacgggtgttctttgggatgactttaatgtgctagcaatgtgaaaaggctgttaattaaagaagcagcaccgtggtatttttcagttgggaaccagttcccaatagaatggtcatttgccacttgctagcatatccacagattaaaaggtgactagctccaagggtttgcgtttcagtagtgctgaaagaaatgatttgtgccatttgcagatggctttcatttgtcagaagtggtcacttgccttatctattattgacagaacaactatggaaatagtgtgcaagggtagaatctatttgtactagctttatagtcactcagtatcattgaaccatcgtgccaattacttcattatgaaaacatttatcttccctcaatttgaatacatctctctttcaaaagtgtttccttagataccatttaaactgattgcccattaaattacctctttagtaggggagtagattggggtagatgaaggcagggtagagagcgaagtgagagcttggtcttttttggccagaaatggaggctgactttgttttcatcatcagttttgctctgggagtcagtgagtgagtctgtgaggggtgggacattggggacagttgctaaaattgtggtgcagctggtgctcttcccttgaggaaaaccgcatttcatctccaagggttctccacatttcatctccaagggttctccaagctatgactttccctaatcatggctaactgtaaggaaaggcacacaccccagacagatgtttttttatttttttctccttaaaatagaaaccgaatttgctgtcttgaaccttccctcactaattagttcagtctctagaagtcttgtcacagatggttcctaacatacatgctgagaccacacatacctttatctgatcctttctgtactctttaaccaactcctttcctctgcccccgacaacacaatgcccttataaatatttcctcattaaaaaataaaagttcaaggactctcttgtcttccttaaaaagatgatattattttataaatgcccacagaatctgctttttatacaatgaaatgagactgaactggagacccagtactcaggctctgactcatctctgtccttaactccctgctgtcaagccccccgcccgagttcctgcctctaggcattaggtttccacagctagaaaatgaagagttttgtttaagatcccttccatactccaaaagataaaaaactatttttaaacatcgaagcatacaaattttaatctaaggaagataagaaaccaattaggacgactgaattattcatgaaccaccccccaactcagctataaagttttcaagccactaattaagtacaaattctaactaatgtctccattagtttgaaaggtcttagtaattttaaattttgggaaagcaaacataaatatgcaacattattagtaataaatcacaaactgtttaaaaatctaaatataattagcagcctattttgtgtaacgcacacacacacagactgatgccgatgtaagcaagcactgtttttcaacaaattaactcccttcctaatattggacattcagagctctctgtcctattacctttggctagttaaagttgtaattatttcgaatttagacaataactctaattgggtcaacatggtaaaaactgtaatgccatggccgcaatgtaagaatttctttttctttcaaggggtactaaaagaatagaagttcaatattttcccatagttttccaaaaggacaatttgggggcagctgcaggttgacattaaacatttgaattgaattcactaaataactcagtatctaaggaatgtaataaaacaaacacacaattattaacaatggtcttcagtatcaccaagggtgatattaacagctggaagaattatgttttatcagctactcagtggtattgattttggatggaaacttgtgagtttggggtaaaagtcactgcattttatttcagttccccagatcacaccacactctcagtaccaaaaggaaaatatgacactggggaacttttctgtttacctctctacatgggggagctgtttttctcagaaataattgaggttttctaaaatctgcaaatcaccataaaataaaagccaagacctagacttaccctcaaaactgagtgctcaaaagagattagtactaaatgcttctctgttttgactgagtacggtacaacaaaataacacaagatgatatgtagtcaatgtatagaaatagttaaatcaggagagaaatataaaacatatttaatatgtgaattaaatatttgtaaacatgattgaaaattacattttatagttagaattatgaaaattatgtagttttaatttattaccccacaaatttacacttgcattgaaaaacctcttcttaaaaataaatatgaaaaaatattaattcattggaattaatgatattccattcattgtagataagtaattcattgtagataagtaattccattcattgtagatgaatgaatattccattgtagatgaatggaatatcatcaaaaaatattaattcattgtagtagaagttctccaacaaaacttccaagaaatccacaacatattttgttttctctataaaataaattacaatattttgaataagttaaaatattcatcatcttacctaattgcttgatggtgaacattaataatgccttgttttttttattatacttaaagttttagggtacatgtgcacaatgtgcaggttagtaacatatgtatacacgtgccatgctgatgtgctgcacccattaactcgtcatttaacatcaggtatatctcctaatgctatccctcccccctctccccaccccataacaggccccagtgtgggatgttccccttcctgtgttcatgtgttctcattgttcaattcccacctatcagtgagaatatacggtgtttggtttttttgtccttgcaacagtttgctgagaatgatggtttccagcttcatccatgtccctacaaaggacatgaactcatcattttttaaggctgcatagtattccatggtgtatatgggccacatttcttaatccagtctatcattgttggacatttgggttggttccaagtctttgctattgtgaatagtgccgcaataaacatacgtgtgcatgtgtctttatagcagcatgatttctaattctttgggtatatacccagtaatgcgattgctgggtcaaatagtatttctagttctaggtccctgaggaatcaccacactgacttccacaatggttgaactagtttacagtcccgccaacagtggaaaggtgttcctatttctccacatcctctccagcacctgttgtttcttgactttttaatgattactattctaactggtgtgagatggtatctcattgtggttttgatttgcatttctctgatgaataatgcctcattttaaaataacccccaaaatacatctaagtatgtttgattcttgagttttcattcaaatagagaaaacagtgttaaaaaatatcttacatatggccgggcgcggtggctcatgcctgtaatcccagcactttgggaggccgaggtggggggatcaggaggtcaggagatcgagaccatccctggctagcacggtgaaacccagtctctactaaaaatacaaaaaaattagccaggtgtgtggtggcgggcgcctgtggaggcagagcttgcagtgagccgagatcgcgtcattgcactccagcctgggcaacagagtgagactgcatctcaaaacaaaacaaaacaaaacaaacaaacaaaagtctcaaaaacaaaaaacaaaaaaacaaaacaaaacaaaaataccttacttacttattctcatttaggggacttaatgcctaatatatatacttatttttggcagcaggtttactgttatacatttgtcttaagataatattaaaaacctgactgtaatttcatagcagaaaatgaatgatgacagaagattgggaaaggaagacagtcattccacgttggctagctggcaggaaggaaacaaactggaacttaaaaattggctgagggccaggtgcagtggctcacatgtgtaatcccagcactttgggaggctgagacaggtggatcacttgaggtcaggattttgagaccagtctggtgaacatggtggaaccccgtctctaccaaaaatataaaaattagctgggtgtggtggtgcacgcctgtaatcccagctacttgggaggctgaggcatgagaatcgcttgaacttcggaggccactggaagtgccactgggagtgtcactgcactccagcctgggcgatggaacaagctctgtctcaaacaaaacaaacaaaaaaccggcttaggataatttgcagaatgaatgattcgcatatggataattgcatgtggttttattaacaaccactgagagcaggccttatggttgaatctaaggtaggaattgtaagcttataatagcatctttggaaatgaaatgaaattggataggagaatgaataagactaacaaaatctacagtatttattgtgttatatgtgagttatcatcttatttaatgctcactgacaatgacactgttggtgctattattttccttcttttatagatatagcacctagagtttggagaggttaagctattgtcaaaggtcaagtagtaagtgacagagagacgtgaatctgtctagcaccaaagctcatgttgttaattactctaacatgatgcctcccttactagaacagaggtttttaacctggtgccctaaatttaggatgtccatggaaagtacaatattacaaatgatttcatgtctatgtgatttcccccccaccagttttatcacagactcaaagaggtgaacaaccaaaggaagttaagaaagactagactagagccatgaacaaaaccaataaagatttttctttaaacaaagacaactacaaaaacatgagtttaggtttacaaccagaaagatatagcagtggccttctgggatgagagcagcaaaaacatgtgcagttttaacatataaaacgttctaaataaagtataataaaaaaagttccaaatgtattaacagtgtgaagaagttccttggagagtcagagcagacttgggctgcaggaagacagggaagaaggaaggaaagcacctctcatttgggtctgggttattcaggtcacatggtgagcactgtgttcttctgagcaccacactccagaagaacactgagaaatggagtgaggtctattcagggtaaggtgatgagaatggcaatgggcacgaaaaccctatcgtgagacagagttgttttatataggaataaagagtagcagaagaaaatacatgacagaagacaactgttgcattgatcaaagagaatgggtcagaaccagaggttaggaggaggcagagttcatcttggtgcatcatgacaagaattttattcagtagggaattagtgactccatggtcacttcaagtgctgaaacaaaggttgtcagtggtaaccaaacttgagactaaatgaaacttaaaaaagcatcacaggaaaggcctaggaatccgtatgttaaaatcttgataaaaaacagtttgttttgtttgctggaagaccatctaccagaatgactgtaaaatttattattaaattgagaataaaagtatcaatagagagcttttacattctccttaatttctaaatgttgaatgagcaagtcataccacacagcaatatctccctatcatctgtacaaatgaaccaactctcaggccagcaatattaccgcaatggacttaagcaggagccttaacataacatgatttctacaataatgaattattaaggtctttcagagatgtaaatgttctcaagtactttagaaatgccagcctttgaagattttcagattcataaggtacaataaagttcataaagaagggtgcctaggttatcagacttcagtgaaggtaggaggatgcaaatgagaagaccttcagagcccactggagtgtgggagtctccccgggctcccttagtctctggcctgacataatcgggcaggctgagcaaacctaaatgttacccatgcgaactcttgtcaggccggtgtgagggcacagtaaaaatacattcacattcaacattctcccacccctccccatttcacatatgaaagaaaacgcaaatgctcactgtcatttcggaggaaattattaagcagttggaaaagaggaaaactatcccaggagtcttgcggttgagcctctagtgcagtgtccatatccactgtaaataaagcccaaaatttctctgcatgttcagccaataaatcaggccaccaggcaaatgcctacaaaaggataaaaacataaaggagaaaagtagattactttttagaaacatgcacaagtactgtgccagttgaaaatattttataacatgtcttagtttcacaaacaggtatgataaacaaaatataatagtttttaacctgagaaaaattttataggtacacattaaaatcatagatttggcactgaggaatgaaatagaaaatagaattaaaatgtacaaggacatttattcctttataaaagaaatacatgattagtttacaacatttagaacatatataaaacaaaaaagaaaaattatttgtatctcataatttaaacaagtctattctgaattttttggtgtatttacttccaatatttctttttttttctgtgaatagaaacattaaaacatttggtattacactttataagattttcctgtgatttcacttttaatataatagcataatcttctactataaggatatactgttatttttttttttttaccaattaccctattaaaatggctgttttcaattttttgctattctcaatgatagcgtagtaaatatttttacataaatatctttgaatatagcactgattatttctttaggataaacttctaataattactggattaatgggtatgcattttagagtcttcacacattgcaaattgctctttatgaaaagtgtttgctcacatccattctccattcagcagccagtcatcatttcatttattttttttgagacagggcctcactctgtcacttgggctggagtgcagtgggttgatctcagcttactgcgacctctgcctcccagcttcaagcaattctcatccctcagccacccaagtagctgggaccacagatgtatgccaccatgcccagctaatgtttttgtatttttaggagaaacggggttttgctatgttggccaggctggtctccaactcctggcctcaagtgatctgccggccttggcctctcagagtgctgagattactggtgtaagccacggcacctggcttcaaatatgaattggattataacaggaaaatacaaaccacaaaaaaggggattgcaaaattttgacacactattttcttaagaactttccatgtttataaaaatttcatgtttcacatttatagtaaatatggccttaaaataatagatataaaataataatcagtaactaaaaagattgccatgtaattaattagcagatggtaaaggctgacttaaggaagaacagtgtagtataaaataatagatttgagagttggggacattttaatgcctggctcaatgctgtgaccaatatatgaatgtgaaaactggttgggaatggtatgcatgatgaaaattgagcatactgttttttgcatatattacctttgaatattttttggttaaatatgtgataaaatgggtatatgacctaacgtaaaaacacacaaaaaagtatacatgatttcattacacagatcttgcgcctatcttttgtagctatagtggtgacaaaagaagaacctgagattctcagctctgagtagagcagcacagaaaaatgcagtcctgcaaagagacattttcaaaatctcacttccagttcacagccaatatctttgcaaaaggttaaaattaagaaaataacagtcatgttagttcaggttgtttcaggactctgagaaaaattcctaaaggtcttcttaaagttaacttggaagacagagccaggatgaggaatgaaataaaatggaatacactttttttttttcaaaacagcttcaggttggcaagattttgccatcaactggaaaatttcattgttttgcagaagtatatatttatatctcaagttgtactcctgatgatgctattcttaatgaatgtaagccaatctgtgatgaatgcctcttctcctaatgatggctaaataacgctttaagcaatcactgtctttgaaaaatgaaagcaacagttgcagttatcttgagaatacagggtcttgtctacaacctgtccccttctctttcttgccatcccaccctgggttggtaggaagatgaggggctgtataattccctccctagggtattacttcctgtggggtggctgagattcaacagcatcaaggtctccaccagggaggagaaaacctccctcagaaatgcatccatctacagggtactaaacagaagtcatgattatctgggttaaagttcttttggctttaatgctaagccactaattagtgtaaatgagatggcagaggcagaaggcaatgtttaatttgcttaagagggaaatataaaacaaaccttgattttaagtccttcagcttaaaaaacttactactggcagggtgcggtggctcacaagtgtaattccagcactttgggaggcagaggagggcagattacctgaggtcaggagctcgagaccagcctggccaacatggggaaaccccgtctctactaaaaatacaaaaattagctggcggtggtggtgtgcacctgtaaccccagctactcaggaggctgagataggagaatcgcttgaacccgggaggtgaaggttgcagtaagccaagatcgcgccactgcactccagcctgggtgacagagcgagacactgtcttaaaaaaaacaaaaaacaaaaacaaaaacaaaacttatacaggattaataatacaaataagcaatacaaatatgtggcaagctgacaatacttggaaagccttttttttttttttttgtagtaaatatagtttacaacagtggcaggtaaaaatgaaccctgaacctagaagcagagtactgagcttttgagcttagtgatgatacttgagtgataacggtcaaatcagttcactgggtggattctcatttatttatctgcaaataggcaataacaatacttgccctaacctctcccagtgttgctgtgaaaatcaaataaatataaaagtttattgctgtgcaaatgtaataattgactaccgcaatcagtaattacaaatatgtgttgactaccgcaatcagtaattacaaatatgtgttgaaattcatataaatcttatgtgagtttatgtgttttaaaaataatgtccaacacaaattaaatggtgtttatgtgccaagtactgttctaaaggttttataaacatcatcttacttagtcccccaaacaattatttcaggtagattgtacaattatccttactttataggttagcaaacagagattaaataacttgcccaaagtcatacagttggtagataacaaagcaatgattgaatctaagtcagctggagcctagagaccaagttcttacacatatagtgtcttcttaagggaggcatatggcacactgcctatcatctctctctctctccatccatccatccatccatccatctaccatcagcagatcagaccactgttagtatcttttgatttatggcttgatttctttatatcttttctactttttattaaaacctgaggcctttgattactttttttttttttttgaggtggactcttgctctgtcgcccaggctggagtgcagcggcacaatctcggctcactgcaacctctgcctcccaggttcaagtgattctaatgcctcagcctcccaagtatctgggattacaggtgcccaccaccatgcccagctaattttgtatttttagtagagatggggtttcgccatgttcgccaggctgaccttgaactcctgacttcaggtaatccacccgcctcagcctcccaaagtgctgggattacaggtgtgagccaccgcacctggccttattacttttgccctcaaaatataataaaaatttataacttaaaacaaaaaaggaggatggctgcctaaacgagcaaaaacagtgagtctgactttgaaatacattttgtgcctatttattccccaagacaagattagtttgcaattctgtactttgttgataatcctaaaggttctggagacaatccagtgtctatagtatcccctgcccctgccacacacatacacacatactcacatacacagcgacatgattctgagggccatattctaaaaatatttaagttctcttgagggacagacgaatgaacaggtgacacctattgtctaactaatcataagttttttacaacttccgtgattcactgataatcaggttcataaacatagatatagcaataaccaagtgagatgatgagctgaaaatgctccaaaacatgagaatgtaaagtattatcctcattcatatatattataaatcagtaaataatgaacaaacatttttggtagagcattcatgctcatgcaattggttttgacagtcactgctgaaatgggaattctacttctacacctgagctgtatgcaagctacttgatggtcatcctcttccaagatgagggacatttgttggtcagaggctaatataactttaaatttgaacccatcctaaaaaaagatttatctcactgactatccagatatcaacaatgtgtaattgaggtcatttcaactgctgagactattgtaatctagttggtcgacaggaaatcgattttgttcatggtcaattattttgcataaccacactttagtatattccttaggcatgcatgccagttggagaggaataagggtacacacaaacaaaaataaattaaaaaaatcaaataccctttctctttacattagaatccaaccagaagcataatttggttcagatactgatatttaggggaatgcacatatgcacaaatacgtgtgttcacactgaactctcactgtccaggctcttgttgaagcagcccagcaaatgaatcaaccatttgcagtgaactgagagctgtctgcattgcaaataccaaattactgccaaacaaccttcttgcccacggtggaatggatttggtggatgacatcgtatttaaaatattttaaggatcttaagtcaatattttgctgtaataataagcaaccaagtaacgacttgagtcgtgctcatatttttcatgatccctccctctcagcccttctactgatattctccgcactccatccatcccccttaggcagagtccttggagatataccagagtacaaggaaggaagagaatgacagaatggaaagggacatcaccaggtttgcattgtgatcaccacgctatgcatctacatccctgttgtgatgctgtggttcaaatctgtcagcagaactaaggcaggacaatcactcctgcaattctacttaaattgcaaaacagcaatgtggtttattggaaaatgtccaggtctggagcctggcctgagtcttcacccaatcactcactagctgtgcatctgtggtgagttgctcaactttcttgggtctgttttcttatcagcaaaatggtgtgtgtggaggggggcatactggtgagggactatggctttttcagcaggcatctgacacctcctagctctgtcaaagaaagtggcttttagatggagagttgtcagatcagtttgcctaaaatatctggtcagagatggtctggtcactgaaatgtggagacagccttaaagattttctggaaaggaacttaaactatctttctaaggagaaaacacaggaattctgcagaaaagcctgagaagagaggttgagaggccttcaaagagaagggaaaactgcctggtaaggtactgtcaaagatctgaaggacatgaaacctgcttaactgagaaattgttgaaggatagaaacaacctcttagccctgtaaagtaaactgccactgtggagagagggagaatgaaaataaaaggagctgacatgcgagccacttgaaggtctctttgaggcagatacattaacctccaccaagggagctgagccaggtgctctttcatggagcaaaggaactctagcttgaacatccagcaaaataagtatcagtgcagaatgcagtccaccaattcactctggaagtcagtctggaatcagaccaattcactccccaatattgttcagagaaaacgtgagattttctgttttgctttgttttttaaaggacaaaaaacaaccaaagacacaaaccaaatatcaacatcccttcagtcatgttttacttagatggccatcagtaactatgcaagcaattattaataatatacatacacaaaacaatataacaaaaattagcacattcaaagaaaaacagacattctgtaatttcaaagaaaggactaattggctttaaaatggactacaatcagagtagattgtattttaaattcacataaaagaggtatcctatgctaataaaatagtggaaatcattttactcacctctcttccctgagggtttccaagaatttggaagcattgcagagtagaacaattgccatagtgttacaaaacatctttaaaaaaggtcatcataatagtcctatatttcagtatatcgtatagtgatatttatgaataatgattatctctatttaataaagtcaactttattttgtggattagtaaataagatatacattttaattgtgtttggatacattatactttgacaagcattttagtgattgcaagaagtataattaacatttaatttttagtttttgtaaaatgtttgagaataaaagatatacctgttttgctgaaatatatactgcaattgaatatccaattattaatagattttttaattcaaaaatcctaacactctgacaataatgccttttaacaaaagacaaagacaaaacatacatatattttatcacataatcactttcattgtaacatagctgtgttaccagcctagaaaagaacctcctgggaattcatttcaaattattgaagcagctgtttcttcagtttaaaataaaatatccataacaagttcacacatgacagatgcaagctaaaaactagattccacagtgtgagctaaaagcagatgttttgaataatcatatttataaccagatatcatatttataaccagatacaataaatcttagttacctatagtaaggattcatgagcactcttttctatgaattggcttaaaatgtagttcctgtagtttcttagattttttagaactaggcttcattaaatacaaaaattctgtaaactcacatgtatttggtcatttttattcttgctcatttcatgtgcttcctcaagaataaaagcactgtcagggcactgacatttattatatttatttaatgctacacattctccccacccaactcaaagtcagaaaactctttcatttttgttaacaaactcatggctattagaaagagtgagaattttaagtctcagaatgagcagtttgcttggtgaaaagccactctagatctttagtgaatgttaatatgtaattagaactttaaaaaattataaacaatacaggtttgattaaaacttaattcaaaaaagtgaaaagttcaatgttgagagcgaaagcctagagttatcaaccatacgcttatgattgttttctactaaagttttgttttatagtatgtcacaaattttccccttccacgttaacttacatttctaaaccaaagcaatcatggcatagggggaaaagcacgtgatgcagcattgtaagacgggtttgtgttccgtctttgcctcttaccagttacacatttggactgaaggcagtgcaggctgattaattataggacttttctgtagcccttgctgttaactaaatgcactcagtgttaactaactgccctcaatgaaaggcaggcaaactatttatggaattatgagagaaatagagtgagatttctttcctttgttactgcagtcttgctattaccaacgagacagcaaatacagaaccaaaaaaaaaaaaaaaaaaagaaaagcccagtggaaattaccccttggtttgggaaataaaaatatcttcttgcagaatagctctgaaagttgccttagggtcactgcaagccctcttgtggtcattaactttcccccttcttcaataactgatgagctaatttctcatggcacagatcccatcagtgtttgttgtcaggaataaacatgaaattatacacacacacaattgctttgtaatatataggagttatgtttttagaaaattcacatatgttctcatgtgtgaatgtgcaatgggatgtacagtgatgcagtgaaacactgcttatcgttggtgcttattcgttaaatgttcagatatgtatcaagactatgggcaggccacttattcagtgtagccacaaccatggtgaagccttacatatagctttatactacagtgaaaacaggtcatcacctctgcatgatgctcttcattctgctgtaagacttctatgcagagctctgccagatgaagaatctcttccagctttctagcaggagatgcctggttcatggtctctatatgaaaaaaaatcataatcatgttaccttgaaaataaaaagccaaacatatttgaagacgtaatgatgagactagaatgttgaaatagaatgagaaataagaaatacaaatgaatacattatttagacaaaaaaaaaaaaacagttcaccagattgcaggaaatatttcacccacaaagcaatgacagggaactgcaagtgctttgccatttaatatataagaacaggtgcatcagcacattagatgctcaacttctgcaacaaacaagttataattctcctcaaggtcagcgacacaaagagagcagataccacagtcttttctttctctctgtattgtattatcagtacaataccattctcaccacatgattcattcctggcattagcaaaacccatgcttttttgttgctgtttaaattcccggcctgaaatgtctatagttcatgttgatcttaaattcaagaagtacaaagtcacctaaaacaactctgacagctagcaattgactgatttcctccctatttcccagccaccatcccaccccacctttccaactgagggggttgtgggggaggaaggcagaagtgttctttgaagctgaaggttctttctgcagtaagctgaactggtataaaaaggagagaccacaataagattaagtgcagttacctgaaattctgctacagagaaggcaaagtagttattttctaagattcaacaagctggcagaaattaaagaagccctgtgtaatgaaactgtttcaaaacaatgtaaagatcagttcccaataaggacattaaagataaatgttgtcggggattcataggctctttctctttgctcagcaaggaggttgtgaggaaagaaaatctaattttcagtaaaagagattcttctggggaacttaaagggcatttttttttcctacaatagttttcccttgatttacttcttcctaaaacctcagccttaaatttggaggagacactttcatttgctctgttctaacgtattccaaaggatgtacaatgatgcagtgaaacactgcttatgatcggtgctcattcattaaatattcattatatactcactgtagctcagacacagtgcaatgtactgatgtggggttcacatccctcaaccctcaagccatatacacttcctactatattcccctacagaatggaaagccattgctcctctgtgacaaggttcaaaaattacagtaattcttttgaaaaatcagtgtgaaacaccaaatagtcaagtgtgcctacaatgttgttggctgtaggaagtagaaggcagtatgagacacacttccaatctcaactcagaaccagaaaatctctactgaaaagatccatagacatgaatgatcaaatgtttcatctgtttcatgaacatttcaacatcctcaaagaagcatgaagtcaaggaggctcatgactttgcatgacaacctacttaatttgggggccgctctagctgttctaattttgtcaggaagagaaggcacctaggaaaagtttggaagcaacatgaggcaaacctattggtgatgcaggaaatgtgagggaggactgctgaaagcaggtctaggggagacatcgggggaaggtaagcctgaaacatggtcttagaaataacaaatgacctggggaagaggaggaggaatttttagagaagaaatactgtatgacacagatgaggtgcattttggaggaaggtggtaataacaaccattagaaatggtacagtttcaggcgggcagatcacctgaggtcaggagttcgaaaccagcctggccaacatggcgaaaccccatctctactaaaaatacaaaaattagctgggcccggtggtgggcacgtgtaatctcagctactcaggaggctgaggcaggagaatcgcttgaacctgggaggcagaggttgcagtgagccaatatcacaccattgcgctccagcctgggtgacagagggagactccatctcaaaaaaaaaaaaaaaagttacattttcttgagagccaattatgtgtcaggcacaagccagggcgcttcccacgtgttagcacacacattttcctaacagctttgttttttattcatgtaactcacagataaggaaacatgctcaaaaagataaatgcaacagctaaaaagcagtgaaggtgagacttgaacacgtgggctcttgtacttgcctggctggagtaagaatgtgctaagaatgatgggtgattatgggagactttaagtaagataataagtagactagatgactatatcctatgaataacttggggcaaatgtttcttagcagggcctcagaataaattaattttaggaaaatgtattttggtggttgcctccaacaaggattggtgaaagtgtctgatatggatcctgagggtctggtttagtagaacagtgaactatggaaagatgatagtaggaatagaaaagaagggaaagatgcacagacactccaaaggcagaatttgtgagccattgttgagtggctagaatttgcaggccagagaggagtatgactctgaggtttggagacctcatggctcagagaatgatgatgtatggttgataaagttaggtaatgggtcttcaatggaccatcccatatattttagcactaactacattgccacataagtgtgatttaaaataagttaaatattctaaactaaaaaaaattgtgcattgtaaaatctacaaacatgcagagttaggctatctgaatctttgcctgacaaactgctactctgcttcaagattctactttaatgctaccttaaaattggaccttctcagagttctgggtctgaatgagttgctcctttctctgagctcccctattacaggctcatgagtctgttgctaaactgtactagatcaaagtcagcaactgggtctcattcatatagttatcttgtgcaggctttggaccatggcaggtatttaatgaatgtttactgagaatgcagcagaataattatgggaggaaaagaatgttaaaaaattcaatcaatacccccaaatttttaattttgcatgcgattgcaaagagctcatctgtatctaatacatcaagggtggataagagagcatgctcacgataaaacgcagctgtagtctgagaacacttctcaaataactgacaaatgtttagttctgaaattcttaaagaaaaagctttcttcagaaacaaaaactttgtcagaaaatgtcttcaaaataacttttaagcctcaagagcatatcacttatctttcttaatttctccatttttagatgaagagtattaagtttgggagtcagagggttcttgaaccccttaaattatgtactaatttttgtatgtagaggcatttttggggtgggggagaaagaccgtatctttcatcagattctcaaagttgtctataaaccaaacagatgctaagaagcactgaaccagataatttctaaaattccttctggctgaggcaatctatgcctcccataaatattgcacttatatattgcattatattatttcaatggactcatatatgtgtataacatgtttttcataaagaaaaaggaaataaaatttatttatgtatcaaagattagaaatttatttctcctacatacttccgtgctagggactagcactatttgaatctttgcctaactctgcatgtttgcacattttacaatgcacaatattgtttcagtttagaatatttaacttattttaaatcactgaagtatataggagaaataaatcctgcatactcttctgaatcctcagaagcattctgcaaattagataatcatgatcctccatttccagagtcttggagaggttgaaggtgtctgaggttatacagtttgttgctggctgagatgacattaaaatcttacctctgatgtcatacagacagaaataatattacaatgacttgaattactataattctttttcattttcaactttctgaataaaaatcacacacaaatgcccccattccacatctttagccacaagtatggaataatagaaaggaatcacagaaccaacctcagaacttattatatgtgaatctttcaaaatcagctattacatgtgacactatcttaagtacaaactctgagagtaccctgtgttctagtgaaatttaaaaacattctaaaacatttattctttctagattaaatttattgaggatcaaaactttgtacttgaacataatagccactctaatactttaaatagatgcatttttatcaagtactctgtgtatcccgtctctggtttcacccatttggctaaggccaagaagtttaatgcattctacagtcataattctattagataacaaggttatcaatagccccattaaaaagccgaacattgggaatatttgagaattcttccttaaaatgtttgttttcactcattttgtaacatttccaaagcattacagatggctctacatccttcaagcttcacaccaaattgctgattgttgtaatacatttcaaacagtgacatttaaaacaaacatgccaaaagtagcaaagttgcttgatgaatttcaatgcattgttcttggctatgattcttctttgctctggaacacttttggttttctgtaacactccttggctcattgaaacaattcatttttaattatacctccatacatttaagaagagatcctactggggaaggggagggaggatggaaagatgtaaaaagacagctcgactgtttgctttggtagggtttcattctactccatggcttagaaaggggcatatctcctggcacactggactgggctgcctcccttgctgctattccctgtcaaagtccccgtgatggatgcacagtgatgctcatggtgaagcttataccaggatgtgggaagaagaccagtgagataccttcctttttatccgtatatgatatgtagtaatttgtcatgctttgaccttaactttaaaattttttaaattgatgaaaaagtatttgctaataaccctacatgatgatttatgtatatattatgtaacaattgtcacaaattaattttgatgagagattttaaatgtcctcacctccactcaccatgatcttaaatttaatgagctgattgtatctgtacttgcagctaaacaataaatagtgttgaagatggtgttagactgaaggactatggaaataattccattccaatactgccctatcttcttccctcctttgcatctaggccatgatgatcagctagggagcatgaaaaaataattcctgtatatgcattcatttcttctttggtttttaaactcctcagattccgtggccctgaatttgattcaacaaacattttattccatgtaaggtacttcgctagccactgaggggatacaatgattaaaaagatattatttctgccttcaaagaatttacatatatctctttctaaccagattataaggtagaatatggcaacctataatccatttctggtcaacataaagaagatctgttataaagtctgtaaagagagtgaattaaatgtaagcagtatgtaagaacagggttattagcttgcaagaaataggatcaaagatgcatcaataagaaggctttaaattgctgtgtatatcatatggagtttttcagaatgaaattattgtggtgggtatgtgttcgagtttagaaagctagcaacagtccaaagtggaagtctttcacctcttccccctcccattcagagaaaagcattcactcactcctctgcttcttccctctccagctaatgactatatatcagatggataatgaaaaagtcctgacgttcaggagatggctgaggtgagaaacacaaaaatcttcataagggactatagggataacttcagaaaatcagaaaagaggtgtggaaaaagggagaaaatgggaaaatatctactatctagtgaaacaagggaaaggaaggactatagtttggcaatagcagggatatgagcacaaggaagcagtcacctggggcactctctgaagtgaggcccaaacagcgaggctttaccttgagagcctgtaaagaacaaggacattacggccaaaggcacagcatctaatttcttctacgtggaaccccaaatgtcagccagtaacaaggactgtcagcctactcttgtggactgcttgctggcaaaacttatctaccattaggcccagctgaagaaatggtggaatggatccttccttttccctctccccactaaaggagatagtgattgatcccctagctgttccccctgcagaaatataaagcaacattacattacacactctcacacacatatacacaatgctttgggcacataaacaaattgttctaattacagagatcagaaaatactctatcttaggtaactcatcaatgttagatgccttctgttcatttataaaccataatcccctggccaggcacggtggctcatgcctgtaatcccagcactttgggaagctgaggtgggtggatcacttgatattaggagttcgaggccagcctggccaacatggtgaaaccccgtctctattaaaaaaaaaaaaaaaaaatagcctggcgtggtggcacacgcctgtaatcccagctacttgggaggctgaggcagaagaattgcttgaacctgggaggcagaggttgcagtgagccgagatcgcgccactgcaccccagtctgggtgacagagtgagactccgtctcaaaataaataaataaaaataaaaataaataaataaaccataagtccctttagtctaccttagctagccagggaatttctactggatccccagtctactctaatttgaatcttaactctgatatcaacatcctccctctttgcatagtacagactgatgactcagttggaaagtctaaatttttatctagattttctgacccttcctccagctctggccatagcaacctgtggtaagttacatggtgccaaagtctagggcaagtaggctccaggaggtcaatcctggccacatctcaatacttataggctttcttatttcaagataagagagtgggaaattaggtacttccttgcccattaaaaaaacaacccattcctgtccctgccatctgtctgccagtttttagaacttgtggctaggtgcacctaaggaacttttggactcagtaccctaaaggagatagtatacaactttgtaagaagactgcctcaaaatctgggggtgaggtggttcccaaaagccaacttactttttcagttctttagggtcaagtggcctataattgctccactatctgtgacatcgctaagatgtggcactgccaactaatgaaagaaaatgaggaatcattgactctctcctggtttatctgactgaaacccaaatgatattatggttccacaagtgttggactatgtactgctttcatcaatgaatggagtaccttcagtatagatctccatttcttggcttaagcatgcatcagaatcacctggaggacttgctaaaacacaaattgcttggcatcattccgaatttctgattcagtaggtcttggatgaatcccaagaatttgcatttctaacaagttgccaggtgatgctcatgatgctggtgtagggaatgcacttcgagaactaccagtagttacgaaaaacaaagttaaaaaacaaaggtgacctacgtaaactttgattatttcctcctttccctgaaatcaagctatacttttatataaacctcatttcaggtaaaaggtgactttttctgcagaatctgaactgattgccagataggatagtgtccacatttgggcaatcctatatataaatgaaaataattaatccaggatggtatagcctcccgataggtatttaaaatccacacaaatactaatgccacatttgtttgaaaacaataggtctgtggcctcctaattccatggcttcctttgggaccaactcatttaatgaccctgccatttaaagtaagagttgcagttaatattctcccggaattaaccatgctaataatatagtgctttggaataattgttctgtcatcacagtcacattaactactttacctagattatctttcgcatctgtaaattcattgtaagcctatggccagctgttgaacaaaggagaattggccactagagtatagaccaatgacagctgggctgaatccaaactgagcagtctccataagccaacagtaagtgctgacccatgactggtgagccataaaatgtcagatacatgtgaggtaaaagtcagtgactctgtaagactatcttggggtggaatattgaggcataatcttctctaaagatcttaaagagatgatagtgatggaattacagagaatagattactagaacccacaagcaaaaattagtatttggtttatcatttgtcacaggcttctattcttacatgatttatgaggcgggaaacacattcggcccaatttgagttttattaaagttgtcttttcattgagaccttggctctcccaaagtttatgaagtaagaaaagctctcacagggacgaatatatctacagcattgctggctgcaaagactgtgaaggcttgagggagaagaaagttttctatgctgtctacttactttgctctggatagctctggatataactgtgttataggattttaatgatagcataaaatttttccagtgttaattttgccagctaattgtgtaatagctttttttaaaaaaattatttttttggacagggtcttgctctgtcacccaggctggggtgcagtggcgtgatcatgtctcactgcagcctcgaacccccaggccccaggcccaagcaatcctcccacctcagcctcctaagtagctggaggagtgcaccaccacgcccaactaattaagtttctttttatacagacggggtctcactatgttgctcaggctcatctcgaattcctgagctcaagtgatccatctttatcaggctcccaaagtgctgggattacattcgtgagccaccatactcagccatacatttttttaaagattgatctttgctgggtgccatggttcatgcctgtaatccctgcacattgggaggctgaggtgggtggattgcttgggttcaggagttcaagaccagcctgggcaacgtggcgaaaccctatctctaccaaaaaaaaaaaaaaaaaaaaaaaaaattatccaggcatggtggtgtgtgcctgtggtcccaagctactcaggaagctgagggtggaggatcgtttgagcccacctgggaggcagaggctacggtgagctgtgattgcaccagtgcactccagcctaggtgacagagtgagaccctgtctcaaaaaagactgttctttagccatgtcatatacacaatatatgtgtatatacacatatacacattcagtagctgaaactgatgaatagtcccctccctggtgtgttgttctttatatatacattgtatccatttttttctaaatattattcaaattcagaaactgaaaatcaaatactgaatcacataaagtctatagcatctttagtatcatgcctattccttcctgttttttaagtgtacttacctaatacattctttccatgtcatttgttttattcataaaaggaggaccaacacgcctccactctcatttcctgcctgacccttgctttaactcttttttccatactcaaggagaatgtttgcctgtgaacaatggggatacaggcaaggcagagcacagcaaggcacaaagatgaagatggtctgttcagtgggcaatggcaggggacagggactccagagacttgccagctgcaaggcaattgaaggagaaggaaagagaagatatttggagacagtaaccacaatatgaaatataacatttgaaaagatttgcagccttgggtgatgagaaatgagtcaaaagatctcaatgtctgcatgtatgtctttgtttcctttgatacataatcaaggtcttctagggcatgctaagatttagagaaagtctcccaattggcaagtgtaaaagaccaggtttacagagtagggttgggcttagtgccactttgaatatttctacagctctaacatcacaaatttgccaatcactgtgaatgtgtgtgcatgcattgatgcctcatggatattttaaagggctcctctttgaaattaaaatataaatgtgtgtcttttaaaaagcttcaattaggccttttaatttattgcttgaaactatatggtcacttagctagggcctacaagtaatgaacccttcttaatttgccaaactatttcatctgtgcagtctttgggtacttataaaccctgttgataaatacagaggtagaaacctgtcagttttcatcactctagttttgtacaattggaaaagactttttcatacatgtaacctactcagattaacaaggtgccatgaaagccatgctgctatgtctcttggtgtacctgttggcacctgttagtaagtaaatgagaggtcaccagttagttgctttcaaattcagtctctggagattgacaaattctataaaattgcttgcgaaaggaagaagccttgttatttcaagactgcatttatctgtgaatcccattctatataaaagtaaaaaaacaacaagtacatgacacactgtcaagtgagctgagcaaactgacatccttctggataccttttagaaaacaggtgttgaacacttgtaatgagatttccatgcatcttcagaggaagtaggaaagattctagcaagagctgttcagagtgttacagatcatggccaaggaaataattccgaataaggaacaaactgaagaagacattacataaatgccgtgtgtgtgtgtgtgtgtgtgttttaactttttcttttttcttttcttttttagaagacacatatccaccagacagaagtattttgaagtatataatttttccagatcgtggggaatctgggatatatttaattaactatttctgaactgttatctaagtgttttatttatttctatgtagaaaatgaactaaaatgggggcacgctatgttttataagaaagttaaaaattttgttttaactcagatactagacaaacttggaaaatcatctaagaagtgagaaagtaaaaataaccattggggataattacaataaagagtactaaatttatagtggtattttcttcattgcatttagatctataatctctctggagaacaagtttctattacagaggaattgagttcatctgtatacattaaataagcccatctttcaaataacacttcccaaacactgtatcattttaccactgatttgtctcccatgtttgctatagatgaagtatgtcaggctctcatttatagatggatctgaccctatgcttgtagtcgtctgccggatcatgggctttggtgatggctttgtaacttgtcttagataacacttttttttttctaagttgacttagttattcagtatactttatttaaattttaaggtaaatttatcaagttctttaaaaaactagaattttgatggatactgcaatgaatttatacattaatttgagggaagaatttatatcttatattattaagtcatccctcctaggtcatggaatagctctatctctatctagattactttctatgacttgtgagtttcaaaattttcttcatagaggtctataaagtttcgcatgtttttatcaaagctaattcctggataccttacagtttggttgttactgtgaaagttatctcatttttgttaatattttttagctagtggattgatggagtggagcagtggttctcaatgtgtggcccatgaaccactgggaagaccacctaaaacctttcagggatctgcaagattaaaattactttcataaataatactaaatgtttttgccttttacatcctgttgacatttacactaatggtgcaaaagcaatagtacgtaaaaatcaccgttgccttagcatgaatcaaggctgtggttgcaaatcataattgtcactgtattctttaacaccatgcactcaagtaaaagaaaaagccagtatcatataaagctgtacttgatgaaacagtaaaaatattactttgattaaacctctgcccttgagtgtatgtgtatacctatacatatatatacacacatatatatatatatatatatttttttttttttgagacggagttttgctgttgttgcccaggctggagtacagtggcgcaatcacggctcactgcaacctctgcctcccaggttcaagcgatactcctgcttcagcctcccgagtagctgggactacagccatgcaccactatgcctggctaagtttgtatttttttagtagagatggggtttctccatgttggtcaggctggtctcgaactcctgacctcaggtgatccgcccaccttggcctcccaaagtgctgggattacaggcatgagccactgtacccggcagagtatacatttttaaatagtatgtgtgacaaaatgggaagtttgcctaaagaacttttgcatattgaagtacaatgaatgactgtctcaaggaaaagcatttgtgtgactatctgcatccagggcctctctcctccccacacttacagaatcatttttggtagaaaagagtactgacaatgtatagttattcagagttggctatttggcagacattttctgagaaaacaaatgaataaagtaaacatgtcactttaagaaaaacaaccagtgtttgttaccacaatgctattattagagtcttcaaggaaaattagaattttagaaaacttgtatctgttataaacttgatagcttctcaatactttaagatgtttctgatgagaagggtgatattaaaagtggtgatatttttgatataatacttgctaatatagggataactcacaaaaccaatattttccaaataatacgtgaagttgaaaaatcatgcacacacacagcttttttttaaaatatatatcacaaaactaagtttcaatttggtccctatccaggtgatcacacatactagatcagtatagctcaagcaatgagtttttacaaatcatacatgtattgctttataaactaaaaccttgaacaaatttataatttcctaaatattctaaagaaaaagacaacaggttactgtctttgttttaaagcaaacaatttgtatctaacaatttgtccctcatcaacaggtgacttagaagcagaaatggtcacagaggttttactttcaggccaagttctcattatccaagccacactgtccaaaaagctaaatggaaattctttaattacctgttcaattctttttagggtgaggattcagtttaagatacaaattactttttgccattgtcggtgcctatgggaacatgaaatttcaggtctattatttaggtgtcagaaacttcagttcatggggacacacaatactcaaaattcaaattaacttcctaaggagccacataaaacttttatcagagaaaactgttatatcatcttagaaatattagtaaaaattattcaccattaacaaaaatttgccacaaactgtgcagtttttttttttaataaacacgtggcctctagacacaaacattcttaagtagaacagattttatttattacttattgctatcgtgtacaatggagtgttaaattaaaacaccacccagatgacacacacatcctaatgatataaggactgccacagtacaacttctcctctcaaagacagtaggcagtctgggcctctgggaaagcatctctaccccattcaactgaggctctgaaaataagaacacaggggttaaacctgggaacctggcaactagaaggccaagaaaaatcctcacctcccaaagactttgcttattcattccatgctaccttttgttcagggcacctccacatttctaggttcaccataagcctaggtaccaagtctatgcaaaagatctcatgtccaggcaagtcctaaggcgcagtctccccttttatatcttaaatcacaatatgctatataattttcaggaaacagtaggaactgttatcaaatgtatgactgcgctcttgtctgtgagaaagtctttgaaccaaagaacaaattgattcttcttttaaaataatatctaatttgcatcaacaaggcacatgatttaaaaaacaattaggaaacatgatgcttcagtgttatctctgcatgccagaattacaagtaaaaaaaagatctcactattatttagctagtaggttagtgataaaattaaagcaaaggagaaaactacttgatttttaatagggtaagtcaaagatttcttaacacaaaagaggcaattcaatgaaatggtagcattttataaccccaagattaaaaacagctgctttctagaaatgtccagttttcaaaataactgtttctatgaaacatgcaaataattcccaagaaagaaagaagacatttagagggaagtcctttgttttatttaacccattatgaaatttaaaaatccttttattctgcaaatttgtgctgccagtggagaattggaagaattcccaatggaagagaactatgatgatggaagagaactatgagtcacaattaagcagcacactgaattacaaaaacaatcaaaacaggctagattactgggcattgttaatgtaactgccatctataacctctggcttctctgatccagcattagtgcttcccccacttcttcctgccgtgataagagcaagaaattatggcttaatttttccaatcctgttattttagtgttagtttttgccctaaattttaattatttagtaattggtttgaaagactttttgcaagccagcttgccagtttatggatgttctttctgctattatgtagcttgataaattcatttgtttatccaataaatatttactgagtaccaaatatgtgctgggcacatctcttggcactgtggataagaagttgttaaaatacaaaattgtctgtcctcctggaactaacattctaggacaataagtgggatgaatgcactatacattgtgttggattataataagcgctgtggaagaaaataaagcaggagagggggataaatcttctggactgggggtaagttttgcaaatttgaatcactttcaacacctgacatcgtgaggaatgtggggaaaaataaacaaaaagattttagcccagtgcaaatttaactagacaagctcgtcaagggcggggagtgtaagaagagatcaacagacagacagtgggctctgaacctcccacttactagctatgggactgtagacacactacataacctctcaggttcagttttctgagaagaagtaataataatgatactatttattgcaaagtattgtcttaagaagtaaattgagttgcctgtaatcccagcactttgggaggccgaggtgggtggatcacgaggtcaggggtttgagaccagcctggccagcatggtgaaaccccggctctactaaaaatacaaaaattatctgggaggcagaggttgcagtgggccaagatcgtgccactgcacaccagcctgggtgacgaagcaagacttcatcgggggcgggggtgggggtggggagggaaacaaagaagtaaattagttgatacatcacatataaaatgcttagaatagtgcctggtatataagcattttctctttttactaaataattatcattatttttggaaagagtggcttttattaatattaatctttggcttttgtgacgcagctgaggtgtttatcataaaatgtcattactttgaatcagtcttggaggcatggcagccagtgaaaagaatgtgaagagggctctggtgtctgagagatgcaagtatgaatctcatatctgctcagttttaatggcaacagcaggaccttgtgcaagttaacgctttttttcagaagtctcagtgaactctccataaaatacctattttgtagagctatttaagcaactaatgaagcagtataaatagaaagcctttgggacaggccaggcactgtggctcatgcttgtaatcccggcactttgggaggctgaggctggtggatcacctgaggtcaggagttcaagatcagcctggccaacatggtgaaaccccatctctaccaaaaatacaaaaaattagccaggcgtggtggcagatgcctgtaatcccagctacttgtaaagctgaggcaggagaaccacttgaactcgggaggcggaggttgcagtgagttgagattgtaccagtgcactccagcctgggcaacaaggcaagactctgttaaaataaaaaaaaaaaaaaaaaagaaaaaaagaaaagaaaacctctgggacacataggcagtcagtagatgacaaaatcatgatgaattttgggtacagctttactcttttctagagggtataaactgaggaaaattattggaatgctcaagagactacaagagactacagtgtcaaagtattatcaagccatctgagttctttagttctttcacatgtaattgatattttcattgttacccacttttaaaagcatcaccccaccaagaacatttacaaggtaaccctgctaggttaccttgctaccaaatgcaaataacatgatataactaatatatataatatattttttggagacagggtctccttctgtcacccacgctggattgcagtggcacaatcatggctcactgcagtcttaaactcctaagttcacgcagtcctcctgcctcagccttatgagtagctgggactacaggtatgcgctactatacttggctatttgaggcgtgtgtgtgtgtgtgtggagatggggtctcactatgtttcctaggctagtcttgaactcctgggttcaagtgatcctcctgcctcagcctcccaaagttctgggatcacaggcatgagccaccatgctctccctggaatataacaacatttctaaaaaacccctatcttctgttacttcagaacattcttaaatttagttttcccttcaatcaatttaaattacataaattacattgatttttctttgtgtttttttggttttttttttttttgagatggagttttgctcttgttgcctaggctggagcgcaatggcaccacctcggctcactgtaacttctgcctcccaggttcaagtgattctcctgcctcagccacccaagtagctgggattgcaggcatgcacccccactccaagctaattttgtatttttagtagagacagggtttcaccatgttggtcaggctggtcttgaactcctgacctcaagtgatccacccattttggctccccaaagtgctggaattacaggcgtgagccattgtgactggccgatttttctcttttctaaacaagcatttcattttaataaaagtatatttcctagagttgccgacctgtacagttgaccagtggtatggattgctaagtcactgtgaggagaagatttctgtttggttgaagcaaggtatatatgggacaagtcccttttgttctctcctctctttaaggagatcaggcaactctacacatggcctctgccccaggcttcaaaaaggggcactctgaccctttcatatctcccaggggaagaagcatagcttctggaggttaaggatcacctaagtccagccccagctggctgagttatttactccatggcagctggaaagccacgaacaaccctgaacttcttgtttgtaaactaggatgaaagctgtttctacaacaggaatgttgtaggggagaaaatgccttaagaggtttgaaaaagtttgctaaagagcatcggattgttgctattacaatgtgctgtcataagaggtgacaatcagtcccatatttttttctaattcatttttctctaaagtgcacttagcaatcattgtaggtgtgttctttctcctcttcgtggctctgagtgttttgttcctgtcactttctggggtcaaatattgaaaaaggtaggggaaaaaaaaaagaaagaaatagagcccttaatagaagacttcagttaaaaacaacccaagcaaacttgcttataacattgcatacaaaatttgaccaaaatgagaaaactaggattaggaagtttcatcacttgtctctcacttcattgttttcagatggaactaactaatctcctacctctctccaaagtccagagtgcctactttgtgtcagcagacacagtggtgggtgctgggaatacaacagtgaacaagtcagtaaggaccctgcctgcatggggctgaagagaagacagagaggagaaacacatcataacaggcacacgtagttaaatgaataattgtgataagggatgcaagaaaaaaataatagaacgttaaaaaattcagcgactcagcgaactctttcctagcaatttcctgatgggatttcataacccttgttcattcctgtgattaacaactttcaaagttaataactgcttactttttatttaatagcatttatgctttttattctgttattttcaagagtgataaaggaaaatggtcctcttttcttgttgtaagagcccttcaaatatctgtgacagcttccaagtaagattggtggatatgcttaaaacataatgcataccattcatatagcctcaggttttttgctttaaatttgtatcaaaaatattgctgaatttttagagatgaatggcctatactttacctacaaagtattagcaatcattctgacaaaatcaaagcattttcagaattcctaatcaaaatgatctaatagaagccctgagaaaaagagagctattcatcaatgacaaaacatcacactaccaacagcaatggaaacaacaaaattaaaaaggcaatgtacagaatgggagaaaatatttgcacaccatacatttgagaaagggttcatatccaaactatttaagtaactcctataacttaacagcagaaacccaaatagcccaacttaaaaatgaaaaaagaaactgaatagacattgctcaaaagacatacaaataaatggccaacacataaatgaaaaggtgctcaacatcactaatcttcagggaaatgcaaatcaaaaccacaatgagatatcatctcacacctgttgggacgactattatttaaaatgaacaaacaaacaaaacaagagatagcaagtactggcaaggatgtggagaaaaaagaactcttgtatactattggtagaaatgtaattaggtgcagccactatgaaaaatagtatggaggcttctgtaaaaataaaatatggaactccaaaggattcagcaatctcacttctgggtatacaaccaaaaaaattgaaatcaggatctcaaagagatatctgctctcccatgttcattgcagcattattcattgaaagcaacctaaatgttcattgagagatgaatggatgaagaaaatgcataatatacatacaatagaatattattcagccttaaaaaaacaaatttctggcttaatagtaaaataagccagtcacagtacataataacacatgataccacttatatgaggaatctaaaagagttaaactcatagaagcagagagtagaacagtcactgctaggggctgggagaagagaacatgaagcggtattattcacagggcacaaagtctaagttattcaagatatagaagttctagggacctattatacagcagaatgcctatagttagcaatatagtacactttaagaaattgcaaagagggtagctcttgtgttaaatatttttatcataaaatattaataataataaagagggcaggaggaaactttcgtaggtgatgaacaggtttatgctatagattgcaatgatcgtttcacagctatttacctccaaattcatcaagttgtgtacattaaatatgtacagcttgcctgtcaatcatgtctcaacaaagtgctttaaaaatatcacaccaccacatgagaaataatggcttgtgcatgcagaaatattaattacctgtttccttttctgctgggcctaaaacataagaaaagagaatttaggagaaaagcaaactctacccttgtcgttcatataatgtaaaaggccactttctaacttaagtttgatttggttcttagtctagtcctgaggataaaacataaatactttttttttcttttttaagaaaaaagtagggggagagggagatgatgaaaaacatggaagtttttctcacctaatgagcaagcattttgttgttgctattttttaaagaagactgctcagcattcctaccacagtgggttgctaggatccattttccagaatattcttccattagaccagagataagagagaagtgacttcagaaagggaaaaggtaggagagtttcccgctcactgtccattgggtactaccataggctcttgtctaacagagacttgtttttatgtgtacaataaaaaggttctttatccatttaaaatggattctatggctataaaatacaaagataaagtgcactgcatatatcttttctgtatccgtggacaagttaatagtcaaaaatattaactcagttgagagcaaaatgattcttacaggtttttttgggtagagtacataacatttacataaaacaatatggtgtttattcaagttccccacaacttttatctttgccagatctgaaaggctttaatatgtctattttaatatcatttcttccaatctgtgtcagaatactcaatgctcccaaaacatgaaaattatttgaatgagtatttaagactgaaacccaatgtgtttatcttccactttccccgaatgatcaaatgttcattgcttttgctttaacacaacatgatatcataattaatgaagttaaaatggtaactaaggaggtttcatgttgttactctcgtgatataatgttggttgttatggtgatgagatggcttttttgttaatcactcaggaggttggttatcgtatgcttgttagaaagcttgaccagatttggagagaagaaaggaataataacacaaacaattatcatcaatctttttccctacctgaattttggtaaaactatactaatatcaactgcttcataaatctatgattccttgagtaccattttatataaaaagttactaaaattttataaaggattatttacttttattttcaggtaagaaacttttattttcagataagtatttaacattaactgcattttttccctctattagttaatcctgcatgtattattatgaaagccagttttatgacaatttgagcaaaaaatgtgaggcctgttacttttaattacataaattaatgtgttgaataaaactgttgaataaaagctgattttgtgactttgccacaaattccaatctacttatttctaaacatttaaaaaattagtatccttaatgaataaagcctgaagaaagaaaaaaaaaaaaagcacagttctctcaagagatctaatctttcaaatgcatcagtacattgcaagcaattaaaaaccgaaggaagttctatgagtttatttcagccctcaataatcaacaagtttcttttttgagtgatactgcagaacagaaaataaaattacataatactacactgttactgatcaggaaagattttgctgcctatagtttaaatgttagacatacttaaagtactgccaaaaaatacaacccatgaaaacaccttttggttttttcaaaactcaaaataagaacaaaggacaacttaagcacgaatcctgggtctttcattcaagcagagtcccaggaggcatattaaagcaatgaataggaaaaagctcttcagttcaccagctgagattttaatgagacatttccctttgccatggcacaggattgttcaggaaaggaaaggacttctcatagaaaattcagttactaggcattgttggctctcactgccacttcgacaattgctcactgcactgaccttctattttggcatattctgtgagtctagtgtaattgatcaaggcagctttctcgagacattttctgaccactttcttcacctcttctgctggtatgggagtggcaatatctttcattaaaacctacagagagaggaagtggaagggtgaggggcagggttggggatagacagatggaagaaaaaagacagatgttgcataaaataaatactaaagacaaattacacaaattgtccttgatctgactattattagggagaggggtcctaggtaacctggggggatgtaatgggtctgcaatgcacttcccaactgagaatgtaatcctcccaccttagctcctcctaagcctaatttatgcatatcaaaacctcccctagaccaggtcaccattcagtgtgactgtcacttttcttccagggacccatgacaccattaaagcagctgtttcagataaagattacagttctcgggacaaataatagtttgttttgcacatccctaatttaaaagccttgagtcttttgagcaatatatttgagaacaataacaaaaattccattaagaataagcataatctttgagctctgaaaaaaaaaaaatcaagacctctaatctcactaaattttaatgattgtgatttgctgtgaataccacggcagtgtattcaaagagggagaaggagacctctttgccttagtgaaatgaatgcttatgaagtatcgaatgttaaaatacataaaaactttctatggttttaaaaaataactgattattctctgttgggctcctaaaatgtgtttttggacttttcctttaaaaatgttattactgggcaaggggaaaatgcaattacatccagaattcaaaatgtaatgtatttataaacactgttacattgactcataattttctttaaaaccttcataatgataaaactgctcacattaagttttgattacactattagtaaaactatctttctgcatatttaatgcatttattcttgctttactttcattcagattacaaaacatatggcagaatgttaatatagagaagacaatgctttcgtaagtgctctatttctatgtcttatattgaaaggaatattgaaagaatatgaaaacatccatttcatgctgtattatttcattctcttgtaagtcagcctcagcactaaggattttatcatccctgatttatttaatcatccaagtatcagtgacctttgacaacattttttaaaggctactctttgatgacattttaaatattttgttaggcaaggttttcttttttgaaaatagcaaactttatcattctctctctatcaaattcaattattctgacaaatatttagcactttaattagcactgcacattagactttgcagccagaaaaatccttttgtgcatagtaaaaaatatacatgcaccattaaatgtgattattactaaactttaagattaattttgtttcatatgcggaaccacgaacgttactattatacttcccatggcaacaaactttacataacaaaaatggctgttaaagttagaatgtatatgtctcccaggtaatatttcatattatctgggaaccagaaacttactttctggcaaagtacaggtaaagggctggcaaatgcaaaaagggagatgccaacctcgatttcctgctgcatcccatgttcttccgaggtatcataggtttcaagaattcacatgcatatttttgttttacttttcaatatcagtaagtaaagagaaataaaaatgaagaaatgacccttaacatttctgtctcaattcagcaggagatgtgatcagtgactataactggaataaaggtccctgttcatcctgccacctgtcaatggagggcaggagggcatcctgccatcactaagtcttccctactggggggcagaaaggaggctctgccatggaaaccaggacatggagaagctgtattaggtacccacgatgggatgttgttccaaaaaataaagcaatccttaaggatttttattcataataccttaatgaataggatgacatgaatactttgaaaaatctgagttatgtgcagctttcagtattataaaaattctaataaaacataattacaacaatcacatttctatcacacaatccacaacaatcagggataagacagggatataaaaataaaattaatctgtaatcctaagatctcattttaatcatcagttgtagtcctcatctcccaagttcttaaatcaatgaaatggagatgtaatatctggacaatgtcttctctctttgctttttaatagagatgctaataaacaatatagtatctaaaattaattcagcagaaaatggacaagatcaagtgttagaagtcaataaatcaggattacaataatcaaattatgagctacagatgaatctagaaattcattttaattctggtaagaaatgggagttggccacattatttaactgttagcatctaacaagtatatgaataaaattacagacagatgaaaaaatactgctctttgaaacttcagttgtcataaaaataggaatagagaatatattttccttaaaaaatgatttttttcacctggattaaaaatcttgtttgctggttattttgtgggggagaaacatttctataatatgtgaattcatttaaggtaacacatacactggaataattgaaagaaattctgagatgaatattgaatgaatgaaatgatatatttgtgaatggtaaatgataaacttgttggcatgaggactacgacaggtagaagtacaaataaagttggaggataataaaagacaactgtaaagtctgagaagcaaaaacaattattcttaactgaaaaaaaagtatttcatgagggaaataaagaggtaggaaaaatgattactaccaaaaagatgccataatatgaggataggatttcagtgtgaggcttcagaaaggcttcagggagaatgaagtgctgtagacagagtctgaatgtagtaagaaaaggtgagaaactcatgacttgtgatggaatcagtagagagcatagaataacggggtctgtctccctagttcaataactaaaatacacagcaactgagaaagcaaatagtatttataaagtaatgttcaaacataccctttcaagtaatgaaagtgtagcttttagagcaccttcaggtcgtccaaagggaaaacagtatctttaaaaacaaaagaaagaacaaaagagtcaaacatttaatacccaagactgctaaataattcctgcttgtattacttggcattaatgaagaaccatgaaacaaacagaaaatattatagcatgaactcatccagggaaattttaactattaaaagtttacctaaccctaggatttcaaagacttaaacaataaaagtataagctgtgatgaaaaaggttttaaacgttttgatgatacttgttttaaaagaatacagtaaataaaagaacctcaagggtcatgagtaaagcgataatatgcattctgcaataatttcttgtttaagaattgttattcaagttctaagagaaaatgaaataatttccctcatttcctcctgtggctacttgtggtttagggtggccacatataccacagcaagattccagctctttcctttgctgacatttgcctgtctaccatgatgtctaattttctacctccccatacaatacacataaaccctctgcagttcttttgaatacagtcatttgtcccaaatatttctagttctacatattcctactgcacaccaacaaatgaaggacaggtcatggggatgttctgaaatcagtgtcagacaaggctggattgtgagtgggctactcagaatttcatggctacctgatggtaacaggtttattgctctttaccagggggtcctgcttcaggtcaatttccacttaaacaatactgaacatcagggccatttcatctttttggagctccttgctttgctgaaccagattcagcaaagtgcctcctcccaggactgcagttcccacctcaggatcaagtgctacaggcagctgggctgtacttaggatggcaccttgctctgacttagaaatctgcaaactaataacttggaaagaagtttatgtatctccatgtcattttgcataaatcaggcacttggtggacatattttctcagatataataaaattatatttctcacaccataatttaaacatatttcccccaaaagcacatatgttaagtttaacttgttttatacaactattttttaatagaagagattgatttctcctttttaaaacaaaacagcagtttaatttatattaggattggattttatattcgtgaaactttcattagtctcacacagatgcaaataaatgttatataaatctagtcactcaagttttttttttaacagaatatcacatttatcattgtatttactgctaaaaatgtcctttcttaatcttgctgctacatactccgctactctccacccacacgcacaagaaagccataaccaatttattttgatagtttcttctgtgcagtggtgcttttaagagcattagcaaattagcaaagtacctttaatcattttgtatattataaaccttaatccacgtttaaataaaacacaaattgggttcttgtagtcccctccccctgcttaatcttttcagtgtatttgcataatccatccattgtcttccctattgtttatttccattaacctgtgggtgacacattttatgaatggaatgttactgatccccagattacatttagcatttcagggctctgaggtcccactgggtatgttctaaattagcattagctgcccatgatgtgtaaataattcaacacatttacggagtacaagtaatcctgaatcaataaagtacagaaaataactacatagaagcttaattaatctttacaaaacaagttttaaaagaagagaagcattttgttctgcctttcaggctaaatattttgggtttttaccactctggcagctctataacagcaaagcaaagtggaaaacattcaattatcaaataaaattcagccacattatatacctaacatgaataaactgaagtcaaccttattcccattttggcaaattaattgcacagataaataaaccagcacagatttatcttataattaagccctttttgttccctatttttaaatacagtattttttttttttaccaaagtgatatatacacatagtttaaagaggaaacttcttttatcttttttttttttaaatgaaagccagaaatcctttatgtcagttccagtttctgctttctacaaaaaaaaaaaaaaaaaaaaaaaaatgctgtcaacttttagctgattcttttggtatttaaactttatatccttcaattgtacattaatatttttacttcttgacttttcaattttaaatattatcctactaactttccactacggaagagaagtatgtagccttcatttgtttcaggaactgcacatatttaaaatatatggtttggttaagttttgacatatgcatatacttgtgactataatcaagttaactcatggcctgcaagtcttccccccagatcacaggcaactactcatttccttgctataattttgattagtttgtatgtctagaattttaagtaagaggaaatgtacagtatttacttttgtgggtctgatttctttcacttagcatagttatcttgatattcattcatgctgttgtatatatcaagagttcattcctttttattggtgggtagtattccattgcatggcatacactgtgtatctattccttgctgatggccatttggctttcatagtttggctactatgaataatgttggtatgagcaatcatataaaagtctgtgtggacacatgcttccatttctcttgggaaaatacctaggaatggaatggctgggtcatatgataaatgtttaaatttttaagaatctgccaagttattttccaaagtaggttgtagcattttatattcctaccaacagcatataagagttccagtttctccacaactgtgtcaacacttgttatgttcagtttttgttttgtttggaatttaactataccactaagtatgcagtggtatctaactatggtttcaaattgcaattccctgttgaataatgacgttgagcatctttccatatgcctttttgtataatattcctttggtgaagtatctgttaaaacaattttttaaattgggttaatattttataattaaactttaaaagttttatatattctgaataaaagtttactgtgggatgtgtgtcgtctaaatactttctcctattctgcgacttaactttttattctaacaatgtctttggaagatcgaaagttctcaattttgaggaagttcaatgtaacatttttttccatttatgaattatgattatgttttatttaagaatctttgcctaacccaaagacacagatttttcacccaagttttctaggtctacctattttgagttaacttttgtattatgggtgaggtatgaattgaggtcaatagtttgcatttgaatatccaatagttccggtagcatctgtcggaaaaaagtatactttgcaaattgcccttgaacattcactgaaaatcaacagaccatatatgtgtgtgagtctacttttggactttcagtagcatactatcttgattactgtagcattataaattttgaaatcagtgttaatgttcccacgttgtcctttttaaaagttatttttgctatggtaaattctttgcatttacatgtaaattctattatcaggttaatttctaaaaaacaatcatactgggattttgactgaaatagccttggatccataggtcaatttagagagaattgacaacaatattgagtcttctggcccatgagtacagtatctctccttctatttaggttttctttaatttttctcagcaatactttatactattcagtgtacatgttttacacatctttcatcaggttgatcccaaagtatttcatattttttattgttattgtaaatgatattatttaatttcaatttctgattgttgccagtatatagaaatatattaatatttatatatttatcacagggtgtggtggctcatgcctgtaatcccagtattttgggatgcccaggcaggaagatctcttgagcctaagaatttaagagtagccctgggcaacatagggagatcccatctctgtaaaagaaaatattatctgcgcatggtggcatgtgcctgtggtcccagctacttgggatgctgaggtgggaggatcgcttgagcctgggaagttgaggctgcagtgagcagtgatcacacctctgcactccagccctgagacagggcgacagagtaagaacctgtctcaaaaaaatcatctaggattctgcaacttaaatattggagtggaattttttagattcggtaagattttctactcagataatcatgttacttgcaaataaagatagttttgcttcttcctttccaatttggatgacttcaaaaaatttgtttttttcagaatcaatgcactacctagaccatttgtgacaattttgaacataagaagtgagagcagacatccttgcctttttattttaggtagaaaacattcagtcttttaccattaagtatgttagccgtaggtctaccatccatgcccttaactggttgtatataacatatggtaacaatagtccttctaatacatttggtttactaattctatattttgtgtcttctcagttttgcttggttggctttttaatcctcttcattgatcatattttactatttttctatatacttaaaattttttcaccagatgctggagatagttttgtcttgttgatgtctagatatttttgtattcctttaaatatgcttgatctctgtattcaggaatgctcttaaattacctggaaacagtttggcctatttgaatcttgattttaatccccattaggtgaatcagagttgtgttaatttttttcccatggctgaagcaaaacctaatgagtactctatagattatagtactctactgatacccatgagttggttttccactctgggtaatgaaaactagaactacccctggtcctgtgtgttagcattagagattccccccataagcctttcctgtggttctttgccagactttggatagtttcctcacatatatgaaatgatcaatacttaacaggagactccagggaatcatttgcaaatagctgtagctctctcctctcctttagacctctgacctgaaatctctggctaccttggcctccctggaattccagctctgcctcttcaagtcagagagtccactaggctctacctaggttcctcctttctggatcatggcctggaaatgctcttctggcagtaagcaggtgcaactaaagggcttacttcatttcttttccatttctcaggaatcactttcattgctttatgtttaatgtcttgaaaatattttttcccatttttggggcctttttaaattgttttgggtgggaggctaaatataatcccctgctgctccatcttggacataagtagctccctcttttttttttttttttttttttttttgaccacattcccccactataaacaaaattcctgtcccttccttacttctaatatagtaacatcattttgcaggggttagatctaaattcagtatctacattacattagttatgagaatgttctagacaactgagacacagtattttctatgattactttccatgccttgctcaatagtttgttcataattcatacttatatttgtttttgatgtcctctctttatacacttaatctaatacaattccaaattctagtaaaagtagtacaatctaattaatacaactccaagctctattccaagtgggcaaatatctcaacatgtcaaaatatgttttatcaatttaatctacgttgaagcattttctgacatgctccagtcagaactgattgctctctaaaatcaactgtcactttgagggtctcaattaaccatcactctagggacacctttctctctcccatgttgatttcttgtttcggggaattttttttttttttttttttttttttttgagacacagtgtcactccatcacctaggctggagtgcagtcaggcgatctcggctcactgcagcctctgcctcctaggttcaagcaattttcatgactcagcctcccaagtaaccgggactacaggagctcaccaccatgaccagctaattttgtatttttcgtagaaacagggttttaccatgttggccaggctggtctcaaactcctaacctcaagtatgtcacccacctcagtctcccaaaatgttgggattacaagtgtgagccactgcacccagccagtttcagggatcttagatcctctttgtttccccctggttttggtaaattctacagttcaccaaagggaatataaaaggaacattttttttagtgcatgtctaaaaatatcattattctaccatcactgttaatagaaactattgctggtatagaattctaggttggaaatgatagtttctcagaattatgaagttactgttttccagatatcagtattgctcctcacatcaaaatgaaagttgaagaaaaggatcttttaaagttttgttcactgtctgacacaaagtaggagctcaataaatatttgtagaataaatcaatgttgagaagtcattctaactcattgtataaaatctggtttctctttctggaagatcttaggattttttaatccttaagtttctgaaaattcatgaaatgtacttataaaaccatcagctctcatgagactcgctcatcatcatgagaacagcatgggggaaacctcccctaccatccaattacctccacccggtcccacccttgacaaacggggattattacaattcaaggtaagatttgggtggggacacagaaccaaatcatatcaggattgtatagtacatatttagagaaattatccaaagatgatgtgcgtataagagaaatagagaaacaaaactttaagagaggacaggaaactaaaacgatactaatacaaaatgaatacaataaatgacgtggacatccctgtccactactatgtagttgtagtttttgggtggtagtgtggggaattgaagtcccttggtgagtggctctgattagtctaactcaatatagcaatcccatgtccatgtcagtgactgattgaggcatcccgtgcacagaatttctctggccactggttttggttcaaaaccaggctcatgagatataaaaaatactttgctaggatcttctaaggaaactttttatgatcttaagagaagactatagaaaaatatagcttctacgacttcctttgaacactggcatgtatgaatgtgaggccaagaaattctgtaggcttaacggctaaggtgtgagataaagaaaaaaaaaataaaaaaattatgttatcttactactagtctggggatgaagctatcccatgaaagagaatagcaatgtgagaatcacaaagaaagagagctgtggctactgaataaagcttgtcttaaagcttgcctgctcgagacctgcaggcaagtgagcatgcaaatttatttattgtttaaaacagttggaggcaggatttctattgcttgcagttgaaatcattgatataataatggggacttattcagttactaatatagatatctaaaatgatggctgggtctcaacggtagcaaaaaagagggaaattacactgattttcattgaaagatacataaaatacatttaaaggattctatacaacctaggagacaacacttttttttgtttgtttttgtttttttgagacagagtgttgtcatccaagctggagtgcagtggtgtaatcagagctcactgtagcattgacttcccaggctcaagtgatcctcccacatcagcctctggagtagctgggaccacaggcacacaccaccacacccagataattttttagtttttcttttttgtagagatggggtctcgctacgttgcctaggctggtcttgaactcctgggctcaagcaaccttccctcctaaagtgctgggattataggtttgagctaccacacctggttaaggcaatgctttcaacaacagcaaatgcagaaacacatctctaaaactgcaaaataattttttatgtcttcattttgtttgtaaactcaaaatcatttcaggcagagaattcaatcttaactctgtaagttgaattcagctatgctatctacaacagtgtttcctaatgtaaatttactggcctttttgggcagaatatttctccactgtgggattgtctcatgtactgcacttttaaacccagcactaaatgactccctacccctggttatcatgacaatgaaaatcataccttattcacttactctaaggtactgctactagccccagttgaaaaatcactaatgtaggggaatagatttatagtatatactatgagattttctcctttcaatatcatttaaaaaaatcacagagtctaagacctttatattatcaggaaacataacaaaaaagaataataatgaggcaataacagatcaggaagaataagaagataaagaaacggagtctcagcatggtcatacagcattcatatggttaaataaaatatttttgtgaacatattcactaagtttattttttaaataagtgcaaattaagagcatattcactacgtttattttttaaataagtgcaaaataagagcatattcactaagtttattttttaaataagttccaaatcacatgcatgcaacatagcagacaggttataagacacaatacattatgtggtgacattttataggcctaataataagggagaaaaagaaaatatgttagcatatttctgtttttaattattaagttctgttgaactaactataaccaggagaaaagaaatattatcaaggtatttatcttttactctgtaaatgtttgaaatgtttcttagtattggtggccttttttttttttttttttttttttttgagacaaggtctcatgctgtcgtccaggctggagtgcagtggtgtgatcatagctcactgcagcctcgacctccccagaatcaggtgatcctcccacctctgcctcctgagcagctgagactacagacatgcaccaccatgtctggctggttaagttttgtattttttatagagatggggtttcaccattttgccctgtctggtcttgaactcctggtctcaagtgatcaaacccacatggcctcccaaagtgttgggattacaggcatgagactctgtgactggctgatagctaattttttgagcaaggaatggtgctaggtgctgtgacctgtgttctcagagaatgtaagtaaaaagataactaatgactttaaagccatgtgggttacaagtgacaagacaatactacagacaataaatgctcaaagacttcagaatactctctgctggaataactgagaaaggccccactgtggaggtgagacttgagggctccttacctggtaatacagagagcaggaggaacagtcaccagagctagggggaagagactatgcaagaatgagaaatgcaaaaggcaagtaagaggtgcagtggaacggatattgtagggggaatggctagcctaaatgaatacaggagactgaatgatacgctgagaagcagaccacagactgaagaatgtgaaccttaccctgcaggcaagggagggctactgatgatcttgagcgctagtagaatgatataataaacaatttttgggggaagtaagggttgagtaaagtatgaaaagaaatatttatattaataaaaaaatatatacctgaaatggcttatctgattttctaaaagggaagagagtctctcttttatctcctcaaatctttctttttcttccactgaaacagtcccaattccatcaggcctgaaaaaaaaatcagaatcaataattcatattgatcgaacatttacttttatatattttatacatatgtatatttaaaaatccaaggaaaagttcactgtatacatattaattgtgtttacagtggaaatttactggaaatatttgcagccatttgctttatattttgacccagaatgaatggaatggaattattctcttttagacagccttcaaggtaaaagattataataaatattttccagatctaccgaaaacaatgactagtccttgaaaatggcagtgaaaagtgttttatagtagtaccaaacatttgaccaactaagtgaaatcccctgaatgaaaatattattaaaaaataatgaacgtaaggtaaaatgtcttaactggttctcttccaaataataattcagctaacacagaactggagatttaattgtcataagaaacatagaaatttttgatacatgtagaagttcactgacctctttttgtttgcttaaatacagggcatatgaataaatattagaattaaaatatacagggaagagagcaagctatgtttcttttcaagatttttgtgtttaaatattcctgtgaaatcaatgtgagtttcatcagaattttacaaagtagctatgaagactgaaaataaatcttattttactaagattaggattaaaaatgtaaaatatatcaaataacagaaatttagaatttattctgtatcaatttaggtatccggttgtacggcaatcatctaaaattttgaacatataaatcttaactgtcttgttagtgcagagggaaaaaaagtatgaatctcatattcacttcaaaacctgtttatatattttaataacaaaataaaccttttgcacttgataattaacaagaatcatttcctacctaattagtttatttgttcatttagtttctgagacagttttgctcttgttgcccaggctgcagtgcaatggcacgatcttggctcagtgcaacctccgcctcctggattcaagcaattctcctgcctcagcctcctgagcagctgggattacaggcacctgtcactatgcttggctaatttttgtatttttagtagagatggggtttcaccatgttgttcaggctggtctggaactcctgacctcaagtgatctgcccgccttggcctcccaaagagctgggattacaggggtgagccaccgtgcccagcttagcttatttctctaaagattatattttaattcccaaagacttgtgcatttatcattccaatgtactaattttaatggttatatataaaataggtagaaacaggaattattgaaaacaaagaaaaataaatgcttaaaataactttcctaacaagatttttatttgttcctctctatatacatataatcatatgtatgtgtgtgtgtatatatgtttgatgcttgttaactagtcaattaggatgaaagcaattaattttaaacttatacctgaattatactgacataatgacctttcagtcaaatcaaagtatcatttaagtatgagattttttttccaatatagagtacataatttttacttcagagactcatgtgctgctggaatttatgctttgaaaacatttcttacaattttttattcctaaatagggaaacattacttaatttcatatgcaaaataatatatcgaccacatttattccatctgaatgcattttgaatgttaactatggaaaaattaatggccaaatattagtctctcaagtatttttaggaaggaggaaaagtctaacgcataaattacaaagcagtgcaccatgagctaatactaatattttatatttatttaataatggatttttcacatattactttagaatcaattcccattgagcgaatgttaatacaaaacacaaactgaaacctatgaataattatgcattgacaatgatcacaaaagctcaactgggaagttctatataaatcattaatttggaatttgggtattcagacaaaaactatacctaaattacattatcatgtagacaacaatgaaaactcataccataaagttatgggtgattatttcactgaatatccctaggcaaattgataaaaagagcaaataacttatcttcatcattctgctgatttgacataatcttttggcttagctacctggcagatgctatgtggttaaataggagtaaacttttctattttgttcaactgtcaaatgagattgtcatccacagtgatactgtaagttgtcctatcatattagatttcactgaggcccactgtctgcttgacagaatggagccagggggtcaggtgatgacaagtgagaaaggtaagtcaggggaagctcgcttgtgtcaaccttcgctaagaaaagaatgttatacagagtgaaggaccaccattttactgagtttatcactaaattaggtacaaatctgacagttaaataccacgtttagcaatttggacttgcctttacacatccttattttagaatatatacaagattaactactgaatattaggcataagaagcagccttctatatctaaattattggtaataaatggtaactttgcagtagtcaactctaaaggcaacagttcctcctacaataattcttcccgataagtgcaaatactttccgtgtcatcaacatcttgtcactgtaattattaaaacaaacataatgatgagcacttatagaattttaaatacgtgtctggtattttgtactggctatcttatatgcagaataacatataaagctcacaacaatcctgtctcctttccaaaagagaaggctgctgaggctcagggcagttaggttaattcccaaggtcacaccgctgggaaatgcaggagcctggacttgaacctaggtctcttgccctccaaagacgatgctcttacccttactctcttcctgctatattttgatagaaaataataacgagcaatagaaacccaatgaaaccatgaaagttatatttgaaaagcaataatggagtattttgaatacccttacattagacattttctatctgacttgtctaaggtggagacgttaaaaaccaatgacatttaaaatataatgcttaccattgaatcagcaagtcagttaaagaagaccgtaagaaaggaagtcctaaaccttgctctttcatacattctaaagtatgtttttacaaaagccttgagagaaatttaaaccagttatattttatgaatgtttgtttaatagactcagagtattcgagatttaaaaattatcatttatataagctcagtttataaattcattcctgccagctctaccttcaaaacacacccagaatgtgaccttccctcaccatatccaccactgatccactgatcccagccactatctgcttatccctgagtacgcaggcagcctcttggtctttctcctccagcgctttctttgtcagagaactggccacacactactccgagcctcttcaaccatcagtcattatgacagtattccttgactcaattcctgtaatggtggcacacaaggtaaaagccaaagcctttataatgatgtatgagccccgcttcccacaatctgaccttatctaccccctcacttgccctgctcccctccactcaagccatgctggcctcctaactagtcctcaaacacaggaagcaagctccaggctcaaggcctttgcaagtgctgctgcttctgcctgagagtgctttctctacatgtacacaaaatcatatatgcacacatgcacacctggcttgcttgctcactttcttctggtctctacttacatgactcagcattagtgaggttatctccaaccatcctacatgaaagtgtatttcccattcccatagacctttctattttttaataataatatttattaaataataatatttaataaaaatgttttattgatggccactgtacatatggctgccatctaacatgatatatttacctatttggttactgtttgcttcctttgtaatgtatctctagtgctagaacaccagatggcatattgttgatatttaatgcatatatgctgaggaaatgaatgagtaatatatgcaatataaaaatattacttaagatgataagaattcatgaattagtaatatgacaaattattattactgcttattagaattaacagggtataaattatttggaacatttttatttattttttatttttcagatggagtctccctctgtcacccaggctggagtgcagtggcacaatttcagctcactgcaaactccacctcctgggttcaagcgattctcctgcctcagcctcccaagtggctgggattacaggtgtgcaccaccacacctggctaattttgtatttttagtagagatgaggtttcaagttggccaggctggtctcgaactcctggcctcaggtgatccaccctcctcagcctcccaaagtgctgggattacaggaaagagccaccatgcccagcttggaacatttttattatatgatagttggtaaaacagaaaattttgtgaaaagcaaacagaagcaggaactgtagttaagtacactggtaaaaagatctctaaagttagtatgtattcacacttagcagaaaatctttagtgtttaattttattttaattaataataaaataatttactttaaatcttaagaatagaatttttctccttagatataaataaacataataatcctgctttgacattgataaagattctgttaaaatgtggttatttaaaattcgaacataaaagacaaattttctcatttgaatgttaagtgggacttaactctatgacgataattaaatattaaagtggttctgatgagaagaaagggtagtcttatgtatcaatatttaatattctcatttttttctggggcctgtagttattgaagttacatgatttcaataaaaatagggtgctctgtgaaaaaggcttaatatatgaaaaaattataaaacagattaaaatagatacacttcttttaattacagataaagtcaaaaaagttatgacataaaacttctatctggtcttaaacaataagcaagtgaacaccaagtgcagttgtgtgttaatttatttcaaaggttcttaaaaaacagaatttgtacaacagaaccttctgccactgaggcctgatcttaacgtctgcctgtgggtcacactctgttttcagagaagccatcacacacatgtacatccccctgcaagctgcatacacacgtgtgcacacaaacacagacaacactttttgaaaggcagattcatccaaaaaatagttgataaggcctctatatacatattttcttaaatttctccatgagctaagcaatcttgtaatttgtgctattcatcaatctggcagattactgcattctaaaacaaacgcaaaaactcttttatatacattgaacatcccgtcatgattatcaattcctcctgtaacaagtgtgacgtgagctctaaattgaaaaaggtatttttaaactaaaagtcaggaatgagaggagtaaacagcattactcatcctaatccattttctattatttcggatgatttctgtggtaaaacaaactaaaaatttagtttctataaaggtaaagaacaactacactatagggtaagaaatatctaagagaaaaagggtacaaaactgggctgtagaatcaggcatttgagcagaagagaaaatatcaatgaggaagactgcttaaatattcagatctgtgcaaacctagtgctttacttcccttgtttgaacagtttgtgttcacacattttatagatcccttttccagtataataaaaaatttcaggggtttgtaacaccaataaaaactaattttgacatgtttaatatccattcctttggagtacatttgagtaaagatgaattaatggctgtcaacattttccaaaacacattgtaaggaacaatgaccctcagggatgcccaaatattttgtaaacaatgcaaattacgcaacccttttggaggttcacagaacaatcacagcatatgaaggggtctgagaagcctgatagtaaagaaatctgtttaactttgtataaatagcacttccagaattatttagtcacatctgcccacattcctcctgaaaattcattatttagtgctgacgagcatccgttctattacttaatgaaaactataccatcttctagagttattttttcaatcacttttatcacctgcacagcttttagatatgtgagggataaatgtgtttataatccctaggctttataatctctaggactctgcacattgcctggtttacagtacttagcaagcttgtggattgaataaagacaccagggttaacactgtatagtgaagtgtggttaaattaataagacattaaattaaattaaatgctcccccaccccatctccaactcatcaggtaagtttgtcctggaaatctggtggtttgttgtaaaagattatttcacaagcaatgcatgagcaaatgacaaagttcatggtgcttttgagttacttataggcttcttttcacctgcttctgctacgaggaatgaggaatgcatgacatcttagcttcctctagggaaagtgagaaggggagagacacctagagggtggtatttctgaattgtcaattctgcctgcagcacagcaggtaaaagtcactttgcacttcgtgtatttcccaccaatatccatttgtgaacagaatggaaaggagaggatgtcacagcacgagaataagaaatgataaaagatgatgaggaagaaaacaataatcccttcttttttatttcctaacctataatacctcctattgtttgaatcaaatgatgtattacttggatggtcatatattacacactcagtgtccttttacttcccctctaattttaaatatccagaagaaattaattgtgtctttatatgatcattgagatataaaaaacagattttctatgaaaaaatattttaaaagatgaaattctgaaatatgttcttatctttttgcaaacactccccccttccttgtctggattttgcactgcattctaatttccttggatgtttattttaaaaagggtagataccactatggtgaaagcaatcatctgactctataaagatctaagatcatattacttcgtttttgtgttagggtgctggtgaataggccaaggaccaaaacataattgataactggcctctcctgggaccaaacaaacaaataagaaaactttcttggactaatccaaactgaaatcactgctgtatataattccagaattcaagagaaagaaataccaagagcaatttaaaataaaagtaaagagaattaaggttggtatagaggttctctgatataaatatcaccctctgccctataactaatatttttaaaaaacaacatatattgtaactaaaggacttcatatatatcatactatgagaagagaaatttgaaaaataaagaccaaaatgaaaatttcctataaatatgccaaccagaaataactgaaatactagtttgtaaatataattataatttatttctctaactctatagatgtattatacattctgattcataatttgattgttttaacgaactgtaagcttttaaaatataatttaaatattctaatttataatgaaataattatatttcaatatatggatgtgccataattaatccaattatccattatttagaaatgtaggcatttttcctccattttttgctatcatagatagtgcttcaataattaatcttatactatatatgtttaacccatatccaaatgttttcttaagaaaaattcccaaaggtatattgctaggttaaatgcacgatattttcaagtattcgatacatattgcaaagttggttttttagaaagcacttatcagcttacactctggcctgcagtgcatgaaattattaattttcctgcaacctcaccaactgtagtctttatcctttgttataatcattttcaattttatatactaaaaaggggatctattttaatatattaatttctatgatggaaaatgatgctatcttgctgattatgtagggcctttatcatgtgccataaaaataattgcagttgattaatttaaaaacatttaattttaaacttacttaagaaggtccataatatatcacctataaaatttgtaaacagatggcccaatgtcattcaattatttactcaatcaatatttatggaccacttggtcaggtcatgggacacaatgtaagcacaacagaaatggtttctgccccaatagagtttatagtgggaaaatgcatacaaaataaaaattagacaataagtatacaattacatttaagaagggcaaaagtataaacatctgatctagtttggagtgtcagagaaggattcagtttggaaatgatatttaacctgaaatgtgatgaatgagcagcagtcatttaggtgaaacctgaagcagaaggcagtttgaggagaggcccaggatgttcgccatagagatgtccaaataattttttaaatgcaaattttttcatgtgacttctgcttgcagtatggtggactaacttgatactccccaaatccttattcactacaaaacacctaaatactgcataagccacaacaattatatattaaatgttgtccagctcttactagaaagtaaaataattctcccaagggtgggagaacaaaacaaatgaacctgatgaaagcaaagaaggggcaaatatgaacaacatggctgtcttggtggtaaatatcaatactgagaaagctttacagctgcatccaagggaatggatcactgagccatagacctaatttggatgagctgctaagcctgagacacctgcataaaaatgggaccctagaatgggttatagtatcagtgaaaggatagtgcactccctaacatcaaggaaaaacaagaacaagtcctctttagagggaagcattcagagcccaggacttttaagaattcccacatattaatcttaagtataaatgtttattacaaaaaaatgctaattgcattaaaaaataataaacaagtgaccatggcaaaaatgtcggcagaaacaatagaaaattcagttatttgaaagataatatgaaataattataaaagatctaaggaaacaaaaaatggaatcaaaccaagaaaggaaaaagatattcagaagtaatcaagcagagctcaaaaagaatcaaacagaataacagaatttccaggactaaataatttgttaactgaaattaataaatcaataagtgagtgaaacagtagatgtcagagctgaagagagaactgaagaaatagagtaagggttggcaaactacggcctttcatctgcttttgtcaatataattttgttgggacaagccacactaattcatttctatattgtccatgactgcttctgcacagcaatggcggagttgtatagttgtaacagagactacatggtcaaaaatagttacaagattttgtatagttacaaagcccaaaatagttgtcatgtttactgtagagcccttcacaatagcagccaattcctcaactggaagacagaattgaaaacattacacaggatgcagctggaaaaatacgtagatagaatacattttagagacattaaaagatatagaagataaaatgcctagtacatgggtaattggagcttcagatgagaagaaaaagattgtagaagagacaatatttaaagagataatgctattccagaactgatgacaaatataaatctttatattccaatcagggtaaataaaaagaaatgcacacctatacaatatcatggcaggtagattagaaattcatatatgtcccaatcacaataaattaaaagaaatccatacaaagaaaccttacagtgtacttacaaaacacaaaagaacaaaagaatctttttttaaaaaaagcatccagaggaaaaagaggaatcatcctcaaaagactagcatttgtactgccaagagccttttttgttgttgttttgttttgttttttaagatggagtctcgctctgtcaccaggctggagtgtagtggcgccatctcggctcactgcaacctctgcctctcaggttccagtgattctcctgcctcagcctcccaagtagctgggacgacaggtgcgtggcaccatgcctggctaatttttgcatttttcagtagagagggggtttcaacatattggccaggctggtctcaaattgctgacctggtgatccacccgcctcggcctcccagagtgctgggattaaaggtgtgagccacctcgcctggcctgccaagagccttcttaatggcaacaaagaaaatcagaagaaaatgaatgtcttcaaagttctaagagaaaataaccatcaacctagcactgtacacctagcaaaactttctttgaaaaaataggatgaaacaaaagaaattcccaataacaattcacagtgtataagagtccatttataggaaagtccaaagaacattcttcagaaaaaaggaaaattgtttctaaatctaagcaaatacgaagtacaaaataagaaagataatattaatttataagcttaggaaaaaaggatataactaaaataccacagaatttaagtatgtaagccagaaagggggtgactggagggtaatattctaaggactctgaactacctaggaggagaaatttgttaattagcataagactttaaaatttcagcaacatgcctggtaaatctcaaatgtaattgttggaaaatataaactgttaagagaaaaaaaaagaattaaagaaaataacttcaatgaaacaaaaagtataccaataaaaagtttatagaacatgagccaaaaaagaaagcttaaaataaaatggtagaaatggatttacttttattaacatgtgatttacttttattaatatgtgatttacttttatcaattacatgataaatgtaaatggaccaaactaattaaaggacagaaatagtcatattgaaaaattaaatcaaaatctagtttgctatttataaaacactaaagtacaagaatatagaaaggctaacgatgtgaacatgcatcagataaacactcatcaaaagaaagctacattaataatcacctacatatcatgcaaaaatcattattagttatgatgatcatcaccaaatgatgataacaatgttcatctaccaggaatatctaacaatcttaagcttgaacacagaacagccttgggccaggcacagtggctcatacctgtcatcccagcaatttgggaggccaaggaggaagatcacttgagcccaggagtttgagaccaacctgtgtgacataatgagattttgtcccaacaaaaagcaactcctcaaaaaccagcttcaaaatatacaaagcaaaaatttacagaaatagagagcaaaaaccaccatgacagtggtaaatcaccactcacgttggtcataaccccacagatcaaacaggcaagaattagtaagactttagaagatcttaaccacacaaatcctgtttgcactgcctaaagaatacatatatttttttttaagtgacagaaaacatttataatatttgacacatatttggccacaaaggaaatctcaacaagtgataaagaattggtatcacacagatcacattctctgaacacaaaggaattaggtaagaaatcagttctcaagaaaataaccaaaaatcttcatattcttagatttttttttttttgaggtggagtctcgctctgttgcccaggctggagtgcaatggcatgatctcggctcactgcaagctccacctcccaggttcatgccattctcctgcctcaacctcccaagatattttaaaacgtacttataaataaccttgtgtcaataaattatgaaaagttaaaattacttagaatcaattttaattaaatagtacataagacatttctatatgtagtaaaaacagaatttagtgggggaagttacagccctaaactcttagaaaagaagaaaagctggcaagtagtgagttacacatctaacataagaagttaggaaagatgacataacctcactaaggagggtgggagaaaaagctgctttcctattcatctttggcaaacagtattttgactggaaactgaaaggttttgtagacaagtactatagcctagttggtgaattccaaaactgctttgcatgaagttcaggggttgaacaattttgtaaatggatggtggaagtaagatttctcactgttgaaaagataagttaaagataaggaagaaaagcatgctgaaatgaatgttgatgtcctagattccagttggagacgtcagtatgaactcatggtttagtacacatcatatatcacctagctctgtccaactgagagggcctggaagctatgatttttccagcagaaataaacacacatgtcacctagatcttggtttctaaataccattctctaaaaaacaaacaaacaaacaacaacaataacaaaaccagagctccttggagaactgattaattcttaggctagagtagggaaaataaaagatgagcttgcagcatgtcagattgccagaaactaagaaagtgctcaaaaaccaaatgagtggggcatatcaaagggagccagtataaaagagctttcaatagctacagcaggaacaatctgagcaacaaagtaatttagatattattagattgtaacccaaggtataaagcaactgcacatgaatctatacggatataaacaaatggttaaataaataaattggaaagaagagacatatattccttacagaagaattctgaataacgtatgcagatagttctccttctaggagttggggtttatttcctgtctcctcttcagtgtgttttattggacttagctattttcttcaaactagagtataaaaaaataaaaatgacatctttacagtagagaaatgtgacaaatactaccaggatgtcacgcggatattatgtactccctgatagaatgtgatgagaagggtatttcatctctttacaaaaactcataatctcaggctaatcatgaaaatgtcagacaaacccaaactgagagacatttgataaaacacttgactagtactcctcaaaactgtcaaggtcacaaaaaacagacaaaaaaatccctaagaaactgctacaatcatgacaattaagtgcaacttggtaccctgaattgaatcttggagcagaaaaaaggacattaatttaaaaaactggtgaaatctgaataaggactggtgttcagttaatactagtgtgccaacgttgatttcttagttttgacaaatgtatgacaataacattaagggaaacggaaatacgaaaactctatgcactcttttagtaacttttctgtaatctaaaattatcgtaaaataaaaagtatatctaaaaaagaaacaatagagttcaacaaagccaaaagttgctcctttgaaaagaccaataaacttgatggattaagagaaaaaaagagagagaaggtaaaaatgaacaatattagactgaggaagggaagaattgtagatcgagcaaaaaatacaaagaaaacaacttgaataacttaatatcaatacatttaataacttaaatgaaatctaccatttcccagaaaatcataacttgcccaaactgactcaagaataaatagaaagcctgagaatttctgtagctacaacataaactacaacagttaaaaatctttccacaaataaattcccaagcccagatggtttaaaacaggggtccccaatacccgggctgtggactggtaccaatccatggcctgtttggaactgggccatacagcaggaggtgagcggcaggcaagcgagtactgcctgacttccacctcctgtcagatcagtgtcggcattaggttctcacaggaacctgaaccctatcgtgaactgtgcatacaagttatgtgctgcttatgagaatctaagtaatgcctgatgatctgaggtggaacagtttcatcccaaaaccatccccatcctaccgttccaccccatccatgaaaaatttaccttctatgaaaccggtcgctggtgccaaaaaggttgaggaccactggtttaaaagatgagatactggtaaactacaaaaagccattcaagtcttatacagagcaagtgggaaagctccccagttcattttgtgtggctacagtaacctagatacccaatcctgataaaaccagtatgagaaagtaaaataacaagccaattttgtacgtcaacatagatctacaaatatcaaactgggacggcaatggtagtggtaaataacacctatgtacatatagagctttctttgattgtttctacatacaacattacatactgtttttgaaaaacttactgtgttaaaaatgataagaagatccaacttaagacccaaaaactttgtcctatacctaactattgacgagaagaaggctctaaaggtatgaagtttaagaaaagctatgtcaaggtgtaacccttgtttctgttcatggttaatgtgatatagtctaatatatactaaaaaatttcctttgccttgtctcttcctcagaccttcagcaggctgttttatttaatatctcacaaagatccaggagttgcacagtttgaatggaaggtgtggaaggaagacagaggaaattaattaggtggccttagcaactatttcccaaattgcagtctgtctacatacttatcctggatgacggggttctaggctcctgcttttcgctgtctttgccactcccctctggggccacagtgttttccagcaacatgggggtggtaggcggggaggtcccagaacttcagcacagcttttccccatgaccacggataggagatgaggtgaggcactgactcagtgctcttccagtctcattctcctgattgaaacctgtttgtggtatgttgtcataacaaaattcacctgagtactgcagtgtttcacagaacaatccccaaaagctcatttaactaatacactgcataaaaaaattactacatgctatttaagcaatatttcatcgtttaaaaagtacttacagaattttatttgacctatttaggaaccatattgagtaggtagcattaatgttattactcacaaggtacacatggagaagctgaggctcagacagattaaaaccatttgctcaaagttaagtagttcatcagtagaggagccagaacaggaatacagatgctctgattcctcactcagagatatttccaacacaccaagtctttcccttccccttttctttttctctggttttgtctgttttgttttgaaaggcacaattatcttgcttcagtattgaacttgaggttgggtgagtataaatattgctaggaaagtctgcttaaggtagatttagggttgttctacagtttttgataaaataaaaaaactcctccagtaatatttgaaatatactccccaatacccatcccttctgcctttgcacatttagcacatggcataaaacctgtcagatcaggtacattacctaaggataaccttgcttatgacctttcatctggttgctcacctgccccaaaagtgagtctctccatttacaacgtgtgtgtcatttatacttaatttctatatagtcacatatctaaaactagaattaagtgaacacttttgatgatcctacgtgatgcaattatctacgttgtttctcaaaaaatgcacactgtctctaaaattacagattggaagtttgaggcataatttctgaagtgacagtcaaggggaaatgttagcacctgtgaagacagaggtattatgatatgatgatttgactgatgcccattaaggttacttaacaactttgtgatataatctggaatccatagaaaattgagattattttatatataaaactacagtcatgttgtactcttgtgccctgtacttgaaagcaagcacatctgagctggcgtttgtcaggcatgcagcagctctaagacagccctagaaaactgtagaggagtcagtgaatacactgtatgccttacattaaattgggacataaaagccattttgtgttgctgcttcagtttctccaccctcagcctgacttacaaaaccaagacgtataaccacacatatcaacctagaactttgccctatgaagcattgtctctgaaagcctcttttctccttcctgtcagtcctcagcggcactatggctgaatgagtggttgtgttattcagagatgtgtgtggctatcatcctgcatgagtgggtctgtttctgtccttgactcactttttctttcttcctttctttttctctctcttcctcagtcttagtaccagccagaccttttctgtttaactctattcttttatttctgaaacactcagagtgctattcagagatgtatctgtacagaaagaacacacctagagagctcaacactgtgcaataggatgtgctccctgaaaaatttcaaatccagacagcactgttgtccttcacttcagtcaataacaaaaggaaatcttttctccttttgaatttatgacagaggtagttcaggtaatgagcaaaacgactctttgaatatgtgtcttgacagatgtaaaaatgatcataaaataagaccacggcaaacaatgtagaaaaaccagacttgacattgacagtatgtttaaacaaaagtctctataaatatcagatgctacagacatggataagagaagcacattctcacaaggagaggttgccaaaacctgaatattccattaacaaagaaattaggaatataattacatacacattgaaatatttctatttagcatgaggtacagtcctaactacatactttttacttttttcttcatctcacaatttacatcctcttgggttaaatggcaaagaaaaatatattagaatagtaagagtaatcaatactgatagtattttataatgatgtagtaccttcacattagtatttgccccttttatgtatgacaactctgagtttcagaaaggttaagtgatttgttgaacatgggtcagtttgcaaatttcagagccgggattcaagtgaagatcttttgcctctttctggtctttcactgtggcagcatagtatttctgaatgacatctgctggactgtaaacgtcacaggaaacgtcataactttcagcttatcttggattatttctatcctaaattgaggctcaaatttccctcaaccctatatttcttcctttctttttcttaagctatatgacacctcaatgctgaatcagagactgattcaaatttcgattctaaaagactaccagagatacctgaatgtgtacacagtttaaactttgggaaagtggatttcacatgcaatattaaagataatatatgcatgaacatataaacataccttgaattacacattacagagtatcgttataaagaaaacaatagttttacagaataaaagtaactatggcaaccagtagagtcaaatcaggctgcctcccaggcagcagcagtagctccttgttgcctcagtaactttccattataatgagtctcaaacacatatattttgggggcacattagctgaattttccaccttaggttcccaatttaattttacctttctgtgtggatgaataaaatattctgattatacagtttgctttgggtttgtttgtttcactgaaaccttctcatcctcttgcattttagaggtctgcctagtgctggaatgtctattttttgatatcccctagtcagaaggaattgagacagagtcaggagacgagacagttttagtaaaacagctcctatcaacagttagccaccctgactgacccctgtacccccccattttctaagtgcagagggttgagtgtgagatagtggggaaaaaactactaaaatcagcaacatcctcctaatttcaaatcaaggctgggctccaaaataaagtgaaaacctgaatagactgtgagacaaggatcaatcttattttattgtaggctgagaaatggcagcactggggacttcaacagatatttattgtgtacctacaaaatgtaacacactgttttaggtacgtggaggataataggtgaatgagaactgatttttgcctttaaaatatgatctagtggaacagaagcaggtgtgtgtctgtgtgtgtgtgtgtgtgcacgtacacacatctagcacataagtatatatgacaaaggtaatgagataagtacagacaaaaagttcttagtgtctgaatgagttaattgaagtcttctaagatgagttttgtgatatttgactttttaaaactggaaaaaagaaaaacatggagaataaacagattttttgcggtaaaattttgtggagacaagaatgggcagatggaagaggatggtaatgggaaaatgttgatgctatcacttggaacctatttttaatttaataatcaaaaatcacttaagctttttgaagaagagtgtggtaaaagttattctacaatttttttgactgattggtagaatactatagaaagaaaaaggtagtagagaggtaaattcacatacataggccagaaaaaaatgaaggccagaattaggataaacaatggaaatgtaaaaaagagaatgttaaggggcactatgggaagagaatattaatattcacaaattggggataggagggaaaagaaaaagatgaataaaaagttaacgggccattaatggaggagacattaacacaaataatgaagtcattcattcattcatcaaatatgtattgagcaagattaagagaaggggagtgatatggacagatttttatttattttttatttttatttttattttttaagacagagcctgttctgttacctaggctggagtgcagtggcatgatcttggctcactgcaacctctgcctcccgggttcaagcgattcttttacctcagcctcctgagtagctgggattacagacatgcaccaccacgcccagctaatttttatattttttaatagagatgaggtttcactcagttggccaggctggtctcaaactcctggcctcaggtgatccaccctccttggcctctcaaagtgctaagattacaggtgtaagccaccacacgcggcatgatatggacagatttttaaggccagagatagacaactgtggaggccaacattagggaatttttatggcatcttggtaaaacaagagtacttgttcctaaagtgtggattagggaagtggctaagaagagactctacataaaacccattttctatcttgttttatcagtgaaaattaattccacagaggaaaagcaatgatcattagttacacacagacctatcaacacatcctacccaggcacaggtatgcattacaataggaatcatagggatacttaaggctattcagacttactacgaggtggtatgtaagaactaaaaggcagtttctaatctcatattttttctctctctctctttcgagtggctttaccagcaaaaagaaacataaagtgtagcccacctaaatcaatagcatattgatgcacacttttttctctgtcgtttttttttttttccttgtaagaagtgtttgctatttacaatctgttactgggtgataatcgcaaagcacatttttctctcttttccatagtcaaccccatacatttcactttgtatttgcaagtaaaaatacctgttgccgtgcacatgagaggcacagaatgcaaagctgtaatggagcagggtagggtcaatgacagcaccattttctgaatgttccatcagttctgcaaggtagcagagatgtctgtgacagcctctcacaccataacgggcacagtactcatctaacacaaagacttggccagggctaaaccatccctgcaaaataaaaaaagaatagatatacatgttttttctttctatactacgatttgctttcctgaacgcacttttaggccttataagcagaagctgcatgaaagtatcttgacatttattttattagtggtatgtttcatgaagagctaatgtcatcaattttgaaactgatttgggacactggcaacctaatgctattctctttttactgtcacagcaaggcatgggtaacttgtgcctctccaatgtcattcaaaattagtcaaatttattcataggatctaaattatcacacacaaagagtgttactccaaaaatctcagtctctttatgaatcaattaaaaaaagacgacattatagatgaaatttcctgctcaggagaagttttataaagtgaactaaaagaaaatgtcattaagtttagcagcagtatacatgtactatttgggaacttaaatatctgggatattcttctcattctgtttgtcttcctatgaacaatataacagagttaatgctttatattagcagtttctgttcctcctgaaataagatgttagaatgtatgtgtgtgcatgcatgccacctgaacacagcaggcagttgatgcggctaaaactggaggacaggttaggtggagctggcttataaaatatcttgatgaattatatggatttataagatagtaaaagaaaagaagggagtatagagagttttaaaagggggcagggtaatcatgtaagagaaataaagaataatgagaaaaaggtgagaaggcaataaaggaaaggaggaagaaaagaaaaggagtaagagaagaaccatcaggtgtggtatttatatgctttccatgttgaagataaataagctaaagctcagggatgttaagtgaattgtccaagactacactgcaaatcagttgttgagccatgatttatattcacagtcatctgcctccaaaacactttctaggcaaatcacactcactcccctttaggtgcagtggaagaccttgtagcattctcctcagactccatattacactggcggtcaacaacaaaatcaaaacagcttttgataattgaataatgtctttgagtggaatccgagaggacactatcccttattgatgttcactctatgtgtttgtccatgaaaagatagaataggattttgagatgatatattttactctccatgtgattgtaaagtttgagttggatcaggtttaaattatacttaataaacaatctataaatgaattaatgaactgttagtgtcagcgtggcaataaattgtttcacttcttcctctctgaagtatccccattttgatttcagacaaaatgggggggcgcattttgtctgaaatcttaaacagaatgtaactttattgcatgaagtttcaggttgagcatcccaaatccaaaagtcccagacctgggaagctccaaaatccaaaatatttgagcatctgcatgatgcttttaaatcaagtttagcctaaagctgcctccttacatattttaagttcagcctaaaggtttctctatacattgtgaattataaactaaatggagttgtaaatacacagtagtctactactgtgccaataactgagttttggccaatcaaaggtggccaactgttcaaactgtgttcaaataaggcaaatgctgaactgtaatcaatctggctgtttctgtaccttacttctgttttctgtacgtcactttcctttttctgtctataaagctttttccaccacgtggctgcgccagagtctccgagcctactctggcttgggaggctgcctgattcaagaattcatgaattaaactctgttaaacttaattaggctaaggtttttcttttaacaaagctcaaaggaaattgattttggatttttggattaaggatgctcaccttgtacatataatgcaaatattccaaaatctgaagaaaattcaatatttgaaacagttctggtcccaagcattttggataagggatagtcaacctgtactatgctcagtgtccaagagattaaagtagtgatagaaataggcattttctggctgcaaaaatttcagatgaattgctattgacaatgtaaatgcttggaaaaacacataatttttaggttataaagtttagtccccatattctgaggtgtcaagcattccttttaaataaattatacttcatatcccaaatgttggctacaatttcaacacataccaggaaacagtttactcaatttaattcactcctttccttttgtcaaggaattcaagttatactttggatggctagatgaaaccaaaactttcctttgttatgtatagctcctgtcatattgttaattccactatttccttcccctgccacttaggttgtccttctaagaacaaaagagagaaatgtgaggtgtcaacatctggggaacagaacttcaaccttaaaatgtctgtacgtcctataacagaggttttaaaaaatctttatttaaagccttctattttcactgagcgttctttaaagtgactgatacaccacagtttagcatctatttgagtctattctcctgtctattgagtggcacagcagtggtcttcaagtgtataattttcaaattgggaagcaatcaactggaatcctttatccctcactctcactacccttattaaatgagtcaggaataaaatgctggtttataacaagtatttctcactttctaaaatcttttattccaacttataggggatctaaaatcttttattccaacttataggggactagatagacttgtactcaccaagcaagaataggaatcattcagtctgtgatccaaagtctgcctctggagtattctaaaaaggaaggcatgatcaagcttgcaggggtttgcagaaataaactcatccataccatgtttctgaaaacgatctgcatctgtaaattcaggaaagcatgtacagtatatttacttttcaggcttaatgatggacatacaagttgtgaagaatacaaaatgcgtgactcaagcagaagactaccttttatcacatgaaatatgatgccaagagttcagcatattaacataaattgcaaactttatgaagcctaagtaaaaacaacagcaaaaaatctacaaatcattcagaatgcagtaattccatctccattcaaagctatttctaatatccaacagaagaataatcttattttccaactctgagaaaagctgtattttaaatctccatttactgatggaattgactagaaaagaacgaagatctattcataaaaaacagcaatgatgcctaggagtctgctttccaaatggcaaactagggcagaattgaacacacatgcttcagctggatcacttccagtcttctttttgtatggagcttttaatgggaccatccttaatgtaaaaatggcaatgagcgctctcaagcttcaagtttaagagacaggaaaaagggagcatcatgtttgcgcaaatatgcagacaaagcttaacgtcccaaatggcacttcaatcaaaggcccaaatttattgttctttacagattgcatctttcaacgcctgtagaccctgcgggtttatcaaaaggcaagcttttatgattgctttcattaatggtatgttttgtcaaagtcttcaatgtgagttatttactaagtatagagagaaaaagccacacactaccccaaaggagtgctggggtgttattacattagctctgttagaaacgtagcgcatactgagcaagcaatcagttatcaagataaaagtggactcttctcacaatggtaaaactgaaactccattgttccctaaaattcacagatagatctctttctggtcatcataagaaaagcagagtcctaaatgtaagctaagtgtagtttgtaaaacctatgtagtacaatcttaaaattataaaggaaaagagacaaaagtttattgattaaacccaattatagagtcagactcataataaaactcaatattgatctgtggacatgatgctaacataatcagtcacatttagatatttagcccagatcttattgatccatgtcaagttcaactttcagccatatttgtagatggaagaactacataattcaagctgaagggtcttcagaatcacactaaaaaatgatacacaaactaatgtacatctcacatcaatgacagataggaaaaggtgaatatagcaagtaatcaatgaatggcagcttattgatgtgtagggtataaggttataatccgtggagaaagtatcatacttatacctttacatttaataattacctgaatgattaaatacattacatgtgataaattaactggatgaacacaaaacagcttttcctgaactaatatacaattgaacttcttttgcattttattcttctgagtcttttaatagaaagttaaatatatgataatgtaatgtgaaataatatcagatgaataggaggcagaatattaaaactgcaaatcacacattttataaaattggaagattcttttgtattttaaaagatgtatcttagaatattcatttttccatttatctcagcaaaaaaatcttttagtatcatttttatgaaactaaattactagttttataaaacatctgctaaattttataccttatttctttcaccagagaaggttacaacaggagttaaaaataatgcccattaatggttaatctgttgagaacaggatagtgataaatttcacaggaaaaagacctatctttttcctgtgaaaaaagtaaaaaaatctttcttttactataaagatttgtagaagcaattaaaaaatgggcatacaaactttaaataaaaaatgtttctgaaaaacgatctatagttcatttctataattaaatcatatttttgtaaatttataaagtacttttctcaggaaatacaattccaaactatatatctgctaaggtaacaagtctttccaaatgacacacatgaatggaaaattactttacaaacaattaccattggtgataaaaatgatattaatgatagcactttgagtcacaaatacagactctactcggaaaaaacagacaggcaaacaaacccattaaaatttttatttaagaaaatcaacaaccttcaatttctccaggattgtaattttatgaaagtgaaatgtgttcttagaaatcattctatttttaaaacacaggctgtgaagaccaaacatttttactttctttctacatcagatcagcaccatttagaacatttcatgcaaaactacattaccatgtggcagtatagtcttagtttccatgaatttatggaagaaataaataaaaaagtaacagtcttgacctccctgaatgaaatggggtggcgggaaggggggcgggaggggaggggagaggagaggagaggagaggagaggagaggagaggagaggagaggagagagagaagagagagagagagagagagagagagagagggagagagagaggtaggtagataggctgtgtttcaataaaacttcattttcaagaacaggcattcagtttcagtttgctggccctctggcccttgttttaaacaaaataatagcaatgtatacaagtgtttataacattactgaaaactgacgggcacaatggctcatgcctgtaatcccagcactttgggaggccgaggtgggtgaatcacctggggccaggagttcgagaccagcctgaccaacatggtgaaatcccgtctcttactaaaaaacacaaaaaattagctggacatggtggcaggcgcctgtaatcccagctacttgggaggccgaggcaggagaactgcttgaacccaggaggcgaaggttgcagtaagctgagattgcgccactgcactccagcctgggctacagagtgagactccattcccatcccacccgccacccccgaccccaccaaaaaaaaaaaaacaaaaaacaaaaaaccaaaaactgtaaagtgaaatgtaaggcaacaatagcatcaaagctaggaggagagaaacagatgtaatacggctgaaatgcttttttagtaataaaattgtgtgtatgtatatttaagctttacaacatgatgttaagggatacatatagacagtaaaatggttacaatacagatgcaaattagcaaatctgtcatctcacgtagctactttttttgtgacagggaagctaaaatctacttaacaaaaatcactaacagtacgattgtatggattctagttgtcatgttgtacattagatctctagacttgttcatcctacacatctgctagtttgtatcctttgacccacatctccccatttcctccctgccatctttcactttaaagttatctcatgaactaatgtgaaatagaaaatcagatatcattaagatattatctagtttcttatttttataaagatatattttcacatagctttctacaggtataacatacctatatgttactcttgagagacacagccatcatctatatcaaatgcaaaacatgctttttagtcaattaccaaatccaaggctttaaaattgggttatactggattatcttcaattaatgttactataacacaacattatggtgactagttttaaacagaaaattattcatggtgttactcagatttctctgataatggaaaattttagttcaatctgtcttctgaaacaatatgacaactatcaaaacaaaccaacaagctatgagcttaagcagtatactgcaaaactgtcataaattgtgatgattaacctatggactaactacagatgtgggattggtaattgaggatactggtggagtttctatggcaacagttggatgtatgctcgagcgtctttaggtggtactgtcaccaggtgtgataacagtagatggaatgaaacccaaattgagaaagattattattagctatagatttaagaagttatagaggctttatgtaagtcaagcctaaaaattaaattttttcattaggataatagctgttggaagttaagagaaaaggataagtaggctgacagtatcaacttaaataggtaatacagacttgaaaataggtggcatagaaaatgatgtgaggactatcagtgaggggctttttggtaggcactgaccgccacctgccccttaagtgcccaagaattcaaatcctaggaaaggcatctaagtcagagagaatgtgagattgaaaaaaatttgaaatacttcttttttgctattgtgaatagtgccacaataaacacacgtgtgcatgtgtctttatagcagcatgtgcacatgtaccctagaacttaaagtataataaaaatatatatattaaaaatacttcttttttctttgcaacaaattcttatggtactgcatttgttgctgctcctagtgttgtgagaaatcatggatgtaaaaggaaaagggaaagaaaaaggtaaaggggcactctggatgaaaaaaggaggccattttttagcattctgaggtcactctggtgtctgggagtgggactctagtatcaaaaggactaaaagggtgctgccagccaagactgctctctgcaaaacagagctgaactaagaagcaaatgactcttttgaaatataatacaatttactgtcctacatttaaaactggcctatgtttaggagttcacctgtagctgcatttaccactactcacatctgattatacatttcttataattcaaaactcccatacagcttgaaaatttataggaagttaaaagtggcacagcaaagtaggtgccacttctctttttataccatccatgtaggctttaataggaagagtttaatattttaaaattttacctagatcagcctgaatagtatgtccatgttttatgtatacatactttctgctgaaaagcaaaggagtttgttcacacctttattattgaccaaataactgcttagcttcttttggttaaattgattcaaaacctgatatatgaattaacacatcttgctttctgcagccaataacacgtaagtaatacttttgcatgatgacaattttgatcaacacagaaacctagaattacaaataagcaaagtaaaccaatattgaacatttattagaaataatatgttcaatgtaaaagaaagacaaatgctttccctatgaagtgtgaaatttaatatattagatcaatcatgaaaataagttcacaaaattaaatgttagtttatattttaatttaataatttaaaaatacttagcttaaaaataaacagatggcagcttttctggttcatttttgatattaatttattattggaagacaaatgctactattcatattgtattatgtgacacacacattgtattatgttacatatataactgagagacagtgaaaaccagggtgtgtgcactgcattttggttggagagaacaaagtacagtttaaccaaagaatgtccatcaatctggcaactctagcacgttacattttaagtgaaaaaattggttaccagcctcttccccaccccttcagctcactctcttcccttagaatttttatatatccagagagtcaaagaaaaaaagaagtggaatagatttgcttattagagaaatctataaatacatattagtaatgtcccaaaaagataaggttgtcttccagtaagttagattttataattttttttttatttttcctagttattgttatgcttagttttttaaaaaataagcttctgatttatacttcattctaaagcactgggtttgtgaaaaataaataaaaatacatacttcaaagaaaagatatagaagaaataaagtagcaactagtgcctccgataaaacatatccactgaatattttagatgtaattctacctatattttgcttcatcaattgggtgtttttttatgtagtgaaaataataccgcatgtataacttagcattttttccacttaacatatattgaccatttgttttgcacgttattacaacacattcgtggctattacccttgtgcctgtatgaatggtagatattaggttgtttctactttttttgttgcgatagacattttttgttttgtaatcaataaagctaacttaaatattctgggtttggctagaaagtaggggattgatcctgtaaacaagatcatgatattcctcaaacatagtatcattaaaaattttttaaaacatctaattttaaaaatcatgaaaatacttacctttaccagctacaggtcagcaaagaaatgagaaacaaagcatatttaaatgggttgggaactatatacttatacaactagacatttaattttttattttctcaatttctactcatgattttaaaagttgtttttctaaaagaccatcaggaaagaaaacaaaaattgattatgtaagtcaatggagggaggaaaatactatggatgaaactactctctggaggaactctggaggaattcatggcatttctctgatagttcagggtcactaccctcattctgatgaggtagaacattttctttcttcattctttttttttttttttttttttttgacggagtcttgctctgttgcccaggctggagtgcagtggtgcgaacgtggctcactgcaagctctgcctcccaggttcacgtcagcagaggtctgccctgatttaaaactttactagcagcctggaatacaagtcagttgttgttaacaaattgaaacagtttccctttttagttataacaagtaaattcagttctcatagcctgatcaattctgccttgacaataaattgatatcaaataacagaaaggttttgttagaaacagatgatagggctgggcgctgtggctcatgcctgtaatcccagcacttcgggagctgaggtgggcagataacctgaggtcaggagttcaagaccagcctggccaacgtggagaaaccccatctctattaaaaagacaaaaattaggcaggtgtggtagcatacacctgtaatcccagctacttgggaggctgaggcatgggaatcccatagcctgatcagtcctgccttgacaataaattgatatcgaataatagaaaggttttgttattatttgttacaggcaggtgcagtggctcatgcctgtaatcccagcactttggcaggccaaggctggcagatcacctgaggtcaggagtttgagactagcctggccaacatggagaaactctgtctctactaaaaatacaaaaattaggtgggtgtggtggcacacacctgtaatcccggctgctgagattacttgggaggctacttgggaggctgaggcacgagaatggcttgaacctgggaggcagaggttcagtgaggcgagatggcaccactgcacttcctctctctccagaggcagactctgtctaaaaaaattctgtattattcagccacagtcttaaagttctatgctagtggttcctacctgcttttcttgccattatgtgcaagcaacaatagccacgagctcaacacattcctcgggcattccttgcactcaggatgttaagaaaaaatatgggaacacaagtgaaggaggatggcgattaaaaaaaaatagttattaagtcactgtaattctgtggttctcaactgggggtgattcctcaccaaccgcaaccctaccctctgggacatttggcaatgtccagagatatttttggttgtctgacctgggaccaggtgggagactattgatacctagtgggtagaggacaggggtgctgtaaaacattacataacgcacaggaaaagttccttactccactccctgccccaaaacaaataattatctagcccaaaatgtcaatagtgttgaaattgagaaaccatgctttaacttacaaaaaattctgcttctggtcatgatggcataattgagaataaacttaacctcctacctgaattaagtattctaaaaaaatttacaaaaagtttattaaacgctgcacgttgggcaacgtgattcctgagggacgggaaacaaggtgagccttacagtcactccaggttactgccaggagaaactctatagcccatggcacaagcaacaggaacccaggaaaagcccagtggtctccctgagttcaaaagatggaactgacagttcagaagggtgatagtaactagagtttgtaggaaagagtactggagagaagagagctgcccagcaagagactctcaagatctacagaaggcctcccccaagaattcagctgactacccatcagctcatgcatgtgtagaaagggaaagaagcaatctaaaggattcgagaggacagtgccccaaactcacacagcctagaatagcactgcttttcagcagcaagaatataaaagctcataattcacaggttatcagttagagtattaagaaagatgttggtccagaaatggggaaaatgcatcctggactaaacactgcttggtcttccctaacaaaacttgaaagcaaagcttgagaggattgaattgtttccaagtaacttaactgtgtctcagaacaagcatttttatgaagaaaactataccaaggcacatcataatcaaattgctcaaaaacagtgttaaagagaaaaatctttaaagcagctagaggaaaaaaggacattatttatagaggaaaaaaccaaaatagcagcacatttctcattggaaaaacaaatgcaagctagaagaaagtggagcaacaccttaaagtactaaaagaaaaatatcttcaaaatgagggtaaaataaatactttttttcgtatataaagaagctaaaagtattcattaccagcagatctgcactacaagaaaagtcaaaggaggtcctccaagaagtgaaaatatctatattagatgatgaaaggcactggaaatggtaatgtacatgtacataacatgtacataatggacatgtacaaaatggacatgtacataacatttttctttcacttttaatttatttaaaagatattgactaaggcaataatcataatagcaatgtattgtgggatttaccacatatatagaagtaaaatatatgacaagaatagtgcaaaagccaagagaggagaaatagaagtttactattgtaaagtgtgcatactatacatgaagatatataataaatttaaagggtatactttaaattctaaagcaatcacaaagataacaaaacaattggactgaaataaaaaattccatttactaaagcaacaaagatgaaatacctagaaataaatctgacaaaagatgtgctagatctgttcactgaaaactacaaacatcccaaagagaaactaaagactacctaaacaaatgaagtgatacatggtattcacagattggaagactcaatattaagaagtcagttttccaaaattttccaaggactgacctatagattgaaggcattcccagtaaaatctccagcaaggaatgtcaagatgttttaaaaatttacattgtaccccatatatataaacaattatttgtcaattaaaagtgaataaacttattttaaaaattcatagagaaatgcaaaggacatagaatagccaaaatacttttgaataagagaaatcaatttggaggacttggactacctaactgtaagatttaccaagctacagtaatcaagacagtgtggtaataatattaagatagataaactgaccaaagaaaggatagcccagaaataaactcatatgtagttaattgatttttcacaaatatgcaagggcaattcagggtacgataatctcttcaactctttgtgttagaacaactggacatccatatgccatccagaaatactgatggatacctctcaccatatataaaaattaactgaaaatggttgtaaaatgtaaacgccaaaattgtaaaatttctagaagaaagcaaaggagaaaatgtttgcaatttgggttaggcaaagatcctttagttataacatcaaaagcacaactatgaaaaaaattgataaaatggacttcatcaaaattaagaatttctttttttttttttctgaaagtcactattaagagatgtgaaaagacaagccatagattaggagaaaatatttgcaaatcacgtatctgacaaacatcttgtatccagaacacacagggaaacttcattttattgtgctttgcagatgtgtttttcataaattgaaagttcgtggcaaccctgtgtcaagcaagtccatggtgtcacttttttaacaacacgtgctcatatcatgacgtgctcatatcatgactgtttcatgttatggtaattctcacagtatttccaactttttcattattagtagatctatcacggtcatctgtggaaagtgatctttgatattattgtaattgttttggggtgccacaaactacacccatataagatggtaaacttaataaatgttatatgtgttctgactgttccccatctctctcccttttcttgggcctccctatttcctgacacacaacaatattaaaattaggctaactaacaacctgaaatgatctctaagtgttcaaatgaatgaaagaatcccatctccctcactttaaattaaaagctacaaatgatcatgcttagtgagcaaggcatgtcaaaagccaagataggctgaaagcgaggccttttgcaccaagtagctaagttgtgaatgcaaaggaaaagttgttgcagtaaattaaagttgctactccagtgaacacacaaataataagaaagcaaaacagccttattgctgatatgaagaaagtttgaatggtctggatagatcaaaccagccacaatattcccttaaaccaaagcctaatccagagcaaggccctgcctttcttcgattctatgacagctgagagaggtgaagaagcctctgcaaactgtgaagccagcagaggtcagctcattagggttaaggaaaagaagccatctctattacataaaagtacaaggtgaaacagcaagggttgatgcagaaatggcaataagttatccaaaagatccagctaagatcattgatgaagttagctatgctaaataacagatttttagtgtagacaaaataatcttctattggaagaagatgccatccaggactttcgcagttagagagaagtcaatgcttggcttcaaagcttcagagtacaggctctcttgttagtggctaatgcagctggtgactttaagttgaagccaatgtttattaaccattttgaaaatcccagagcccttaaaaactatgctacatcaaccctgttctgtgctctataactgaaagaacaagcccagatgatggtgcatctgtttacagcatagtttactgaatattttaagtccactgctgaggcctgatgctagaacaaaagaatctgttggaagcattattgctcactgacatagcatctagttgctcaagagctctgctggagatgtacaaggagattaatgttgttttcatgcttgctaacccaacatccattctgcagcccacagatcaaggagtaatttcaactttcaagtcttattatttaagaaatacattttataaggctatagctgccatacatagtaattcctatgagacatctgggaaaagtaaattgaaaacctggaaaggattcatcattccaaatgccattaagaacatttgtgattcttgggcggaggtaaaaatatcaacatttacaggagtttggaggaagttgattccaaccctcagggataactttaagggattgaagacttgagtggaggaagtcactgcagatgtcatgaaaatagcaaaagaaccagaattaaaagtgcagcctgaagatgtgactgaattgctgcaatctcatgataaaacttgaacagataagaagttggttcctttgggtgaagcaaagaaagtgatttttgagatggaatctacttctggtgaagatgctgtgaacattgttgaaaggacaacaaatgatttaggatattacataaacttagttcgtaaagcagaggtaaagttttagaggattgactccaattttcaaagaagttctactttgggcaaaatgatagcaaacagcatcacatgctaccagaaaatctttcgtgaaagaatcagtcactgcagcaaacttcatccttgtcttattttaagaaattgccacatccacaccaaccttcaacaaccagcaacctgatcggtcagcagccatcaatgttgaggcaagaccctctaccagcaaaaatactataatcactgaagtctcaggtgattatttttagcaataaagaattttaaaattatgttttagacatgatgctagtgcatgcttaatacactacagtgtagtataaacataacttttttttttttttttttttttgagacagggtttcactctatcgcccaggctggagtgcagtggcgctatttcactgcaacctccacccctcgggttcaagcagttctcctacttcaagcctcccaagtgctgggactacagccacgtaccaccatgctcagctaattttgcattttttgtagatacagggtttcatcatgttgcccagtctggtctcgaactcctgaactgaagagatcccccccacctcgacctcccaaagtgctaggattacaggcttgagccactgcgccggccaaacataacttttatacacactgggaaaccaaagaatttgtgtgactcactttattgagatattcatcttattgcagtggtctggaactgaacccacaatatctcctaggtatgcctgtataaagacctctcaaaacccaataagaaaatagcctaattacaaattaggcaaggtatgtgcagagatacataaccaaagaataaatatggatagcaaaaaagcacatgaaaatagcatttctctatatgagcaatagtcaattagaaaatataataaaaaatataagatgcaatagcaaggaaagtatgaaaggcttagaaattagcttaaccaagaataaaaagagctctatggaaaattattaaaatgtaaaggactcagatttgaataaatgaaaggatatttcatagtcatggctgggacaactgaacattacacaggtatggatctggaggcattctatgtttccatctctggaggagtgaatagaaataaaatgtgcagtagaccaggtaacataagacagaagcccacttacatggtatgcagtaatcagaagaatgagattagatgtattcataaaaacatggataaattttaaaaacatagagatgaacaaaaacagtaagactgaatatgacaaagaatacaaaaccatttatgagattgacgctaaatgcacacatacaaaatgcaaatttgcaaaatgaaaaacacaggaaattcacattaaatgctgtagaactgtagcttataggggaagggacagagactggcctatggagaggtaagaaacaaatttataaaaacttggttttcaacaacaagaatcaaaactcggagggaaaaaaatagatcagctggatggaagaaaatggttttgggaagagatttgacttgagttaatgttgtgctgggggtgagcaatgaacagagctccagaggaaaaaagttctacccggggttgagggagtcttatactttgatgcccaatgcaggcacagtccagggataaatacccaatttggcacttgaagtaggaaagaagcagtggataagagctgtgctgcaagagaaacgcctgagtgagcacccctgtgcatagctggggaatacccaacaagttactatgtaccactgtggcaagaatctgatgaaaatgatgtaaggaattcataggtgtctggagttgatccaaggaggacacagactacatggacttcattgccaggtgccctggcaggtccatggtgacgagcagtgcataccagcacataagtaatgaaatcaatgacagaagtcatgcctaagcccatgtgaacagagaatagtcttaggctagatgttacattcaatgatatcacagttttatgcaatccctctgaaacttaatttactatggatcacatggaagaagagtagggggaagaatcttgaattaattgaattataatctgtgactcagttgttttgaattagcgagttaaagttttttggcaacattagaaattaaaatttaagatatgttcaattgtagaaaaataaagttacacttctgtacaccttagctctgatgaaacactcttatctgctgtgccatactctatgtgtattacccagagggtgagaggaaggcagcagcagcgagttaaattttcaaatacagtgaaaacatcagaatgtgctctttttattttattttaccttttaagatgacaatgctactaattttaaagaagaaattttaaatcaatgaaaaaatttataatattcctaaatagttttcactacatataaaagatatgccccaaaataattacgataatctatgagtatggtctgtggtttctaaaataaagaaataaaaagctcatggttcacatttaattatttgaactaaagtgcctttgtttaggatgcccagaaatgatactgaagggtatctaaaaagagaagagaatagttacttgatgcatgaaaagcagaagaaaataatgcatgtcaagatgttattccctttgagaagaatctcaagaataaaaagccacaagttgagctgaaagttaaagacaaatatttattacaggtaaaacaggataagctttgtaaaggagtacaacaagttaaaacacttggtttagtgattatcaaagctaggtttgaagatgttttgaccattattccataattattaagcatcagtcatttaaaattaaaaatttagttcttaacaacttaaggtagcattcaaaaagtgacatgtctttaaggtacaaggggaaaaaagttggctttatgacttattatttttatcaatctacaacaaaaaaatagacctattatccttctggggtattaagaacaattctagaaggtaatggttcatcattttggtattctgaaatcctatcaaagcaaatttgattttgcaatactttttccatatctataggagacttaagtcaaaaatcacaataaactaaattaaattttcctttgagaagttttggagaattttcttatgtgctcttgagatttctagaaataccctaatgcttgacaaatccatgattggaaaccacacgtaccatttactccagatttatgtgaaaaattagataagtgattatgtgactactaatatgaactattttcatttaattaggaatcaattaatgatgtaaactataatactgaatacatttgcctcaattttatatcttattaaggctattaattgataatcaaattattttttaacaaaacttacaaagctgagcatctgcatggagagttcctcctttaggattcagtttctgggtttgaattgcaggaactggtttatatgattgacctgtggccctatacatggcttgaacccataatattctgtcctgttcatcatcactggcaaagattacagtatctccttctttaacagcattaaagaacatacaaccaccctgaaggcctgtggaggaaacaaaaagacatcattaaaaatttataggattggcagattttcgtctcattcactaactgacctcatggaaaagaatggctttgatattagcagttaaatgttttaaagaatatttagtttaaaggatcaaatccacaatcaaagatttgaagaaaaacaataacaaaaagggttaagctcccatattacctcagaaataaaaaataacctagggaaacagtccatgacagagtatcattctacaagacatataaacacactccatggaaatgcatagcacaatctgatatttcatgccagagaaagaagttttatctgttggcatagttgccattctatacatgggaaaaatatataatgattaagacaaaaatgatatttcatattgcatgtattttatcttttataaaattctttcacataatattttgcattttaagtgaacaattagttaatatagtcataaatttctatttcttaatctctattcaccaatatttaatcattatgtttattaatgtctacatttcttgatcttagatattaatgtcattaatattcattcattcaattttttaaatatcaggtgtccaatactctttccagtattaatatgaagggagagagagaagtacaagcatgtattgttggggagaaaattagtagttataatataataattcatttgccatttctttgcctatttctgctataacttttgctttcccgcaaagaagtttctgaaaacattgtaatatctcacctaattattccattacagtgaattttacacatttcaatcctgcgctaaaataataacaaatatgatgaaatatggctaaaaatacaagccctccaaaagagataatttgaatctcataaagtcttgcccaggtatataagtgaaatatgcaccctattcatcgagaggggtttaaattgtagaacagacaaaggatatttataagaattccatgcatacatacatggcaggaaaagtgattcaattaagatttacctgggtggggatcggtataatccacagtatagccttcaagctgcattaattcttgtggttcagacttcttttctctataactgcacatagcaaaggtatattggctaacctgctcgagaaaaaaaaagtttacagattagtcacattaaatttaccaaatttaactttcgtttttttatcaaaatactcttttcccaattaaaaatataacataatttgcacataaattattaaattttagcatttttcaaaacctagctcagagattcaagcacctttcgtttgtcagcttgcatttgttgggtcttctatgcctatgatccagcattccccaagacaatgatttggtgctcaagcttctatattaatagaagcaccataaataagtattcatgttgatacgtttgggatcattagcctattaagaagataaatagccttctttcacttcatggtttcttacagcttttaatatgctaacgtaggctataaatctctaagagtaagattaggagtagtcctagatttacataaacatgggaccacattttcaagcatacttatatcaagacttttaacaaagtaaaaaaagatctcacgcctgtaatcccagcactttgggatgctgaggcgggcagatcacgaggtcaggaaatcgagaccatcgtgtctaacacggtgaaaccccatctctattaaaaatacaaaaaattagccaggcgtggtggcacacaccagtagtcccagcaactctggaggctgaggtagaagaattgcttgaacctgggaggctgaggttgtagtgagacgagatcgcgccattgcaccccagcctggacgacagagcgagactccatctcaaaaataaataaatgaataaataaataaattaattaattaattaaattaaattaaaataaatctcactaaaagttgagaatttagtggccacataatgaaaacctcaggcagggccaggatggagtaaattttgggcagccagtgacaacattgccaagatctggtctgcctcttaattcttcttgtcttttggaattggcctcatttccttgtgctaaagtcttactagaaccatagctgctctgaagtcacctccctgagtgtgtctgcttggatcacaaggccatatttgaacaaaatactgtaaatggggaatgtttcattagcccagtttgggtcaagagctcatgtatgcagcaaagacgtcagatgctacaacaggcaggctctttccaaagtcccccaacagagatagagggaggttctgttcccagcaggagaaaaggctgtttggtggatatacatctaaattgcaaaatatcctgcaacacagggtccatggaagatagtttggttagtgtattttttttctttttttcttttttgagacaggttctcacatcgtcacccaggctggaggacagtggcacgattatggctcattgcagcctccacctttggtgatccagtgatcctcccactcagcctcctgaatagctggaccacaggcacatctaccatgcccagccaatttttaaaaaatatttatagagaaaaggtctctgtctgttacctgggcttggttaatgttaattatttcctttttctgtttttaaacataaaatgaaactaaggaaacatagtacctttcaatagacagtgattacttcaataggaccccaaaataaactaattatgaaagacagagaaaatatgggctacattaaaatcaaggtattctcttcatttaaagggtatcatgaagaaagtaaaaaaggcaaagcaacagactaagagaagatgcatgcaaaacatatattcaatcaataactcacaccagaaatataaagaactataaatcaacagggaaaactcagaacacatgttggaaaaacgggcaaaagatgactactcttttttattttcacatccactctctgtacctgaggccaaaaagagaggtttgaggaagtgacaggtgtaagatgcagggatcaacattgtaacttttaaaaggagaaaatatattttctgttctgagaaaagaggagctcttttctctgctcctctctgctcttctacaaagtaaaaggcgcaggtcattgtgaaaattaccatgttagagactgctaagttgcatgacaaattgtggatttaaaactgaaaattaacacaaagataacatttcattagaaaaaatgctgattagataagcaaaaatgaaaatggttactagtacacagtgtgggtgacagaatgaaaactggtgtggactttctggaaggcaatctggcaacaggttctatgatatacttacgttttacgtacatcacagtacataggtacaaagatgtaacacatttttgccaagcgtggttatgtttaatcttttttttttttttttttgccaattttgatgagtgggaaatactttcactgttatttgagtttacaattcctatcacaataggactgagaattttccgttatattcgataaacatttgaagttttcttttctgtgagtttcctaatcaaatagtttgctgtttttctaatatatcatttcatcatttgtacccttctctataatcaattttgtcagaggtttattcacttttttaacgtgttaacatgactaggctatagtatccagttatttaatcaaacgctaatttaaatgtggctgggaaagtacttcgtagaaatggtgaacatctacaatcagttgactttaagtaaaggagattatcgtcgatatgtgggtgggtctcatataagcagctgaaggccctaagagcaaaaactaaggttttctgaaaaagaagacattttccctcagcttctgctgaggcagcaccagcttctgcaggagttccagcctgctggcctttctggagaactcttactgatacagtagcaaaaggctgactattttttatgcattcctttggtctagcaaggaacgtatctcaaggaaacaaatggagaagtactcaaagatgtatatgcattgtgttcactgcagtattgcatataagcggtttggttaaaatatattatggcatgactatataggataatactatgagacattaaaagagacgtgacagatttttttcttaacatgggaacctaagatataacatttctaagatataacataaagagcaatttaaaagcaaaaatgtagactgtgattctgtgggtaaacattatatatatatatgaattaaaatatatattaaaatatttacagtgattattacaggatggtgaaatgataggttattttattttatagtgttgagttttttaaaagaatatacattattttaaatcagaaaaaagaataaagttatttctattttgaagaataaaaacattaagccttaatgggagagattgaggccagtatcttgtgatacttgtggttcttgctacactaaattttccttgtgtctttcctcatcttacagacagtcaaatttactttttcccttgcatatgtctaaggtttacaaatgaaagtcagttgctcccataagggttttttttttttattttttggtaatcacttaaaggtttcagtttccttgtgttaaaaggtataattgtgtgggtgtttttgggggtaagggttaaggggttggaggtgggggtgttgagaggtaaacaataacggtccaactgtatttgttctaaaaagaagtcctttctcttactctagaaaaataacttagttcaaagttcccctattctttcataaagctattttacacagcattatcttaaaatattatgaaatatctccaacataaagaaaagtacaataatacactaacatgtatatattcatcattcggctttgttgaatggtaatttcttagagatacatatgctttaaagtgtcttttttaaaaaaggacagattcaattaatgcctatacatactcacccaagacaatttcctttctcttctcagagataaacaccatgatgacttttctgtttattatattatttccatgacgttttgaaatgtgtaccacatacaagaaaatcgataaacatcaagtactttttgcatgtttccaaacttcatatgaatatatcatacatattattctgcaactttcttccccaaaagttcaatgcttctgatgcttaaccatcttgatataaatattgttacttgaattgtcacactttaaccactatcctagtgatgtccttcactttttttcacttgtccttacaaacaatgccatgatggacattcttgtacgtcttgtcttcttgctcacatatgtgacagcttctctagtaccacttcaaggagtggaactgctaggttgttgggtgcacagatcttcatctttactgaatgttgcctagctgctttccaatttgtacatactatatatacctgtggtatatgagcactccagatataatattaatacatctttaccaagcttggtattttaaatctttttattttttgccaactttgatgggtgggaagtggtatttcactattatttgagtttacaattcttattaccaataggactaagaatattctcttctgtttattagtcacttgggggttttgtcttccttcctgatgaaataatttcctcatttttgaatgtatcatttagccattttataccattttccacaatcaattttgccagagatttattcacctttttaatgttttcgagaaatgttattgcattttgttaatcctctctgttgtttttcatttccttaatttctgccatctttcttatctcttcatttgggatatttatctctttatttatttatttatttattgagacagagtcttgctctgtagcccaggctggagtacagctgcacaatctcagctcactgcaacctccacctcctgggttcagtcaatactcctgcctcagcttcctgagtagctgggatcacaggtgtgcgctaccgtatctggctaactgtttctgtttttagtatagatgaggtttcaccatgttggccaggctggtcttcaagtcctgacttccagtaatccacctgccttggcctcccaaaatgctgggattatggcatgagtcaccacgcctggccttgattgtttttttaaactcatataattagcttattcatttttaattcatttttaatatatgcatttatgtttattctaagttcatattagcctcatctcacaagtagcatttttatgagttctgttccaaatatttttcatttttatgatttgttttttatgttggagctacttagaagtatgtttttaagtttggctttgtggttctatttttggtttttaaattaatttcattgttatcagaataattctgaatcttagtatttttgagacatgttctgcttaacacatgactagttttttaatcagtgttttgtttgcttaaaaagagtgcatgtcttgtaattattattcagtgattattcacgtccattaggtcaaatttactaattgtcaaatattctatatctgatattcttttctgatgtaaaagtattgagaaatgttaaaatttcccatcaagattatctctctgtggattcttcatgcaattctcttaaatgtctatatattttaaagaaataatctcatatatatacctgggattgttacttctttctcggactgttctgtctttctggtaacttgttctatttgtatttatgcagtgagtattttaaaaatctgatactgctttttgccttgaagtctatcttcttgtacagtcacaaaactatacaatctttcttttgtttagtatgcatctggtaaatttaaaaaaaaatctcttcagtctcaattattctgtgttatattttagatctctatgaacaacaactggggtttttaaagccctgaaaatctagtcttctaacaagatttattttaaagacaagctatatttgctgtacatgctgatatatttggatttatttctattatcttatcttgccctttgtatttgccatgcctctttttctttcattccctgtctctattaaacattaacaaaatctccctatttcctcaacagtatagaaactatatatttcttttctctcactgattccttaaatcttgtttttaagtctcctcctgaatccaggaaactttgagtgctttacttccattacccattcccatctgttaactcagtcctcattatattagttctaccttattttagtaatgtttagtatattagcatttagtaatagaaattcattattaaagtatatgatcttaacaagtcaatatttatttatatttgcccttgggtttactcattttcttgctgatgactgcttcttgactcgcactctgtcattctgtgttcaatttctttcttcctttaatttgaaaatatatccttttgaaatatctgaatatttgaaaatatgtctttaatttgttcttactcaggcgtaatggtttagttacttacatagtgttttagcccagcaatcctatcagtaattttgaagatattccattgtcagaaggcttatacatccatgtggaaaagacttatgaaagttcaactgcagttctcctcttgtaatttgcttttttttgagacatctcacttggtggcccaggttggaaggcagtggcacgaactcggctcactgcaacctcctcctcaagccattcttgtgcctcagcttcccaagtagctgggattacaggcatttgccaccaggcctggctaatttttgtatttttaatagagacgggggttcaccacgttggctaggctggtctcaaactcctgacctcaagtgatctgcccaccttggccttgcaaagtgctgagattacaggtgtgagccaccatactcagcctatttgcctcttctttatgattgttcttacatgttctcttaatctttgtcattttgcactttcatcatgaaatttctaggagttaaagagttatggttaatacttattgtatttcttatatctgataattcatgactatatcaatttaaaaatcttcccattatctgtttaaatgttgcctctgtcacatttttcctttatttaatgcctttattcaaatcctatcagaaataatcttgaagctttctttcctccatatcttttaatttctttatgtatatttttttcacctcttcattttgagttctaggcagcttcctcagattctaaccaatattccatcattaattacatgacaaattttctcttcagatgtgtctaacctattgcttaccctgtctatggaggttctaattttagtgactgtgttttgaagttttggaagttctatatgatccttttccaaatctgctggttcactttgcatactgttattttcttttttgttattgttttttattatatttttgaacctgcttataaatttcatcaccttaaataaaattattttataatttatgtatgtgagagctgtattgctgaaattcttagtggtgtaaatgatcaatttagttttgtaattttagattgtgagctaataataaacacagtgttatctctggatatcctacaaagcctagcttaagggctcaccttccaataaaaagcaatttttaaaaatgccagctgctccatggtcatcaccaatccaggattgctttttatgttaatttcctagcttaggtatttcccttatatttaataaaataaactgggactttgacattctttaagtacaagctaacagttaaaaattctgagggttaattttcctgcatattcagagcttcagctcaaacacaagattaattgcccaagggcagattttttttctagcccatcatttcacagagatctagttcttttaagttctttataagatctctgttccaaatacccactttaagaatacctcatggtacatcttctttctctgcatgagcaataaaatctcaagtgcctacctaacaacatcaacatccactaatttcaaactccagcactattgtagccacaatgtcaactcacaatcataaccattctaggtgtttgtggtctctaaagtttttcttttttttccttcacttgacctacgtatttaaaaacatgggcactatattttattcggcatttctaggtattggccaaaaaggaattcttaatattacctttaagactagccaaaactaccaatttaaatcttttgatcaatcctttaattttgctttatgaactttccaaatagcaagtctaacttttatatgtatgagaaaaactgtgtaagtccttttcactacatttcagaaaagaaaagaagaaactatgacgatggggttagggtatgcaagtaaacacactgtgtgaaatgtgtcttatgtatccttaagttataattattcaacaccaggggacctctacaaagtaatacttttatcatcaactattgaaataatagaaaatatattgggcagctaattcataagtttctcatcttcttctcttatttggaagaatcttaaaaacctgactaaaaaaagtcacctgacacatcaccacatgaacaatctggaacctgctgggagagagatgaagggcatgggaaggtctgccttccctgcctggctcacaaacatttccatcaatgactagctgcaatctatagctaccgctgtgtaaagtactccagacggaccatccagcaagactcacccactttaattcagttcttcacctgaactgccaagcagaaaaatatcacctttatgtttaaaattccatttctatatatttctcaatctaataaaaccctactcctttttccaagtttttaacaaatttgtcccctttaccattctaaccttgtttgtcatttttttgtttctgactcagtgtcttcataatacgtataaaatggcttccacagtgtgtggcacagagtcactgcttctgtattttggcacgaaatttatttcaattcagtaaatattctgccatatttgaaaatgtactatttttgaaagtataagccacatatttatcgtcttaaaaaaaaactaacagtttaacagcacacataactcaacttgtactcttaaatgtatcctcttccacttaccataacaaatgacatttgatttttaaatgtcatacactccactgaaaacactcaagaaacagtaaacatcccctcatgcaagtaggcaccccattatgttacggacacagatgtcagagccatggagaaaccaggcttaccctttcaggatacacagatagctatgatgtgaccatagttataagaaagccatcaaaataccaaggaaatttggaaacaaacaaaattaacaaagaatcaaaaacaataacttaggaaacaactaattagggagttattattcccattacaaagacactcttaccttcacaaaaatatctgacttatgtaagtggcaagatatttttatattttatatattagtacttggagaaaaaggtaaagcaaaaatattggaaggtattgtgaactgaaaactagtcaggaaaaagtggtgtttttggaattgtaatggaacataataaaatgtataatttaattctaaatctaggccaggcacagtggcttgtacctggaatcccagcactttgggaggctgaggtgagatgatcacttgaggctaggagttcaagactagcgtaggcaactaaacgagacccccatcttttaaaaactttaaaaatcagctaggcatgatggcatatgcctgtagtcccagctacttgggaggataaggtgggaggatcacttaagtccagggattcaaggtggcagtgagtcatgttggcaccactgcactctagtctgggtgacagagtgaactctgtctcaaaaacaaaacaaaaaaaacattattacatatgatagaattatagattttgattatgtagcaaggatttgaagatattacatttggaaatttaaaactatgatttttagaggattcaaaactcactaaatcataagtagttaaataaagaaccaagcttcactgaaaagaaaatgaaatattatactctaagtaattctctcacactagcattgagagacaaggtctgggcctttgagattgaggtctaaactccagctttcatggatgagggaagtaactttccaaggtcacccagataaaaagggtcaccttggccaggcatggtggtacatgcctgtaatcccagcactttgggaggccgaggcaggcagatcacgagatcaggagatcgagaccatcctggctaacaccgtagaaaatgtaccgtagagacggtagtgaaaccccatctctactaaaaatacaaaaaattagccaggcgtggtggcacacgcctgtagtcccagctactcgggaggctgaggcaggagaatcacttgaacctgggaggtagaggttgcagtgagctgagatcgcaccactgcactccagcctgggcaacaaggcaagactccgtctcaaaaaaaaaaaaaaaaaaaaaaaaggaaaaaaaaagtcaccttgagtctagaacacaactctctgtagttcaatggatattctttccaatatatcatattattttatacattctcattctgaaacttaaaaacaactgtattcccgaatagcaagccaattacctcttaatttctggcaaagttattatttcagatagcactgagtccatgatcaaaaatcactaaaggtgttggagaaagagaaaagtgaattgaatagcaaataattcaaggtagtacgcttttattctcttttctcaggtatgtgttcaataaatcaccatcatttgttttatagtaattgttaatatccttaacataaaattgtaatctttggaggtatttaataatttttctcttaaatttcactaactaggtctgaaattaatattgtcatccctttagttttttcattctgagaagctgactgttaacaggtccatttaacttatttataataagaactaatatattttgtcttgcttttttttcctctttatcttctattatttggtaattaaagttttcttagcatttaatttttatactataatagtttctttaaaagttttaaagacataacccatattttctctatttattgaaaaacaaaataattttttcactggctgtatataacatgaggactagaacctgttttattgttccattcattattttgacaaaatctagaggttaggattcacattttgtaataattacttaattatatttctataacctatctcaggaataatttttcatgtttaattgagccgccaaaatattttacaagaataaaataaaccatatgcgtttatttcattattattctaattcttctacatcttaagtttcacatgtctgagatcatactcatttatctctcaaatgtcaggaattctcctttaaatatgttcagcaatgtgaactgtatttttttctttttttgagctttttggttatagaaactttttattaagtccaattttatagatttttttaattgtagagaagcatgacagagtgaccaagattttcagccataacacttatttcataagaatatcttgctgggaaagcacaatagaaataagacttcaaggagaaaaaaactttttttttttttttttttgagacggggtctcgctctgtcgcccaggctggagtgcagtggcactatctcggctcactgtaacctctgcctcctgggttcaagcgattctcctgcctcagtctcaggagtagctgggattacaggcacgtgccaccacacctggctggctaatttttgtatttttagtagagatggggtttcgccatgctggccaggctggtcttgaactcctgaccttgtgatctgctcgcctcggcctcccaaaatgctgggattacaggtgtgagccactgtgcacggccaatacaattttcaatgattgcaagtagatataaaatcacaaaagtatttagattctattgaacacgttactgaatgatttagtggtttttatcttagaaactagtatctactgcaactatttaaactcatgatgaaagacttaggaggatgcacagttgtataaaattattttaagggacacattggcaaaatagtttaatactaatatgattgctctttcctatgttgtcttttacagagatatactcctttcttgatgtcttttgagatctgtggattagtcatactaaacaaaatagtaagttactgaatttagtttcttgtgtatttataacctctgtatctccccttatgttcttataagtacttttttcctccctctcattcattcatccgtgcacttattcattcaccaaatatttatcatgcatctacagtgaatttttccaggctttgggtacacaacagtgcctcagaattgggaaaaaaagccatctcatagagtgagaatggaggagataaatgaattgcaattaggaggtactgaaaataatttgggtgatgaattgttttgcaggaaaacaaagcagaggaaagagacattaaaagcattctattttcaatagtgtggtcagaaaggcctctctgaagacaaccatattaaggtatttcaactggaagtgaagggaagataaaccaggtttaacagatcaatctgctatgtcaaatgcaaattccactttcattttctcccctcaattacttacttatccttattctttcatacttatttttgacaaggctttagaaaaatcattttaagtcttatatatctcatttaatttttctgtaatataagaaaaacaataatagaccttacaggattttgagagaattggagagaactgatgtgggagtacctagcacaatgcatgcctgttacacagtggtctccccgtgaatctaattcagttgtcagggagccaccaccctcctctcactttattctttttgagtcttagaagaattgtttcatgttgggtacaggacacaggtgttactataacgcagtatagtcagcacctgattgacttggggattgaactctcttcaaaccacatgcttccacactgtgaatgagctgagggctgctgacactccatgtttctgacttctgtctcctggcctcacttggctttccccacccctacctttcttcccactctcagggcatgtttcttttatttttagagacaggatctcactctgtcacctaggctggagtgcagtggtgcgatgatagctcactgtaacctcgaattcctggtctcaagtgatcctcccacctcagcctcccaagtaactgggactacaggtgcatgccactgtgcccagttaattaaaaaataatacagacatggggtctcactacgttgttcagactggtctcaagctctcaaactcctggcctcaagcaatctcagtttctggagtagctgggattataggtatcatcaccatgcccagtccgttttcacaacttttatcagcaaagaaagaacacagtggctgtgttgatgaagatgtttggtggaagaatacgtaaatttataagaaactgagaaagtgaggaaaagtgctaatacacctaaatgtagttttagatactaaatttgtctatttctaatggacattatcttaattatacattataatgtcttttaaaaattattgctttcttaaaaaccaaatgttgattacttccaaaagctctttatataattaacatgttcatattgtcatgtgttaaagagtacagacttgatgtgtgtaacccacccaaaatgccaaaaatttacctgctatttaagagctagccttataaattagttgtcaaaagacatgtgaggtgaaatgcttacattaatgtgcatttttcttcacataacctgaagtacaacttgaagttgctgttttatgctataagtattgtatctctagctagctttaaatgagacaattattttttaaaaaatgctagagatataaaattttaagtaccaatttaacaagtctgaaggtacaacaacaaaaatcaagaagtcaaaaacttcaggtttagaggaatcactccatttctagaggcatggtcacttaaatggcaaagtattgaaacatttgcttttagcttttaacttcttaaatattttgtttaatatctaaaatatcatccaacagacctagactctgtcatagataattgggcctagagatataacaaagagtacagatggaagagtaataaaataccaacaactaacagagctgtcactgacaattaggaaatgtgagccatgagacaactgaaaaaggtgcaatctggcgtttcgaatacatcaactccagaagctgcaacctattaatgctatcttttgggctcactgattcctggttctgtttccataaaatgttgccatatttcatccttcttttagttcctttaatatcccaagagatcttacttttatccatcccctttgcaaggtaataataaatcacattcccaaggccagacctagaacaaacccacagggtaaattcaggtgttcctgaatagtactaacacctgtagctgctggtttactagccagttaccagttcacgggtaatctggagaaattgtactcagacctgtatcagttggcactaatagttaaaatatgctgctgaaagattagcagggtcaccctgctccctgtgctcccacttagaggcagtcttgcagcctctactctgcctcgtcaccacttgccagggaattagatagacaacaggtggtttgacctattctgatccggtatttgttttcatttacgagcctacttgtgtatttctgaacaaagcttatataatttactaaattgaaatcgaaaatcccttcagtggaagcacagcaatgagaaacattcaatatcttttacccaatccactcttaataactctgtaaagaatggatttgttgagaattgggagatatgaacagactttaatctggggacagaattaaatcaggtttcagcatcactgcttttgatagggcacctaagttgctgtagtaccacaaggtatctgcatctggtatacgaaacctcccattttgtcctcaattgccaacctgtgcaatacctgtctgtgtccacacatgttaagtgctaactatgggattctagagaccacagcattcaggtttgtatgtcgtattcctactgcagggatgttaacagctggcagcttagcaactgccaccatctaatttcagtgaagattaaggctttaaaaatccctagctggaaatgttcttggcagaggccaaaggtgctgctagagttatttaaaaaaaaaaaaaaaacaaacaaactacaccagagctgaatttaatcatgaaaaatgaataaatcttcaagatccagatagattggacaggaatatttattgttaactgtgttgtccaaatggtgtaaaaagagttagtattcggtgtacaaattagagaaagaaaagtcagtcttttcagaacaatgttgagaatgatttgcatatatttatttacttaacaaatacttagtttctactcatgtaccaggcagtgtttaaaattccacagataaagtagactaaaagaaagataagatccttcttttcatggagtatacattctagaaggagtaaagagataacaacaaaaataataataataaacatataaatgtaaaaaaaatttaattggatataaatgcccctaacaatatcaaacagaataatgtgacagagaatgagttgaggggtacttcaggtcgcctgggtggaaaaggcacattcgaaaaggcaacatttgaacggatatctaaatggacatgaaggaatgagccatgcatggggaaaataaaagctgtaggatgttcagaatttctataaagggacttagaggtggcctaacaatctaggtggaagaaaagtaagggacttaatccaaaggtgtatttacacaacaatcacatttaaaaataaccccagtttatatatttatttgaggtgcctttggtgggggtatctggtgacttgaaggtgctaaactcctactcttggcactctaattaatctgaggaaagagctgcagaagtcaagacgtggctcagtgacagaaaataactattcaaagaggaagcttgaggccagaatatttaggacctcctctaagacacggttatgagttattctaagtgcaaagggagtccctggaagaatttaagcagcaaattgtcataatgtgagttatgctttaaatagattatcccacaatgtgaagaacctattgttaagaacgagggaagtggaagcagagagaacagctaggatgctattgtaggaatccatgtgatgatggtggtttcaactagtatggtggtggagaagatggagatgactggatgtaaatggaatgctgtttttgctatggaacagcaatcttttctgccatgagggtaaggaaaaaagagggatcaaacatgacacctaggttttgatttaagtatgttcaaatataagtcaattttatattccttacagaagtttgggaagtaacctaaattaaaaggggaatattcatttatataacaaatatttacagattctccactatgtacagattcaggcacactacttgtgtagaaaattttatacacatacctgtagatataaagacatatatatgcatatgaatacttacaaatacacacatgcacacactcagagcgttttgaaatggagtcttgtagaacaattttcaaaaaaaattaagctcacaaaaatgtaaacttttgtggatttttagccagcaatttcatttctacaagaatactcccacatatatatgaagattaatatacaagaattatacatatattgatgatggcattgtttttttctcctccacaacaaaaaccacattcaaagtgtcattgtttgattaaaaaaacttaaatgttcaaagaaggaggattgttaaagtacataaacttataatatagaatccagttatttatttattcatttaagttttttttttttttttttttttttttttttctggagacagcgttttgctctgttacccaggctagagtgcagtggtgcaatcatggcctactgcagccttgaactcctggcctcaagtgattctcctgcttcagcctcccaacatgctaggattacaggtgggagccatggcacctagccttaggtagattcttatatgttgatatggcaacttctcatggatatatttttaaaggggaaacaaagcaactcacagaataaaaatatatgaaatgattccattaggaatgaatggatgtgtgtttcacataatgatgaattaaaggtgcctaactccttcaaacaagtttggaaggccacactattagcaatggctacttggcgacttttgcaaaggatagtagaataatgtggtagtgctggcaggagtgttgaaggggcctttcattttctaccataaaaattgcatggtttgatttttatcctacactgagtatgttctgggtttgtaaattttaatcccatttaaagcataaagctataaagtcattatgccatgattttcttgatttggcaacaatatctctgttcacttcactttatcttactgccattagcaaacatcagctagtgtcccaaactaaacctagaggatataacagaacttcatgttcttcaggtggtagtttcattctcaagtgagtgagaggagtctgctgtaatgggtccccatgtgtgctgaatatttcagaaatcaataggatgggcagccacttctttatgttgaaagcagatcttgatgacatcccactaacagagtgcctctcatacatctgcagcaggtatggatcactctgtggcatggctgactgtttacatcccgtgccaactcagctgatatgtaattaacattatgtcttgatagcctactgttgtttgcagaaacttcaagtcatgattctgacacatcaacaacaagcagtgaacactttgatacagggccaaaacaacacagacgtctactcagtttccaatgatgtcacacagtcagtggccttcatgagcacaggactcaaattataccatcactccctggccatttttccaatagagtaacactgttttgtacttcatgaaatgaatgatccatagtgattaatcacatatctgtttgtcttcagatgaactgtagttatgtgcatcaatgtaatcatagcagtatggcagaggaaagagaagtttgacagaactggatttgcttgactctacaacttactaaactgcataatcctgagtaagttccataacccctctgtattattttcttatctgtacaatgggtataataataatacctaccttcacgggcttattctgataagataaagtattacaaatgttttacataaatgcttgccacaaagtacttgcttaataagtattagatttaatataacaataattatgttaattggggagtgcttcagaattatttactacagaatatggaatacctgggacatacatttttgaataggcattagcaaaatatagaatgaagtaataattcatttgttcaaatctcaaatacagagtgttaaaggtaacagattattttataataatgaactacaatatattaaagtatcttaagtactttacaccaatgatatcttccaaatctaataataaaacactgagcaagcacaagaaaaataagtaacaaacatatacaagtttaattctggtagtatttcaagcatattcttcgaaatcactgttctttcaatttggcttgaaccaaaatttaccttcattaaaaaaagaggcctcttagaaagcattaaattctatttattattataactatattggcatcagaatataaacagagaccaaaatgatcttacttggaagccaaataaacactcaatattaacaactcatttattttcccaccttttgactccaatttaaatgtttacatgagagtctttgaaacgtcttttcacctcagtggctcctcgagtgttcactttgaacaatgactttgcagctggccaaaccttactctcaatcaatttttatgaggacaaattcttgagctgatggttggatttccagtgatatcactcataatacacactcacaagtggtgatgagattcacattatcaacagagcatcattctgccgatggcagcggcagacacagcaggggtatactgtcctccctgtgaaaacgattccttcacctttcaataatgcagcctgcaggtatggacctacaaactgtgtgtggatagaatcagagctgcctttaaaaatattaataaaaactacccagttcctcccaatgggtaattctcattgaatctccatacatatccatcttgattttgaagtgtgtgccctcaatttgccttcccattacgtttggaattgaatgtaagattcacttgtgtttaaaacttgtcagaatactcgcatggattctcagttcatttgggcatggaattctctgcatgaatgcatgtggatatatgcacatatatgtgtgcaaagtaaatacataatgcttaaacatgacttcaaattttaaaaagaaacctcaggtagaataaattcaaattcattatagtttggtggtactttcttaaatttaaattatgaaacatatgggtttgcctactttgaattaacttagatatcccttttaagatataaagcatatgtttgttactgagaaaacacttttagctccccaaagacatggttaatcttcccccaaaaacctaccaattaacagtctcaaagttttacaattccttcatttccaaactctcttatgagtaataatcaaagtatacatatttgccctataacttctgagtcttacaatcatatgctagaaaataagataaggggcaaaagattacttggaaccttacctggcaaaaagcatgaggtgatcatttgacctcttaagactgatctacaaaagcctaactttcatattcaaaaaatcagttaaaacaatcaaataaaaaaaaaccagcgactaatgcaaataacatactgaacatctgtggttattgggttacattcccacgttctttcatgcctatttccaccagttaagacctatgcttgctaagttagctgggtttgttcccaaactagtttatgctaacaacattagccattgaaatcatgtagttaaatgagattttacataaatgcataaaataactgaaaaagaagctgctgtttccatgaaaaatcagttgaatgctttagaaaaacttgataaagacaagtcactaacacaactttgtcaaattagatatgaatgaaatatatccataagatataaatgtgtccagaagtatctattaaaattgcttaggaaacacattttaattcatgcaccaatgtcagaaacgaaatgtggaaactgtagaagatggcttaaggtttttgaaaaatagatgacccacaaccccaaacaggtaacctttttcaaagcaaatgctagggctctatacaaacaaattaaatctgtgtgtgcacgtgtatgtatcttttattaaagttgaccaactattagttctaatcatgtaagaagaggttactttttagccaggaaaaaaaaaataggctggttgtttgccatgtagataaaactacttttcactgagttttcacacttttcatggagttaccaggctatcatgggacatcaataaagtaattttatccagcaattgatggatggctgtacgtactcactggaagacagcaaatgatcattttccttccttggcattttactatgtcattctgatctagtccagttaagcttgtttaatgtgtgccattggaatcaatgagatttttacagaatgttttgtgttaagaattccaagagtgatactcttttcatatattgggaacaaaatagcttggatttatcatggactggaatgactattacttagaagggtattctttaatataaatttaacttaattagtatgttctatgagcaaagttatccatgactacaaaagaagagtcagccaaactgcatgttctgataatatatgttcagaatccaatcgtaagcaaatacacaccagtcaagttgacttaaaaacatatttatgtgaacaggtgatttcttggcttatttgtactaaatgtggcatatttgcattaaatggcagcatatttgcattaaatatgccagttagtacaaatatatttatattaaaatcagtgattatatgtattatgctttatatataaaatatagaatgatgcagtggttctcaaggtatagtcttggaatcccagagatctccaatatcttttcagagggtctacgaggtcaaaactgtctttataagaatattcagaagttatttgtctttttcacactttttctcccattagtataaaggtgagttttccagaggttacattttatctgatattgcaaaaaattgaatgcagaagctgatgcaagaaaacagttaccttctattaagccagagggtaaagagtccaaaagcataaaacaatgccacttatttcactaaattgtttggcttggaaaacagttattttacataaaaactttagtgttagcatgtaatgaatgtactgcttttatttaaagtggcttaaacatattttaatttctaaaacagtaaattttgatagatataacccacataaacaaattttgagaactgctatcttagagtgattatttaacaggaaaaaatgactaacctgaactagaacaaagtaacgttttttccatcttttccaaaccttctgtccaagggcatacagatatctggaaagaaaaacaaaagccaaagaatacttcagatgaataatgttgtgcttccatgtaatcacatttcttccataggtatttatttttgagaccagcctgctaaaggcaaagtttagctcatttggaaagtgagacaacctgcagcttctgtgatacaaaatgagttagcttattctgggttctcgaaagggaattgatttatgtgacttatcaatttgtcagtccttaccacaaattgagcaaagtaggaattagaaaggataatcaaagaaccagtaggaattttattcttacatgcaattcttaggagagacaaaggctattaattgaggacatggttatcaatgcttcagttctcagatgactggagctgagtagtgcgccctgaggagcagccagctgcagagccaagaatccagggtgaagggtcactgtccagctgggtgaccccaaaatgtgcctgcaccaatctcagtctccatgtcctcacctatcaaacgaaaggatggatttgctgatttctaaggtctctgctagctccatcattatgggatttacctgacttatgaaagcatctcactgcaaatgttttaactataaaattctgatagtaacgaagatgccattgggtagttttacatagtttcaaccatggcttttcttcaactttgcattgaccttagtaagctgaattgaaatgattagccaatcatttgagaatattattcttactgaatatacaaatgatatactgaaatatcagggaggaaaaagaagaaattaaaaattagtgtgaccatgttgtggagagctattccaaaattatgccacaaaattataaacacactccctacaaaagtggaaaatattgctagaagtttaaaatatgacagaggcctaattttaagactaaagaaagatttttcaatattttataatcctttattctgaaatgaaggattaacagtgcagaggctgttcaaacgaaatttatatacaattctgagtgatttttttaaaggagcattatgattatttatttaggggcttaagatttttagactttcacaacttttaaaactaaaatcttaggctgaatctttaatttctgtcttattaaaataatcctattttgcaaaacataacaaacatactgtttgcccccctcccccctttagaaacagtgacatagggagttggctaaggtgtggggaattaatgcgcactcattcactactagtgggagtgtaacatcttgggagatgatcttcttgtaggataacatgtcaatacatcgaaatagtcatactctttcattcctgaatgtattaaggtaataaggaggtgcacataaaggtgtatgctgtagggatacatagaacagtgttgtttatattattggaaactgataacaaatgtccaacagcagtaaaattagtcaatacgtgctggcatatccacagagaaataccatgctgccaatgaaattatgtttttgataaaattaataacatagaaagtatcacattgtgtaatattacatgaaaagagtaggattcaaaactacacacatagttaatgatttggaacttgtaaaagaatatgtaaaaataattccaaaatattactaatagtatctttgagtggtagagttatggcagatttaagtttccttctttattccctgaaaattcacagaaattttcagaatccaggggggagaaaaaaacatggagttactaaaagtcaaaataaaaacaaagttcttgcattgtaaaacatcacccaaatggtccaaaccaattatatattttctttcagcacatcagctaactgaagtttttggtgaacttctattcagcatttatgataccgttaattcattccattatctgtgcttgtggatggaatgtgaattcatttaatgactggctgagacattactgctcttattcttacctgttcattgttttttctcaaggaccccttaaaaccctttgctccacctttgctctagcttctaatttcttctctgtggttctagtgacaggtatttagttgctctctttctgtctttctctgcaatttcctgttttgaaatgcacatatccaagctcttatttcagggttaacagcaatgacctcgggagctagatgctgtggacatgacaggtgccttttatgaaagtgaactagcaagatatgcaccaaatagctggcttggagccacagagagcatctggaatgacctttgcctggaaccacagcctgcttctcagctctttccaagtgtctcactttgcagactgttgggcaactgggtcatatacaagtgaaagtaaatagtgatacacaaaccatcaacaccacaagctactcagtgtcagtcttgctgacagtgaaggtcctgcataaagaataataatcagcattgcacatgtatatatatgtaactaacctgcacaatgtgcacatgtaccctaaaacttaaaagtataataaaaaaattaattaaaaaataataataattatatgtatttaagattaatatgctttctttcacctgacatttggtcaattttgttaatttctttattaaaaagtttaaaaatatatttggaaaaaaaacatgcaaaaaaagaataataatcagctgcaacatcatcaaaatgacagattaacaaaattggattaaaatatatggtttctttgaagacagaaagcagggggacagatggatacatacatgttgtattaggggttagtagaagatgttataaggaacagaataaaagagaatttgtgattggaaccaaggtaagcatttaaatgatgatttctgggattaggtatcaagtatccctatctagctgctatttcactggtatgaaagcagtttcttagcataagaaacacattgaaaaatgagtgaagagccagatgcagtggctcatgcctgtagtcccagaactgtgggaagtcaaggcaggaggattgcttgagaacaggagttcaaaatcagcttaggcaacatagccagactctgtctgtacaaaaataaaaataaaaattagctggatgcagtggtacacacttgtctttgctacttgggaggaggctgaggcaggataatcccttaagcttaggttttggaggctgcactgagctatgaccatgccactgcactccggcctgggtgacagagcaagatcctgtctcttagagtaaatacatgaagaaggaatgaagataaaaatgttcatcaatattatttaagaataaacactcaaaaacaatctaaaaatcaaaaattaaaaaataataattttgccattaaaagtgaggccagataaagaattactaatgatatgggaaaattcttataatgttaggttttaaaaaagcagtcatacaaattcatattatatgcatagagaaatatccggaaaaatgcaacaaaatgttaatcttatagttaatatctggcaagtgaaattaaagatgaatttcatattattctttatgcctttctataattccacaatgtctatattggccatgtcttccttttattgtttgagtagtttattggtatagtttacataaagtaaaattacctgtttcaggtatctaatttgataagtattgacacagtcatgtaaccaccaccacaatcaacttatagaacatttccacctccccaaaagttcccttatgccctttatgatcaatcccctccttacatccctagctctggcaacccctcatttgatttctgattttataatttttctttttccagaacaacatataattggaattattcagtatgtagcctttctgtctgacttctttcattgagtagaatgctttggtgattcatccatattgctgtacgtagttaatatcagaagcccactcctttcattgctaagcaatatattccattgtagggatttgcaagaatgtgtttattcactagttggtggacatttaagttgttttcacttctttggatatcataaataaagctattatgaacacttgtgtacaagtctttttgtgtaggcatgtcttcatttctcctgggtaaatacctaggagtgggattgtagggtcgtattgaaagtacatgtttaactttacaagaaactgccaaattgttttccaaactggctataccattttgagttaccatcagcaaatgtataaaggtacatcttacttttgtaatcagagaaggttaccattattaaatattagggggatgtagtcattatgactataaatatgtatttctggtacaaccaagttgaatatttagagaccaaagataaagtcctttatctcattatcttgagtacagtggagacatcctataagctttcatgcttaaatgggttttctagtttccaaggtcattctcaagttttggaatttagagtagtctaaattccttgtagatgggtaatctttttacctcagaagggctggaatgtggagggaatgaggaaaatggagcgaaaatctttttactgtttggtaactatcagataatccatttattagaaaacatctacaaaactaaaaaagcattttctcctaacccatcttatgcttggcattgctgttgaattactattctttgttgttgttgtttcttaatgttcagtgttgttatgattttttttatggtatctaaggccaaaatgatttctatttcagaaaaatatacaaaagttacatttaacctgatattatgctccactaggcaatagattttgttcattacatttacaggttccagtatctttaattacagaaacatgagttactctatatagaaagactgtatatatatctatagccaatttttaaagactttgcatataaaaatcaagttgacctcaaatagttagaaaatataacttgatctttaatgattaggaaggatcccatagcatctgagagtcactgttataaaaataaattataataactacataatgctgtaaaaggaaaatgcacagctgataaaattaaatgtaaccatttatttgacatataatggaaatggcattaatttaacagatcttcaatagctattaacttgtcttaaaaaatttgttttttatgttattatcatttgcattctggacaattggcattttactgcttcataaagtatgagtctaccaaataaacatatagaaaaatattatctaagaaatgcgtgtgtcaggctgaagagagagtacctcggctaggtgtactagagatttgctagcgggtctatgctgcagctgtattctccctcaatattttgtaacctgctgagtcattactaccttcctcatgattgtgtgattaactcaaagaagtttttttttaagggtatgtaaatgagacctgccaaataccagtcaaactgggaacacacatttaactgggttttatgtgacaatttatgatgttatccaataaaataagtatctatcacacagcatgagagaagcattttctaatgagtactgtgaatttttttcacgtgattttaaagaggaaagcagattttgtgtgtgtgtctgagggctttttaacattaatttccaccaacctacagaatttggttttaaatattttgttgtcatctttgtcaaattcttttagttaaatcagaaatatatggaaaaacaaaagaacacaaatatcatcagttttcatggccatgctacattctccagtactctattagcaaatggccctgggttggggcgggggagggaatccccaatcaaagttaaatttgatccaagaattatttgaatggggttaaaagaggtatcccattgtacatgacattttcacaagcacatatttccaaagctaatttaaatataacactttttctattgaactatttccaatgcatcacaatactcaggtaactagagtgttctggattattttaaaataactgcccagatactatttaaagtatttgttttcatgaacacatccaacttaaagcaaggtattaagcagttgttccctttgaacaacaacaacaacaacaattgcctgcttaactttaaaatcttttcttcttgcatgggattaggtaacaaagaaattagcagcactgaaacaaagctcagatttaacacacaagagtaaagccttgaagcatttagttctatcagtcagtataaacatagcaataatcataaagtattaatccctctcttgggttatttcaaacggagagcactatttgctccaaagaaacacacaactgattgctaggaaacaaagcacaaagacaactaaatatattccagtttcattcatctatgacttaaaaaaaaaatccagctatccttaggtcacactgtatcatcaaatatcagagatatgaagaaactaaactttcaaatttttgattatatatttaatatatgatgtagatgtgtagaatatattttatgctgtttgggaaaaaagttaagagaaaacatttttttaaatggtatttgcctaattgatttttttttaaaggaaatggccagtccttaagccaaaatagttactaccaacaaggcaaatagtatattttaaaaatcttctatatctgtagttatatataatcattagcatatctcagtacctacaatctttttggtgtaaacatgtcaacatgattcttaaaagagtcaactattaataaggtagctggaagataacaccacaattacttctaaaagctttcatttgcaaacaaaaatagtctttatgaaatccatcagaatgttccgtgacagcaggaacaaaaacttttctttagaaagatttcctgatcattaacatatgtattttagtaccaataaaatggttcttggcaatagatttattgagtaaaatgaagtttagtaaaaataaatttcaagcattaacgctgcaatgcttatacgacaaaactattttaaaatgcttgtctttacatagtacccggttgaatgtgtgtgttttttttttaagtagattcatatgtaatattctgatttcttttcttttaagccaaaaacatcagaagtaagtttaaccattaagccattttcctttaaatactatatattcttggctaacatttataatcacaaaagtcaatgacattttaagaactcattttctgattaaaaaattgagatttaactcatcttcatatcacaatatgtttgaactatatcccatattattctagtaatagtaaagacatagctaatattctctatgccagattttatatagaaaagagtaaaatgaaataaagaactcgcttacccaaacactttaaaagcactttatcaaacctttctaacttgaagattgttcaaagaatacttcaacacacacaaattctccaaacacattactaaatattgtagtttagtttcaattagaatggtagcacacaattctaatagaaatgagaatatgacaatttatttgcactcagtccatgctgtgagagttcatggttttactttatgatgaaaaatcatcactaatgaatatttgaaaaacataattgtatacagaagatgggaattatttggtgcctgaaaaaaagaactattaattttggtggatcacttatgagtctagcgctttattcaaagaaatgcaacaatcaatttacatgttgaatgataaagccttttcttctacaagccttcatttttcaaggaacaatacagaaagaaaaaaaaatcaatatatagagtagtttagtcctggaaagggctttcataagagaaacctcagtcaaggttgaaagagcaattaatgcaggctcaaaaatctgggccattcggatagagttcggttaacatgtggcagaagtaatcatccacttgtgaaaatgattttcggttcattctcaaacacctttcagacactcatgatcccatttaactgacaacaatacaggctatctgtgggcaccattgcatttgaagtgaaaaccaatagggaccaaatgccctcaggcactttcagtcatccctacaagttctctgctgcttgcataaaaggaatcttcctttcactacattctttcttttatttgaccccacaagattaagacttttttgcgggggggtgaggtgggggggcttgtttcaactaaggatgaaaaaagaaactgattccagacaacactgggacctgggcattaagaaacttagaagtaaatactttctggttggttattataggcttgaattattatgggaaacagtaaaagagaggtggggatgcatggaaaggatcttcatcaaacaaaattacataacatttgtggagaaattatgactaaagaaaaaccaataactcctattgttgagcaagaacttaaaatttatgtgctatataaacaggagattcctaaaagcaaatgcataaaacatagagttcttcacttatattaggtatcacattttatagaattgtccctcttccttttcctgagaagttctaccttctgttagtttcatctcagttaaatccaagttaagcctcagctcatatcagcactgtaacagtttaaaacagtttaagacagtataaaactatactaaaaatttgcttgctatagcaaaatctagaaaatgaatgaaggcaaactgcccagataagaccataaaaccccattccaccctcagataagacatcaagaactgctgatgcagttctagctgatcattcttttttttctctttttgcaaaataattcattttattttatttatttttgagacagagtctcactctgttgcccaggctggagtacagtggtgtgatcttggctcactgaaaactccacttcccagattcaagagattctcgtgcttcagcctcttgagtagctgggatgacagaggcatgtcaccatacccagctaatttttgtacttttggtagagacggggtttcaccatgttgctcaggctggtctggaactcctgagctcaagtgatctgcccacctcagcctcccaaagtgctgggattacaggtgtgagccactgcatctggcccctttttattaaaaaaaaattttactgatatgtattttacatgtttatgggatacatgtgacattttgatacatgcataaaatgtgtaatggtaaaatcgggatatttgggatctccatcacctcaaacatttatttctttgtagtgggaacatttcaaatcttctcttctagctatttaaaaacatacaataaattattattaactatagtcaccctattgtgctattaaacagtagaacttattccttctatgtgactatatgtttgaacacattaaccaacctctcttcagccccatcctccccatcccccacccccaacacccttcccagcctctggtaattatcattctaacttctatctccacagatcaacttttttagcttttacatgtgagaacatgtgccatctgtctttctatgcctggcttatttcactttatataataacctccagtttcacccatgtggctgcaaacgacaggatttcattcttttttatagctacatagtattccattgtgtacatgtaccacattttcttgatccattcatttgttgataaacaggctgatttcatatgttggctactgagaacaatgctacgataaacatggaggtacaggtatctctttgattcactgatttctgtttcttttttaataaacagacattagtgggattgttggatcacatgatagttctatttttagttttctgagaaacttccaagctgttttccataatggctgtactagtttacattcccaccaacagtatataagagttcccattctccatatcttctccagcattttacaattgatcattattaaaggatatatcttaatatagatgtcaatgcactgtcacctagaaataaaacaactagaaaaataattaattctataaaatgtagttttcaataaatataagccaaataacccaactaaatcaaactgtgcagataaatattttattaaaagacagtttttcctgatatttttctttgctaactggtcattggcattcttttatatctcaattagcagaaaagaagtaccttgataaatatttttaagtggttcatgatcagtgctgatatttatacgactgtataaatatgttaggtctttattcctttttatttttaaaaatcaaccaacaaattgtatatatttatggtgtgcaacatgttttgaaatatgtgtacattgtgaaatggctaaatgaagttaattaatatatgcattacctcaatatattctaccacaggaggcatatttcataaagcatggtttcatgtttttcctcaatttaaatacccttcaaaatttttgtctacacatgcttcactgtttgctaaaagttaaagaaaattagtaggctttccaagctgattataaaatgtctcagaagtaaataaatgggaaaaatgtccaaagaatttactgagtagccccctctaccccaaccaggcaaacttgcagagaggtctattcctccatcctctaggaagaggactgggactgtgaaaatctgaatgtctctgggagtaagcctatggcacattccaaagaaaaggacattttgcatctcttggcaaaaagtctctgaggcatctaacaattaaaaggaaatgatttacttatgcaatcctagacatttttgtgagatactctattaagctttcctttccctgaaaacgtaaatagtttagcaagaaacaaaaggtttagcaaaggcttttatgtgtcaaaccatatcatgttgactaataaaaatacattctcttttagggcacattattcccaagatataacaaaatgatcaaatgttatttaacattacatgtaatacaggtaatcctgaattaacacaaatatgttaggccttcatttccttttttttggaaatgtaggtatcggtctccctttttcatattcagaatttcaagtgaaatatgtacataaaatgcccattctataaactacatacactctaaaaaaataattaagatgacagtttgagatacagtgttttccacagtgtgtgtcttggaacatctggatacaaggaggtactgtgaagaaaaagaatggcaaataaatgtgaggaatactcagttaaacaaaactaagcaagttctgtatttattaaggacttctaagagcctgtagcagacatgtgcaaaggtaggggagaatagtgtatgtggtatctccaaaagtgcagaatattttccatagaatatctgtaacagtcatgttctctagcacatactttgagaaattaactggactagattactgttaatgagtctttaagcaataaaattatataactgggtttttacattgtttggaattaactaatatcctagtcataattaaaataccatcttcacttctaacatatttttactacgtatctataaaaatgtatgtttggggctgggtgtggtggttcacgcctataatcccagcacttcggaaggctgaggtaggcggattgttgagccaaggggcttgagaccagcctgggcaacatggcaaaaaccccatctctacaagaaacataaaaaaattagccatgtgtctgtggacccagctgctcaggaggctgaggtgggaggaatcacctgagcctaggaggtccaggctgtggtgagccatgatagtgccactggaccacagcatggacaacacagtgagaccctgtctcaaaaaaaaaaaaattctttaaaaagttttctttaaaattttgatcataatctccatggactatacttggttcctgaaaggcctcttcttctagtatgttgctctctggtcttggctaatgaggacattttagcagagctctgaaatttagtaaacaaactatgtctgtctttagagtaacatcttcctgtaacttatttacaaaggtacctaaattcctcctaacactcagcatgtttcacagatttcccttcccaatagcctcttctacgaaaactatgtcacttgaacttcaactttacactttgtgaccaatcttgtcggtagtcaaggaggcttgtggagttctgattcaaggctggaggaactgagcagtaagatacgcttgctgttaatccagctctgatatcatcctttggcttcagtgtctcagtccctgccctgctcccttgtgtttaaatacagtcatacatcgctgaatgatggaggccttctgaaaaatgcatcatgaggcaattttgtctttgtgagaaggtaacagagtagacttacgtaaacccagatggtacagcctactacatacctagcacatactttgagaaattaactggaccatacggttgagttattaactggttattatattatggttaattgagaaattaactgggctacatggtacagcccatttctcctaggctataaacctgtacagcttgtgactgtaggaattgtaacacaatggcaagtatttgtgtttctaagcatatctaaacataggctacagtaaaaaaggttataatcttatgggatcactgtcatatatgccatcagtcattgacaaaatatcattatgagctgtgtgccagcagttgttttgataagctgcccaataccccaggctgaggacacagctttgctcttgttcttgctaaactttctctgatactttgtgcttgaattcttgacgtgttagttggtcagagacatttctgcagttgctcacatggataaacactgtgttgatatcctttgatacacttatttatttatttatttatttatttatttgaggcagagtctcactctgttgcccaggctgtagtgctatggcataatctcggctcactgcaacctccacctcccgggttcaagtaattctcatgcctcagcctcctgagtagctgggattatagccatgcaccaccatgcccagctaatttttcgtatttttagtagagatggggtttcaccatgttggccaggctggtctccaactcctcgcctcaggtgatctgcctgcctcagtctcccaaagtgctgggaatacaggcatgagccatcccgcctggtcttctttgatatttttattgtcttcctttgacacgaagaactcctctgtacaaatactctctgggttctcactactcttccaattgttcacatgtagtgtgtttcaccccatttgtcccacacattgtacaatttcatccatttctaacacttatttttaaattgatttagttcttgagtctcatatttcccatttattaccgtcttcttagctcaactatcattttctcagagaactttctgcattgctaattaggtcatattcctttattataccaactaggtgacatgtagacatttcttccacaaagtcatggccagcagattgtttgactaatgtttactccccacacaagactgcaaactccatgagggcaagggccatatcagctgtgactcaccactctatcctcattgtccagcactgttccttcatatggcagacactccataaacatttttggaatgactgaatggtcttttcctagtttgtcattaggaacaattgtaataaaactataataaaggaagtaaatattttgcaaaaattatacaacatatatcaaaaatgttaaaaagtcttggatagcctttggatttttgataaaggtagtatatttagatcaagagtattcaaataattttagcagcagaatattaccctgaattttaacttaatgtgaatgatgaaaacattaaggaagcatggagcagctgctgtgaaaacaggcttggaggttcaggaatctagtgcaccttaagcccctttatgccgaaaagggacttccagggctcttcaaccaccgctgaaaatggcttcaatctcacagcatcacaaggacctttcagtcaaaatggaacagaatatattatatgtctaaagatctcaaaatgctaccagatttctaactctcactaatatgctaaaaaaaaaaaaaacacaaaactgtctgatattgacagttggaatctctgaggagaccaagtaattcagtatctcttttctttgcccgagttctgaacaaattgacttaaaagagtagacagagtacaaaacatcacctttaatactggtaaagataatactgaatagagagagagagagagagagagagagagagagagagtgtgtgtgtgtgtgtgtgtgtgtgtgtgtgtgtgtttcctgcaagtggtgggcttccttatgaggttcagtattattatgacacgtattttccccagcccagtcacagatagtgctaagaggacaggctgttccatgagaagatcttgcccatgacaggcttgtgcagaatgaacagagaacattcattacggtaatgaatatcccttacatggaagcaagtattgggaatggagaataaatgtttcccccaaaacagagagagaagggtgaaaataatgagagagacagacaaacagagaaagagagagaacctaaatgattctctaaatggctaagtgccaggtataagatttacttttctcatttgtaaaacaagaatagcaatattagctcccttgctataatagatggggtcattacaaaaatctgctgcaatgatgtatgaaaggggcctttgtaactataaaacacaatgtagatgaaggcattagtggtggtggtggtggtggtggtggtggtggtggtggtggtggtggtggtaagcagaacagaaaatatttcaacttaacttgtttgaaggactctttggggtgtgaggatggtaataaacttttcagctttgtcccatttaaggaaaaaagctttccaagaatggggcaagaatgtaagtatatctttttctaaaatgaagaatacctacaatgtcacacattacaacaacaaaaactagctcttcttattcattagataaaagcaatgtttctaaagagtacctgtattatgttgcaagctacagaatttcttaagttcttaagaaattgctacttatcaaccaactaacaaattctagactactacaaaaattataacgttcagcttctctctcatgtatctttatttaggggagaatgaataactaagtaaagccagtagtcataaagaatccatgggcagtaaggatggactacataggactagatttatataatgtttcttttcctttttaacttaaagcttaagaattccatttatttatttgctgacaaaactatattcacagtgcttctgcttatgaatgtaggacacataaaaatgaaaccaagatagtaggaaaaatagcttttgacatttacacaacatattccaaatttcaagttttggatattttttgttaaaactgaccttgtgatatctttgattattcataaactactaaacattaaagtttttctatattaatttgatactttcttgacaagtttgatatgtccaaaatgaactaccacttcacttccttttaaccttttctttttacatttttgaaaaagaaaatgtgttgaaaattacttaattctacttaaataagtgccacttttattattaataccaagttttgtactttaagacaattattttctatttgggggaatgtttgcgccatctactggacatatacatattattacttttgtcctacaagaattacaatgccatgtccaaaggtacttgtgaagttgttccttataaaccactccgaaacaaaatctattccttttctttcttttttcttacggcacatttcagcacaggaaatcagtaccttcccaccccaaaaaagcaacactaagatatattagttcaaataactaaatatttctattttaatggaatcatttcacagactcatacattcataggcatacaaatgaaagaggcataaaaacacatttggagtaaaagaaataagtaaggcatttatttcactgaaaaaagtatacccatccctaattttacaactattataagcagaaatccttctcctattacacataaaactagggataaagactagaaatctgttacatgaacttgtagaggaacaatactaattaatagaaaagaataaaagagttaaagccagtctggtggtgtctctggatttttcttaatgagtaacaaccattaaatggaatgggaggaaaatcagcctttggaagaaaatgacttttaaatatatttttcctccctgtcttttggatggcaccatctaaacagcagaattgaaaagaaacataagatttattcagcttcaattaagaaggtatgttatttttccacaggaaaataaaatgtggatcccgcttgaagatccacgccaaaattacattcctgggtatgaggtttgattcaattgctggcacatttatatctgcttttcagggagatacataaataattggaaagttaacaagaattgcactataatgttaatagattagaatccaaataattctttaactcttcagaggtttttattttttatttccttcctttgatctacaattagaaaactggcatgaaaaacttactttagactctataagacatattttggaattagtgctatttgactcacttaatatttactttgggcagtttagaacagaagatatcctcatacttaatacaaaaataatgcagaagatattataaaaggtaaagataaattaccatggtagttcctacaagacagactttcagacagatgaacacaggtgagtaaatgatccttagtaatctaaaaataaaatatatttgtgaactctaaaaagcacaaaattctaacaaatttcaatatagttttcaacaataagctttgaaataagaaaaggtttccacttaggcttaagttagcttttttttttttttttcccactagctttcaagttaattaagcttcactctatctgaaagtaaaaacaaattttaaaaagtgagtaaaatgagactatgttacattaggaaatattctatgccatagtatactctactaatgttgttaaaataactatccccactgcattttatcaccatcattttccttataacaacttacctttcaaaagataaattttctatattctaagtattgtgctttatgctttacatatctcagttaatataacaatcttataaggtttcaattatcactacagacaacagtaagttataaccaacttctgatacttttaatactacaaaagactgtgctaaaaactacacataactattaatacacaatattcattaaatatttatactttctgactttgctacaagattcactttagcattctatttaattttgaagcaatggcttccagctaccatatatataaaattgtcttcaagtaagctttttacctcttttatacggaggagatggtcttgatctcagaacaacaggatcaagaccattccttgtattctggggagagggacctcctgtgctagatgctggattgattgtgaatgggaaagtgttcacatgtatagaatgccatccctggtgggcgtaagataggaatcttcactgagaaaaaaccaacaacaactaagagttaagtagtagggaagcctcactgaggtgccatttaaagtcagcaatcttgagagagtacagtgtcacactgcagtagagaaacagctcagaatccatcagtgacagcaagctgtactggtagtttattatattctttgtgattactttctcatttgttgtcctttagcataaagactttcagaagttctacactgctttaactgcagagagcgtcaaagaaaagagtgtccacaatggaagagaaagaagaagaggtgaagttagggtatgtctgaggtcaagcacagtattgtggaaaggatgtgagaatccccccaggaggggaaccctcagaattcaagttccagcctcacagtctagtcatctacacctgcaagattctccttcctaaaaccagaggtttgaagttcttctcttaagggcaacagtattctcttttagttgttcccactaactcttaagaatggggcaacaaaattacctacttattaaaaagagaatgagtagagtccctatactaatatacttacagataagaattctaagaattctaaaactggtctcagttgagtctcaatcagttttttctaattgtaaatggagataacgattggtttcctaattgcttcaaagaattatccagaggatcaaatgacccaatatatgtattatcccttgtaataagtataaagatactacagagatgttttaaaaaatactgttagcaggctgggcacggtggctcactcctgttgtcccagcactttgggaggctgaggtaggcagatcacaaggtcaggagttcaagaccagcctggccaatatggtgaaaccccatctctactaaaaatacaaaaattagctgggtgtggtgacaggtgcctgtaatcccagctgctcaggaggttgaggcaggagaattgcttgagcccaggaggcggaggttgcagtgagccaagatcgtgccattgcactccagcctgggtgacagagcaagactccgtctcaaaaaaaaaaaaaacaaaacaaacaaacaaacaaaatactgttagcctgttagcattatcttgacatctaggctatgccccgacattgcaaaaagttagatttgggaaattctatcaattggctgatttttctacataatacaacaaatgatttatctcaaattgttcctttttgaggaggagataaaaatgaccattcaactaactactctgacttatatggacacagttgcacaatcacgggcaaaaaaattaccttaagtcttcaggctcatctatttatctattgctaatgtaggtaactttcctaagaaacacattttctacaatattccaaacatattaataagctaattgataacttaatttttaaagagttggaaataaagtatttcaaattgcacatattctaattcaggggttttcaaatgttaataagcaacaaaaatcttacatggacagcttgtgaatatacacactgccgcactccgacctctccccacccccacccccctaccccgccaaccccacaacctcccagagttccagatcgacagatcaggcctgagaatttgcatgttcaagttctcaggtgatgctgacgctgctggcctggtatccagtatccacacttttgagaactgctgttttaatctgtacctattctgaaacttaaaaaaatgaaaagaataaaagccaaccatctctgtatatttaaaaggtattttatctaaaagtatacagttatatttcccgagagtacgataaacaattttaatggaaataaaccaaaataacatttttcttgtttgctttttaaatttgatcatagtgcccccaagtggataaaaacattacttacaaaaaaggaacactaaacatttctcactgggatagggttatgcgaatttatctttttatttgtcagaatgcccaacctagtgctttgcccataacatactcagtaacagggttaatacataaatgctccgcacccccacccccatttttagaaaggcctatcactcttgccctctagagatgtggggctaagtaaccctcaaatctcttttagctcttaaattcctacatatctaatatgtaggatactggcagttgtctatttgtgccagatgctagagaaattccttgaaagaaaatcaatttttctttctagataaaaccaataatatctttattaatatgtagaaattattaatataaagcagtagttaaaaaaatagcctggagcttaaaggcttgataacgacaaatctctttaacaattaataattgtcttacctgaatgtatgtaactctctacctagctccctgccaccagctagcatttttatatccatttctttatcattcttttaatttcagaaaatactcttctattttaaatgtacacccatggtcttaaatttttgtaaccactcaaatcaacaaactcacactgcttaacggaaggacagaaattcaaagaatagaagcacaccttttggtggcaccaatataatggggctaatgaatgcatttacctctttgtgtttcccttagcttccttaagcacatgtatttctcatatgaaatatccagaagtctcatgttattttatgccaattaacaaattgctaacatgtcatgttaataaaaaaagcaattgacctaagtagaagagctaattacatggagtaagataattaaacgattctcaatatgtaatcaaaaattatggctggaagtgtttcacaatgttgtctttttgttttcaagtatctgcctatctgcaaaattctaatcagtgtatccatatgcataaaagacagatccagtgcagatgttaatttgttgcatgatagaaatcaggtgttcaattacaaataatggggtgtatgagagaacgtccaagatttccatttagccgaacgcatgcatctctgctggcaaatgattgcaaagcattcatattggaattagctactaacatgcacccaaggcacatcacattcaactcctttattatcctcattatataatattcacatctccagctctgtgtattacctaatttgccaatgatttaggagtctgaacatttgctgatctgaattctatttattgcacctgaattcttttaaaagcgtgattctgatttttatctaaactctagacaactttaatatgagggattttgtttcctaatcttacatttaaacaatcaaaatcatttgcttttgtagtaaggtaaattccttgaactgatatgatcagttcaaaataggctaagcttttaacatatcaagactatttcaacaatgcctcccaacatagtctctaagtgatatttcagcaaagtaactacacagaggagagcaaatatatttactaggctgaaagatattatgcagatttgtttttcatataattcactacaaagtcacaggcttaaggcatagttataaattgagatattcaccatgccaaacttacaaactgatacaattctgagatgagaaataaatgtcaaactgatgatgaattttatgtcctaactcaagaccctaatatttagagtttgtaaattattgagtaaatataggccaggcctcagatagccacagaagagataattgatttgatggcagattaacagtaatgtacatcaatggaaatgtcattatttttaataaatgacatgaagaaagatttaaacaggaaaaaagtgcatttttaattcctttcattctcttatttcaatgaaatcaatttcaaaatatgtgaatatccaaggttccttagccactaagaaaagaagcaaatacagtttctgagtatgtggcaattagcagaacctctaaattattcaaaagtagtaatggggagggatgtttctataaaccaaaaaataaaaaatggtgactcatggaccaaatctggcttgccaatgtgctttgaaagctgagcatttaaaaatatattttgaaatcccttttgcaggacatgttctcctgatttctataatcctgatacttccagtcctcatgacttttaacctaatcactttacacaagtatttgagttgcctggcctctggtggtacttgagtatcgtgaactgacagtgatcacttaaagagaaaagtattttgtattagtaggtggtgttgcctagcagtttagagaataagctctggaatcagacaagtgagttcaaatcatggtcacttattagctatatggctttgggcaaatttcttaacctccttatgactcagtgatcttgtttgtaagttggtatcatcatacctatcacatagtgttgtaagaactaaataagaatattatttaatgtgatagattcttcaaatgtatttaatctactatatctggatgtcagagatgtaagaagtcatatgtttggatcagcttgctaattagagtagtagctgagtactctaaaaaggtaatagtataccagataataaatatgttttatttttataaagtctgttaaagaacctttccagtatgttcacaagacttttacaaaacaggcataattaccagaattatcctattgatattgaccacacattcctgtaagaactagtagagaatattgctgtatcattgatgaaaacaaatatatatttggatttttgataataactcatgcaaatagatcttgttttaaagcctaatggcaagagttgtagattgatgggatgatatactgagccccacatcagtgaaagtgacttgtgtctcttgggaccttttaaaacttttacaaaaattccactgcgagtcttactctcacgttttccaataatactttatcaagcatttgataaagtgaggataaagaaggataacaagaccttagaggaaaccctagactattagcaccatatctacccaactgaactaagtggctgctgtgaggcagtcctaaactatctccctactgggaagagagacagaacctgtagcatgacaaggcatccttatacaaattgccttttgtaattgggtttctccaaacctaaattttataatgtaaatttatctccacagaataaagcaaaacaaaacaatattagacaaatgatatccttttgcttttaagaaaaatgaatagttgtagaatagttataaattatagttactgaataatgaacagactagaaaaatagaagtatttaagattatttattagggacctgttaattgcaaaacagtgtgttaggaattaaaatgaggaattaaagatgaaaatgacacagatcattgccacaggacacttaacgagtaagagagctaagaaagataccttcagatataattaaaaatatatagtagaaagtgctataggattctgaagatgaaaatctgttttgtatcaattgggcccataaaagatcaaggttacttcctactttgagtagaaatcacatctgtgaggatcaataagatgaaaaagtacccaatccattgcatttctaaactagaagcttaatgcttaatgcatggagaaaaaataagcacacaaacaggcgagagaccatttactgatgagggtcagtaactggagtctgaaatttctacacaggtgggtcttatggaaaacaatctttttatatgaatgggatgtcaaggggaaaagagggacctaaaggattcttttagcagttgagtttgcacagcgctttcagattcagaaaacctcaactctcacatcagaggtctgaaagggtgctaatgaagattaagggacagggggcctaagctctcaagctaccttggtcagacttggtcaccactggtcaaaataattcattgatgatagtaatgaaatgcctgatgaatgagattaagggaagctgatatctgaaaataccacatgttttcacttataagcgggagataaatgatgagaacacatgggcacatagaggagaagaccacatactgagacttttttgagggtggaggatgggaggagggaagaagatcaggaaaaataactatttactaggcttaatatctagatgataaaataatctgtataacaaacctccatgacaaaagtttacctatgtaacaaacctacacttgtactccaatcttaaaagtgaaaaaaaaaagactttcaagaagcatgtatacaactatttatcaaagaagtatatttacaactatttgtcctaggttgtttagataagtatctatgaatggtaatacaagcaaaaaaaaaacaaacaaacaaaaaacaaaagattatgctccagagaatacagaagcactacataacagaggaaaaattctaaaagaaaattataaagtgtaatgctatgatgaagaagattctttcttatgctaatagagaatgaaattaaagataaaactaggtgaaaattttacacaaaaactcaacataagcagaaaaaaagctcttttgaggtgaaacaactgcaaaagaattagaaaaaaaacttttccttgagtaataaaataaaacaaataaaaacaaaaacaaaaatttcatattaaaaactcaaggctattgggatataagaaatactgggaaaaataagctgaattattcaactcaaggatttggaaaaaacacaacccaacaatcctagggaaatagaagaaaggaaataatgaagatttgggaggaaattaatggaactaagattttttaagagagacgaaattaatacaaatgtattagtcctttgaaaagattagtattgcagacaaacttctgcaggaataacagaaattaaacagaatatttgaagtgagaaaaatgaaataaaaaataattttaaaaaaggataaaaacgcaagagaagattttaaataatattaatagctaaatctaataataatctggaaaaaaatactttccaaaggaaaaactaacataaaatgcaaaaatttaaaccgatcaacaattactaaaaaacttgaaatggccaccaaaggtattcaaaaatacctccccttacctccaaccgaagtttccaatccagatattattgaaaatacatttctaacaaactcccaatgactgaaaaatcccacttatacaaattcagtaaaaaaaaaaagagaaacaaagtgaaaaagagaatgcaaaaaaattactgtccaactgatttaatgaggttaatatacctttgattcctagactgaaaatcacttcagaacagtgaagaaaaaaattatagaccaatttaacttataagcagagatgtgaaatttggcagtggaggtgaatataaacacacaaggagaagcttaattaggttttttgttttttttttttaaaaacacaaggagaagcttaattagtttaaaaaaaaaaaaaagaacatttaccttaactcattagcagtcagataaattgaagggtattatttaaattttatttaattttaaaaaattttcgtaacatttaaataaaaatattgttttccatgaatgtaaggatgttttaacacaaaaaaactccaccaatataaattactatattgatagttcaaggagaaaaatatcattgcttccccttaccagaaaagcaaaaattagaaaggccagtaaaaccaattttgggtaaggagataggaaagtacactgtaagtaggaacagataatctggaaagcaatcttgaaatacttagtgaaattaagtatctgtatgcctcattcctgattatacatagtggagaaattcttgcacaggactgtgagtggacatgatcaaggacaactactggaacactatttataacgatgggagttggagacaattcaggtgtttatcattagaggatcaaataggtaaaatgtagtagacactgtggtatgccaggtagtacaagaagcagtgacctaaaagaatatataacaatgaatgtaggtcttaaatactggatgtttaatgaaaaaaattaaatatctatagcacaaaacatcaatatttaacacacacacatactacacattttacaaggatacacaacatccatggctatattaaccaatacaaagtggatactgctatggtttgaatgtgtctcccaaagttcatgtgtcagacacttaaaacctaatgcaacagtgttgagaagtgggacctttaagatcacaaaggactctgccctcacaaatggattaacaccattattatggcagtgagatcctgatgaaatgatgaattcagcccccctctctctttgacccatgtgacgcctttcaccatattttaatacagcaaaaatgccttcaccagatgctggccccttaatcttggactttccagcttctaaaactgagctaaataaatttctgttcattataaacgacccagtctgtggtattccattagagcaacacaaaatggactaagacagatacctatgtgggcaggagcgaaataagagatgggatcagaaatgaaatatttaagtaaaacaaaagaggggctggtgatggtgagtcattaaaagagaaataacagtattcaatgctctgtgctccaaatcctaaggaaaacaaaaaggcaatcaaggtaaatccatcaacagcctttgtaaccaatgtaattgtgtaccagtcataaagggaaaaaaatgagtatttagaatgttgtaaatttaaatgtaaatcttataactctgcctgtctgtccctctctctctgtctctctctgtctctgtctctctctttctgtttctctccatctctctttgtccatctctgtctttctgtctctctctttctttctttagtaaagcatgctttaattttatgcaataatcatatgaagaaaaacattttttcaccttttttttccattttcctaatgtgtccttaatcttcataaaacttcaactgatgattttaggtaaccatatgttcaaaatgtttcaagtcacattttatatttaatatatttactcttttgtgttaagtttactgtttaagctcatttcaagtacatgtcattttcagttaatttattttagctgcgtatttgagatttagtctagaattttaaaagtccactgaatcatgactacattacaagtttccatgtggtatcaacagaatttataattcatatatgacattatactcatgttggcatcatttacaaaagaagattttccctgaactgtaataaatgctaaaactaaaaaatttagaataccgataccccagaaatctgaaagcaatttaggactttaacttagtattatagtaatttaaaaggaatactaagttttaaaatactgtgaattccatttttcaagttgaataatccaataaaaaattaaatggtatcaaattaaagaaacatttaaagttttatgattgttaacctttcttaaccatagatcattttaacaaagtctgttgtgggtatgctcctcaatttggaactaaatttatatctcggctcttacaaatattcaaactaattatttcagaataaatgtagaatgacactttaattagtaatgtatctcctggcaattaaaattctcttgcttctctcagcaattaaaacggcaaggcatattattaaggtcccacaattcttcatacctcttcctgacaattaccatgggaaacattaaagacaagattgtagttataatccattcactgaatatttggtagcaggataaacactttcttctttcttctccttgtctagtaatttttcatttcactcataatacctatcaatcattaacgcaatttgtgctctgtatcacaaagttccagttttcattttatatgacttataaaaaccaattgattttatagaaatgtaagttatagcaatgattttaattaagaaataatttttaacccatttattcataatatgacttttacggtctgaacactataaatacatagagagtacttaatgctggcagaaaatgttagtgttggaaatagaaaatgtctaaaattactgtaaattgagtatgttaatataacaaagatatacacacagagaaacaaaaatatgtgcaccaaataggtgatactgtggttcagaatgaaatagaaaaagcagcacttttaactttcatatacctaagaatattttttaaactggtattatgagatgatttttttttttttttttgagacggagtctcactgttgcccaggttggagtgcaatggtgtgatctcggctcactgcaacctccacctcctggattcaagcaattttcctgcctcagcctcccgagtagctaggattacaggcgcccaccaccacacccagctatttttttttttttttgtatttttagcagagatggggttttaccatgttggtcaggctggtcttgaactcctggcctcaggtgatccgcccgcctcagcctcccaaagtgctgggattacaggcatgtgtcattgtgcccagccaatttttgtttttttttttttatgcttctcttataattccatttttctgtaatgaatatacatatattcatatatatttatatattcatatatatttatatattcacatatatccatatatattttcatatattcatatatattcatatctttatatattcatatatgtttatatatttattcatatatgtttatatattcatatatttacatatattcatatatatttattcatatatttacatatattcatatatttatatattcacatatattcatatatttatatattcatatatatttatatattcatatgtttatatattcatatgtttatatattcatatatatttatatatatgcatatatatttatatatattcatatatatttatatattcatatatatttatatataactattgcaacagaagaatatctaaaagttacatggaatatatcatatgtgtaatagtagcataaaatcaaatcatcatttatttgtaaatcataaattatctattgtgtaatgataacagctaaaatggacagctaacaacgtgccaggcaatgttttagtcactttagtgatactagttcatttaatccttacagcatcattttgaaattggtgattgtcatattcaattttacaggggaagaagggaggcacagggaggttaagtaacttgccttaagatcacacagtgatgaggctataattggcatgctggctgcagactctaggaactacaattaagctgtcctactatgatattacactatcctttagtaaattttaattatgtattaacatttcattattcatatatattactacaaacacacctaacactctcgttctctcagatatgatagtaagtcaaatggctaaatctttgggtaaacaacacatggttttctataactaagtgcaagtttgggaaggtattattagcagattctattaaatgttcataactttcattttaagatcaagggaaaggctaaacaaatgggaacttgtctttctataaataaaacatgcatatttgtgtccaatggacaaatagatattgtggaggataactttatctatattctttgcagtattttcaactgtaacattactttcctgttttattgtagctctctgattcattttaatgttttacacatttcaggttcaatcctcattcactttattcattatttttttttctgccctgttcatcatagtctacatcagtctagaatctctctgatcactccggttttatcatcttcccttttacagtttttcacatttcataagaggagttaagccctttctattcttaaatgcattccatgtttaataaacatccataaacacatacagttctcacaaccactaccaacaaagacagtatttttcagttactgttctcaaataatcattttatatttgttctttccctgactagggtgaccaatgaaaattccatctaagtgacttggggcaacactatcatgtatagtgttaatatacattaacactcaaggaagaataaagtaagttatttttttttaataatctgtgaattctggtataaggatattttggaaacagcttcaagctaccagttaaaatagattctgtgaaccccttatttatggtatctttccaaatggatgccaaagtcatggaagaagcaattaatatctaacagtacactacactttttacatatgattatgctgtgttttgccagcttaaactgttttcaattttacagttttaaaaattttctagtctatgctatttggttaacagctgttccatttcagtggggcaagtaattagctctactgtatctaatgcattactcttgatggttttttaagtatcactattattacagcaaatttcactcattcactcatttgagtctgacacatagtctcaataaatttactcatttattgagtctgacacatcaataaacatgtgttgaataactgatttgatgaaatcaagcatgcattcagtgcttggtcaaataatggtgaacaataaggtccagcccacaagaagttgatctgagctggtgagacaaataggagggtggatgttataattttatagtagggagtattcaagattatctgggaacacaatttgggattcccaagtcagtctgtgatggaaaaatgaaaaatatcaagggaattttcatattgtctcttaatctgaaattctgaacaatcaaaagtatataaaaatcaaccaattatcagacgataatgtgtatccactatgttctgaagcatttggactaagtaatgaaataagagtcaggatctctgccttcaagagacaataatataactataaacaaaaacatgtgaaaagtatcaaaagaaggcagtggatggtaaaagccaaaaaaagagaagaactgaaagatcttatatattgctggaagaaatgtatactggtagaactatctagtaaaacttgaaaaagttttgtattatcttgtaaagataaacattcacattcttacgagctcagcagttccactcctacgtgtccactcaagagaaactatgcatatatataccaggagacatgtacaagaatgttcacagtagcaatacatgaaatagcaagaatcttgaatgattcaaatgtccattttgatgaaatggataaagtacagtatgtttgtagcaagccatattgtgcaggaaagattatatatatgcacaaataaatgtatagatcaatgtgacatacatcatgggctaaggattatgattaatccagctccatgcatttgatgtataatagaaaaaataaattgaataggattttgtaagacaagagtgcacagtatctaacctttgctgtatagcatactgccctaaaacctcgtgacttaaaacgacaacgatttattatttcttatgagcctatagtttattaagcagttctattgacctgagctgggcaggccatgaccaactcgtgggtctgtggtcagtttcacgctggctagctggctttgttcatttcatctggactcattcatatgcctgaaacccaggtcagcacaactaggctgatttagttctgctttaccagtgggctagcccatgtgtgtcctcatggtgaaggaagtgagcaagagaggaagtgaaaatgcacatgtgctttttgaagtatatgcttatgtcaaatctgcttctgtctcagggaccaaagcaagccacatagccaaacccaaagttggaggggacaagaaagatttagggcacaaggtatgaatttaggaagcctgtttattggttctatttatgtgatcaacctaccatacgtacaaataactttgtaattcacttatctccccctttaatatagcaaagggcaagtctggctgacttaatcaaaaattttactaagtaaggtcctagacagccagaaaaaaggaagaaagtccattcttctggtgtctgtaggctgtggtaaaaagtaaagagacggaatagggaacacaggtggttgagaatgccttgggtagaagggcttctgccccacctcccattccagattctcttgtgcagcttgtaaggtaacaaatgtggagtaatcttcatgaggcagagggagggccagcatctctttcgattatcttggtataaaaaagactcaatagttctctcaaaaatcaagggagtggggacaagatggcttgcagttagcggagagtctgcttctgaggaaacattagttacacagaaaataaactgcctctcttggcacatatgtatgagaaaatgtgtaacctggtactagagtggcaggatttggtaaaagagtgaaagaaatagatttgagcaaataaaagcatgctcagggtacatgaactgatccacttggcaaagttaggagttcgtgttgggtataaaatctagacgaaccagatttttgaagaatctgaatgctagcttaaaggatttgcatctaatcccacaggcacttgggaagcaactgaattttttttttagtagagatataattgtattcctaaattcctaaatggtgtggaaaatgggaacatcgtagaaaagtccttgaacaagttttgtttgttaggatggagactgaattagggttggcagaaggaataaaaagggatttagttgtgggaagtactacagagagatagagattaactaatgtcagtgaagaggaagttgtaaattgaagataaacctaaagatcaatcgaactgacagaaaagatgaggctgccagtttcacaaaggtggaaataggtggtattcaacttttctttgattgacctgtggactactgttatatccttctaatccactgtcaaaaccatgttttgaaatgtgttttagaagtattaatattgatacgtaaaataaccagaggcattaaaaatacatttgtatttttttaagtaacaagccgatctttttttaaatcatgagaataagatgtgcttttctcttctgaattactaatgtactaaccttaaggatataaatgaatgcaggatgaatacttagaaatataatgtttgtaaaccctttcctctgttcatgtcatcgacactggtattaatgttaaaattgtggtgatgtttctttttataatctgaacacacatctatcacgctaaagcaagttcattgtataatcttccccagtattgtttacttatgattttcaagtgcttcagatacagtctacatagggggctgtggccgtgatattataccctattaacaacgccccattcaagtaagttctagttatgattatatagagaggagtaggaatactctttaggacccttatacccgtatgttaacatctatggaaagaatgccaaaattaaatacactaatagacaagcttggactacttttgaagagattccttttcatcattcctgtatttttaggccatgtcctatcctttgctatgttccataaacactcattttctcctctttagacctctgctgatcttaagctttttccttccttttttcagggactttcaagtaaggccagctttgctgccatatgctgtacttttgctgctattgcccttcactactgccatgtatgatgctttctggtttatgtaaccttctgctcctaagtttcatcccgactttggcccactgccatgctctgactctgaaatctttgcaagtcttggtactgtcagcccatgcttttgcttgcttagtccattcctctccgtatacagtctaggactcttcctgcctgtctcatcattaaaacactggttccttgtatatttctcctcattcttgtcagctgttggggaaaatattttcatgaattatttttgagcctatctaaatgtgaaaaaaaagtgtacaccaaatagaattgacagaataaatactgaaataaatatagcatgactattcaaattcaggggtcactgtagcagaaagaaagcaaattacttttatttagtccataaagataatatgaacgaagctcaaatctagggtgttttttttttgcctttaatttttataagtattggttacataatacatcattcttacaaattaaaacatattaaccctggggtatactctacccacaagaaatgttgctaaaacttcttcctacagttcaaccacagggatggtctaagaataaatgttgacaggcaacaagcctccctgcagacagtaattaatttcaatttaaagttttggggaaataatatatttctttttaatacagtctttagatttatagtcaaatttaaatttgtgaaaaaaggagacttcctgtaattcttctggggcaataatgttttgaaacacactccaacaaatccaccttacagtggtaccaattagataatttgaagttaatatccaaacaatcagtccacttacaactgtgagcataatttctgcattctattcttttctaaaaaaaattcatcaattcaacaaatatttgtttagcttctactaaatactaggcaatgttctaaaaattgggtttaaaaatagcaagtgagacaaggttcctattctatggcaatcaaatttagttgggaagctaatcaatagcaaattacaccatggcaatagcattctagttgaggatacagttaataaacaataaatatcacacagataataagagcttaaaaaaaagaatgaagccagttaaaagtagaattggaagcagagagagaagggttctttgtagggtgaacaggatgggctgctgtagagacagcacctgataagagacagaagaaacagaggaagtgagtactatgagcattctagagtagagctggcaaaggtctttagaatgctaatttcaatgacactagtctctctcactgattctttccacaaaacatttaattaggctaattatacaatcacatgaatgtcttgagtgtgatggtaactacaaaataaaagtcatgtagacagtaagtattgagtcagctgtttaggtttatcaatccctcttcaaataaagcaatttagctgggtgtggtggctcacacttgtaatctcagcactttgggaggctgaggaaggaggatcacctgagtccaggagttcaagaacagcctgggcaatatagggagaccccatctctataaaaatttttttaaaaaaactagtcaggtatggtggcacacacctgtggtcccagctactcacgaggctgagatgggagggtcacttgagcccaggaggtggaggctgcagtgagctctgttcacaccactgcactacagcctgggagacaggataagaccctgtctaaaaaatttttttaaattaaaataaaaatgaatcacacataaaactataactaaaaataaacaaaaacaacctgagatgaaattaaaactaactcacctggtatgtaaatctaatgagatcaacaatgtatcataaaacttgacaaattttaatatcacaactagcaagatttgatagactggtagagctatatggatcaaatcatacttatttaatgatttaagcaagaaaattacaagttaaactagcaaattgtagtaaaacatacaatgagcaccaccagttatttaaaaagtgttagacagcattagactgaaataaagtgaaagtgctttcttattcctctcacttgccatgaaataatctccagatgctctttatttttagaacctgagcttatttcttagataaatcactcaagtcagttgctcagacatggttcaaagcccttatgtaatattttcatttttctcccttggacatagagagaagacaaaataaagttagcagaaaaataaacacacaaagagcaacgaactaccatatctacatccataatagctgtcaaataaaaatgtaaattaaagtctaacaattaagcaaaggacctaatagggatataactgttatactctcaatgaattaatgatgatttgtacatttctatttttctcatttgtcttcaagcattttcttttgaataaagtcaaatgatgtggttaaaacttgaagaatatcataaggccgagcacagtggctcacgtctgtatttccagcactgtgggaggctgaggcaggaggatcgcttgagtgcagtagtttgagtccagcctgggcaacatagcgaaaccctgtctctaccctgtctctaatacaaaaaaattggggattgataaacctaaacagctaactcaatacttactgtctacatgacatttattttgtagttaccactgcactaattaatacaaaaaaatcaaggattgataaacctaaacagctgactcaatacttaccgtctacatgacttttattttgtagttaccatcgcactcaagacattcgtgtgattgtataattagcctaattaatacaaaatttagccaggtgtggtggtgcatgcctgtagtctcagctacttgggagactgaagtgggaggactgcttaagcctaggaggtggaggttgcagtgagcggagatggtgccactgcaattcagcctgggcgacagagtgagactctgtcttaaaaaaaaaagattagtattaattaatattattattattattatagttcaagggactcaagtaggatttcggtgaaatcaggataagccaggctgggccaagttcaacctgggaatgcaagtagacctacacatacatacatacataggttcaagtcaaggtcagatgtcgaaacatagttattttagacaaggacacaggggaaagtcattctaaaaggtacatttaaaaatgaaatatcaatttgctttgtgaaagaacagacttggctttgtttaaagcctggactctttgagcaaatactacctcgacgcagctaagattttcctcccctaaattagttggagatcataaaccctgaataataatctaaacaatgaaactttactagagtgcagtcatttcactttatgaggaaatacaatgtctgaatatttagtgtgtgaatgcagtttatgtaggcatgctgtcccaacctctggatgcccagctggccctctctctgggaaatggtggggccacaaagcagccggtgtggggcttgtctcgtttttctgctggaagtttaactattgtctctccttgcaacaagagatgagcccaatgccttttctatctttatgatggaaattaaactacagagttttatctgtgacaatgtcaaaatattttaatccatccgttcattcaacaaaatgtgtaaatagccaagcatgactctacacaaagagaaatatgagattcatctcagagtagttttgctaaaattttatcttaccaattagaaactatgataaaagtcttctattatagttatatagttacgaaactctatttttactataaaagtaatcagttgcatgcagacttctcatagatcatggtcataatgcttccacatatttgtgaaagccaattttctctttttcagttatagatttaattgtcataacagtcatttattagttccattttattttactttttttggttgagaaagtaacctttgaattaggaaaataattttatttaataaaaacaggaatagttatttgagttttaagttaatactgttacttagccactaggctatgctaaggtatagcccatttgttcaagaacacttctatcttcatgctacagacacacacacacacacaaaccaggaaaataaattcaaaagctggatgtgaatcatttaaccattcaaaacatagctggtaatttgttcaatagatttatctaagggttagtttctataattagtttagatgacatattccaaaagaataaataaactcaagtttttgctaaatatacgtcttgtggtaatgcccagtttggttttaaaaggatggaatcatagttatgcttatttgatccaaattaaatatctattttcatttacatgtagttagtcctacttaaataaactataatatatagtcgtggactgattagttatcagaaacatgagctttagattggatgcattttaccttctggtttaaaaaaatagtcatattaaaatgcaacattgagaactaaacaccatttatttcatttattttaggcatttttttacattaaaattatgttctattctcaataaactgtgtttagaatcttttaaggttccatttgtgaataaagcttactctcatttgtattacttttcccttaatactctagggagcacaatattacattttcaccatcattattcacattaatatctatctctgattatacactgtgggaggcattgagaattcaaataggtctaagaaacttagagtacagttgagaacacacagaaaaatataaataacattgataaaaatattttttaggggccatagataagtgataaatgaataaaacagagaatacatgttacaatagttcacgcaagaaagatctatttgacgtccacattattaaaacagagaataggtttttactactgaagtcctaaagatttcaaagtctaaagtgctctgaagataaaaatccattatcctccaatttatttttaatccacctaacaactctatctgtaacaggagtttgctatattttaaagataaattaatatttttaaaacttgacttgtctctcaaaattattatccatctgttaattattgattataggagaaatgattgacaaaacacgatccaggcccaaagcgaaatgctattaatctactattcctgttatgttattgctttggtgtatgatggaatacttggaagaaaaagattaacttactttctcttcttaaatgtaattaagtgcagtaaaatccattgatgaagtacctcagaaaaagacgaatatagctatgctgtaggtgaaatgtttgccaatacatgtttacacacaggtgtattattcaaaatgtttaaaactgttaccacatgggtactgagaaaacagaacagatgcttaggttaaagcacctctaactgtccctgtccatagggagcaattactattatagcattgctgaaaatgtttaattcttctaatattagtattaaaatattttaattgaaccactattttggaatatgatattcttaattctgctacataacacactatcttagcataacatcatcacagataattttcagttctaacattgcttcaatgtatacatcagaaactgaagagatatttaaatatctggaaatgcctgtatctcttagcaatgttagataattgggctatgaggcatttctggtccgtgtccttcagtgagttcctgagctttatggattaaattaagagacgatgatatatcctctttagtcttttccttcacctttagtcttgggcagaaggcaattgcaggcctttctaggggtactgatttagtcaaagagatgtgataaaaacataccctacccccaaatcaagccttgtaaggggtctggattgtctcacctatcctggagtatgctaaaccaaggaactgccaggtaagagcaagggtttcttcccactggagctaaaggttacaggacctgccctatgcatgttcagtctttgttcttgagacaagctgaaggtccaggagtattcaccatggcatagtactggccatgggtaaattagggtcatctcggcactatgataggttcctgttttttttttttttttttattattgtgccattcatcaaaagaaaaagggactgagtgaaaaagggtagagaaacaactgcagttcctggaacatactgtgttcttttatgtgtaactctactagtctctaagcactttagagcactagcactctctctagtctcaaagcactctatgacagtttcactgaacttgtcatcatcagctaaaactccttccaggactccctgcctttgtacatgctgtcatgtagctggaatgccagttctcccactgtctacctgataaatttatccttcaagttttatctcaaaagtcaggtgtcctgtgagactttcattcactatacctggcaaaaatcaggtattatttctcccaggttcccatttctgtcttacagcacttatcactatcataattatttgcatacaagtctgaattcctgactagccagttcctataggcctgcaataatatcacattaaagtttgtcctagttggaagacagtagtgctcaatacatgcctgctgcataaattactggtgagcaggtagatggatgcatgaattaaatattaaatcccagatactccatgtgcattataatctgagtcatagttagacttgactttacattactacattaaagatgcataatgttgtttatccaaatcatggttccatttctaagagcccaccctctcatgtactttttccctttggtgaggtctgttctgacactgcacatgctgcctactaaaccaaaaagcaatacagtccttagcaccatcccaactgtaatgtataccttgggtttccccctgcccagagcctaactttgtttcccctaatggtcatctaaagaatcctcctcattttttgaatcatcagttcgctccaccctgatgttagtgattgggccctaatgccagcagactctgcttgttacaaggatgcactttcttagacctctatgtctgttgctactaactcagggtaagccacttcaacaactgcttttctccatagtaagaaaaatggccccttttctttcctaatggctaatacccctatgctgggatttggccatagtaagtccaaagtgttattctgaggaagtcctggatttttggcaattcattttattcaagagttcagacctgtttcatcaccagctgcaacagacaaagaaccttggcagagatgaaggctgactctgacccctggtgatccccaggagacagtccctgcatttcttccccaggcaacagtagcagttttctccaatattgattcaattctcactcacatgtttggatcaacactcatatccctcttgttaaaatgtatatagcctcgttgggttacatctacactatgttttagtttttatacagtctatggaagtttaactatttctaggaacctcaatgctaagcttgtttcaactattattgtaatttgaagaatgtttcttagaaggtatcagtgccctggtgccctgtatcaatatgactgatgagtaatactaacacaatcaagttccaatatcgtggtagctcgcatacagttatcttaactaaggactcatgtattgagctataaagccgtctatgggtataaaaacattgagtaagataacttacgtatgtcactttttgagaaaactccatgtgaaagcctgctatactggttctctcactaaactgacaaaaataatacactgaaatgaaattcaataattcaggaaaaaaatcctcaaatttatactcacccactatgcttcatatgtgctggtttatccattcgcactgccagtttgatttttaagtcagaatcctggctattttttggaactaccattcggtgtaattcagctgatttggagctattagaagttgggtataatatcacctgtatggaaaaaaaaacccacatttaaacgcatgatacggagtgtctatgggttggaactaaaatattttctatgttttcctgtttgaaaaaatgatgtcaacacccaaatgtatccaataaacaatttgactccctactacaatagctgatggattttcaatacagactcaatttatttttttgacaaatatgtgttttcacattatcacataatgagttttcttcctgtgtcacttcataacgaattaatagcacaacaagccacagttgaattgacgttgaaaaatactcaagagacacccataatttcaagaaaattctaaactcctcagggcaaagccgttcagaaagatattctttgacattatggataacatgcttaaaaaccaaagtcaattatttgaaacagcacaaatatgcctcatgttttaatattatcattgtaaaatagtataaaaggaaatcaactcaattagagatggaaaacagcacattttctgctgtagatcaataccaaagaaggactttttcctgacatgttttcaaaactatagatattataatgactgaaacaaagtaattatttttaacaaaactgccaaattgacaagtgattatttcacaaccctcacttcacagaatcaacccaggaaagacaagcctactcttcagatgttaggtgccatgcagataacacaaggtattctcccccttttaaaatcagttatgacatatttaggcacagtttacatctaagccttaatatttttaaatgggagaatgctcatttgtataggctaaaatacaaaatatgtgaagtgcactgcattatattttaagccataaacctgaagtttagatatgaatggaagaattataaacattctcaggtattctaattttttcacaaacaaaataaatatgttcattaaaactatattgaaacatatcttcttgtgcataaatcttgaggcaacacaaagtgattgtgaatctgaaatttctttgtaatactgttataattttactttaatataacaaaactaagtccagtctcaagttgttagggatagtctttaccaatttaataaggctgccttctattcttagattctaatactaaaatgttttgaaagcattcatggcaattgactttgtcatgcccttcccctaccctcaaatcctcatttgcagtataagcagaaatcttcactgagaaatctttaagcaagactccccttctctctaggaaagacaacacagtcataaaagcttctcaaactattctcaacttgcaagttgttaaatgtatctactattttgagacttttctcaagtccttcctataaagccatagctgtgttgaatccagcatatctatatactcaagtatataaaggacatctaagaacaaactaaatgacatttacaatgttttcacaattatgatcatactctagaattcattttgactgctaaaatatccagtgtaatattttacagattctttcttaagtgacagtaaagaaaaataagctgatagcttttggctcaaaccagtagacaaaggaatatcattatcaacttagaagattattccaaaaaagaataaaagactaagatagatctctatatcctctgtagctatagctgctattttcctaataagtctggaaagctttttctctttctccacacccatcccccacaccaactttaaaaaaattatttggcatgagccacttacagactttattgttttttaattcttccttctatgtttatataaaaattggtattgtaccaaactctgaactcttatacaggaagggaatatttaaattaaaacttttgacaatttctcattctgcaaatgctgatgatggcttgctaaattaggtcccaaaataactgattttggctgatccacaaattaaaggctatcccaatatcgaataccattttttctgccacattttattttttgatgggtatttctaactgaagtcagtggaaggatttattgctcagctctgttcaattaaataaacactgagttcttactatgtgaggatacacaaagattaaagaacatgaatggctcacatctctcaagagctcagttcctcttcaatagggcttagtttatgtcttttattaatagcactcttagctctgataatatcacttcttcctattgctcttctttccctagagtatgcaatggtttcctgatttagttaatttctgggtatattcacaatcatctgcttggcttctccctatcatatgtatatctaattccctatgttatgttccctccactggaaagacgtgggaatgtttgtttttctggacagactgactgataaaggtgtgaacattggcacgtgtaacaaggggaggtccacagatacgaaatcttctgtttctaagagaagtgcattggtaaataaatgctgaacttaaacttcaaaatggtctgtaaaatagttttcaggctcccaaattgcacaagcaaaaaagtggtcatactcctttatccaatttcgccatgaatgaatagataaggaagcagctcccaaggtgcagagcccagagggccatggagaataaaggacaagggagttcttttcagaacacacaatacagctctaatcaagagatctgggacacttccttggcagggtgtcttcacagtgcctgccagataggatttcattattgtaattggacaattactgccatgcgtttcccatttttcctttttccacgtggcaaacttacccatagctctcctgtccctgttccgttactgtatattggatttatcctgaggcagaatggggagggaagatgtcgtaggcagttaccatgaactttagttcacaggtttccagcctgcaaagggccactgctagctgtgacacagatattggactggatataaaaatgaaataggactttgggctgtttctcttgagataaggtgaatgtgttctaggtttaggaagaaaggcaacaaaacaacttggtggccacaagggtgaactatggcacaccggctggctatttgccacgattcatgctttcaccagtatagaactgttgctagtaaacagctaattagccaacaaccaggttttctagctcctcctgcttctaagtagggacatatgaaagttcttgttaaaggtgacatgtgtcaccttgggaaaaggtgatcaagatacaggtttgatgtctttaccccactttattccactgccagccaagttcagagaacaccaatacctaggaaacgaaagaaatcagagccctaaatcaccatgtggaagaaagtcacacttctatcaggaatacctgtggtaaactcttacaaacctgatattattttgaattattgaaatgtaacgactttcttgttatagcatttagcagtatcctaactagtatatcaacaaggtattttgtttcaaaatctttcaaaagtaaataatgaagaattgtttttttttattagaagcagttccacttcaataggactcagttcatgtttagagattgtgtctgatgttgacagtcataataattaaaatatttaacagatataaaagcttactaaggatccttctgtatcctaaattcgcatttaaattaaactatagctctgtacaaataacttttaatattatttagcaaactattttgttctttaccattcgtttctcttaacctttccgtatgcatttctgcttcttctcatttatttttgtcaccaacactttaaatgtcttgtcagcatggcacaaaaatgatttcttgtcttaaacataaagctaatgtatcttcttcataataaaatgtcagtgtcacttgtcatctttgctaaggtgtaatggaaaccacaaaatggatttttaggatttgttaaaaattccatcaaatttaatatacaggaggaaaaactaagacttaaaaaaatgaaatataaaatacacatttacacacagaaatgtttagagtgatatggggttcagaagtagctttctcttaaaatatataagctgtcacttctacattgtttcttttctactgagatacctgattgaggccaaactacatacatttgtgcataaactctgtgatctgtgaaatcaagactatttaaattgctaaactctgtttcaacaagcacctgaaaaactaaaacaaaaaacaaaacagcactgggtgctgggggagacaagctagaaaaacagaggggctagacagacaattcactaccttctcccatatatgtctcttagcttagagaaaggaaaaaagaccctgggaccacaataattgcaccatatcttatggcaaaacagcagacacacagttggtacaattctagctcaaagatgagtgcattcagcaattcttgaaaaaatcatgacagctttcatagaggaattacagtttcacttggaagtctaaaagaacacctaagatttataaggctgacatggggtaggggatgaaaaataaagatatgggggctgttgaaaccaaacactgtaacagcggcaccctagaaaaaaacacatgattccaatgctgacatttgtaacattactctaggttctcaagctcttccccaagcttggctgttcaactttttctctgttccctggacttagcctcagtccgtttccaccgctctccacgaaaagaacttcaatcagtacaaacactcattacattttctgccatgtcaattctctttatgttcttaaaagataagaagagagggccaggtgcggtggctcatgcctgtaatcccagcacttttgggaagccgaggcaggtggatcacgaggccaggagtttgagaccagcctgaccaacatagtgaaacctcgtctctactaaaaatacaaaaaattagtcaggcatggtggcgggtgcctgtaatcccagctacttgggaggctgagacaggagaatagcttgaacccaggaggcagaggttgcagtgagccgagactgtgccattgcactccagcctgggtgacagtgcgagactccacctcaaaaaaaaaaaaaaaaaaaaaaggaaaagaaaaagagagaagataacccgagaaccctctgggcaccacctttctagagttaggaaaagggacaagactctataactgagaccagtcaccaaggaggcagaagaaagctgaagtttgtgatgtaccaaatttaagggggagagttttttaggtagtaggaagggggcatcagggtcacatggggatcaagaggctgcacattgttgggtctgaaaggctattgcctggttaaaaaagagagaggtgactggagacctgagcaggaaaaagtttagttgcggccagatagcaatggtgtgagggacatatcatgtttgaggaatagaataagacttcatttaaggtttaagttggcaaaatcaggtaagttgggcaaaatcattttggctagaaggttactgtgtgtaaaggcagggaggatgacaatacagacaggtaggttgaaggagatacaagaaggtaggttgaaggagataccagaaggttaagcttatggataaaaccagtaattatggaagattagggatagactgtaagaaatgtgttttgctaagcgtgtgttatcctatataggtaacatttagtaaaacaatgtttacaaaccagagaatgaaaatcaaattttcatactcaagtaaagaataattcccctctctctagctacatacatctcagagatgagtcatgtgactcaatgatcaggtttctcatatccaactaagtgatgaactagcctcaaacagaggaagaaggaactaaaaacacaattagcagaaatcatggttcaatttttgattaaaaatcacttctgcttacaaacaggtgtccttgagacaaaggatattttaggcaaatggctgagggaacatctttccagataagtagagcctatctctacaagaaaccttgactttttgggtttagttgatgtttctttttctctttcaattgacagagattttatactttagcaaagattcataaagacagtctctagcaaatctttcaaataccttcttgagagtgtagaaccttgaggtagcatatattatgaaaggactacctgaagtttttttcacttcagtatttatttagcagatgttaataaccacatatattaatatttgccccaatatcagaacccttatagtatgtgaagatggatcagatgatttgtctaagggaaatctatattattccttagtaacagtttctcgtgttttaatacacttgaggttgctaaatctaaattatttcttatttgatttaatatcatggcttcctgtcctacttagtgaaaacaaagaacacctgctcactcttacagacacagtgctcttttgtatactgaaagattagcattaaatcttgtcaaccttattttccatgggctaaattgagttcttttattttcaaagctggaaagaattttggaatttacaatatgcaattattcaaactcccaaccttttaccaaatgtgtacttggcccaacagagaaccacacaccacatctccttccttctatacacttttttttttaaacaagaaaggcctttttttgaaaaaacaaaatggggtagaagaaaaacaaagtattatcctaagtggatatattttccttgacattagcttgttaaaagatcaagattagaagctttgttatttgcatgatgggaggattaaggataaagcaaggaaaagaaaagtaagatgtgtcaatcattctccagtttttcctgacatctctatttaataatgatatgaagggggcattaggcaagccgttagtagtctacgctccttgagagcaagagctattgtgtagtagacagggtaattcatttgtaccacatagagtcacttaaatgagtatctttaagacattttttttcaccagttttttattgaaattactatatttaaagtatgcatcctgatgttctgatacatagtgaactgatcactacagtcaagctaattaacatatccatttcttgactgttaccattttaaaaaaatctctaagccttcttaatcacagtttccttcacagtctattgtaaacactcaccaagtatttgttggttggatgattggctggaaagatggatggatgaatgaatgggtgggtggatgcttagaaaaattagaaataaaaatgtaaacctaaaattaatacttcactgtggtgaaaagagaaaaagtcttgataactaaattactgccaaaatttgataacagagaatgatggtaattaattctacagtgtgttgtttacttaacagtctctcaaaatctatgaaactttcatccttccatatctggaatgtaacaggtagaatactggcttcccaaagatgcccagatcctaatccccaggacttgtgaatatgtttttaccttaaatggcaaaggagaattaaggtagcaggtgaaattaagattgctaactaggcaattattcacctatccaggtgggcccaatacaatcacaagggttctgaaacacggcagaggaaggcagaagagtcagtgttgatgtgaaaaggacttgaccagccattactagcttcataattgaagagagaaacaagtcaaagaatgtaggcaacccgcagaaatgggaaaaggcaaaacaaaacacacaacaaacagattatcctctagagcatctagaaaggaacagaaccctgctgagagcttgattttagctcacagagatccattttgaacttctgacttcagaactataagataacaaatttatattgttttaagtcactaagtttttggtaaactgttgcagcagcaacaagaaactaatgtgtagacaatgaaagctaaaatttcatcataaaggaaaattaaatttaccttttaaatttctcctcataagtgtgtgatttaaagatatttttacatattgatttctatcatcagctttgcttactttgtgtgtgcttatatcttgcacacacctgaagcattctgcttgtaaaaaatattttgaaatgcttaattttctctcattttgtattaatgtagttaaagttttgacttttcttacaataaactgaaaaatttttttaaaggtttaacaatgaagctgattattttggttaccagaatgaagaccattatgtttatattactaacaaagttcaagttccacacaacctaacgattaagaattatttctgctatttcaaagcctttcttgaagattccaaaagacataatcaagtttgtcagtcactgtatttttcaaggctcaattaaggatagtgtcttttattaatatacatagatcacttttcttgtttataaggtattgatttcatccttcttagatagagcaatatactccaacacagctatatctgtgtttttaatatgtatatagacaggaaagcatcactattcttgatctattgccctcagccataaattatgaatagcataacctttacattactttatcaaaacagtttctattagaggatactgcttgagtagctttatcatttttctttttactagtctgattataataatgcttgccatttatggagaatctatcaactgagtgtcttggaatgctttgtgaaatttaaatcaattcccacatcacccctcaaaggtaggcactattttgttatgtaaacttggcactgaagttaaataaatatctagaggcaaatcacttcaaatcacttcaagataacaacagacactttcaattttatatcgcccccctcaattcaacatattatctccttaattatttcataaatataacaaatttagttttgttcttaatctttggttattaagtacaataagaatttttagagccaattcaatgtcagtcaatccataacatacggtggtcggatggaaaagagggaggtataaacaatatctagacttggacaattattttagctgtatccttaaagtgaagagcatggaacataaagttatggcaaaatgttttgggattggctagctaattcatggactactgatagatgtgggtatttaaattaaaaaccaactacaggttgtgcattcctaacctgaaaatccaaaatcagaaatgctccaaaaccctaaactttttgagcatccatatggtactcaaaggtcgtgcctaaaggaaatgctcattggagcattttggatatcaaatttttggattagggatgatcaaccattaagtataataaaaatattccaaattctgaaaaaataaaaaaactagaatacttctggttgcactttggataagggatactcaacctgtaccaccttaaactgtgaaggtgagctcttgttcttcatatgaataagggatccatgcaaggtctaacaatcacaacataataatgtaccaaaataacactaatgaaaacctttccaagttggaatacttatatactgttggtgggaatgtaaattagtacaacctctatggaaaacagtatggaaatttcttatttatttatttatttatttagagatggagtctcactctgttgcccaggcaggctggagtgcagtggcatgatcttggctcactgcaacctctgcctcctaggttcaagcaattctcctgcctcagcctccggagtagctgggactacaggtgcacaccaccatgcctggctaatttttgtacttttattagagatccattttcaccatactggccaggctagtctccaactcctaacctcgtgatccacctacctcggactcccaaagtgctgggattacaggtgtgagccaccatacctggctggagatttcttaaagaactaaaaatagaaatatcattagatccagcaatcccactactaagtacccaaagtaaaagaaatcagtatatcaaaaagacacctgcatgcctacgtttatcacagcgttagtcacaataacaaagtcatagaatcaaccaaaatgtctatcaacagataactgcataaaatttttaattgcataaacatatgtgtgtacacagacacacacatacacacacatgcacacacacacacacacacacacacacacaaaacactacccagacataagagagaatgaaattatgtcttttacagcaacatggatggagctggaggccattatcctaagtgaaataattcagaaacagaaagtcaaatacagcatgttctcacaaatgggagtgaaacaatgggtatacatagatatatggagaggaagggaataatagacactggagactccaaaagggggcagtgggaaaggagggtgagcactgaaaaattacttactcgatatgatgatcactattcaggtaatgggtacactaaaagcccagacttcaccgctatgcagtataaccatgtaacacgactgcacttataccccctgaatttatagaattaaaaaaaaaaaaacttcccaatttgccattttatatgtatgcaaactagtcagtagtcacttaagcaatgggaaaggaagatggacagggagtatgaggttgagaaatctctgcgatacattttcatatgctcaaaaaatcaaataaattcagaaaagtaaataacacaggaagatagtggggaataaggtcaggacatggaatgattcatgggcagaagagatgttatgtgacttgttcatggcctcatggctactatggcagagccaataccagaattaatgtcttcaaaatcaggtttcaaagttttcagtttgtcatgctgaataaccaactaatttgaatcctgctcttctgatctaaggagttcttgactcatacaacgcatataatacaaaccatcagggaataagagtgttttctcataccactgctaaaggcaacagaggtaaatatttttttccagctttattgaggtatacttgacaaaattatacatatttacactatacaacatgttttaatatccatctaacatagtttttgtgtatgtactgagaacatttaagatatattctcttagcaaattttcaagcgtataattcatgattattaactatagtcaccatgccatacaacagatttctgggactgattcatcttaacgaaaactttgtagcctttggccaacatcttcccattcctcatcccctccatgcctatgaccctggtaaccaccatcctactctctgcttctaagagtttggcctttttagattctacatgtaagtgacatcatgtggtatctgtctttctgtgcttggcatatttcatttagcacaatgtctcccagcttgattaaatgacaagatttcttcagtttttaaggccgaataaaatcctactgcatatatgaaagaaatgctcaacatcgctaatcatcagggaaacgcaaataaaaccacctcacacctgaatggctattaccaacaagataaaagataagaatggctattatcaacaagataaaagataagcattggtgaggatgtgggggaaagggaacccttgcatattgttggtaggaatgtgcattaatatagccatttcagaaaacagtatgcaggttcctcaaaaaaagtaaaagtagaattactatatgattcagaaatcccactttaaggtatatatccaaaggaaatgaaatctgtatatagaagagatatctgcactccaatgttcattgcagctttattgacaatagccaagatatgaaatcaacctaaatgtccatcagtgaatgaataaaatggggtggatattctaaagtgactttgaatagctctgagatacacaggacttattttattaatatagtgactaaaagagcttagtaatacacttgagaatgtttcaatttacttctatttcaggtagaagactaaacatactagaacttcactcgctgtaggatccaaattgtacattattctataattgttgttctagtttattacttgattagggatatcaggcatccaaacaaaagtaactaattctgctttctagcataactttgcataggagaaatgaaaccaaattaagcacatttcagatttattcatttgttcacctatccctccaacattaattggacatacactgtgagtcagaaactgctagacagctgctgttgctaaagtgcataatatgtccatggccttaccctcaaaaggataacaatacagtagatgccactatgaactggaaaaatttaatttgcatctttgtgccacagttgctttatctggaaagtgaagagattggattaagtgagctccagtgtccttttaaactccaaattctactaaccaataaaacagaaatagccagaaataacagttagttttgtttcttaattaattatagataaaatatcacatgaattatgtaaaaactaaactaatttatctagtagcttttcttcaaaattcagctgaacataaaatttcagtttcactgacttaggaagtacagtttgcagcgaactcaatcccatcagcaccttgaaagataacctctactctcccatcactagatactcagcttttaatttatatgaaaaaaggcactgactattctggctaggttgtttgttttatttgtcctaaggattacaaaagcatcgactttggtgtgatgcacacatgcaggacacccctaccagcttcctgaacatcccctttttttcttcctgaaacaattctgattttgttcaaagcaacaattgttaaataaatgtacaatcttctaaaccttttctgaacctaaagatgactatgtgacactagtttaaaagataactaaccatttaaagaatgtaaaaacaatgtagtgtgggtttgtaacatatgtaaaagtacaatgtacaatgcataacaataactcaaatgatgggagggaagaactagaggtataatattgtaaggttcttaaatatacattaaatgttataatattacttgacttagcctctgatgagttaaaacaacataaaataacaagacatttatcagtaacagagcaacaaagaagaaaaactagaatcttaaagaacattcaacctaaaaaaagcagaagaggagaaacgggataacagaagagaaagaaaaaacatctaaatgacagatttaagcttaaccatatcaatattcatattaaaatataattgaaataacccagttaaaaggcagaggtgtgtcagaatggataataaagacacaattatatgttgcttcaagaaatatagtctaagtgtaaagaaacaaatagattaaaaaatgggaaaaatagaacatgctaatactagtcaaaagaaagctgggggctgggcacagtggctcatgcctataatcccagcactttgggaggccaaggtgggtggactgcttgagctcaggagttcaagaccagcctgggcaacacggcaaaaccccatctctacaaaaacaaaaataacaacaacaataacaacaaaaagaaagctgaggcagctaagataaagtagatttttaaagtaaagtatactaccagggataaagaaggtcatttcataatgataaaagatcagttaatgagaaggaaatcgtaatcccatctatctatacactgccatatcagatattcataaaacatgaggcaaaaaaagataaaacaaatacaaaactatagcaagatatttcaatacctaatagctatataatataatatttacaccaaagagctcaatgggacagaatagagagtccaggaataggcttacagatatatagataattgatttttcacaaagatgttaagtaaattcagtggagaaagcatttcaacagactgtgctagaacaacatgttcaaataaaaactttgatctatatgtagctctagatctgaaaattaactaaaaataaatcaaagactaaatgtaaaaatctaaaactatacagcttctagaagaaaacagaggagaattccaactttgggtttggtgaagatttcttagatacagcaccaagaacctgagccaaaaagaaaaaaatcataaattggacttaatcaaaattaaaaatttttgttctttgaaatatgattaagagaataacgagagctatctatgacaaacccacagccaatatcatattgaatgggcaaaaactggaagcattccctttgaaaactggcacaagacagggatgccctctctcaccactcctattcaacatagtgttggaagttctggccagggcaattaggcaggagaaagaaagaaagtgtatccaattaggaaaagaggaagtcaaattgtccctgtttgcagacgacatgattgtatatctagaaaaccccatcatctcagcccaaaatctccttaagctgataagcaacttcagcaaagtctcaggatacaaaatcaatgtgcaaaaataacaagcattcttatacaccaataacagacaaacagagagccaaatcatgagtgaactcccattcacaactgcttcaaagagaataaaatacttaggaatccagcttacaagggatgtgaaggacctcttcaaggagaactacaaaccactgctcaaggaaataaaagaagatacaaacaaatggaagaccattccatgctcgtggataggaagaatcaataccgtgaaaatggccataatgcccaaggtaatttatagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccctagaagaaaacctaggcaataccattcaggacacaggcgtgggcaaggacttcatgtctaaaacaccaaaagcaatggcaacaaaagccaaaattgacaaatgggatctaattaaactaaagagcttctgcacaacaaaagaaactaccatcagagtgaacaggcaacctacagaatgggagaaaattttcgcaacctactcatctgacgaagggctaatatccagaatctacaatgaactcaaacaaatttacaagaaaaaaacaaacaagcccatcaaaaagtgggcaaaggagatgaacagacacttctcaaaagaagacatttatgcagccaaaagacacatgaaaaaatgctcatcgtcactgaccatcagagaaattgaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgtggcactattcacaatagcaaagacttggaaccaacccaaatgtccaacaatgatagactggattaagaaaatgtggcacatatacaccatagaatactatgcagccataaaaaatgatgagttcatgtcctttatagggacatggatgaaattggaaatcatcattctcagtaaactatcgcaaggacaaaaaaccaaacaccacatgttctcattcatagatgggaattgaacaatgagaacacatggacacaggaaggggaacatcacactctggagactgttgtgaggtcgggggagcggggagggatagcattaggagatatacctaatgctaagtgacgagttaatgggtgcagcacaccagcatggcacatgtatacatatgtaactaacctgcacattgtgcatatgtaccctaaaacttaaagtataataataataaaaaaatttaaaaaagagaataacaggacaagccaaagactgagagaaaagtatttatatcacactctcataaagaaggtataaataatatgacctttccaaattcaaaaatgagaaaacaagcaacccagttaaaaactggggaaaatatttgaacagattcttcacaaaagaaaagctgcagatggcaaaaagatgctaaacatcattagtgtttttgctaagtgccaattaaaaccataatgaaataacaatatatacctattagaaggcattagtacagtgtacatgtctaacatttgttctacccgagacagaggaaaacctctattattctgaggaaatagtaaaatgtcaactacttttactataatcacctacaaaggacaccatagaggatgctgtgcataatatgatcagcccctgtaagtggtgataaggaaagaaatactttcctctacctctacagtgaagactcaggccaacttctcagagaatgaccaaggcagacacaccgagcaacaactttcaaagtcaggcatggaatgacaggtagaaacccataacacttcaaagcatgtgattaataagccagacctaattagaaagaatttgcatcttatgtgaattagccctggacctttccctgtctgcgctcctgcttcgtcactggtgtggtgactgagatatgattataaagtctcatgaagaattgctatctgaaaggatttaagccatatgtagccaatacatgtaactggaccacggaattaaaattttttctctaattatctagtttataagtagttatcatggaacttctaaaaaacttatgaagtaacagatgaggagtagattaaagatgttttattgaataattaactatactaatttttcacaaataattacaaaaaaattaataatcactttaggcctttccttaactctcacagacaaaatttatattggggatttaagaatgccagcattatatatctacatgtgaatgaagaaaacattagagaagctcctcgtgaaatcataatcacaggtatttttcttcaatttgaaagcaaaatttaatggctaattttattgaaacagcactaaatgactgactgatgctttacctagtgaattaatatcatatgctgcaagatggaatggaaattcttttgcatcctatgtatgtctaattcaactcttcatatataggagacttttatatttgtggtacaacttttcttaaaatcacagaaaagttatccttcctccttaaatcctttcagatagcaattcttcatgagactttatagttttatctatgctttccccatccccatggaagcagaggactcagcatccttctgtatatactgaagatgtggtattaaggccatgaactcaatctattaatggacaataggttccttctgtttgtagaaatgtttttatagcaaaatttctaaaatgaaagaaaagttattttggcaaaccctccaaaaatttttttgtactgaagatgaccctttatcaagttaaagagttacccaggagtatatactacccaatatttcactgtgaaagactcaatggaaaatgcattgcccacaaatagatgtcccttgggactgctatttagatttttatatggctatgttaggcaaaacttgcttttcaagtttttcaggacaaaattatcttcattatgataaactatatacttagggatgcttgactggtcagctgtttacctgctaggacataatcataattgtttcctgagaaaaaatccttgttctgcctccaggtattcccttagcacctggtggagggttggccatcaattcggatgaaaaatctccatatgccacctctatttccgtaaataggtatttgcatctgccatccacaaacaaaatttgcatgccaagtacttgccaaataatataaccttcaactgcccaatgtctacgaaatttgagctatcatttcacaaacctacaggttatgatatttttcttacaacaaagagtcactaggttctgaacctgtccgcacatttgtgtcaatgatgctatttataccagtgcttctcaactctgtatgcacattagcatccccttggaagtgtttaaaatactccctccttggcataccccaaaccaactaaaggaaatgcttggacctagaaactgaatctttttacaaccttctctgaccaggcatagtggctcatgcctgtaatccctacactttgggaggttgggatgggaggatcacttgagcccaggagttcaagaccagcctcgaaacattgtgagactccatctctatacaaaacaaaaaattggctgggcatagtggcatacaacagtagtcccagcaacttgggaggctgaggtgggaggatcgcttgagcctgggaaattgaggctgcagtaagccatgctctccggcctgggcaacagagtgagaccgtcaaaaacaaaacataacaaaaacaaacaaaaaaccctcttcaggcagctctttttctaacaactgtcagaaagaatgttttcatagcaacatttctaaaattaaaaaatcattttggtaaaatacccaaaatgtactttgtactcaagaataccattcaacaaactaaatagttaccaggaatatattacacagtaattcattcacaaataaaagtgcactggcagccagatagtaccctaagaagattcaaacattttataaaatgatataaactgtatgtctaaaatgactatgtataaaaatactttagcttaaataatatttgatttctgaaaaatctctgcaatgactgaacctgcaatttcttcaaatggttttcactgtaagaataaaaataagaaattttatcttctattgcactgggttacttttgaacagagtattcagacatacacacttactggaatacattctaaagacaaatcaaatggcaaaaaaaatgtttatctttactatgtaagtttgttggtggtggcactgacacggtatttttgaaattatttacgcaaaatgagtaaatatattgatgtcgttgagaagcagtaaactcatgttttaaaaaaaaatgtgtatttcttgggctgggaacagtggctcatgccaggaatccaagcaatctggggggctgaggtgggaggatttcttgagttcaggagtttgagaccactcttggcaacatagtaaatccttgttctaccaaaaaatctaaaaatttgcccagcacggtggcatacacctatggcctcagatactctggaagctgaggtaggaagatctcttgagcctagcaggtggaggctgcagtgagccacgattgtgccaccgtactccagcctgggtgatagagtgagaccctgtcttaaaaaaaaaaaaaaaaaaaaaaagtatatttctcaactaagaagtgttgatacatatgtagaatgttagtttctaaattccatcatcactaaaaacaaccagtgctaataacaggcctggggcagggagagtacaagttgagcctctaaaatttcatgtcccagaaagcaaagaccaataggtacatgatttaaaagaaaaaaaaaacatattggtgctgtgggggaaatttttaaaaaaggaaaaggaagatagtaaaggaacacacatacgcaaatgcatacacacaactttgacacaatctgatcatgaaaaaataacagacacagactataacacacaaattttttttaaatctatgaatctttagctaaaacactgagtgaaaggtggttagagaaactctaatagtaacaccccacagcttattaaaatcaaaacagaaaatgatatctttacgatggagagaactggcagatgccaccttaaccaagtgataatacttaattaaaatccccaatattagaaaaaactgtcactctgtaacttttgataagatgcaacgggaagcacaaaacattatgtaggtggatgcttggcaaagatgtttacctaaaaccagtcatgaaaaaaatagtcttatttttttcttattctggatttttctaatccagaataaagaacattttataagactaatttggatgcttaaaaatgtcattataataaaagtaaaaaaaaaaggtggtgggagcatctaaaataaaggagactgaagagctacaacagcccagtgcaatgtatgatcctggattctatcctagactgggggagaataccagcttttattgacatgttgggataattagggaactctgaatattgactgcatagcacatatttctgaatcaatattaaatttcttaggtgtaatgaagaaattgaagtgatgtaaggaaatgttcaattctttttcttttcttttctcttcttttccttttttttttttgaaatggagtctaattctgtcacccaggctgaagcacagtggcacgatctcggctcactgcaacctccccctccagggttcaagcgattctcctgcctcagcctcccaagtaggtgggattacaggtgtgcaccaccacacccagataatttttgtatttttaatagagatgaggtttcaccatgttggccaggctggtctcaaactcctgacctcaggtgatctgcctgcctcggcctcccaaagtgttgggattacaagcatgagctactgcacctggacagaaatgttaatttcttaaacagtatatgctgaggcatttcataaaatatttaaaagccttttttattataaatgtttataataaacactatagacgttttacgttttagaataatttaagacttacagaaaagttgcaaagatagtatagagactttctgtacactcagtttccctcagaatgaatagtatacattaccatggtacatttgttataaccaagaaacttacattggcacattactattaactgaattccagattttatttggatttcacaagtttgttcatcaatgccttctttctgttccaaggtccaatccagggcagcatattgcatttcgttgtcatgtctccttagtctcctctgatttgtgacagtttctcacttttcttttttatgaccttgacagtctggaagagtactggccaattatcctgtataatgtcaccaatccatgtttgtctgatgattagcctgggttttggggcaagaataccacaggggcaaagtgtcccttctcaaatcataatagagagcataggatatccacatgacatcagtggtagtggtcatcttcatcacttggttatcaagagagtattggcagcatatgtttcccccttaggttactgaggtctgtttcttttctcatcacccctttcagtggagctatgtcatacctgtagagtacaactaatttcatctgtctcagtctctatcctatgttggcacccttttgatgctgctggttgatgtgttcattagggaagtgtgtgtgtgttcatgttagtgtgcatacattaatgtacattctttgtaacataaagttctatacctcttggcaaatacatacaagtatgcatctgatatggttaggctttgtgtccccacccaaatcttatcttgaattgtaattcccataatctccataatttccacaagtcaagggagagaccaggtggaggtaactggatcaccgggatggtttccctgatctgttcttgtgatagtcagtgggtctcaggagatctgatttttttttttttttttgagatggagtcttgctctgttgcccagtggcgcgatctcggctcatgaaacctctgcctcccgggttcaagtgattctcctgccttagcctcctgagtagctggggttacaggtgcccaccaccacgcctggataattttttgtatttttagtagagataaggtttcaccatgttggctagtctggtcttgaactcctgacctcaggtgatccccctgcctcggcctcccataatgctgggattataggcatgagccaccatacctggcctgatctggtggttttataagcttctggcatttcccctgcttgcacttattctctctcctgccaccctgtgaagaagtgccttccaccatgactgtaagtttcctgaggcttccctagccatgcagaactgagtcaattaaacctcttttcttcataaaatacctagccttaggtatttcttcacagcagcgtgagaatgggctaatactgcgtataacacacagtaccacacagaacagttccttcactctaaaagtcccctgtgtacccctttctggctgacaacccacctcagctcaattcttggcaaactcgcaactgttgtctacccctataattttctagaatgaatggaataataaaatatgtcatcttttgggtttgacttcttccatttgcatttacattcgtctatgccactgcattaattaatagcttgtttctattattgaatagtattccattgtatggatgtgccacggttttattcacttgctgactaaagaacatcttggttgcttccaagttttagtgattaagaataaagctgtttaaacattcacacacagatttttgtgttgacacaaccttcataaaccctttggtaaatatctaggagtacaatttttggattgtatagtaagtctatgtttaactttatacaaaaaactggtaagttgtcttccaaagtgactacaattttgcactgccaccagcaatgagtaagagtttctgttctgcattctcacaagcactgtcagtttttctgcattttcgccattttagtaggtgtacagtggtatcttgctgtggtataaacctattttaagtgctctgttgttcattttcaaatttaaatgctacccgaatttttaattaaaaaaacttcatgttgaaaccaagctccccagatatactattcataaaactttatctacagatgtcagatcatgtaaggttttttcttttaacttaatagaagttatttgttctaattagaaaagtagatatatatatgtgtatatatatacacatatatatacacaaaagtatatatatttatgtatatacttttgtatatacttaatatgtgtatatatacacacatacattatgtataccaacaatatacattattggtaatgtgtgcacatatatatatacccacacacacatatataaaaccagtagctctaccatccagagacgaacaccaattttttccaattgtgtgtgtgcacatgtgtgttcagattaaaacacatgtaacaacctaaagtctaaagcaggtatgagtgtacaatgtttgaggaaaagaaagaaagcacggtgtaaggaaagaatgacagtaggcaaggaggttataacagaagatgaatttggagacagaagtcagttcatgtagatcagggattctccaactttggtgtgtcttaaaatctttaggagggcttattaaaacagaaggtagccctgcacccctggggtttctgactcagcagatctagagtggggtctgagaatttgcatatctaatgtgcagggccacacctgagaacacctgtcgggcctgctacactataatgaggagtctgatttttattccaaataaattggaagacattggaatattttaaggacagaatgttgtgatttgttttgaattttaaatagatcatagtgactgaggtatgaaggtcaaatcagagagaacaaggtggtaaatgggaaaatagtaaacagactctttatgtgaaatgatggtgctttgaattagggtagtggggatattaataaatggatggattcagaacaaatacagaaaaagctcacagaagttgcaaatggatctggtgctagggtgagaaaaggggaaacaagggagatgtctaggtcacaggcttatttaataactgcctctatggaaggctttatggggatacaagtcataagttctattacaaaaatatgtggtttgagatatcaatatacaattggaaatactgagtacggaagttggatacacaaatctgaatctacaagaaaaatagtaacaatttgtaagtcattagatacaaatgatatttataatcttccaacctattgaggtcattagtatagattaatggctctcaggcagggttgattttgcactaccctccaggagacatttagcaatgtctggagacattttttatttgactagaggttagggatgttgttaaatatcataaaatatacaaaaaagcacctgccaacaaagaattaccctgctcaaaacatcaatagtgctaaggttgggaaaccctgtaatagatagaaaagttgtctttctagtatgaagagagtaagggagcataagcggtttctcagatataaaattgcatcgaatatatatatatatatatatatatatatatgtcacttatgtatccaatttagaaactgcttaactatattatttgaccagctgataaacaaattaaaaatagctcaagaattacttatagcattagacttaaaatggctgctgttaaacagtgagatatagttacaataagaaaagtaacattaattttacccttaaaattaatataataatagtttaaatgaaaaaccctgattaataaaaagaccatatgttgtctccaaagctcttgtattagattatgctacctgcacacctttgttcaatgaaaacaaatgcacaaatacgtaagcacatgactgaatgagcagtaacacagctctcttaggtattaacaaatacacatatcaataaaatggaagaggaaatctggattatgaatgcagagtcaaaatctctggagtgtagatacagacttacaaatccctagaaatagaaaaattccaagagtataaaggaggtagaagaaaagggtctgaaactaatagaaatcctgacttcagttttttaaaaaatttctagtatacagaatgatcctagcatctttttgcatctagcactgtacaagcagtccattaataccagacagaaattttcaagtaagatttctgaaggttttatttgctggaaaatatctctgaatacagtcttcaggtctaggtaagataggttcacattacagagggcgggtgttggtggcttatgcttgtaatcccagcattttgggaggctgaagcgagtggatcacttgaggtcaggagttcaagacaagcctggccaagatggtgaaaccccatctctactaaaaatacaaaatttagccaggcaaggtggtatgtgcctgtggtcccagctacttgggagtctgaggcacaagaatcgctcgaatctaggaggtgggttgcaatgagccgaggttgtgccactgcactccagcctgggcaacagagcaagattctgtctcaaaaaaaaaaaaaaacccattaaaaaattcacattacagaagacatcttcatatagactactcaattagaacacctacttcatttataagtctgaagatgacctttcacacagatttacctaatgttaatgcttttactgacagcacaagctgagtatagtaagggtatactgggattagaaggtaaacatatatatattctaggtatgaagaggtgactataggaaaagaataatgttaaaaggtgtgagaaaaagggcttttcatggggaaagtggaaaagataagagagacagatgcacttcggagatattctgtgattaatcacaatgaacatgaagagcagatgatttcaaatataaagatgatcctttgaacccagggacaaaaatatgttacatgagaattacccttcaccaagagcaagttggccagcaccattcacattcaatggccagtggagcacatgtgtgagaatgactgagttggtgacaaggaatttgtatttaccccttacacaaccaaatcctatcacaatactttctgtgttatagacaattagatttaataaattagaggtgtatactgggcttgtgggaaataacaaattattttatgtaatttatgaacataaagttcacatatggcatactgatctaccttaatcatgaatccaaagaagttaaaactgttctaccctggacacacaggctgaccacaactcacccttcccagttctttatcttccagggccagaactccagtgctttctgtgaagagtttcactttgaccacaggccgaggatgggtggtggtgaaatctccttgagtcccccatctgtaatgaagtaaaaaaaatgtttcttaaaatgcagcattatttttttccccaaggagatgtgtctccatagaaggcaaattaaatacagaatcttctgtgctcaatgagctttttatctttgcttttgtttctagcagatggcacaatcaagaaggaaaagaacaataagctttacagcttgtaatagttactcagctattcaaaaaattagcatgttggactataaaaaattgcatgttatgagaatttaggttaaggtaaagcaatatagttgtagctattgaaatctattactttattaattcaaatgtaaattatagcaccatttttactggcagctgggaaaattgctcagggtttgtttacgtaagagagagtttctcagaaaatgatttttatatactaaagactttaccccacctgagaggtctttattaaacattatctttttttaaagtaagcataattatctcagatctattacttcatatgacttttgaagctcctgccaaaaagaaagaaatatgcatcataagaatctgaatgttttgtagttaatttcccactacattctcttaggaagggaataagtctgtagacatctggcttttgaaatcatcacaacaaaataacatgctttcttggcttatctcttaattaatagcatcttgcctttattgcagaccagttcattctacctgatttacaaacttaactggcacacacctgatattaaaaaatcttatcaatatttctcacaactctgagagatcagatgcaatgagactcagcacagcatgaagaagatgccattgagcaaaataccagagaaaaaaatgagatttaacaaaatacagatcatgttaaaaataaaacaacaaataaatatcaattttcttatgctgtcttgaaaaaacaaaacaattcaccattttcacggagctgtctacattttattttataaatctcattcggagagcttacaacatacagaaaactcagtaaagcaggtataataaaaattgaacaaataattgtgattgccttcctctcctatcacagcatttataataaatgtatacagtaaagcagagaccatttcaatgactgaagaaactggcatctagatgcagtctttttttttgaaatatcataagccagagggaagagaagaatcaattagggaagaaaacagcttaatttctattttagacttccagaatggggttagcaaagagactttttgcaatttcatataattaagatggtttacataaagcaatggtaaaataggaataaaaacaaaaatagattcagaaccaaaataaggcataaagaaaaattctcagtttagtgtttggaatcttaagccttgaatatagtcaggcaatgtggttaacagcctgggagctaattctcatgacatacccttttaaattcagtgtcacatggttaaatttagaagactaataaccttgggaggcattctcttataactgaaataaaagatttttgatagtcatatagaaacagtctaataggtttccatagaatttgctttttaaaatcctccccataaaacttccatgtattacactgatttttttcctctaatttcaaaatcctttgaaactatttacactacatgttcatttttaattcccaaacctcctgcaatacatgattcttcaaagagaaaagtgaactttgtctttgaacctggtccttctgaaatgcatcccaattccactttgctggatagaataagacaaataacaatgaatgcggaggaaaaaaaaaaactgctcactcatggttccatgaacttccagagaactatcttttacctttgatccttcacagacaagtatattcaaaaactattctacaatatttatcaccatagcacatttctcatttatgcattaaaatatttttatacaatgatatattttaagtgtccataaaatgagattcagttaaagaataatgataaagtgaaaaccaacattcctgccattcaggttaagatggggaatgtactagaacattaggaaagcccttgtgtgcccctggtctcatcttcctctcctctccaccgtcactactctgaagtacctagcatcctgaattttatatttatcactcccttgaatttcttcttaaaaggaatattttcagcattttacctttaagtgtgataactgctctaggttttcagtagtcttttataggtaaaaaaaattcccatatttattagacacacacataaatatatcagaatatatgtgtgtgtatatatatgtaatatatgcatatgatatatacataatatataaaaaatatatatcacaattatatatgaaggagatattgtacgtgtgtatatacgtatatacatatgtccttcatatcatatacctcacaatagcatatataacagacatcctaacacacatacatcatgtacataacaatatcatatacataacatacatatcatatacatcacatcatatacatatgcatatgtatattcatatcatatacatcacatcatatacatatgtatataacatatgtgtatatatacatacactcacacacatataaagatccagaaatgagtgctctagtttatgaaacatttccctacatttattgaaataatctgtaattatagtagattactctattgtcttcctttcttgagataaactttaaaaaaaatactagaatgagtaggctaatactttatttagccttttatataatgtccattattgagactagcctgtatatttacttttttgtattctccatgtttggttttattgcataagttgaaaagtgctatatttttattatctgaaagagtttgtcaaaaaatgataattatctgttcctataactcacctattaagctattcaaacctgatatttctgtatgggaagatacttgctaatgaagtgatttctttattggttgtagctacagaattactcaggttttctctttctccttgagtgaattttgataagcactaagttttatgttatttatttcatctaagtttttcaaaagtacttatacaaagttgtaaattttttcatctttgaatccttatagcatctgttatgtccttcttcattcttaatgttttcttttttccatttttaaacttaacagaggttcatcacttttattgttcttttcaaactcctgtcacttgactttgacaatcctctctacttcatgttttttattttattgcattctgctctttgctacattattctaatttatctattttaaccctgctgtttaaaattttaagttgaatgcatggtcattaattttaagcctttcttccattccgggcaagcatttgtgactataaatttgctttaaacactttaactacagcaccccataaatttagaaagtgctatttttactatcattcagctgtttacaggtgtgatttagaatttctctctatatatatcttttcctttttcttattaagttctatttttattacatcagattagatagcatagcctgcataatattgatcatgtaaaataattgaaatgggctttaatttccagattttgtgtgtctaagttttccatgagtgctcacaaagaaaaaaaaattctccattatgggtacattattgtatttatggccggaggttctacttacaaggtttaggacttctgagtcaaggggaggaaatgctaacgaacacctcctgtgaaatgaagaaggcttaaataacgtgttctcaggcaaaggagaagctgaggcacaaaaataccagcagatcctgactgcagcaggccagaagacaaagcttttactgacattcaacaaaaatgtacaattttaagggggtgcataaatagttatttataaatatttatccttgtatcctggaaagttgggatttatcatttctttataagaaacaataaataagaaactttcttataaagaaaatataaatcccaacattccacgatacaggcataaattggcaccaatttgataatttcttctttgggaaataaaagttgaaaagacacagttagaaaaatcataaattctagaatgaataaattaaaaacacaagcctccccaaaccccactcaacaaaggaaaaaaaaaaaaaaaaggcaggaaaagaggaaagaagacaataggcctaccttcaatattcaccaagacatctccttattttctacttaattggcatatttaaaccctgtcggtaattaataccagttattgtcttcccattttctcaatattttatgacaaaagaatacattatcttgctgtcattttgtgttgactcaaaacgtattgcctttctccacttctctgaatgtattatttatgaggattcagaattccaaggtaaatgttcgaatgaataaaaatctacaaagcacctttacgagaacagcaggacttcctggctttgaaaacacagggtaattcatataccaactgaaataactgacattaattatgtatttgctattaaataaagggtactggaaatttgtatcaggagccaaaatacatgttcatatcttttaacctagtaaggttatttctaaggacttatcctatcaaaataattgtaagtattaaaaagagtctaagcagaaacattcatgacagcattatgtataacagtaaacacttaagcaagataaatataaaatattaggggaatgattatgtaaattatggggcatgtgatgaactattttgctactttataatgatggctataatggcaacataaaaccatgcatgatataaagtgaaaaagagggaggatacaaaactgaacgtgcacattttattcatttaaaaaaatggagtaccttttatgtggagatgacattctagtgtgagcaaccgaagtccctatccccttgggatttctattctaataggagattttagataataaataattatactgtaacatatattccttctcactcctgccctgccttctcaacaggttgtatatttccatggtctcttacagtagctagagcactagatataacttgtgcccacttttgacctgtctgaaagtcgatagtgatatgaaatgacagttttaattttccacatgtcctaaactcatttgggtaagaaatcaaatatatttataaaattatataaacttgggtttggttttgagctttatgttctgcagatctctcctgagccgagttaccctgttttaattattgcagctttgcaagatgttatgttatctgttagaacacaaagaaaacagacattttcatcttatttctattcaacaaaaagggaagggaggtggtgtctctgttaaactctgttctaacatttattactggaatcttaaacttttttcttcattatgtagaaaaaaacacacattccttaatttatttcacagtatttaatatatcgggatcctaaagaatctatttcctttatattgtctgactgttgcacatatgtaagaaagttatggttaaactctaatcatttttcaaatgatttcatttccaatacagtgagtgcttttaaaaattatttgtcaccaaataaccaattaactctattaaaaagattattaaaattatcaaataaaaatgacatatattccaaatgcatcactaattttataacagaaaacattaaataaggatccagcaacagggatataaatgaaagcctataaaaaattacaaataattcttatgatttttcatgctgaattttttttttttacttttttatttttagttctggggtacacgtgcaggttgtgcagatttgttacataggtaatgtatgccacagtggtttgctgcgcctatcaacacatcacctaggtattaagcccagcatgcattagctatttttcctaatacttttcctcctcccatcccaccccatgacaggccccagtgtgtgttgttcccctccctacgtccatgtgatctcactgctcagctcccacatataagtgagaacatgtggtgtttggttttctgttcttgaattagtttgctgaggataatggcttccagcttcatccatgtccctgcaaaggacatgatctcattcctttttatggctgtatggtattccatggtgtatatataccacattttctttatccagtctatcattgatgagcatttgggttgattccctatctttgctgttgtgaacagtgctgcaatgaacatatgcatgcatgtatctttgcaacagaatgatttatattcctttggtatatacccagtaatgggattgctgtgtcaattccatgtctttgctattgtgaatagtgctgcaatgaatatatgtgtgcatgtatctttgtaacagaataatttatattcctttgggtatataaccagtaatggatttctggttctaggtctttgaggaatcgccacatcatcttccacaatggttgaactaatttacattcccaccaacagtgtaaaagtgttcctatttctctgcaaccttgctaacatctgttgtttcttgactttttaataatcaccattctgactggcatgagatggtatctcactgtggttttgacttgtatttctctaatgatcagtgatgctgagcttttctcatgtttgttggctgcatgaatgtcttcttttgaacagtatctgtttatgtcctttgcccacttttaaattttttttctcgtaaatttttttcttgtaaatttgagttccttgtagattctggatattagaccttgctcgaatggatggattgcaacgattttctcccactctgtaggctgtctgttcactctgatgatagtttcttttgctgtgcagaagctctttagtttaattagatgccatttgtcaatttttacttctgttgcaatggcttttgtcaattttatcatgaaatctttgcctaaatggtattgcctacattttcttctagggtttatatacttttgggttttacatttaaatctttaatccatcttgagttaattgttaataaggtgtgaagaaggggtccagtttcaattttctgcatatggctaaccagtttccccagtatcatttattaaataggtaatcctttccccattgcttgttgtcaggtttgtcacgatgaaatttttaaaacaatccaactctagttaaattatccttcttaaaatttagccattttaagattaaaatgatataacagattcttctaataatagaataaaagttttggttcaaaactcaaacattcagtatttatttggtagcattgattctgatattctcttgggaagtagaaaatctttccaaaagtttcctgcactggactttaactaggtctaaggtctttctgctgtcctatgagagatttgctgaagaaactgactttggattcactcaattcatgaaaatgagtaaggactgtgttattttcattgactcatatttggtgagaaggtagatgggcacctcccccaaactcattatgatgaatcaagaggaaataaagattcttgaaaataggatagtgagttgatcagaaaggcctgatggtattctcaagggtgtcaagcaatatcatttttaaccgcatgccttcttgagaactgggagccaggaaacttgcctgactgaaagcatacaatgtgtctctgctcttgcagctatgtttatgccaatgagctgtagtatcctttagtttcattaaagaaatctgtatgtgttggtgtctttctattagtcattgccctgcacataatggccacatatactccaaagccatgctgaagtcactgggaaaatgtgtatgtttaatagatgtgtaaaatgtaccaagtagacacaatatcccacctttactaataaacagtattatctccttttaattgaataatgtaacaacctctgaaaattgggaattaagtttaacaagagagaaatacaaaaagcctgattatcaattatataaatggaaattaaataataaaacactaaaagacttataaaacaatgttaagcactgtacaaatgtttttaaaaatagctttcttcattaatataagcaattaaggcagtcttgtggaaaactctaagcagaaaacaatacttacggaagagcagcttttaatattttaaaagttcaacacagggcccaagtatataaaaggcttatataacactaatgtacttcagccaaagactcagtgaaaaatgacgaagataagtaagttttcatgggaacatgggtggctgctgacacgtcgtttactatgatccaaactataagagataaagaaacttatcttgggaaattcaagtgcttgattccaataggctgttgcaaatccagatacagatttgggagtgattaacatagaaactgttgtataaactatgaaaatgaatgagcttatgaagggtgcccactaataatgatagtagggacttctaccttacaagtatgggcttatacatgtatctctatgcttatgtgtgtacttaaacgtatattttaaaggtttgcaatcatttattgaggtatagtttacatgcagtaaaatgtaatcatctcaagtatagagcactgaattttgaaaaatgcatgcaatcacgtatacagaacttatccgtcaccaaaacatttccttatttaagatgtttgcactatgcaaaatgaccagtggttcaacgtgaattccatcaaaatcctaacatttgcagaaatatgaaaatctaccctaaaattcataaggaatctctagggactcaaagtagccaaaacaatcttaaagaaaaacaaacaaacaaacaaaaaaacaaagtggaatgcatcacatgtcccgatttcaaaacctactaaaaaataatggcaatcaaaatagtgtggtcctggcaaaaagacagatatacaaaccaatggactggaacagagagcccagaaaccaaccctcacacatatggtcaaatgtaatgcatatttattagtcatttaaaaattaatgggatatccaaattgttctataacatgttcttttatgtaacactatatcttgaacttcttcaagtgtcagaacatggatttatgtaattcttttcaagacttaagacattccccttgtatggctgcgctataatttagtcaatcactcttctaatgatggactgtaaggttgtttccagtcttaaccattacaggcagtgctgcaacagacaccttcatatatattcatatataaatgatgaaaagaataaaagatcagagacagatttctaaggcagcccaatactttaaacttctcttaaacataaaaatgtcatcctaacagattgattcataaaaaaatttacctatctagtaaataaaatttacaacaaatagctccaatataatcctaagtcaaaaattttaaataattcactgcaatacaaaattcaaatttactagctagaatttcaaaattttattataaacaaatactatttcccttaattttaatagttaatttatacagcaagttttaaactccttttatttactgaatgtattttaaaacaaattttctatacatctaattaaattagtttaaattgggtgatcaataatgtttatagaaactgcctaacttatcaccatcattgttgttgacatactataaaagtatctgaaattccaaattgtccctgtttgcagatgacatgattgtatatttagaaaaccccatcatcacagcccaaaatctccttaagctgataagcaacttcagcaaactctcaggatacaaaatcaatgtacaaaaatcacaagcattcctatacaccaataacagacaaacagagagccaaatcatgaatgaactcccactcacaattgcttcaaagcgaataaaatacttaggaatccaacttataaggaatgtgaaggaactcttcaaagagaacttcaaaccactgctcagtgaaataaaagaggacacaaacaaatggaagaacattccatgctcatggttaggaagaatcaatatcgtgaaaatggccataatgcccaaggtaatttatagattcaatgtcatccccatcaagctaccaatgactttcttcacagaattggaaaaaactactttaaagttcatattgaaccaaaaaagagcctgcattgccaagacaatcctaggccaaaagaacaaagctggaggcatcatgctacctgatttcaaactacactacaaggctacagtaaccaaaacagcatggtgctggtaccaaaacagagatatagaccaatggaacagaacagaaccctcagaaataataccacacatctacaaccatgtgatctttgacaaacctgacaaaaacaagaaatggggaaaggattccctatttaataaatggtgctgggaaaactggctagccacatgtagaaagctgaaactacattccttccttacaccttatacaaaaattaactcaagatggatcaaagactcaaatgtcagacctaaaaccataaaaaccctagaagaaaacctaggaaataccattcaggacataggcatggacaaggacttcatgtctaaaacaacaaaagcaatggcaacaaaagacaaaattgacaaatgggatctaattaaactaaagagcttctgcacagcaaaagaaactaccatcagagtgaacaggcaacctacagaatgggagaaaatttttgcaatctactcatctgataaagggctaatatccagaatctacaaagaactcaaacaaatttacaagaaaaaaacaaacaaccccatcacaaagtgggcgaaggagatgaacagacacttctcaaaacaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaatgcttttacactgttggtgggactgtaaactagttcaaccattgtggaagacagtgtggcaattcctcagggatctagaactagaaataccatttgacccagccatcccattactgggtatatacccacaggattataaatcatgctgctataaagacacatgcacacgtatgtttattgtggcacaattcacaatagcaaagacttggaaccaacccaaatgtccatcaatgatagactggattaagaaaatgtggcaatatacaccatggaatactatgcagccataaaaaaggatgagttcatgtcctttatggggacatggatgaaggtggaaaccatcattctgagcaaactatcacaaggacagaaaaccaaacaccgcatgttctcactcataggtgggaattgaacaataagaatacatggacacagggtggggaacatcacacactggggccttccagggggatggggggaggggggaggaatagcattaggagatatacctaatgtaaatgatgagttatcgggtgcagcacaccaacatggcacatgtatacatatgtaacaaacctgcacgttgtacacgtgtaccctagaacttgaagtaaaatgaataaataaataaataaataaataaataaatgtatttgaaattccaacttgagatatctaaattgaattacacagagtttaataatatactgcatgcaatacagtgaggacaatgaatagaatggctttctaggccatgaggataacattcatcccacaaatcacactgtcatttaagacatcaaactatactactctatattttcaacaaaacaaaaaaaattctgcatggcaatatataaaagataacaatctaagtgaaattagtgatacaaatactacaaatttattctacatagtttcacataaacattgtggaaaaaagaccgattaaataacaaaaggaaataaaaaagagccattacctgagccctcgcccacagccgagtacaatggtacagaaatagggctaccaagtacagacccaagagacagattctgggcttggaaaccaccaataagtgaaaagacccggggcgagcaactttaccacaacctaataacatgttcctcataatacatttgaggcatcaatgaaaatgattcatgttaataaatgtaagagcacagcacatctcatagaaagtgcacagagaatgttcgttattcttactagcatccatattagtactgctttagctttactaaataatatctacctgaaaaaattgacagttttgaatattaaagttttcatctgtttcataaaatggtgacactaaaatccagacaatatgaaaaaaaagagagagagcaatagagacgtcaactaacagcaaaacatggcaaaggagaaagagagaggaagaaaaagaagccatgtgagaatctgaggagaggaagagaaagggagagaagggggagaagaaatgagatgattaatgaaaggtcaacttacaataggcaaagtgttacaaactgagatttacttttaatcttaatgtatttttgtatatcatcttttaaccttcctttaaaacataatttacagtctataatactgaaatgacacaaattttaatagaagaactagacaataccttttaaagtaactatgttttatcattctaggcttttgggaggatcttttaaaaacactgaataaaattttttattatgatggaaagataacacaaagttatttgtttcttcaaacatgacaagaactgggtgtagcagcacacatctgtaatcctagctattcaggaggctgagataggaggattgcttgaggtcagatgatcaagaccagcttgggcaaaatagtgagacccagtctcaaaaaggggaaaaaaaaattacaagaagagacaaaatcctgagatgacatcttgcactttaaggcagaaaaatattgggaaatgggttggggtgggtaatgactttcataataagaaaaatcctgcaagctttatctgccttctcttccttattgtctcatagaagtttccctttcccttcaaagagctagttctcatttggttgctctaaggattacaaaggcctccagaataataggataaaattgtcctttaaagtctgtatttcttttgtgaagtattcatgccattaaaccaccacatccagagtagaaaaatcatattacacttgtatcactttcttctgggaaagtctagcaagcctgttagcacaaaatcaggtttcagaaataacagaagagataatctctcacaagcattttcctttctctccctcatagcagcacagttcaaagacattagcttgaagcacctaattttaaagagaacaaattggtcacatcttggcttacaattttacttgaccaagtaaaattgtaatccaagatgtgacaaacaaataatgtacaaaaaagcacagtgctttataagatgaaaaccaagatttttaaaaacttacatataggaaagaataagtaattgatgtataacttaatttaacttcaaagcataaaacatgcacaaatcccccagatgtctaaataataaaatgcaatggtgtggaaatgagcacaactatactgtatacaccaataatcagtcatctacagaaatttaccaatatgttatgttcatattgctcccaaaccctcaactttgatgcctatgtgagaatctcaacctacttgctcccattttgtgggactaaagagttagatgtgttatatgaaccaaaaaaaaaaaaatcctttcaaatgtaacataattaatatattaccttttaaagataaaaagtactagagaaatttaaaatatagggttgcaaactatgaggttataattatcactaggtaatcagttcagcatatgaaaagtaagagtgcccatcaataactagtactttctttacaagatatcttcccctaattgatgtctaattcgatggaactttaagtgggggttatgttctttggggccagtcatttggggttataaaaatgttttgctttacattttcttaatttgaagatcttggaattgcaaagtactataatgtcagtacatactattcttaattgcttacatttaaaagcaaatattcctcagctgtttccagctactccaaaggtaagagagtcttaattctgtatcagagcagtaacgtggaggactttacagggggaatgccaggatggaccatctatatgggtttattgcatttcccctaggaatgctccttttgggctccccctgcagataaaacaactttttttctttcctaaatgacagtttctttagttgaaataaagagaatttccaactacacagaagtagaatgggagcaatagggaaagtctctgcattacacaaacatcccagatgccagagagggtaggatcacctgagactttttctgagagttgaaaagagccaaaaacaccaggcattcaacaaaagcatgatgcatagagcagaggcaagtggatactcaagtgcaatgtgagggctcaaaaccagccccaggaatatccagaggaatactagcactgcggtccactgtacagaagtgacatgtcacaagcagcctcaggagtctggtcaagcagtgaaacctggtaatcttcacaggccagacagtcactgccagttatcctgctgctgctggttcctgtgagcactacccacatgttactcagggaagggagccccacctgctgtggatttcccatggccacagtaacaactaaatgttgagataccttggaacaaaaatgctatacacacaggcttttaagctcaagaacatttaagctcattttgttagaaaacatttgatcctcataacaggagctccatcaagaatttaaaggggtggaaatcactgctatgatctatgtttctccaacatttacctacctggcacttaatggaacatttaaataatgacactttgtgttaattcttgtcctcatttgtccagaatctgaaaggatatttaataagcacctattatgtgccatttatgggaatgaatgatgaaaacacaaagatgaaggcaaacagactctggccttcgtgactcgggcttgtgttaaaaggaaaagcgtgaaatgtaaacaaatactatagcagtgagaaaagcttcacgatgaccttcattttaagacagaagtcattacctatgtatgtttatgatttccctcagcaatcatagctacatccccactgtaaacaacattgtgctctggacataaaaggcacacattacatattcaagacagaagacaatgatgtgcagaaataacacagactttcgaatctaagaggactgggtttgaatcctggtttccctactgaagagctgggttagtctaggttcctttatagcaacacaaaacccactgtgtgttgctataaagaaatacctgagactgtgtaatttatagagaaaaaaatttatctgggtcatgattgagctggctggaagactgggtgtccagtgagggcatcaggctgcttccacacctggtggaaggcaaaggggagctggcatgtgcagagattacctggggagagaggacacaagagggtgggagagtgaatgccaggctcattttaacaaccagctcttgcagcaaataaaagagcaagaactcactcaagccattcatgagggatctgccactatgagcaaacacctctcatttggccccacctccaacactggagattacattactacatgaggcttggggggtcaaatatccaaactatcatcatacgtcagttaaactttttgagtatctgttttcttttctaaaaatagaaacactaataagtcctgcctcacataattactcggaaaaagaaatcagtaagtaaaataactatcattatatctggcaaatcagaaggcttagtaaataaatgcttgttcttaatttacctgagcactgctgctatggtctgaatgtatgtgtccccctacagtgtacatgttgaaatcccaactccccaaggatggtggtattagcaggtgggacctctgcaagatgattaggtcatcattgtgtgtatgccctgtgtcagtagagaataattatagaatactccacacgaataaaacaccacatgactgcttaagtagaaaccatagttttgtctctgaaatgaatctcttatcatttttttattctctaaaaattcttccctgaaataaaaagtaaaatacaaagtccatttgtacgtattttaaaatcaaatgctgcttagaggttagaaaagagtttaccttcaatttcccctgtaataactcacaaacattaagctaaccaatcaagtaacgtatctgatatgctttgggagaataaaaaatgtaactgtggatttttgttccaatttactcaggtataaatctattaagcatatctttcaatgagagcatacagaacttttggcaaaggcagacttggcatctttttaacattttttttttttgaaacaagaataacacaaacatgggacattattctaataaaatattatctgggtcctttgaccacaaaaatcatatatgtttacaaaacagatgacattttgttgcctagttaggtatttagttattttagaactaccatttcttttttcttagattccttacataaatatattttctagcaattgttttgtgagtccttatttccataggcaaaagtcagaagtaagcaatgtgagtggaaaatttttaattgaaaagaagcacagttgtgtatttggttaaatagaaatattctacctttgctacaaagattttttttttgaaaaataccctgggtattcacataagagttgggaaaaaaggaaaataccccctatgttttttaaatgagagtattataatagctttagaaacgttcaaattctagcttacatttaaaaagtagtttctccaagaaaccccaagtgacatataaaggaaatttaaataatacataccatttttgttgctgctaaaatattctggatatgtaagatggaatattaatgttgcaatttgtgaagggagatttgggccacagaaagtgattcgtacaatgtcacttagcagattgtatttaattatgtagtgggtggaaattagggtgacaactggctcccagatgctattaagtccattcagactcatttaactttctcatgtattaatactagcaggccagtcagtgaatatctatagttttataggcataactaattttggtaaaacagtgtcctccctatagaagcactcttattaatacttcattaataggttcaagataatactgttgtcagttattggaggttaaatgcttcatcaaataaaggttagttacagaaccagatactgaggatacgatgttgaataagacctgccttctgtcttcagtgagctcaaagtttttgagggggagcagataaaaagagagacaactagagcaaacagtgagagttctggggactgagaacatatagggtattactgaagccctctggggaaggagggaagcaagggctcagggaagccctcacagagaaaagcatgctaaactggagccttcaaggaaaagtaaagggaaagtagttaggtgcagaatgaaaggaaggcaggccatgtgcaaggacagtgttcttcccaggaatgggacctgctcctagtagggacaacattttttaatgtgtggacacaggccagggaagttcaataactccagatgcaggggatagctcaactgataaaaacagctccctccaaaacgcaacagaattcctgcttgaaaataccatacagcatagaatctaagctggagatgcaagaggtacagaggtaagtggaagccaaaccagagagaggctcctgaaataaacctagcaagggctcaaaccaaggggcaggcaaggatgatgtggtaagaaagatttgctggatattaagaaggcagaatcaacagaatttacatatagaaatcaaaaaagaggaagaaataataaatgcccaagtctctggctaaggaatccttacagctagaaataccacatactgagttgataaacagaaaaggaggagtgtgtttaaaggtgaaatataaatgtttctatttttaatgtgttgagtaaggtatccatgtgaagatatccccggaagagaaggctgcctagtgttaatctggataactaaaaagcagattttgtcaaccgtagaatttattttagtaacagttttctttctaaacttgaaagctatttctttgtattctttcacaggtttaggccctttgtaaaagtgtatttcagatagacaatgttacatataatatgaaatatacatacatataggatacagtatatactatattctgtgttactttaacatttatatttcacctctaaacacactcctccttttctgtttatcatctcagtacctacactgtttcctatctaattaaaggcagtgattatattttactgtgaaattcttgctcatccatgccatatggataaatattcctagatcagattatattcctcgtaatatatcttaattcacataagtggtgctataaaactgtgaactattttgatcaacttaaaggaatttgctgtttgacaattacatcttcagactggttttaagaaaaggatggctataaaaatggatggacacttttcatccaggccgtcagaagctacatgatggaaagaaaacaaagcaaacaacacatgcagtagctaagtcaaggaattagcctctttgcaaacagaaagagcagctccatggagtcaaagcaacaaagctaagctgagattggtgtaaacaagtttctctttctaaagatcccaccaactgtgggaaaacagcaaaggtcactggctaggttggggaccttctctgaaaaaactgagccatgaaacagtcatagatatgcccaagaaaatgttaatgatgaaattttaatgtaatcaccaatctgtctgattataggggaaacaagttcatctgttagtaagtctcatcaaaaaagtgactaatcacattaagtccacaaacttgctctgagccttctagaaatactgttacttctgtaattttaatgagtttgccacagcagaaatcaagacccctgctctaagcaatgtataattctattgccactattagtagggtatatgcttaacaaaaagctcaaataaacagtaaagtccaacaaaaacttgttatgacatgagtttgttcagagctgaacttaaaataacttttgtctgtttgggtcctatttactaaaagtttcgtttaataaagaactaatgagcctctcccagatattggttcagtggccttcacccagaatccagtatttgcagacagagaacacgagaatgaggcaacctgaaacactgctcacatataaaacaaataactggatgtgaacattttgggttttcagagggaacagctaaagttatttaacattaatgtagatgttgacatttagctactgattttaacaaaaataatgcaccactttagaaacacaattttttaaatgtggataatgataggttaagtttttacatcattagaatcatattcatagtgcataaatattgtatcacttttttttcctagacatctaccatacttgaaagtgaagtaataaagggcataaaagattatttttcatctctaccattttggcagaactatataaaattcatgattttttttcacactcaaatattaaaatttttgaagattcttatgagaatttgccaaattcagtatgatccaaatgctgccatctgccagcaaagctatattacggcaaaaaaggaaagttaaacattagaacacagtgagaatttcacagacttgcttcaggtaaaatttgctattttataagccaaaagacttcacatcttcgccaaccagatccatcttgcattttatgtaataaggaagtctgagccaggaacacgaaagtgttacttgtctaaaaattgactaattcttcatttttattttttagccacacttcaccaccactgcgatttctctggtggtcttaagtcaatgaagttctgggaacaaaataaattaaaaataggatcatcttctcttccttaaaaaaacatttctttaaataatgttacatgaatatctttgcagcaatgtttctagagcctgtaattttaatttggaagacgtgtaagtgcaaaaaaaacccccaaatcctaagtttacatagacgtactcttcccaggaaaacaaaacaaaacttaagaaaaaatattgctgttatcatccaggtcgcagagttcctatacttagaaaattttcttcaaatttcaaagagaaggagaaactactgtggacaatagctctcatgctgcaaaagttacctgataattgtcagtacttcaggagatttaagtctcccttttaaacgggaaggcttagaaattatgattttaaaaaactgtattaatttaaaaacattcagcttgccattaaccttactaaataacttactgacaaaaaatgtataaataaaaggagaaaaatcaccatcatggatatataaataatagtgtctcagtaaggaaaaatattttacttaggtggtttgagttaaaagtttccgttaaagcaggagaacctgtagcagattcacatacctataaaataattacataatgcatagatcagaatcatggccaaattaaggaaaaaaaaaaagtttatttttttcatatgggaattacctcatttgaatgtgtgagatgggaggtgtagggcatacatttaaaaatacatttcacttgcaaagaatgtcaatcttcatcttacgaccattgcaattttactgcatacacaactccataactaaaaaatctctatataacgtgtatatacagaaacacaccatggaagctaaaaaatgaacatcttttgctctgaagctatacataagtcactagcatgaatataaaaatggaaatataatacattgtattgactttgtgctaatgaaaaagagagggttctgagatcaatgtgggtacaaaaccttcaagttgaactggtcttgaaatatcaatcagagttcctaggcagagaaagatcagggaggcaccatgtgtacatacaaaggcatgagacagtatggcatttttggctcccactctgcttggatctccagttcactgaggtcatatgaatactttgattcacagaaacaacttcctgtattctcttcttaccactgaggacttacaaagtgttccaagatatttttaggaactctttcagatttccctgtatctgaaagaatagcaataatataaggttggattcaatttaagattatcctttcttttgctaatccacgtgtcagttgcagaggaagatcccagcttcaccttaatttcataactccagaacaggtaataacaagtgctcttcatgtaatgtattaacatggtgccaacatggaagacatggctgcaaaattactgtcaacaactgcaggctattatgctgcaaggcactagagatcctttgacggctacactttagcacagcagatataaatcttcaatgacatcaactgagacacaaaaccaatgttgatagagaatatatgacaactaacaagtcttttcccttcataactgacaattaggcattattcattttgaaaactacctccatttgaatgtagctaactctcaaatcttaaaaaaaagattataaagtgcttaccaaataaatattatatgacaatacaaacacccaagccaaaaatctcagaagggacttgggaaacaaaagcacattccgcttcataaaataacgtttgcagtttggtactgttaaagacactcaatcgtttattaagtgtgaaactcctcctgtaaatttcctggacttaaaaataggatgctaaaagaagagatttaaagaaagtagagaaatgaatacatgagcagaaaaaaaaaacactcaaagcaaaggctaaaataaaaaatagtgaatatatgggcagaggtacctgaagaatataacgattgggtgttcctacctatattaccccaattaactcacaaaatagtccttgaaataggtaccactgtttccttcataccaatgaagaaacagactcaaacagatataaatagccatagtaacacagctaatctgtggcaaagctaggatttatactctgcaatgtctcaatctttctcttaaaaccatttgtactgataaatacccactataatcccctgtcattaacattttaaaacctagaaattttgaattcttgaaaaattctactactgtatgatctttatatgtagaatctaaaaaagttaaactcataggaatgaagagtaggacagtggttgccagaggctgaaggtgagggaaatgagatgttgatcaaagagtacacattttcagttataagatgaacaagttctaagaactctgtacaacatgggggatgatggatatagtaacttgattgtaataatcattatacaatatatacatatatcaaataatcatgttggataccttgaatacaatctttatttgttaagtagataattttaaaattttacaacacaaaaattctacttccttatctttcattcaatgtatttctgtttttaaatattatgaattcggtaatttttcaaaacatgaacttatttaccaattcataccaagagctatgcaactaggtttcttaaaatgcctttcctaacttatgtatatcaccattgttattcactcacagattgttgaagatcttgacaaatcctttacatgtgctatctccatttgctctctacagcaacactctcaagtagttattaatgtgcttgtgtcccaacagaagatttgtactttaatgcccccttaggaaccctgcctgtgtaaagatctgcaccagcagcactgagggtggaccagccccaggcatatctcctggactgctggacagagctctagatttaagagttgcagcatcttagaataaaggcatttcttctgactgtatgggttcaaaagtttgcatgtgaagtatgacaacactaaagtctttagagttcaggacttagttcaggctcaaataaatggtatctcctagaaaagcaacccttcaaaccttttctcatgcacttcccacaataattctgaaaaatttaccttcttcactcatttttaagtggtcacctagaaatttttaacataaagagttacaaaaaatataatttctggtgcatttgaaacattgacatttaacataaaactgtggtgtcactcttaagtaaataccatggaatctaactacagtcatgcattgcttaacgatgggaataggctctgagaaatgcatccttaggcgattttgtgcttgcttatgtgaacatcatagagtgtgaaaatcacagagtgtacttatacaaacctaggcagtatggcctaccacaaacctagggtatttggtatagccaattgctcctgggctacaaacctgtatagcatgtattgtcctaaatactgtagacaactgtaacacaaaggtaagtatgtgtatttctaaacatatttaaacatagaaaaggtacagtgaaaatatggtataaacaatacaaatggtaaacatgtatagggcacttaccatgaaaggaaattgcaggacgggaagttgctctaggtgagtcagtgagtaagtggtgagtaaatgtgaaggcctaggacactactgcacactactacagactttataaaaactgaacacttaggctacactgaactagtaaaaaaattaagtaactgtactacgatgttacgacggctatgatgtcactaagagataggaatttttcggctccattatcaacttattggactggtcattcatatatgcagtccatcattgactgaaacatcattatgcagtgtatgactattttatagcaatatgatcccaccaccgatgaaaaatacctgcaaactctttacagaaatttacaatatttcttttttcattgaactccttactttgatttcatttcctccagaaacttagaattgttttctactgtaatatatgttaatgcctgactattaatgaccttatcaaaattacctatgccaaatctatatatattttttctctgatcttaaggatctagtctcaaaaatcactgaattgagtttttattagacagtaatgctcaagtgatccaaaacaaatatatcacacaaatgtgcatttataatacatataataaataaatacatttattagatatgcatctcaatgaaatggatagtgctatttcttccaattagttcatgtatccatagattgaaacagagttcagcattaattttaatccaggatttttttttctgttgtaagctctaagaaaataaatagatgggagcattattatagcaatgtccatcaatttaattcctgcctatttaaatgtccccaaaccacacagtgattaataagcaaaaactctttcaattatttagcagttgaatacttgtataaattctttgccaactttactgaaagtaaaatacaagccatctaatttgcagaagaattgattacatcatcaatcaatcacttcctcaaaaccaatggtaatattacacatttgccttttgaacggtaccctggaggtttttccactctgggacaagaatcaccactgttaaaacctgagttaagtgagagttgtacctttcctttgtaaagcgggagaaggatgactgtgaaaggcaggctgagaatgagactgagcagaagacctttaggaaagggtacttacagaattagagggttcctactcagtcctattaaaaatatacatgtgcctatgtattcctggggaagttgtcttgcttatccaggtagcctcatagtttgaaaaacatcgtcccagttagggtagcaaaggtctggaagtgaccatggaactagggcctaaattgaacacacacaagaaaaagaattggccctttatggtgaatatctttcacatggaacttctagaaaaattggagcttggggtaggagaatgaggactggactttctaccaatctgggcagatgctgggccaagtgtcatagtctgagaccgactgagaggctttttttaatactctaaatagtacaaaaagtagtatgattagagtactgagtgcctactgagccatactattgtggctggtgctaatggggaaaaagaaggtataatacacagcccttgtcttcaaggatcttccaccttatttgagctatctgttaaggaaatgaaatttaagcagaaagaggacacacagtctatattattaaatcagtagcccaggggaagaggaaagagggcagccataggatgtataatttggcgagggaatgttgtgatgttagaggtccctggcagtgggagaactgctaagaattcatcggagaagagttacatgtggacacctgatatgacaaacggcatttgctaaccaagagagaactacaaaagcacctacatacatagacatttcacgccttcttccccttcctaccaactgcaatcctaaacaaatgttgtagacagattagacgatcaggaaaagcaagaatggataaaagggactaaagtccctttttcccactacaggtttctgagtgatttagaaggaaagaaaaaaggttttgaaatgtgtaagtcttggtttaaactgttctgaaaaatttagtacctgaacatgttatttaatacccaaaataaccagaaaaggtatggtatctgcaaagatgtcttcaaggatggtatgagagagagagatcctagagtacctaaggattgtgctgtggtaagaattaagcttcctacttaagcccttccaaatttagaccactcactaatttgttacataaaccaaatcaagtaataacgaaaactataaaagacttttccgaaaaaactgtcacagtatataaggggacgtgatttcaagctgtaaatcaacaacaaatactactaatcataattctataaactttctcccaaattttctcatgctgtttttcactggagctcatgaatgctcttcagctaacatctggaatctaaatccatcatattttcttattaattcagatgcctctcattttaaagatccccagattgctccctttattataaataaattctcaatgaatgtaaatttctgtatttggctaatgcttatctctttaggcttcattttgttctgcaccaaccctatcggtcttagagaaatgttacttctaatgaatttatttatataaaaagaagcaatctgtcatgattttgaagatggaaatgagaggagagaaaacttttgtgtggtttgagtgttttgcctttggttcattaaaaataggcacagttggctgacagcggtggctcacacctgtaatcccagcactttgggagggcgaggtgggtggatcacgaggtcaagagatcaagaccatcctggccaacacagtgaaaccctgactctactaaaactacaaaaattagctgggtgtggtggtgcatgtctgtagtcccagctactcaagaggctgaggcagagaattgcttgaacccaggaggcggagattgcagtgagctgtgagtgcaccattgcactccagcctggtgacagagcgagactccgtctaaaaaaaaaaaaaagaaggcacagtttttgatagatcatataaaaatgtagcatattttatctctagtctataagagtatctgactaatgaattatacttcaaaaataattctgacattactgaattaaaatggaaactaatatgcttttaaaaagcacggttagattatcttggtttatatgcagtctgtatttaatctctcttaaacattgtctcagtaccttgccattctgataagcattccatttgtagctgcaatgttctttcaatagtttgacagatattacaattctggttaagaatttaaagtttccagaagttggtactggagactgtatttcccatcattttcatgaggcaaatggatgctctatcataatatccataaatgtagttctctaatgacacacaattcattagtttttcttattgcttcttgtctttttattactttcaggtggtgggcagtagagacccattaatcttcaaatgcttttaataaaacagcactatgggatgaaggagagacagagagggtggcaaaaacccagtgtggcttcctggtgtttttatttttttctctaacaaatgttactgatatttaattgcctactgtgattatcagtgcacttatattttattgtggtactgcactggacacttaaaaatttgttaagaggttagatttcaaggctgggtatggtagctcacacctgtaaccccagcactttgggaagctgaggtgggaggattgcttgaggccaggaatttgagacaagcctgggtaacatagtgagacttcatctctacaaaaaaatgacaaaattaaaaaagaggttcgatatcatgctaaatgtttttccctatttgtttttaataatgaatttccttattttcctggcaccaagatctatcttcaccttccatagggtattactagctcctgagtttgtttaggcactcaaaggatacttaacacttggagggaataaaagactagtacatataaggaaatttaggactactatatgaaaataacaaatcttattctcccttcaccaccccacagctggtcatccctcctactatccctccatttccttttcagtggtatcattaagggtatgcactaacattaaaataaatgaaatgtctggaaagggtaaaatgctataaaagtgtagaaacaattcctccgtatctcattcatacaaaacttttcctggtttactaagagactatgaaacaatgacttaaaaatccataaataacaggaattttctccataactgaaaaatacagtttatccacactctcttccctattttacaaaataaaaattaaaatgaaactttcacaaattacattgcctcaccgttactctttgtaaatcaaacgtgtctatcaataccatgtttattagaccccaggtcctatattctaggttatgtaccaacctcacacgctgtttcctcctaattgctggcaggaaatcagaactacaggaaggaaataggtaatggccagaaatcttgattaagtgtattggaaatacggactaaataaggcactataattagtatcagacagaaggatgaatttatctccaacaaagcacaaactgttgaagcattaaaatttggaaaacgtgtctgagacataatccactatgatgatggaggagatgaatctctttcctgtcatgcaagatgagttcaggatgaaagtaacgacactgtgacactgctaaaaagctgcagttggttagcattcatgagatacctttttaaggtaatctgcccctgggataccatgataaatacaaatctcttaatttatttaaaaagttaactcagtgttcgtggggaaacacagaaaggctattttaaattaaaggctattttaaatcagacaaatttccttatagaaagagtaataaaaaaaaaaaagagcactgggggcttattataatacttcctctcaggtttcaaagtattttagttcacttatattgttcatgcacttgttccccaatatcagaagccctttcaaatacattatgaatatattgaaaattaaataacagcccatgaaacttttactatttgtaaaaaaaaagtgttaaaataacgtaacttcagataaaagttaattgatctcacgaaccaaatatttaagtatcaattaaatataagattctgtagaaactacgataagcaaaaaaaaaaatccagatacaaagactacatattgcatgattccatttttacaaactatccaggaaaagtaaaattacagagcctgaaaatagatgagtggtttcctggaactgagagtgggagcaggaatagactgcaaatggccatgacagaactttctgaagtgatatgtttaaaaattgaattttgatgatagctgcacaaatgtataaatttactaaaaatcatctaatctacaatagatgaattttattttatacctaaataaaacagagaagattatgtggggaaaaaaaaccatggcattgagattattagagaagttgcactccctcaaaatctcatggattagtagagtagaattaataaaataatctaaggaccatgaaagagcttcccaacaagtggtggtacactagtgttcttccaatgggtttcagaactggcaagacttcaattctctcggccactggagtgacatggtaggacctggggcttgtattccctgcagctaagaatcttcttccattgactctatttactacagaaacaaaatattttgctgatcaaaggcaccttgatgaatgaaaatgaagagagatcatatcattacttacaaatgcaactaaagcagcgcttagagggaaatttatagctgcaattgcctattttaagaaaaaagaaagatctcaaatcaaaagcctaacctttcacctaacacactgtaaaaatgagagcaaactaaacctaaaatagaaggaagtaaatagtgcagaatgaagataaaatagagaacagaaaaataggagagagtccaagaaatcatcctagaaatgttatttaaaatagtcttttaatggacaaacttttagttagatgggctaagaaaaaagaaaggctattcaaattactagaatcggaaacggaaaagaggacattattactgaccttatagaaactaaaaataattacaaaaactatgatcaaatgtgtaacaataaattagagaacttggatgaattgaaaaattaatggcattaacttttaatggcaaaaaacacaattacttttgcaccaacataacaggaaaacacaaaatgactcaaaagaaagacaatgaatagatctataacatgagatcaaattaataatcagagaattactaccaaagaaaagctcagtcccagatggctccactggtgaattctaccaaatgcttttaaaaaatacaaattcttcatacctttgaaaaaaattgaagggtccacttaaaacttattctacaaggccactattaccctgataacaaaatcagagatatcacacaaaaaaattacaaggacaatatctcttatgaatatagaggccaaaaacttcaacaaagcactagaaaaccaaatccagtgacaaattttaaaaatcctatattatgatagtgggaattgtgcaaggaatgcaaggttcatttaacacctgaaaatcaaataatgtattacatcatatcaacagaataaaagacaaaatccacatgatcatctcaatagatgtaggaaaagcatttgacaaaatcaaacaccttttcattataaaaacagtcaataaactaggaatagaaatgaacttccttaaactgctaagagtttctattaaaaattcagagctaaaatcagatttaattataaaggattatatgcttcccccctgtgatcaggaacaacaccaacatgccttttcttaccacttatagtcaacattgaactggaaacaattagtcaaaaaaaataaataatggaaatctaaattagacaggaagaagttaaactatcagtatttgcagatgacatggtcttgtacatagaaaagtctacaaaatccactaaaaattttaaagttaataagcaagctcagtaaggttgattgatgcatataaaatctatatacaaaaataattatatttctaataacttgaatgatttaaagataaaattaagaaaacaattcaactcaaaatagcataaaaaagaataaaataatagaaatacatgtaacaaaaaaataaaacttttactttgaaaactacaagacattgttgaaagggaaattgaaggtctaaatacatagaaagacatcccatatgtgtggatcagaagacttaatattgttaagatggcagtatgctccaaattgacctacagttacaacataatccctactggaatctcagctggtaatctttgcataatctttacaaaagttgataaactcttcctaaaattcatatcaaatttcagaatagccaaaacaatcttcaaaagcaacataggtgaaggacttgcaatcctgatttcaaaagttactgcaatggtagagcaatggtaatccagaaagtgtggtagtggcataagaatagacatatagattggtaaaacagaattgagagtccagaaacaaattcatgtatctatggtcaactgattttcaaaaaaggataaaaagaacatttaataaggaaagaataggtttttcaacaaatggtgttgggacaactgaatagttccatgtaaaagaaggaagctggactcttacattacaccatatacaaaaatcaacctaaaatggatcagtgacctaaatataaaactatgaaagtctcaggagaaagcacagagctaaatcttagtgaccttaggtttggcaatgaattcttagcggtgacaacaaaagcacaagcaacaaagaaaaaaataaattaaacttcatcaaaattttgtgtttcaaaatacaaatcaagaaagtgaaaaaaattcacagaatgagagaaaagatttgcaaatcacatatatgatgtgggcctagtatccaaaatagaggaactcttaaaacttgagaaaacagaaatgggcaaagcacttgaataaacttgatatatggcacttgatactggcattgcacgtcaggcaagaaaattgtaatggtgctaggacatttagctttccatatgaaatatatatatatggaagatatttataccatatcagcttgtataagtatactctatgatgttcaacaaaatcacctaatgacacgtttctcagaatgtatccctgctgttaagtaacacatgactgtatataattctatttatacgaaatgtccagaatagataaatctataagagacagaaagtaaatcagtggttggttaaggctggattggttgggggttgatagctaaagggtacagttttttttttttcttgagatgatgagcatattcaaaactggatagtggtgatgattacacaattctgtgaatatactaatatattacccccaaatatatactgtgactaggtcacaaaagtaagtttagtcgattgaattaataattccgcttggatgcttactaagtactcagatataagattaaataggataagatgttttgcccttttctcaggaggaaatacattgcaaaataaacaggtaattaacacagtcccaaaattaaaaagtggtcagccagaaaatgtacacctcccactgggttaaagggaaggattattctcagtgatggttaagttgagattctcaatgccaagaaagcagctatacaaagataagagggaagatgactacaagcagacgggaaagcaagtgcgacactgagaatgggtggataagtgtatgagggactgcatgaagtccagggtggatgaactgcagaagatcgggggaacagagggagaaggtgagatcccagaggtcatgagagattggtcaagggcaggcctgtagggatttgtaggttaggatgagaagcttcaacttgtttcttttcaaccccctaatactctgtgcacctcttttctgttacacataaccctctgtatctccctatcctgcctgctctaaagaaaatgaacatttctcatatatcttcagtgcctatttgggatctcaacagaggtttcctgaatgaacaggtcacatattggtattataataaggcaaaatcctaaatcctataagatatttagaataaagattaaatagaagaaaaaaaatgttttctaaaggtaatgcacaaatgaaggccaagcaaattgaatctgaattcctcaggccaacctggttgtttctactagagaccatgatggttccccaagtttgaatgaattaaagcgaacacttactaatttaattaactcattgccagaacctgaaacatcaaactgttggcaaaaagcagctttatgctctgaatatcgtgcggtagtcgtacattaactgcttctctagcccgctcactaagtattccaagtcattgtgcagaatcatggtatctactgttacatcaccaaaaactataacagacaaaaatggaaaggctattatacaattctcagaactgaaataggattatgtattacctttcaaataacacatggtgataaaatttgctttccttagaaatgacttataaatgttttattgcctaatgattagctttgcatttgcatgttggattttctgtttgtactacacagggattctgccaaaattccaattataacatcattatctagaaagggacacactagttctaacacatttgagacaaagttagccaaatagcagttttagagggtaataccacacatttatgcacataaacagagcatgtttctttgggaggattaaaaaaacaaacaacaacaataatacacttttttcaactggcttactgtggccttgaggcttcggcctggtctgtctgaagtttttctccttccacttccattgtacagtaaacaattcgattgggagcaactgacttcaggccttgcacttccattatgacaatctaaagataaaatgattttaaaataatgcatcaagttgataacatttagcaatatacataaacagcagcatgaactgtaataaggaagattgacaaaactgaaaaaaaatttgttttttgttaacatcactggtattttatcttctttataatccacctctattcatagaaggtataataaataacatttttaggaaatctggtaactgaaaatatatctgctgccagatacaaataaaagtaaggtcaaatgtcataaatataagccatagtgaattaaatgaaatttaaactcagatccttaacaaattaaggcaagtctgcacattaagcagaatcacaaatgaaaattcagtgcagatgataacagcagtacatgataagtaccatataaaataatatagtatatattattggtaaacattgataccatcatactaactcactgatatcaatatgtgatatcagaaattttctatattcacttatttgagattactattattgtctgtaaaagagtttaatttatggactgtgtcttattaaatagaaaattataatttgtcactgaacattttaatactaacttggtaagaaaaaatattttttctatccattaaagatatgtactaatttaattcagtacactggaaaagggtggaaaaactgatattgccttatgtacttgtaactcctgggagaaaggacaacatatattttttatgtgtgctttttaatgtttgtcgaagaggctgccaatcttaaaacactgtaacctatcattcttattggatgtatgtatcaaatatgaatattatttaccatagcgttttcaatcaaaagttgcatcatgaactcttctaaattctcaaaatttaatttataaaatagattaaaatgcatttttatatatgtacattgatgtcttaattgatcccatgtggtatttgcacaaacaataataaaactcatgttatgcagcgaccaaaacatctatcataaacataatctgtatcagttactgatcatgtaatactttattacagtcatcacattttttagagtcatgataagaattttgatccaaaagggctcaaaaaacaaaccatcttaaaagtgttcttcctttcagctctgttacaagagaagggtcatgtttgtaaatatgaatgtgtatttgttttttgttaaattttgttttcataaaatatataggaaactgatcactcagttatttatcaataaaataaaaggtcaaactcagaacaagttttcttcctcatccagggcttttgtcattttctcacatggaaatacataccaacatatgaatcaaaatcaggacttaactgaaaacagactaagaaaattaatggagaattgatagagaaaagcagtatctttcacagctgttctaatactcatcagggaaattgggatgaaatactaaatcttgattaaagaaaataagcaaaggaagttatgcatttttaatgactcagattttttgttagtaatatggaaatttgttagattcttatacaaaatgaaaccagaagctgagataaatcaaatatataaccatattaattaaaaggcaactacacttggacttaccaccatttctctaataacttcttaataataaaaatgtttgatggtcatttaaaatgtatgaaacaacagaattgtgtagcacaaatctagaaatcgtaagagcattgcttcatatttcagaatattattgttgacactgcatctctttctgcagtgtgtttaaataacccaaatgcaagaaaggaagcatctgcttgacattatttctgtcacctctactataagctactgtaaacatgacctcctaaaacatacaacttgtgaaacagtactctgcttttcaaaacaatacttccaactgtgctgggaacgttttaccctgcagaatcgtcattttcaaaagatacagcttctgtgatgaatctatatgtataaataaaacaatatgattctacagatctgatatccaaaaggaaaataaaacataggtggccttaataattagtgataaagacagccaagaattccatggaccatcagctaatctaattttaagtgtttcaattcccagcaaaacttgctaatggacctacagaagctaaactgacctatttttcatcttctcttccccagtctctctgtagctgatgtcataagcataaaataaagttgtcctagaagtaaaaagaagagaggcatgtataaaatgtgaaactaggtaacattcttccaagtgaaacactgaccacagagttaggagacatttaagcatgtgtagtttataaaaaaaatgacactgggcaatatggtgaaattggggaccatatagcaccaaacatagagaaagtcatgggatctgctagcctaatatcaatgaaagaattcagtctaaaaaatcaactataagccgggcacagtggctcacgcctgtaatctcagcactttgggaggccaaggcgggcatatcatgagctcaggagatcgagaccatcctggctaacacagtgacaccttgtctctactaaaaatacaaaaaattagcctggcttggtggcaggcacctgtagtcccagctactagggaggctgaggcaggagaatggtgttaacctgggaggcggaggttggcagtgagccgagatcgtgccactgcactccagcctgggcgacagtgcaagattccatctcaaaaaaaaaaaaaatcaactatattcatgccactgataacattcccccactttccacttcttaagtgaacgtttgtttttctagtattgcttgaacatttaacattattgaacagcttagcgttttgtggattggctcatctcttgctttaatatttcttctgaagccttaatgaacagagatacctaaaagtaatcctgaacggctgtttttttgataccataaaaatccttaatccagtaagtatttattgagtcaattgtgtgctaggcactgtttaggcactttcaatacttcagtaaacaaaaaagaaagagaaagaaatataaccttcctgcaacttatattctagtagagaaagccagctaattaacaataaacacaataaataactgaactatatgttagttggtaagtactacagcaaaaactgaacttggtaagggaatagggtatggtgggagaagggaggggtgggagcaattttaaagagaaggtgaaatttgaggagagtttttcaaatctgcactttattccttcgactcagtatagttcttagaaaagattcctccactggaccacttctaagcctgactaatgaaatgtgtgagctttaaattgatttaactgcttgcctttcagagtcttcttaggctgaaatatggggtctgaggagcaaggcttgctgaaaggactagagataattattcagtttagcttggctgatgtcacaggtcctgtgactagaggcatatctattctctctggtgtcctataaacatgcactgcaccatcgtcacttaacacgattttactttgttgctggacacataactcctgcttaaaatactgtggacattgagaacagatttgtattatgctatggtaggaaaatatctgccttagatagacatagcaacagaggatgtcaaaacaattttataaatatgcaaacttctcagaccatgcaaagtgaagttttagctcatattctctgcctaacaacctactgccaactcaacagccctcctaaacatattggcaataaagcacagaataacaattcataatttcacttaaacattgactcagcagcctaattttgttttcaacaggcaaaatataattcataagaagttaattattacaattgtttaagatttttgaacaatagagaaaagataaaatgttctgaacttttagttctgaatgtttacatataaagataatggtagatttgtaaattataaaagttatttgctctacaaattatttttttcatcaataaatttaaattatagactaggcacggtgtctcaagcctgtaatcctagcactttgggtggattgtctgagctcaggagtttgagaccaacctggacaacatggcgaaaccccatctttactaaaaaatacaaaaaaaaaaaaaaaaatttagccaggcattgtgttgcatgtctgtagtcccatctactcaggaggctgaagcgggagaatcacttgaacccaggaagtggaggttgtggtgagcagagatagtgccactgtactccagtttgggcaacagagagagactcagtctccaaacaaataaataaataagataaactcttgttggaaaaagttatactataattaagggacgaattgtgttttgtataaagccttaaaaaacagaaaaagttgacgttttgtatttcactcagcaggagatctgagacaggaataatgaggaaattctataggtaacatgctatgtagtttcaaattagacatccttatgtcaaaaggctgaaaaggctaagaagaaacccagtagtgaaaccatttggcaaagtcattaggtaagcccagaattgaatcttgagtcagaagaaagactcatagttctaatctgacactaagtttaatccattaacctacaaataaatcattaatcctgaagtcaagaaagtgagaggcagatgtcctgaagtttgaatttatctcagagttaaatatatggagaaaaaagaataaaaatcaaagttttctttttctgccataaactaaggaagtgaagtttcaataaaaaaattgaaaactgttcttcgtaagactgtatttacttttctttgtcaatcagcaaatgcaaatggcagcactgggaaccagcagagaggataaaaagaatgagctataagcctcaatataatttttgagagagctatgaattaaagtgtcacattgttactatttactcacggaataaaaatcatggggaggggaagcttaagtttaagccaaatggtgacttgatactcctaattattatgttataatcttttatcttaatgcctgacataagttctttctcctaggaactaaagatgtcaggtgtgtgtgtgtatgtgtgtatgtgttgtggtgtacaaacccacagacatataactagataagcccacatacacacatcatcaatgaagagatatcatgtaaaccatcaacagaaagctgtacaaagagtattagtctttggttcccagtgatttgcataaaataatgaaattctgaagttttggagaacacaattttaaatgtatgacttttcttcttgctctaatatgtacagtgcctgtaataaaacttgaagtcctgaaaaagaattatctatttctcatcatccatgatacctaataatgtgcattagaactggcttatttgatatgatcctagaaaaatgatcctatgggtaaagtagatttaaaaagaaaggttaaccaaaaatctgaaaggaattcccaaattacaaagaattcaattatatgttgaattgctatttctacccacgtgcgttttgatgcttattttatcaatgaatttttgttattgttttatttttgagacagggtctcactctgtcagccaggctggaatgcagtgtcatgatcaccattccatgtaccctcaacctcctgggctcaagcaatcctccgcctcagcctcccaagtagctgggactacacgctcacatcatcatgactggataattttttttttttagaaacagggtctcactatgttgcctaggctggtcttaaacttcttggcttaagtgatcctctcgcctcggcctcccaaagtgctgggattacaggtgtgagccccaatgctcatcttattttatcagtaaatttacaatagcctcgctggcataaagaagacttgccttaaaacttctattattttatttaatcctaatattgttgttatgtttaaaggaaaatttgcattcatttgcatatataagctgagtgtccaacaaatggagaataatttaacatctccaacatatattacactgttttaaattctaaaagttactgcaaaggtcaacagaaattattgtgcatcatcatttatgctgtcagaggtgagcatgagataaagctacttacctctaaggtgaatgacagtaccacgtcggactttgacagctgaatctcattctcatctcctatgtccaaaaatgcagagttctgtgaacgttttaatttttgtaatttaaattccggaccacctttcgaaactggaagactttccaaattggccattagcaaattcactgaagaccgcaactcttctatatacatattctccatatcttttgctataaatttggggaattttctttccttgaaaataatttttaaaataatagtgttacataagtcatatttcaattttatcatacaaaattgtatgatatatatacttcactgtcttagaaattacaacactctcaatatatctatcctacttgagtcactaggctgtaaaatcctcaggctttggcatttttgattatatctatggtacttcagatatcttattgaggatcactgcagtacaaaatgaaaaaatcgcatatattttcacattaaatttatttgtgataagatttgcttaaggaaaaacaaactctgaaaacatgcatggaagatattttagcgtatagatgaaccttagccactagtagctttgcgatgcttgggataactggtctataaaaaaatgttcaggacacacagctttccaagttaggaaacaaacattttaacaatagcccaatttcttaccacagatatgcgttgttggaagagtatgctttttcataaataggcattaaaaactcacattattgaagagtgatatggtcatatttctaaaattagtaaattttcacattacattaatgtgccaagatctcttctggctataaattcagttttttactaaaggcttagaaaaagttaagtttaaagcaaaaggaaatttatgataaaaactattaagggaaaaattaacaatatcaatttggaagattctattttcttgctaaattatatcagcattgccattcaataattttaactctgcaatcagatttgtttcttctgctcaattaaaaggatgttccaaatattgatatttagatggtgccgaatcattcttagagaagattataataaatttatattccccagaacagcaaatgagagcactttgttccctcacattcttggctctttctttaatgtttgccaacctggcacttaggttttctctcttaaagacagagggtatatagttttacaacattaagcctagtttaaaatgaccaccagtgcacagaaccggctggaggatgaaagcctaaagcagccatctttcaaatggctgctgaatgctccagaaaagcactgcctttactgttgtctcccttgacatcattcaaaatctaacctaagaaatctgcatgtgtagtacaatttgaaagcatccagcatgctcttgtcaacctgcatctagtctctgactcacttgcaccagttcattcatgggattggaaggaacatctggcaccacttcacagatcagtcccagagtctcaggccacctgcttttcttctcctccaatataacattcacatatttctttttaaaataatttacatataatcaaaattaaaattgcataatgtcacagacagattaaatatctacattaaaaattaactttcccaaagaaggttcttaaatatccttttaaaatttctctacagtttgaagcaacattccaaaacagcaaatttgtatccttaagaaaaacaggcaactacccagctataaaatacctgggtttcctttagtggggcgggggagggaaggaattgtctttagaatattttttcagtacaagcaaagagaggggaaaaaagcaaaatgatccataaaaaacatattttacgtttttggactaactttaaggctgccagaaaaagcatccaaaactgagaaataaggcaaagcaatgagggggcagatcctttcaatgtcgtatggaggtgaaggccatccaatgatcatttggggaaaagttcttagttcaccttattatttattattgattaaagattccagacaataaagctacatgttaccttgtaaaactgtgtctgaaagaggtgcaaataaagtttggtgaataatataacccacaggttcagtttaaatctgtattagaaattaaccaatttttgattaaaccccattaatcttaccttagtaatgcccccaaacacctagtttctcatatgctctttggtctggttttaacacctaacttgtttgcttattaattatgcgttgaataaaatctctattgtgtgtccattttatatttatatgaaaatcacaattctacccctaaaaaagtagagtttaacaaagaaaaaggcgagcatgtcacgtatctgaaagttctgatatactaacgctttgctttcaaattttcaacatgttatggaaaatctagcattagcacaagaacaaaaataatctatttgtatttagctttaactataaacacttcatgaactatctatcatctgtcaaacaggagaaaagcaggcatctccaaaattggctcttttatcagtatttccaaacatttcagggactagactatacttgaatttttttctccaaaaaagctcaaaattcagttttaaagctttgaggtttattgataatatttcattaactctattcagcctgcttgtgttgtccctcactggcaaacaacaaaactaactgtatatcagacaaatgtacattttaaatttgttgttttaaactagaattgaatgagaaatagggttatttcctagttgtctaactgtgagtcactcttacaagtcatgtgttctaattaggtcctctgtacagcataggtccctagtggtcttaacccatggtatacacaaaaacaatatttgcttctttaaaaagtttttctcattattcaaatatagtcactttttcttatgcgctcttaaccttccattagatgacatctggggttcatatcacaggattgtttctctaagctgatctctgctgcttcccatgccccacattaattttaggttctaatctcagcatcatggcatcaagtgaactactggctgtgaagctggttccaaacctaactaaatcgttgaagtgtttaaatgtttttgctacaaattagagcagattcagttatccttaccatattggtattctctcttcctttcaattcaaatatgcctttgagtgggagaaaagggagggagtctacaaataattcaagaattcttcacagccccagatttctcacaaatatgccagcatgtaagactcagtcatttgatagacattccctgagtgtctgctatgtgttctgctccaagcccctggatagaaccatgaagataatggacaaagtcctgatagacttagtaaacaaggaaataatttcttctgatagaaagtcataagtggcatggagaaaaagtctagaaggaggaacacagagtgagtggtgagaagggttgcagctttaaacggggtggtaggggaaggtctcaatgagcagatgatgccctttgagctaaaagtggataaggaagtatgatgattaattattttttttttttttgagacagagtttcgctcttgttgcccaagctggagtgcaatggcacaatctcggctcaccacaacctccgcctcccagtttcaagtgattctcctgccttagcctcctgagtagctgggattacaggcaggcgccaccacgcccggctaattttgtatttttagtagagacggggtttctccatgttggtcaggctggtctcaaactcccgacctcaggtaatccgcccgcctcagcctcccaaactgctgggattataggcatgagccaccgcatctagcccaattaattttgtttgtcagtctggctaggctatggtgcccagttgttggatcaaacatgaatttaaatgttgctatcaagatattctttagacgtgaataacatttacaatcagtaaattcagtaaatcggatcaccctcctacatctgtaggtaggtctcattcactcagctgaaggatttatgaccaaaggcgaaggtttcctaaagaagcagcaattttgcctcaagactaaaacacagaaaccctgtctgagtttctcacctgccagtccgccctacagatttcagacttaagactgtaacatcaaccctcacctgaatttccagcctgcctacttgtcctatggattctggacttgccagtgcccacagccgtgggagccaattccttgaacgcaatcaatctctctctctctctctccctgccctcccacacacacacacatatatatacacacataacatgtatgtatgcataacatctactttttaatattatatacatatttattatatctacctagatattggtctagatatatgaaaatacagatataatctcctattggctctgtctctctggagaacctgactacagcagggagaaagccatgtaaatgtcagtggaagttcgctgcaggtgaagagtcagggccaagaccctgtggcaaggaaaggcaaggaggccaccatcgccaaagtggattgagcaagggcaagagtttagtggaggataaagtcagaggggtaaaaaagaccagatcacacaggactggggtaacaaagaccagatcacacaggactttgcaggccattttaggaacttttctttttttctcagcaacatagggaatcatcacagatttagtgcagaacatcactggctgttgtgttaatgaggacaggggtagaatccaggagactggctaaaaggacagaacaatgatccagacaagagacaaagatgaatggaccacagtggaaagggaaggatggtaacaactgtcacattctggaaatactgtgaaggtaaagataaaggatttcctgataagttttgcatgaggtatgagaaaaaggagtcaaagatgattccaagttttttggcctgaatatctggaaggattgtactatcaagaactggcctgccctgaccacttgactgaaaactgtaaccacccaccacctctctcctacactcctcatcccactttttctgatctattttctaagtaacaatgatcaccttccataattcaattacacggcatgtttactccttattgtggggctatcgcaaataaaatgtaagctccaccagggcctggcagaaatatttttgtctcattttatcccaatgtatcccaagtagctaagactgcacctggctgtatagttggtgttcaataaatatttggtcaattaatttgtggatagaaaaaatgaggctcgaaagtgttaagtaacgtgcctactattatgtttagaaaatagctatcatgaatttggtcacaggtctttctggccctgtacacattttgttcactacttcctaattacctcttggctgaagtactaaagtcaacatgtctcttgaaacagagattttgccctgtagtttcactgttattatattgtgttgttctgtgaagtgtgggagggggtgttcctgaatgccaactaatagctgtttattaaccactcttctggaatgatcagattgcagaggcagcaggatgttaagagagcgagcccaggctctggaagcaaggccaggatttgaggcctgcctcagccacttatttgttatgtaatcatggtgaaataaataatcttgtctaagcctcaatttcctcttctataaaattgacttcatgatatcatctgcccttacaaggtttgtaggattattgtcagaaaataattcagcaaggtcagtcaattgttattaggcttaaaaatatttcattaagacggcttcactttggtgaacttgaagtggaaagcaattaaacctgctcaatctatgtcaatattttcatcaaaaggtatcctatttttagaggtatattttgctttccaaccccatcagctttacttctttctccatgttttttccactctatcaacatctctgatgaaaccattagggttctctcaaggagaagcctttgtgtgttcatcactaaccctttcttctgactcagcccaggagtttatgaacacaccttcttctcagtcatgaacctgagaatacgtctgagtctcttcttccagtcccataactctctagaaaatcacttaaactttattctaaagcattacatatgacaatgtgcccagtctcaggtacaatctatatacaagtaggtaattttcaaatgctgaacacagatccactgtccctcctgctgctgtcaggcacatctctccaggttctttattagctttaggtctcagaaaagcaatttcttttccagccaggctcaatacaggataggacttggcattaaaatatttttctttctaaaggtttcaatagcctcaagttgcttgctttctactctacaaaatccacattcaaatctctagaatgaaataccacctttctagaaacccagaggacaaaaataaggcatgctatcctttcaatcactgccctctgtgcaaatgtaactctttggcccctaatttatagcacactgtatcttcattcatctagagattcttcctcatgatctaattcctgcttggttcttacaacttactgtcattcttgttacccaattatctacatttttctctattttattatttatttctaatttctcaactttccctctactttttaataaacacttaaacagtgttagcattttaaaaacattatgtattaatatttacaaatacacattttctttgcagaagtaaaaaaataattgttaaaattagtatgggatataacttcttgaatgctggaagagttcattatcttgatctgggaggtggctacacaggatgtatgcgtaaacattcattaaactgtaaaatgaagatgtgtgcagtttattgtatacatgttacgagagagagaaatagagagggagactatccatcaaatattggaagtttttgctaagcagaaaggaaagggagagaatcttatgttcagagcaatcaacagcactataactgcaagtccattgaaaagaactaaaattttcatatcattgaagtaagttaataaattcactaaagaatgatttagacaattgggttccattctctctaaaaaccttaagtactagaaaaaactcatgccttttgtctgaaatttatctctattcacgatacacagtgatcacacaaataaaataagtacaatatgatgaatttcttgtatcaagcacacttcatctgccagattgcatactagatacttaaaataatattttttcatgcatttagtcattcaattaaatgttagtcagaaccactatgtgccaataactttactgtatacttaggaatgtattatatgattttgcggggaggagttttttctccctggttatattttgcttagtaaaacattaaaactcttctagatctggcagtttgagaaactcatgcattgctttaagagaagtctataaaagttatcattaaaattaaacagttcacatattaaggatgagtacgtaaaatgaataatatgcttcatttagataacatgctttcagatatttgggattaagaggtctatgtgtagaggagaaaatgttaaaattatgctggctcttttttttttaacctatacaaaacactttttcagctcacagaaatctaggtaaagaaaggaatgtcatacagtatgtccaagttaataatttacctttgccattttatctgccaattgcagccggccatcaagttcccttctgatctgggctgcttgttcatctgcgttatccagcttaaaaataaaacagaagttacacatatgtaattacttaatctatatacagtgacccacagactgaggcagtcccacagactaaggcaaagattaaatgactgaaaaatgtttaatagattgtatcagatatctattacaaagagaatacaggaggttgttcaattagattggcagaccagataaatttcttgggtactttctcattgtggttttactcacaaaaccaccaaatcaagaaattagatttcttgatcattaagtcagtcctaaatagttccagaaagatgaagctcttgttttgttctttcaagttctcaccatgtatttctggagggtgagatgctaatgtttcacttctttctttgtactttaaaaaaactccctttgctttaataataagtttgtattagtgctaaactataaaagtactctttgattgactgatacaactttctaccacttaagtcttcatatactcctcattctaataccagtagactaatactgccaagaaatccttccattcttttaaggattggcaccatattagaaatccattctcctgttctaaatttgactgaaaacaagaaaagtgtgctctcatcattttttttagaaatctcccatttacatggaaaattattttcacttcatgaactaatccttaactttttctataacttattttaactttactcatgataccttttcacccattcactcaatattagtccctttataaaaatgttaaagtgaggatgttaagtgttaattttctcttgactttagttttttctccttttgcactctcatcacgaagaagcctggactgcacaatacactttagtaaaggaccatctaaagattcgattgagtataacattaaacaccaatgagaaaacagtttacttgtcactttcccaaagaactacaaattgaccaggttacatttttaaaaacatcctcaaagagagtcctcaaaaagatgagtagaagcaaaccagattaacaggatagtggtggtaaggcaatttatatgaagagtcaaaaaaaaaaaaagaggaagatgttcctataaaagaacaccaaaagtctggaggtgaggaggtaaaactagacacacacagtggttcttttggaatgggataccagaagaggcagggtgagggacaggactggagagagaagcagggcaacttcataagttactcttcacaagccacattagggaatttggagttagttcctacaacaatgggacttccttgagaggtttaaagtgtaggagtgatatgatcagatgtaagctttggaaaggaaagatcactctgtctctagtacaaacaataggtcagaaagacggaagtcttattttgttttctttaaagatatacacaaaatgttaaattgaggatattcatgttaattttctcttgggagaaaaactatacaaaaggcctgagattacctgtctaaaatatgtttccaagttgatttttaaaaaaccaaattcattttaaaataagttaaaaaaacaggcaagattttcttaaagtaaatccttgttatataggagtttctatgtcatctcataaaactaacaaacaattttaattgattaatatgattcaaaatcaaacagaaacaagtttctcttcactgtgtctaaaatcaaaatgattaaaattaaaaactaacgtaattatgaagaaaaataatatgcagtaagtacgggttccaggttaactgaaatctctcattccaagctcctaaaaactaaaccataagaacactgaaactgtaacaatacttcaaatgcactaaatgtaatatgaaatatattatgatctttgcttaaatgctgatacatatttcttcaaaagacataaaaagttacttgcatataaagaaattatatttttctcacagcttcaacaaaaaatagcatttaatatcttaaaaggccacagtttttcaaacttcactagaaacactaacatatttttgtatctatatctccagattaacagctcttacttaagtgtaagtgaaattgtttgagttatttctaaattttggtagttttgtttgtaagagacaatttacaactacatattttttctttttgtggagatggagttctcgctatgttgcccaggcttgtcttgaactcctgggctcaagtgatcttcccgcctctgccttcctaagtgctggaattacaggcataagccaccgcacctggtctgtttttttaaaaaataattaatgacttgatcacatttgtctgaaaaaaaagtaagcaacaaaacaaaacaaaaccaaaaacaatgtagagcactgggacactacattgtcttttcttttttttttaatttcagatttggagggggtacagtgtaggatggtttcatgggtatattacatgttgttgaggttgaggttggggatatggatggtcccatcacccaggtggtgagcatagtatccaataggtagtttttcagcccacatttcccttggtcaatcattccccagtgtactattcccatctttatatctatgtatattcaatgtttagctttcatttataagtgagaatgtgtgatatttggttttatgttaaggtgctaatttgcttaggataatggcttccagctgcatcgacattgctgcaaagaatatgatttcattcttttttagggttgtgtaataatccatggtatatatgtgtgtatgtatatataaaatattttctttatccaacccaccattaatgggcacctatgttaataccaggtctttgctattgtcattagtgtgtcaatgaccatatgggtgcaagtgtccttttgatcaaatgaattatttttctttgggtacatacccagtagtaggatttctaggtgtaacagtagttctgttttaacttctttgagaaatctttaaactactttctatagtggctaaagtaatttggattaccacccacagaatacaaacatttgcttttctctgcagcctcaccaacatctgttgtttttttgactttttgataatagccattctgactgctgtgagatggtatctatctcattgtggctttgatttgcatttctctgatgattagtgatgttgagcatttgctcatgttttttggccacttgtacatcttttgagaagtgtctgatcatgtcctttgcccatttttgagttggattgattttgcttgatttaagttccttgtagatatctgtatattagatctttgtcagatgcatagtttgcaaatattttctcccattctgtaggctgttggttgactctgttggtaatttctttcgctgtgcagaatctctttagattaattaggtcccacttgtcaatttttgttttcactgtaattgcttttgtggacttagccataagttatttgccaaagctaaggtcgagaagggtatttcctagtatttcttttagaatttttaaactttgaagtcttacatttaagtcgttaatccaccctgagttaattttcgtatatgatgaaaggtaggggtctagtttcattcttctgcatatggctagccagttattccagcaccatttattgaagagggagtgctttccccattgtttatttttgttgattttatcaaagatcagatagttgtaggtgtgcaggtttacttctgagttctctatgctgctccatttgtctatgtgtctgtgtttgtactagtacgatgctgttttggttactttagccttatagtatactttgaatttgggtagtgtgatgtttctggctttgttctttttgcttaggatagttttgcctatttgggcttttaggttccatgtgaattttagaatagatttttctaattctgtgaaaaatcatgttgctattttgatagggatagcactgattctgtaaattgctttgggcagtatgatccgtttaatgatactgatttttccattccatgaatatggaatatttttccatttatttatgtcatctttgtcattttctaagcagtgttgtgtagttctgcctgtagagatctttcacctcattggttagatgtattcctgggttttttgtttggtgtgtgtatctattgtaaatgggattgtgttcttgatttggctctcagctagaattttactgatgtatagaagttctattgatttttgtactttgattttgtgctgtgaaactttactgaagtcatttatcagttcgagaagctttttggcagagtctttaggggttttctacatatagaatatcattaacaaagaaagctaatttgacttcctcttttcctacatggatgcattttatttatttctattgcctgatttctctggctgggcttctagtactacgttgaacaggagtggtgcgagtggacattcttgtcatgttccagttctcaaggggaatagttccagctcttctccatccagtatgatattggctgtgagtttgtcatagatggctcttatttttatatgtttcttcaatacctagcctgttgaaggtttttatcataaaggaaaattggactttattgaaggctttttctgcatctattgagattacatggtttttaattttggttctgtttatgtggtgaattatctttatttatttgcttatgttgagccaaccttgcatcccaggaatactgcttgattgctgtgaattaactgtttgctatgcagctggattttgtttggtagtattgtattgaggagtttgtgactatattcattagggatattgatttcttatttcattgtgtctcttccagattttggtatcaggataatgctggctttgtaggatgagttagggaagatttttaaaaatagtttcaggaggattggtaccggttcttctttgtacatctggtagaattcagctataaatgctgagctaagaagctgctatttcagggctctttttggttagtaatttttaaattactgattcaatttcagcatttgttactggtctgttcaggttttcacttcctgcctggttcaatcttgggaggttgtgtgctcccagtaatttatccatttcctccagattttctatgtagcatatacagaggttttcaaaataatctctgaggatctttttttatatttctttgagatattctgtaaatccatctttgtcatttctggttacacttgtacgtatccttctttgttaatctagctagcagtctatcaatcctgtttatgttttcaaaaagcaactcttagtttcattaattttttgtatgaacttttacatgtcaatttcattcagttctttgctgattttagttatttcttctgctagctttggggttggatgttttcctagttcctctaggtatattgttagatcgttaatttgagatcttcctaactccttgatgaaggtgtttagcactgtaaactttccttttaacactgctttagcggcatcccaaagattttggtaagttctgtctctattttccttaattttaaggaagtttttgatttctgtcttaatttcattgctcacccaggatttattcaggagaaaattgtttaatttccatgtttatataggtctgagagatcttcttggtattgatttctacttttattgccctgtcgtccaaaaggatgcttggtagtatttcaatattttgaatttattgagacttgtgttatcaccaagcatgtgtcaatcttagaatatgttctgtgtgcagatgagaagaatgtatattctgtgattgttagatagagtattctgtagatgtctattaggtccaattggttaagtgttgagtttaattctggaatttgatagttttctgcctggatgatctaatgctgtcagtggggtgctgaagtctctgactattaatgtgtggctaatttttttttttaattattattattatactttaagttttagggtacatgtgcacaatgtgcaggttagttactatgtatacatgtgccatgctggtgtgctgcacccattaactcgtcatttagcattaggtatatctcctaaagctatccctcccccctccccagaccccacaacagtccccagagtgtgatgttccccttcctgtgtccacgtgttctcattgttcaattcccacctatgagtgagaatatgtggtgtttggttttttgttcttgcgatagtttactgagaatgatgatttccattttcatctatgtccttacaaaggacatgaactcatcattttttatggctgcatagtattccatggtgtatatgtgccacattttcttaatccagtctatcattgttgggcatttggattggttccaagtctttgctactgtgaatagtggtgtggctaaattttttcacaggtcaagaagaacccattttatgaatctttgtgctccagtgttggatgtgtatatatttaggatagttaagtcttcctgttgaattgaaccacttttcattatgtaatgcccttctttgtccttcctgattgttattggtttcaaatctattctatctgatatgagaatagcagctcccacatttttttttgttttccatttgcatgatagatctttctctacctctttgagcctgtggtgtcattacacgtgagatgcctctcttgaagacaacagacagttggttcttgtcttttttatctagcctgccactctatgccatttaagtggggttttgagaccatttacattcatggatagtattgatatgtgagattttgatcctgttatttcgttagctggttgtttttgtagacttgactgtgtaaatgtcttatgttgtctgtgggctgtgtgcctaagtatgtttttgtggtagcaggttttggtgtttcatctccatgtttagcactcttttaaggacctcttgtaagggtagtctagtgttaatgaattcctttagtacttgcttatctgagaagtattttatttctccttcacttaggaagcttagtttggcaggatatgaatttcatggttggaatttcttttctttaaaaaagctgaaaacaggcccccatcctcttccggctcgtaaggtttccacaagagatgtttttttttttttttttttttgagatggagtctcactctgttgcccaggctggagtgcaatggtgcaatcttggctcactgcaatctccgcgtcccaggttcaagcaattctcctgcctcagcttcccaagtagctgggattacaggtgcacatcaccatgccaagctaatttttgtatttttagtaaagacaaggtttcaccatgttgaccagactggtctcgaactcctgacctgatgtgatccgcctgcctcggtatcccaaagtgcatgggattacaggtgtaagccaccaaactcggtctgcctttttaagatttttttgttgttgttgaacttggtgaatctgatggctatgtgccttggggttggtcatcttgtatactatcttgccagaattctctgtatttcttaaatttgtacgtccaactctctagtgagattggtgaaattttcatggactatatcctctaatgttttccaagttgcttactctctttcctctgtcaggaatgccaatgagttgtagatttggtgtcttcatataaactcatatttctcaagggttttatttttttaaattgtttatttatttttttctttttgtctgacaaagctgacttgaagaacttgtctttaagctctgaaattccttcctcagtttggactattctgctgtaatgcttctgactgcattatgaaattttgctttttttttttttttttttttttttttttttttttttcctgagacagggtctcactctgtggcccaggctagagagcagtggcatgatcacagctcactgcagcctcgacctccctgactcaagtgatcctcttacctcagcctcccaagtagttgggactacaaatgtgcaccaccatacctggctaatttcttgtagagaacaggaggctgacctcaaactcatgggcttaagtgatcctcttgccttggcctcccaaagtgctgggattacaagcatgagccactgtgcctggactattatgaaattcttgaagtaaattcttcaattccagaagttcagttgatttcttctttaaaatagctattttgtcttttagctcttgggctgttttacggaattccttgaataccttggattgggtttcaactttttcctggatcttgatgagctttgttgctacccagattctgaattctctgtctgtccagtagtcattacaatctggttaagaactactgctgatgggttaatgtgtttgtttcggcataaagagacactctgcctttttgaattgccagcgtttcttgcactgattctttttcatgtgtgagggctgatgttcctttaactgtgacataagttgagtatagtcagttggctccatttctgggtgcttgcagagagccaaggctctgtacataatctttatttatgtctggatttttgccttaggtttcacaggtgctgtatgctggcataatgtttttgatgtttcatttgggctgtaatccagtaggtgctccttaagagtggtggctggcagatagcctctaactcagccatgtagctctgttgtattttggcatacgcacagtagtactctgtggtcaggggagagagagctgacaacctcaccaggtttgctcctaggccttggaggagccccttctgatcactggcaccacgtccacattttctttcttaggtgttctgggctatagagctccctaaggcagagactgtggctggtagacaagactataccctttctggaaagcccttcagagggagacatgccctgctcccccaacatcctgagagcccagggatctcacccttttcagtattctgagagggagggcgtcctccccaccccctgcttggggctctgcccaagttaggagcagggtgaagttgaatcctgcccagttaggagcaggatgagtggagtcacccaattcaccatcgaagtgcttcctgggggaacacaaagctctcctaaaccacaggggtttagcaggttttctgtcaagagggagtagagcaatctgtccatctccagcaccatgactgcagcttctgtcagggccatggcacctcaaccaggctgttccagagtccagggcctgggggggtccccacggacttgagtgttgcctctgcaaaaactctgggtagctctctgtatcagtctagaggcccaagggagtcatggggtttttcacattctcaggattgcacaggtcactgtgggaagtatggatcccctgaggactcttactcactaattctatccctgtgttgaggagcttctcctgtcttcatgctggtcccaggcaggcagctgcccagcttcgattttctctgttctccatgtcccattactcccttgatgcatcctgaatcctgacgtggtttcttagatgatccacttagagagtccatgtttactcgtcactatttcctctccacgagagcagtacacactagctcctctagtctgccaccttgaaccctaagtcctacatgtcttttagtagccttctcttcataaagcgaaattttcagaggccaaagggtactaacttctgtggccactggtgtcattttgtgaaactggaaaagcatacttccaagcaacatgtttaccaaaaaaggaaaaagctaatgaaggcaatggataaaaattcaaccagtaatcctcattttatgtaatgttagaattgaaggggataaattagttggttaacgttcttttttacatgtaagaatcttagtttaatgttgcatgttttgagttttgagttttttaaatttattttcgacataatttatttaattggaagtttatataattcttatgagcattttcctaaaggcagaattcaactgagacaattttgattcacaaataattataaaaagtagaaaaacatccattatatgctcttcccagttttccctaatgatagcaccttataaaactatagtattctatcacaaccaggatcctgactttggctacgtaatcacccatctaattcacatttcctcagttttatgtgtgctcctttgtgtgtgtgtttagctctccacaatttattacttacataggtccatgaataaccaccataaagacactccatagctctaacatcacaatgaaccctcatgatgcccttttatacccacatccacctccctctagccagtccccagttggttagttttaataatgatgtgccccattttacaaaatacttcaaaataaattatactaagccaaatatgattttcttttaattgtcattaggaaactggagatgtggtcccttgagcgctcataaacattggagattttaggtctgcagcctctgacctcttctcaatctaaatattcactgcctggatgctctcctcaaagcctatgatcataagcagcatctagtctctgatcttccaagtgtgtatctatagcacgaaactcttgcaggagttccagacttaaatttcccattgcctactcgagtttcagcttatgtgaagacaaggcacattgaaattaacaagcccagaatagaatctcaattttcagctccgtaccccgatcattcatgagtaatgccgtgtgataaatggcatgcctctctaccagttgctcaggcccaaaacctacatgtcatcttcgacttctctctccctcacagtccacatccaatccacctagagtcatgtagagcgaaacctagaaccacatagttgagacctaggcagaccagtatgcagggattttcaggtattatgagtctgtggccaggtctttctctccctttccctcttctgcaccccctctctttctttgggtgtgtgtgtacattacagtgtttctctagccacttcaaagcactatttcaatttgccagtatggttggaaactctgtcacagtgaaaataattatctttctttactgaaccatcagaacttaaataagtggttgtgtgtgcacacacatatacacacacacacacacacacagagatagagagagagagagagaaaaaaaaagaagggaaggggagaagaaataaataaaagcctgaatggacaaaatttaggtctagggcattacaatttaaaatgtttccatgctgttccctaaaaaataaaaaataaaaataaaaaaaaatattgttggctgggcgcggtggctcacgcctctaatcccagcactttgggaggccgaggcaggcggatcacaaggtcaggagatcaagaccatcctggctaacatggtgaaaccacgtctctactaaaaaaaatacaaaaaattagccggacttggcggcgggcgcctgtagtcccagctactctggaggctgaggcagaagaatggcgtgaacccgggaggtggagtttgcagtgagccgagatcacgccactgcactccagcctgggtgacatagcaagactctatctcaaaaaaaaaaaaaaaaaattgttgacccactagatcctagtgccggatttaggctatgagatacataaaataagaatatgtgaactctggggattgtaatagagatcagaggtaaggcttcactctaccaaggcaatttcaccttttaatgtcattttttttttacttttaacttctgatttcaacattttatttaacaatagattactttgctcacagatgtcctttcctggcagataacattttacaggtctttttaaaagggccgttaatccttgatcataacagatacctaatgtgtatctttattatctgcaatgcttctagtttctattatacagataattttgtcacttcaattatcaaaatacttgacaaatatttagttcagaaaatatgcttttattttcctcctgttcattacacagggattactgtttccacattcagaattctctcggttagggaattcttgaattggacctttggaagtctgtaaaacttttgaagttgtgagcaaaattttgtagagatgcatatttttttcccttggggaattatttgaatttcatagcttacttgaggttctcaaaagggtgattaattgaaaagagataaagaaccatgaatcttctgtatgaaagcctctattatttcattctaggaaaggccatatgacttttgatacatcaaccagggaaaacagtcacctcagtcctacacatcttcagacttacacttacagagattttctaaattctttgtaaaggaacactaaaacacagggtcttaataatgttaacctgaatggtccatgattttattaattccatatacatgttttctatacctacagtacagcataccctgttgcaggattttcagtaactacaaaagttgtggctctccaggagttcatatgttacgttaaaaaaaaaaaaagtaaaaatagtaagtaaaacagatatcattatgggtactcaattaggagaaaaatgtttttctggaatgatagcatcaggatggatttgcaaagatagaaatattaaaaatggagaaattgaggccggccgtggtggctcaaacctgtaatcccagcactttgggaagctgaggcaggtggatcacttgaggtcaggagttcgagaccagcctggccaacatggtgaaacctcatctctagtaaaaatacaaaaattagccaggcatggtggtaggcgcctgtaatcccagctactccagagactgaggcaggagaatcacttgaacccaggaggcagaggttgcagtgagccttcatcgcattactgcactccagcctggaaggcacagtgagactccatctcaaaaaaaaaaaaaaaaggagaaattaatgacctaatgtaacagtctattagtcttgccttacaaatatcaaaccctaggctctccttgcccagtcactctcctgttgcatgggagcagctctgggaaataggaaggtcttcgagatcagcaaatctccctttgcagaagtcctagggagaactggaagcctgtgctggcagccaactatcctacaattaagaaaatgttaaacgtagcataaaataactactaagtttcacccaacagctttttttttttttttttacaacttattatattgctcttctagtactttaaaaactatgaacatcaaaaacttgaattcattaaatttacttatatcttaaagaaaaaagatcttttaaaaatgcttttcacagtactgtttagcatcattgccctctctaatatatctgttctctagaaccaagataaatgtccttatgttaacattgtcaatcactaaaaagggggattaataactgtttttccataatcatgtctttgtatatgttaatcctagttaactgcactcttccttctcctactgaaaaaaaatcaattagttctttcacttagtccccacaccaattatgtcatactctttttgagtgaattgcactcttttgttttcttataatatttatctttatcctttattgtgaaaatataagtagattagggtttatgatgttatgcaaatttggtgtcttccctgagattaattcctagctggttcactgtatttatattatctgtaaatctagtgatttgtagataatacattacaataaataatcagcacaaacctaatgctgattccaaaagaatactcttcctaacactttcttgcttaccatatctagcagcccagtgtttcatttggaaatgccaaatatgcatagattttgcaacacggcctcaaaacaatggtcaaaagttttattaagtattagcaaattaatgtaccttatcaataagtgtcaatcctccaccatcacttgaatcaaaaattatttacaataaagatagagcatagctctacccaactgactgtgatcatttctgctgttttctttgctggctccctactctctcagcccacaaacacatgagctctgtcctcagctgttctaggcttcagagtgtctgcagtaatttctcaatgcaatgtcatacatcagaacacagctgggcctctcgctttgagtttcagctttgcacttccaactgaaggccaggtctttgctttcaagcatctcacaatgacctcaaactaaaactgaactgattttatcacccattcctcaatatggttcccctatttctgcatatgattctcattacccttgattaggtgaaaatttctgagggggcagagggaagagaaaggagggagaaggagagggagaaaaaggaggggaagagggagagggatgaggaaggagggaaggggagatgaaaagagtgaggggaggaagcaagtgaagaagaatataaaaccatggacttggcacggtagcttatgcctataatcccagcattttaggaggccgaggtgggtagattgcttgaggccaggagttggagaccagcttgggcaacatggcaaaacccctctctactaaaaatgaaaaattaaccaggtgtggtagctcatgcctgtaatcccatgtactccagaggctgaggcatgaggcggagattgcagtgagccaagatggcgccactgcactccagcctgggcaacagaggtagactctgtctcgaaagaaaagaaaggaaggaaggaatgaaggaaggaaggaaggaaggaacaaacgaaggaaaagaatataagactatgaataagagagaatgaccaccaaacatcaaacacttcaaacactttagcctaacattcgggacttcccacattctatagcaatctacctttctagcctcttggataattgcattatctacacatacagatttatccattatttaccaaacatgttacattttctgaatcatgtatttctcttgcctgggatcctttttttcactaccttcattgtccaggtcaatctccaaatcttcttggaagatgacaaaccaattacttaacaacaaagcaggtactatctgatgacacagccttcatagttgtcttactgtgcaacttttcaggtatttatgagctttatatatttcaccttaccctaatgatagaaataacacaaattcacttctaatggtgaacgacttgcgttaattttattccaaaacagagtaattccacctgtatttgaaaggttcttggactccaatatcccctctgtgttgacccattttccaagaggcagccccctcaaaaacaaaaataaaaactggtcctttttcttaatcattgagaattagctaacaactataaggtaactaatgttctttttgtaatttcatacaacaaaaagaacataaggaaatgaagtcattcccaaactctcaagagcaacacattccctgtgtgaagttatgtatgaaagaatcaggtaccattctgtctgccagatacaaagcttttaaagaactctcttatagctaccttctaaattatgcattaaaaaatctgactcacaaatagcagtttttcatggattcttgtagaacagttataagggtcttaaaaatgcatttcccaaatcacattttcctttgaaaacttagaacagggaaaagatgaatgagttaattagatataaaattaccctatgtgaactgaactaaactatattaaataatggatcaaaatgttcaaaggcaagaacataagaagtttaacctcatacataaaaaccgtgggacttctataacctagagaatatgcatatatattaagtatatatatacacatatatgtatatacataagtatatatatacgctaagtatatatatacacacatgtacatgtgtgtatacatgtacatatatacacacatatgtacatatatacacatatgtacatgtgtgtatacatgtacatatatacacacatgtacatgtgtgtgtatacatgtacatgtatacacacatatgtacatgtgtgtgtatatatgtacatatacacacatgtatatgtgtgtatatatgtatatatacacacacatatgtatatatgtgtatatatgtatatatatttagcgtatatatatataagtatatatatacttatatatatataagtatatatatatacttatatatatacttagagaatatatatgcatattctctaggctatagagattatatatatatatacacacacactaagatacatatatctctactctaagatacatatatctctaagatatatatatatatatatatatatcttgggattttgctcttagttagatccactggaaaaaaactgcggtaataaagaacaagttcactgtgcttactgtgaatatcactgccccctgctatatatatgagatatatataaacatgaagatatatatatgtatatatataaaacaacagcaataatgtggcaaatttttgcatgtaatgaaatattctttagtatttcatttggtattaacatttcatcttctggaaaaaaggaatgagctattattttaaaataattatttactaactatacttatctcaataaaatagttgaatctgtattcacattaatagtgaataatgctgagattaaaggagtttatcattaagtaaagtaacaaagacactatcacttttccaaaactttcccagagcagatttgaactcgagtttcaacataataagagttcaatttatacagcacttgcataccaaaaactgtcctaaatttttataaacattatctcatttgaacctcagagccatgtctcgtcctcatctttcattctttcatttactatatgtaagtgcccaacaataggaaacacaagtaacattactgtacatatggtacaacagtacaagcattaatatttatttgatgtttaagttgttaaaatgccgtcaaagaggcatatgtaaacatcaatgcaaagtacaatatgacaggcttttgggttataatggggaaactgtaagctcttcatacattttttctctcccccagtataacaaaagtgaacagacacaggggcaggaaggctttctgaaggaggtggaatttttcatgggtcatgaagaatggagaagtaggaattccaaatgaagagaataacgtgaggtaaaattaaaatccaagaaaatacatggtgtgaactaggaacagcgagtaattcactttatctagaacacagactataaagaatcgttacatgagaaggaacagttgaaatgcagatggggccacactgaacaccacaactgctgaaagcttaaccaaggagtataaatttcatttttttccctatattcaaagttcagtcatgatgagatcaggaaggtgcttcaatgatgtttatctaaaaacaaaagtatgtaggattagaaggagaaagtaggtaagagattactgtcatgctccctatgtgagataatgaagtctccagctatggcaattgctatgaaataagacaagagtagcagataatgtagtattatagaggaaacagcagtatggagtaattcagttggaaaggcaataaaaaaggaagggcttgtgattatgagtcagaaaggtgaatatgacattaatagaagaactaggtattggatgaaaaagaaagtgacatttaaatctactgaatttcagaagtttcatatccatcagtttaccatgggtttaagtgacacagtgcgaaacgaggaattgatctacctaaaaaaggtggatagcagggggcagtggtattcacagtaagcgcagtgaacttgttcttttttactacagtttttttttccagtggatctaactaagagcaaaatcccaatatgttctaaattctcaaactctacaaggtagtgaacctatctatatttttcaaatcctattgctcttcatatctgaccatgtatacagagagtacacaaacttttgaccattgttcatagactgagatttaagccttgttcatcatatatcagaatcatgaaaatactttgcacgtaggcaatgaagtagttttagacatttaatagtaataatagaagtctttctgccagtttgtaacaaaaagctagaagtaatcattgtcatctattacataagtaatattctgctaagataacatcagttggccctgctccatctaaggtgattagggaaaatggaagcatttaacttttttctagtttaaagcaaagataatttaagatattttgaaccaagaagatattaatcagataaaacgcattaaatatcactgatactattttgtgagtatacataaacacttttgccacagccttttcaaaatgctttaaaaaaagctttatatgaaaaatgagaagctgtgctaatcagaacaaataaacaattaaaaacaaagtctaatgctatgagcctgacatatagtgtcaaataaattttttaaaataaatgattcaatgtactgtatagaaggaatttattgaatatataatgttctttgttactggctgattttctgaagcttttcatcttaactatttccttaccttgttagttcttctctaaacccacctcaataaggtttgctctcaaccatccaaggagtctgcccttatcaaagtcaatagtgttttccaacttgacaaatccaaaggttacttcgttgtcatcttaccagacttggtaagcaggtggcatagagattagctttctcctccttgaaatggcttctcttggattccctgatgcctcactctctagttcttctcccaccccactgtttctttcctcttggtacaacctctaaatccttgtgtccacagaactctgtcctgggctccttttctccttgagctctagaccctcccaaagggttctgaagatgtcccatggtttaaaatactaatgttatctaaatgattcccaaatctgttaaaattaaaatttaaacagattaaaattccagacttctataaccaggcatcacctgcaatctcgacatggacaatcaatatttgacttcagcatacacaaaacagaacccttgatcccctctgcccaccccgccaaaataatgttgcttcacaagaagaggaaccgtcatacaccaagagcctagaaaagtgcccgagtagaacgggcactgtgttaaaacaaaaataccctaatcagagaagccacatcatactatgcttaatataaaagctccagcaggtaaacactgacaatccctagatcctgccagaaattccgacacttttatcttgtccctttagagagtaggtagttcagtgttttgacccaggccatagttctcaagtgtgggagcacagtggaattccaaaggacaatacagagtgcagacccaagaggatgcaaaaacagtctcgtagatgaagtccagcagcctaagaacttcataggcaacacagaggtaaaaccaggcccacaagcaaaagatctacagcagaacaatgcgtagtgcttggagagattacctgaagggctaatatgtagttcctgttcattttaaacaacactggcccatgcccacagtagggtgaggctacctgcaattcattcttcagatcacagagaaggagctttccagaccctcaatttgttccagtcattcctttgcttataccccaacagtgttctctaccacaaggtaaattccaagctctttgatctagtatataaggccctaaatattcaaatcatttcctaactttttagcctcttcggctactccagcaacacacaccatacctccctaacagattccaatccatttcatgatcctcatgcctttgtaaaagctgttttctccctcatggttaattttgtgttcatcatccaaaactcagaattactgttttcttaaaacctttattaaacttcaattaaatgtccaagaaagaattgggttcccacactcccaaaccagctctatttcctggcacccaactagactgttcccagcttcccctacattagatgtgaccacaggacaaagtcctcagatgggatgtcaggccagtggtcctcaattctcactgtgcaccagcattatatgggaaaattataaaaaagaggcattgggcctgacctccacagaccatttcacttagtctgaggtgaggcccaagtattaaagctcttctattcattctaatgtgcatacaaagttggagagcactaaagaaatccatgccaactatccaatataaatgaagatgctgccacccatgtgctcctgctgtacagtatacatactcccagtaatgcactgatcaactataccattacatttcatacatctatatgatttatacatctataccatttataaaactatacaattttatacatctgtctactgaccacatattaatgccttgagggaaggaatcaaatcttgtcatttatgtattttcactgcttaacctagtaactgacatttttcttaagtattcaatgatttttttttttttttttttttttttttttgagagagtctcactttgtccagcgcaggctggagtgcagtggtgtgatctcggctcactgcaacctctgcctcttgggttcagcaattctcctgcctcagcctcccgagtagctgggattacatgcgcgtgccaccacacctggctaatttttttgtatttttagtagagacaggtttcaccatgttggccaggctggtctggaactcccgacctcaagtgatccacccacctcaggctcccaaagtgctgggattacaggtgtgagctactacgcccggccaatgaacatttttgaataaataaaagaaaaaatatatatcaaatatataattttaaatttgttagaatattttcattaaacaaccatgaaaaataaagatacagttgcttattatgcttgaaacagtacacccatataatcctttcttatttattagtagttgagaatagactttgaagtacttcagcaaaaacactttctttttagtattactaccacaaagatgtgatctctttgtaaagctgtgttctcttatttttaaaaagtggaaagttgggataactttctaatttccatggagcagaattagataaagtagaaaaatctaaaaataaatacaggaatgtctaaaggtaatctatattcattatctagggagatgctggagaaagcaaagacaaattcaacaaaacattttagcagaaaccttattttagaatattcttatgtaactcttccacatgtaagccaaaggtaagaaacaaaataatccacagccaaatggagcaacactaataaagcctataatttaatttgttaggaatatgttaaaattacactgacaatttaaaaatttttgagagcggaaacttaattctaccagagactcaaattcattttagtaaaattaaatccatccaatttacattatgatacatttatttaccaaaaatttaacacatatataaatattatggccactccaatgattaatttcagaatttcaaaaattctataacaatctaactattcttaagatcttgtttttcccttgctgcatccccaaacacaaatctgccatttaatacatttacttaaatattctcctcaaatgttttgagattttaaattatatatatatgagaaaaatatactcctccctaattttcattaccatggcatttatttttctattttgaagtcatttttgaaagtcattttgaaaggtatccaatgtaactgtcagtagaatgtgctattatttctgctgaagtagacacattactgtatgttaaatgaaacctattatcaatcacaggctactagttggaaaaaaaaaaaaaaagaagacagtggtggaagtcagtctccagtttcctttggggattcacatttctctccctgttttctttctgcacatgttgaatgaagatgtccaaaatggttaatgcctcatggctcctggacttctaggggaagacacccacggtgaccacagcaactgcctatttattgatttctttaaactcttagactcaaagcacttaatctccaaagcaaaaacttctagggaaaagaaatcataaacttgaagcctactttttaaccattcacaaatatttctgcttatcccttacaaatacccaaacagttctgtgatgttacttaacatgggtggtgtagtcttcagacatgaagaatttgagtgggaggagggataagtgaacaagatctcagttaactttgctttgacactcgggtaaatctgggtgagtcgctttcttcagttaatggaatgagattataaaagattaatgaaagctgcttttggcagaaaagagcagggtctagatagctataaaatttagttacttaatcattttaagagacaaatatagaagttaaaggaaaattataggagtagatatggtactatgtatcccactcttcagactctgttcatttaggattacatgcctctctatagtccataaggtgcttacctacctctgttaatatctcaaatacagccccatctcctgctcatactccagtagtcaacgatgtgaagttccccaaaaagccatgcatttcatgcctgcattctttgcatgtgcctgtccctctgcccagaacaccttagcatctactcattttggagaacctcttcatgatgtatccagaaccagagattaaccacaccactatagcatttacaacagcatttttttctataaaccttgcaaaaatctaggttttatctgtctctaggttcctattatttaacacaatgcctagtgaaaactctctctctctctctacatatatatatatgctctgcatgattatagataatgggttaactaattaatttgaacatactgcattaccttatgtcttatttaaaaataacttttcataaacacatttgttttaggaaaggcagttgattaactggtaccacttaagtaacagcattttcatttaaaaaagtgaaataaaattattctaagactatcaaatatacagttttaatattatataacattgtttctctaaaagaatatatatatttgaaattaactgcatttccttaaaatattccaaaattaaactttccactgacagattattcttccttcactcctgttcctttttataatatcctgattcaattaaatcacagctaacaatttcagattcttgtactgttatgccactcattttagactgtacatgttgatctttacttttttcttaatattttgttctatgaatgcgcaccactgcagatacattgttctcaaatcaaagaatccaaagtatgaaattttattagcacaatagctaatctaggtgctacttacattgtttttattcttttttatgttttcttgataacaataacaatttgtctttctattatccctaatttcatatcttaactatggtatgtgctatcttctatcttagtgttttaaaagtttccttcatgccttaatgttgataattaatatgttactggctctgactcaaagtaatgtaaatagcctttttcagaagagagtttcctgtttttccactcctgatgctaatcctgaagctctggaacaaaggatattaccaaacgatggccatcgatgtcatgtggcagccctggcaaggctcccttcccattcgtgtcctttccttcttgagttgccagagattgcctggctgctgccatcctgcacatttcaccagaacagccctcgatcctgagcttctgactcttaagcaagcaacatctttgagattttctagatttgtgctgccaaaaacaaggggccacacaagggtaaacacatacagaagtgacactgttacagttaggagaagtctcaaagcttttcctgaaacatggagaaggtggggtaaatctcacagacatacacctgagccaggttccagcagctccattggctttagatcctacctgcctccccaaggcctgctcttctatttctcttctcaggctattcctttctataaagaacaggctagtttctgtgatttctattgctttgccttatcttttctttttaacctttgttggaatataacaaaagaaaaaatatacaggcgtacatcattttattgagtttctctttattgcactttgcagatattatggtttttttacacattgaaggtctgtggcaatcctgagtcaagcaagtctataggtgctatttttccaacagcatgtgctcacttctgtgtctcattttgataattctcacaacatttcaaactctttcattgttattatatctgttaaggtgatctgtgatccgtgatctttgatgtcactattggaactgttttgaggcaccatgaactgctcccatacgagacaacaaattcattcaataaatgttatgtgtgttctgacagaccagccacttcctcatttctttccctccgctcagccctgcctattccctaaaacacactaacattgaaaataggccaattaataacccaataatggcttgtaagtgttcaagtgaaatgaagagtcgcatatctctcattttaagtcaaaagctagaaaggattaagcttagaaaggcatgtcataagaagagacgggtcaaatgctaggcctcttgcaccaaacagccaaattgaaggctatgagaaaggtaaggaaggtgtagaagaaaagtttgaagctaggagaagttggttcatgaggaaaaaggcaataagccatctccataacatggaaatgcaaggtgaagcagcaagtgctgatgtagaagctgcagtaagttatccagaagatctagctaagatcattgatgaaagtgactacactaaacaacatattttaatgtagatgaaacagctttgtgtcagaagatgccatctagggttttcatagctactgagaagaagtcaatgcctggtttcaaagctgcaaaggacaggctgactctcttgttagtggctaatgaagctggtgagtttaggttgaagctaatgctcacttactattctgaaaacatgagggatttgaagaatcatgctaaatctactttgctagtgctccataaatggaacaacaaagcctggatgacagcacatatgtttccagcatggtatactgaatattgagacttctaagaaaataaagattcctttcaaaatagtattgctcattgacaatgcacttagtaacccaagggttctgatagagatgtacaagaagattcacattgatttcatgcctgctaacataagatccattctgcagctcattaaccaagaaggaattttgactttcgagtcttattatttaagaaatacagtttgtaaagctatagctaccacagatagtgatggattagagcaaagtaaatggaaaactttctggaaaggatcaccattctagatgccattaacacacttgtgattcaagggaggaagttaaaatgtcaacatgaacaggcatttggaagaagttgattccaatcctcacagacgactttgagggattcaagacttcagtaaaggaagtaactggagatgttctagaaatagcaaaagaattagaaacagaagtggagcctaaagatgtgactaaattgctgaagtctcatgataaaacttgaatggatgaggtattgcttcttatggacgaacaaagaaagttgtgtcttgaagtgaaatctaatcctagtgaagatgctgtgaacactgttgaaatgataaaggatttagaatatttatataaacgtagctgataaagcagtggcagggtatgagaggactaattccaattttgaaaaatgttcttctgtgggtaaaatactatcaaacagtatcacatactattcagaaatcttttgtgaaaagaagagtgaatcgctatgcaaatttcattgttgtcttatttaaagaaactaatatagccaacctagtcattaagcagccatccacatcaaggcgagaccctctaccagcaaaaagattatgacttgctgaaggctcaaatgcttggtagcattttttaaaacaagaaagtatttttaaattaagatacataggttattttttaaacataattctattatacccctaatagaccacagtacagtaaaacataaattttatatgcagtgtgaaataaaaaaaaattgtgtgacctgctttattgcaatattcactttgtggcagtggtctggaactggacccacaatatctccaaggtatgcttgcatagcattcaggaaaaaaaaagtgtcttggttgctttctaaacaatttattttcataatttctgtaaaataattattattatatgtccttatttacaggggtactctttataatttctttttgttttaaaatcaatcaaaaataatcctcaagcttttctttcaaatctcagaactgaaagaaactatagttttagttcagacatataaagagcttggaagtcatcactcccatcctcagaataaaaagttgggcaagctgcaaatcattgacttttcttggacttctcagagaactgagtgtgcaggggaaaccactaaccaaaatctagaaagatgggcaaatccagaaagacacagcacttggagcagaagctgctgtatgccatgagtggtaggaatatttacttgtctagtaattttgaaaaattactataagctgggtgcagagagtaagaaattcctggagccacaatcataaagaggctcccaaactttgctggactttcctttcagttaccccacaaagttctaatagtgaggatccaaaaaagatccctgtatggccatggcagaaaaaagggggagaaagccattgttcaatctcccagatccttctctctagcaaaagcagaaaggttttgcctgagggaaacactgaaaacttatcccaggtggaagaagagaataccaccccactccagccctcttgactcacgtactgaaaagcaaaaacaaaaaacagagagaacaggagacaggacttcaaaaaaagagactgggaagctgcatccagggaagagaatgaagaatatggtagtaggagggagcaatcctcctagaccagggacagaaacacttatgaaggttacaggtccactaaaagactgagatttaatcagattagaggacactccatctctccaacactttaccacaataccaacacagctctaggatgacaagagtggattggtgacagctaaaagagctgcaggatgtagactttccctggggcagagtccttagggaagcccagtcaaaaggggagacaaaaacaaggatactggaggaagctgaagtttctcttttgctgtgcagaagatctttagtttaattagatcccatttgtcaattttggcttttgacgccattgcttctggtgttttagacatgaagtccttgcccatgcctatgtcctgaatggtattgcctaggttttcttctagggtttttatggttttaggtctaacacttaagtctttaatccatctggaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtttatgtgtggtattatttctgaggactctgctctgttccataggtctatatctctgttttggtaccagtaccatgctgttttggttactgtagccttgtagtatagtttgaaatcaggtagcgtgatgcctccagctttgttcttttggcttaggattgtcttggcaatgcaggctcttttttggttccatatgaactttaaagtagtgctttccgattctgtgaagaaagtcattggtagcttgatggggatggcattgaatctataaattaccttgggcattatggccattttcacgatattgattcttctatccatgagcatggaatgttcttccatttgtttgtgtcctctttttatttcgttgagcagtggtttgtagttctccttgaagaggtccttcacatcccttgtaagttggattcctaggtattttgttctctttgaagcaattgtgaataggagttcatttgtgatttggctctctgtttgtctgttattggtgtataagaatgcttgtgatttttgcacattgattttgtatcctgagattttgctgaaattgtttatcagcttaaggagatttggggctgagatgatggggttttctaaatatacaatcatgtcatctgcaaacagggacaatttgacttcctcttttcctaattgaataccctttctttctttctcctgcctgattgccctggccagaacttccaacactatgttgaataggagtggtgagagagggcatccctgtcttgtgccagttttcaaagggaatgcttacactttttgcccattacagaagctgccatcagagtgaacaggcaacctacagaatgggagaaaatttttgcaatctactcatctgataaagggctaatatccagaatctacaaagaactcaaacaaatttacaagaaaaaaacaaacaaccccatcaaaaagtgggcaaaggatatgaacagacacttctcaaaagaagacatttatgcagccaacagacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtgaaagacagtgtggcaattcctcaaggatctagaactagaaataccattcgaccagccatcccattactgggtatatacccaaaggattagaaatcatgctgctataaagatacaggcacagtatgtttattgaggcactattcacaatagcaaagacttggaaccaacccaaatgtcaatgatagactggattaagaaaatgtggcacatatacaccatggaaatactatgcagccgtaaaaaaggatgagttaatgtcctttgtagggacatggatgaagctggaaaccatcattctcagcaaactatcgcaaggacagaaaaccaaacaccacatgttctcactcataggtgggaattgaacaatgagaacacgtggacacaggaaggggaacgaaacacactgggccctttgtggtgtggacgagtggggaggggatagcattaggagatatacctaatgtaaatgatgagttaatgggtgcagcacaccaacatggcacatgtatacatatgtaactaacctgcacgttgtgcacatgtaccctagaacttaaagtataataaaaaaattaaaaataaggagatttaataatatgtaaaaaaaaaagtttctcgtacttatggctacaagaaacactaaacattaagcacagctcaactcctactcagattaacataaatatttatatgaaagccttagttacctcagttctcagttctcattacctaatatatctggcttacaacaaaaaattatgaagcatgtcaaaagcacaaaaccaaaagaaacacaatctggagagataaagcaagcatctgaactagattcagatacgagacagatgttagaattatcaaacaaggaatttagattactattattaataggctaagggccctaatgtaaaaagttgaaaacatgcaaaaacaatgcataataaaagcaggagacggaaactaccaaaaaatcaaaaggaaatgctagacataaaaaaaaaaaaaaaacaccgtggaaaaaaatgaagaatgcctttgataggctcattagtggatttgacattgctgaggaaagaatcagtgagcttgaagacatgtcaataaaaacttcccaaactgaaatacaaagagaaaaagagttgaacaaacagaacggacatcccaggactgtgggataacatgggtaacagaaacatgggtgacataaacatatctagaataccagaaaaagaataaagaggggataggacagaaggaatatttgaagtaataacagcagtgaactttccaaaattaataatagacactgacccacagatacaggaagctcagaaaaacaccaagcaaaagaaatacacacaagcacacacacccctagacacagcatattcgaattgcagaaaaatgaaagaaggaaaaactcttgaaggaagccataagggggaaaataacaccttacctctaaagagtaaaggataagaactacattaaactcatcagaaatcatgcaaacaaaaagacagtgtggtgaaattttcagagcgctgaaagagaaaaaaaaatctaacagataattctatatccagtgaaattatactttaaatgcaaagaagaaacaaggactttctcaaacaaaaactgagagactgcatcaccactagtcttggcctacaagacatgataaaagttcttcagagataaggaaaataatatcagtaagaaatttgaatctacataaagaaatgaaagagcatcagaggaggaataaatgaaggtaaaatacatataatcttttatttttcttatttttaattgagctaaaagataactgttcaaagcaataatagaaagaatatattgggggttatagcatattataaatgaagtgaatgacagcaatgccacaagggatgcgaggaaggaattggatatactctattatggagtagctgcagtacacatgaagccttatagtatagtgttatctgatggtaggcttagattatttaaaaatatgtattttaaactctaggagaatcaccaaaattttgtttcgttttttaaaaaaatgtataagcagtacaccaaaagacacaaaatggaattcatataaagtgttcaatcaaaattacagaaggcacaaaaactaggggagggcaaagaacaaatgcatcaagtggtaaaagctacaaagattttaaaatttaatccaactacattagtaatcaccttaaatatgaatggcctaaacatacccattaaaagaccaagatgatcagtctggatttaaaaaaaaaaaaagaaaacttgggccaagcgctgtggctcacacctgtaatcccagcactttgggaggccgaggcgggcggatcatgaggtcaggagatcgagaccatccctgccaacatggtgaaaccccatctctactaaaaatacaaaaattagccaggcatggtggtgtggtgcctgtaatcccagctacttgggaggctgaggcagaagaatcacctgaacccgggaggtggaggttgcagtaagttgagatcacaccactgccctccagcctggacaacagaggaagacttcgtctcggaaaaaaaagaaaaacttcaagacccaattgcacactgtctacaaaacatccactttaaaaataaagacttatgttaaaagtaaacagatggagaaagagataccatgttaaccttaataaaaagaaagctggagtggctgtattagcttaagacaatgtagatttcagaaaaaggaaaataatcagggataaaaaggaatactacatcacgataaaggagtcaattctacaataaaacataacaatcctactacaaatatatgtacctaatagagtatcaaaatatatgagacaaatactgatagaactgaaaggacaaataaacaaaactgctattttttattgttgttcaggccaactctgagcaaggacaaagccactgctacagttggagatctgaattgcaagtaggtttcaaatcacagaagactaaaaccagggtgcccacagtccagctgattctctagtaggcagacaacttaaacatattttaagttaataacataaactcataggaacatggaaatatattttataaccttgtaacatctagtatattctaatccatatgtaataactcatttagaggtcttataatatctttgtgttttaaaatcaataaaaaataatccataagcttttctttcaaatctcagaactgaaaggaattatagctttaactgagacatataaagagcttgaaagtcatcactcccatcctcagaataaaaagctgggcaagctgcaaataaatgacttttcttggacttatcaagtcttatcttatatagactttagccactacagaggaaaaaatatgttttttcgctcaacttggattccctaatacctacagaggttttggacttgaataaagctcaacaaatatctactgaatgtctgaatctgagttttcccactaaattatgttaatcaacatttatttgtacaagtgagctactgtttcactaaaaatacaaagttccagttgaagttatctttcaaatagaagattttggttttatagtcttcttccactattatcaaataactacctggtttaataaaacaatgaaatcaattacagtgagtacacaaattgttcacagggttaaagtgcctcagtgatttactattaactctattaatttgttgacttgaaatgatccacaaattaccaatgcaaagtaaccaatatggatataacacagaaattcagagaagatttgcaaaaagattaaaaacaaacatgtatattatagaagtgtaactcttaaggtaacacaaaaatttttaagtgtcagaattttatcaatttaagttttatattagggcatagttaaataatttataccctcaacataaacaaacaaaatgcaaatatagaaggactacattattagacaaatcattgggtctaaaaaatgaaaaatgtgaaacatgattttatacctccttccctgcttttttttttttttttttttaagacgagtcttactttgtcaccaggctggagtgcagtggcacgatctcagctcactgcaacctccgcctcccaggttcaagcaattctcctgcctcagcctcctgagtagctgggactacaggcatgcaccaccacgcccagctaatttttctatttttagtagaaaccaggtttcaccatgttgcccacgatggtctcaatctcctgacctcactatctgcccgcctcagcctcccaaagcattgggttacaggcgtgagccaccatgcctggcctttatcccatttttgtatgtataactagaataacaactgaagagaaaatataatattcactctgtcatctctttaaattacatagttcaactatcatcctcaatttatttcaatctggatgagttaaataaaaaaatttgaaatttaattacttccatacaactcagaagaccagcatcatatctttataaaatattattttgcagtgagaaatacctatttattataatttgccaagcttcttcagataggagatgattttccttttactctacatggcatggcccattaatacctaataggcacaaatctaatgtcctacagtaggacacatggggatgattacttactggataagaagtactgatattcttctccttctaccaaatacttttttcaaaacttctctcaaatatcactatgtgatctattcaaattcaattttgctcaactttccaagtaaagtgattatagcaagtaaaggacatcttcataggcttgtaaatacttcatgttcattccacgagtcagacaggggaagggaaaatatcagagaccacttacctgacatgcattataaaggagctggtgttccagttttttaatacccagaatctgctgaaacatttcatagagttgttccttgctcagaataagttcagacactgcacttagggccattctatttggctgtttgcacaagtcctcttcacctctgtaaatggcatcatatttggctatccatgagctcaacactgtctctttgctcaagccatctatttctggcaaactccgcacacgtttttctatgtttttcttaaatacttctctgaagtcattagcagaacaccctccactctgtaccattctggccactcggtcactctttagaaaaacctgaaaacaaaacaaaacaaaacaaaacaaaaaacaattacaattaggtgtagatgctaacaccacttgctttcagcaatccagccagagtttctacaaatatttcagccaaatactccacaatgattcaaaatgttttataatacatggtaactaatgtcataatgttggccccaaatctctctaaaattttaaaatgtgtaggagacacagtatacagtaaaaaataccagtaagatggtttactttgacctgtatgtctcccacctctacaacgaaatcctttagagtgatgtccttatgaatgtgattcgtgctcttatacacagactccagaactctctcatgccttccaccacatgtgttcagagtgaaaggacagctgtctgtgaatcaggaagcaggtcctcacagacaccaaattggctaacaccctgattttggacttcccaagcctccagaactgtaagaaataaatgaccattgtttataagcaaaaaaaaaaaaaaaaaaaaagatgattaggaaaacaactggagatatgaacccaacatccatacctgtgtctgagagttctagctggtttttcagcagggaaagaatcatgtattatttgagtgtggacttgaagatcaacagtagggtaagtctaatatccaagtcaatattcatcatatgtaatttttactcaaaattgcccaacagctggggggctagaatatacctgtccccatccctgattttaccacctctgcaacttctcacacacttatcataactagaaagaatggaggcttggaaagcaatacctctaagggacttctaattgtccattactactggaaaataaaataaaataaaaacaacaatagagacaaccatagagtaagatgttcatgagacaggtagcaagggttgggtaaaaataagtacagtaataaggtcatatttgggaagagacaccagagatttggccttaaatctctctgttctgctaagttatgtatctaagtatcagttaagattcattaaacttctgttatgctgtcaatattcctaagaatcctccataagccatataagactgcttttattcttgctttattctttctatgatgtcaaaagactctcccagaaaagcctgcaggacaatttaatagaacctccataaattatatgctgttattgagcttacagaacaaaaattcaagtcaacttttttttcttttttttgaaacagggtctcactctgtggcccaggctggagcccagtgacacaatcacagctcactgcagccttgacatcccaggctcaagcaatcctcccacctcagcctcccaagtagctgggacctgcaaacacacaccatcatgcctgggctagtttttgtattttttttttttttttttgtagatatggggtctcatttatatgactcaggctggtctcaaactcctaggctcaggcaatcctcctgccttggactcccaaagtgctaggattacaggcatgagccaccacacctggcctcaacttttaccctaagaactgactcattatagtgaagtactcccaagttatgatcatactacttgcaccacacttccacgcctgtctgcatgtgggcaagcagcacacctgcttgatacagtcaaagtggactcacttgaaccactggggctggcatgctcaaccacctgaccccaagccttttcccaccactttagttctccctcttaaggtcactcacacaaactgtttttcttgtttcctatctttactcaatggcaagaagattcctggagctcaaatatttcggctgacagacttccgtactgaaacactggtagtaaattctgcattgtcaaataagatgctcctcaaactacaatgaggttatgtcctaataagcctgtcataagttaaaaatatcatgtcaaaaatgcatttaatacacctaacttacctgaaacatgctcaaaacacttacattagcctgcagttgggcaaaatcatctaatgcaaagcttactttatgataaagtgttgaacatctcatgtaatttgtcaaatattatactgagtatgaaaagcaggacggctgtataggcagtcaaaatatggtttccactgagttatatcacttttgtaccattgtaaagttgaaaaatcataagcagaactgtcatgagtcagggatcctctgcatgtgtaacacattcccaaaatgcttcctctctctttaccagctctggctcaattacttactattggaaagtctccctgtcttattttttatgtttttaaggcaacacaaattaattcttaagtgacaggtatatgcatagtgctttaaatattcatgtatcaaagacaatgaaattgagatgtttaacaatatgttttgtctaagaatgacaagagctacttcagaactcagatgtgtctctacctcccttctcaacctcatctaatcactcattgagcagtgacatttaacatacataaattgtatatttataacctgcataagtatttatatgcaatttaaaattatattcacaaatattagaagtatttacacatatgaccttatatattacattatatacacacaattttggtctatctgtaccctaatttctgcaaaagttgtatctcaaggtggaactcagggaagctcagtagttaaaaggatggactctgccagctgtcagtctgttgcttttcagctccatttccacctttccattgccctacctgtgtctgctaacactttttttttttttttgagatggagtcttgctctgtcacccaggctggagtgcaatggcaccatgtcggttcactgcaaactccacttcccaggttcaggcaattctgctgcctcagcctcctgagtagctgggactactggcacgtgccaccatggccggctaatttttatatttttagtagagacagggtttcaccatgttggccaggctggtctcaaactcctgacctcatgattcacccacctcagcctcccaaagtgctgggattacaggtatgagtcaccacgcccagccagctaacacaattttaagcaacatcggtagaggctgccggaggacgtacactggaagaaaaagggctcttcttcctggttctcttcttacctgaaggcatgtggcagcaacccgtgggcagcttttctccagacccctgagaatggtctcccaatgtaccattcccactggcagattcccagtgagttctgcagtgtggcaccccactgtggacagcttccccctagaaccccagaaggccaatcccctgcaagtctccctgcaacacttcggtgaactactctgccatgcagtaagacacacctactccagtgaggtctggatcccagccctgggggagggggtgcctctttgggtactctgctccttatttctgctactcctatattctttagagttttctttacccatactaaccaatttgttattgtttatattaagcgttccctgttcaattattgtgtgttctctgtcttcacagtgcactctaactgatacaaaaatactgaagagctgcaagattgtccctataggaaaatattctaagtcaaaacaaccacctttgagaaatttagtaatgtatgtatagtttgaccagcaagatataagtgaagtatgaatatcttaggagggacatcagaaaaccctttaattgcttaatttctaatatgctaagttggcagacattttgtattttccaagttcttctgcctaacagagtcagagctagattccaccaagtaaccaaatcacatttttgaaacaaggacaccaagaaacttacatttttgaactcatttcccctacaaaaccatacctgaagccatactcaatccaattagatgtaatgtaatcaacatttagtgtcaacaacatttcagggattctgctaagtgttgggggcacaatgagaaatgaaccaaagaccttgccctcaatcagtcacagcacctgagagagacaggatacacatgcaaatataatagggcgacagcagcaatggaaacccacacagagggagaaaaggcaaaagaaaagaagttattaactctgctggggggccagagtaagagaggagaggagcacagggcagagacaagggacccatgttttgaataacccatgagctgtgtgagaaggaaagagagaaaaaaaaggatacttcaagaaaaagaaaataaaagaacaacagcaataaagcacaaaagaataacactgcaaggccatttgagggaaatacaaggactttcatactagcagggacattcactataagagtgggggccacgtggggggagggaggactctgggctgtatctggtgatgcagaggtcaagggtagctgggtagccaaggtgctaaaatggttagaagcatacgttaggtaattggtggcagcaccaagggtagacaacaagtgaccagagcagacactgggacatcagttatcacatgaacacaacagacctggtggaaaacaataagggctaggactaggctagagagaaaagtggagttaaagaggatttgggaaatagaatgaatgtgtcttggtaatttacaaaatgtggaaatataagagagggaaaattggaaaattccatttttttttactggggtgtctagattccactaaccaaaaataaagaatataggtggaagcccatgtgtgtgcatttgtatatggtggtgaatgttgggagagtcatggaaaatccatttagtttcggtacaggtcaggtttggagacaaagtatggttaaaaaaaaaaaaaaaacaaaaacaaactgaaagagtcaagacaaaatcttctgaaatgcctacattttaaaatttggcaaaataactggatccacggcaggttggtggtgtcagagtagactgctagtaaaaaatatggatttactagcagtcaagagaggagacggtttcagaataagagagacagagacagtctcagtcaagataagagagatagagacagtcccactggccttttaaaaacctccctttgtccatctcatcatgagagagagacagagagagaaatagagaattatcaagtaccataagagaaatcaggtcaaatgaagagagatttgctggtttttatcatcaccaggtcacttttgacagacaagatttactggagtggtgaagaggagaagctctcatctcctgagaggaagccctgtcttccccaccaccactttattcatctgccttactctttcattttgctctgttttttgtttccgcatataacatcatctgacatgcatttattgtccattcctccatcaaaacagaaggtaagcacctcagcagccactttgttttgtttgctaataaatccagtacctaacacagagcctgtcctttagtgagagcttaataaaaatttgttggccaggagcagtagctcacgcctgtaatcccagcactttgggaggccaaggtaagcagatggcttgagctcacaagtttgagaccagcctgggaaacatggcgaaaccctgctctaccaaaaatacaaaaaattagccgggtgtagtggcacatgcctgtgctcctagctacacagtagactgaggtgggaagatcgctcaatcccaaaagctggaggttgtagtgagccatgatcacaccactgcactccaaactgagtgacagagtgagatcctgtctaaagaaaaaatatatatatatatatattttttttttttgagaaaaagtaattactacccccacacactgaaatctccagagataaacaggaggattatacaggcatctagctcacaggtgtcctatgatgctgataactgtgggaaaagaaccaggggatggataaatatccagtaactggaagtctaggaagtgatgtattgaaaggcatgagctccagaaggaaatgggctttcacatgagggaggaagagtaacgatctgaaagcaggaatgaagacccgttctcttggccctacgtgtagaggacaacgaaaggcccacaatcataaggcggctacatttcccctgtcctcagcctgctgattaggtgtggagccttccacatcacacatactctgaaggccatcacgaagcctgaaccatcaacctttaatcacttaagctccacatttagatctccaatattacctcacatctctccttaggtgtcccactggcactctaaataagtctcagaattcatgacttttccaatatttgttctgcctcctgcttgcctatctcagtgagtgacagatcccagtttccatcctcgagaggcctggaaatcattcctgactcctcacatcctccacgttatattccccaacatacaacttgtccctgaaccctgctgattctatcctctcaggcccttcttcacctctctatctcccatgacggttctccctccctctccctggggctcaagggatgacagcaaacagccttgcaactgcttcagaggtttatctggcagccaccctattcccactaccattttttctgaacttattgtcaattggcatatatatatataaacactgatcatttaaatccttctccagcttaaaatttttcattggtcttccaccaaaatcgtcaccatggcctctgaggtcccacttcaaaaatgtctcaaagaagactgggcacagtggctcatgctggtatcctagcactttgggaggccaaagtgggaggatcacttgagctcaggagttggagaccagcctgggcaaaaccctgtctctacaataaaatttaaaaattagccaggggtggtgacacatgcctgtagtcccagccactcgggaggccaaggcaggtggatcacttgagcccaggagttcttttttttttttgagatggagtctcactctgtcacccaggcgggagtccagtggcaacatctcagctcactgcaacctctgcctcccgggctgaagcaattctctcacctcagcctctggagtatctgggagtacaggcacaagccaccacgcctggctaattttttttgtatttttagtagagacgaggtttcaccatgttgatcaggctggtctcgaactcctgacctcaagtgatccacctgcctcagcctcccaaagtgctgggattacaggtgtgagccatggtgcccagccatgagcccaggaattctaagctgcagtgagctatgatctcgctactgcacagcagtgaaaccctgtttcaaaaaaaaaaaaaaaaagtcccaaacttcttctctggcctcatcacaagttattcttccttgctggatctccgtgctccagtcccacaggccttttaaaaacctcccattgtctacctcaccatcccctaattatctcagtcaccattcagatctccacccagctgatccctactcaggaatttcttccccagttacccaggcttggctagatcctgtatcgtacgctgttacaggaccttttcttttttctttaaaatactgatcacactgttaccgtaatatttaagtaaaaaatttaattcttatctcttttcctcactggacagtaagttccatgaagtcaaagactgtttcattcaccattctatctgtagcacctagcactaggctacgtacatagacagcaagcacccagaaaatatccactggatgagtgaatgagtggtttggatggttaaaccaatgatttaattcccccatccatgcacatgtataatttaaataattaatgaatcaggaagagggaacaatactgcagaggaagaaatcacaaagaataacatcacagaggaaaggctggactgtggtggctcatgcctgaaatcgcagcactttgggaggccaagcctaggagttaagaggctgcagtgaaccatgcactccagcctgggtgacagagtaagaccatcgcttaaaaaaaaaactactactactactaaaaataatgttgcagaggaaagagggaaagaatgagcctcgtcttgtgagaagcagctgatcaactgcccggagagcagggctcacagtacagtgagaaagaatccctggataagcaaagaaggataggtacggagatgtaatttgatacaggaggcaatggaaaacacgaaagaaggaagtgacatgttgaaagattattttggagagtatttagcagaggagtagtgagtaggaaggcagaggtgtgagcaaaactagggcagactttaaagctgtgaaacccatccatacacttgcataatttaaataattaatgaaccagtaaggtttactgattcctattatatgctcatatacgaaaggagtataaaacatggaccttgtccatatgaaaaggggaggaaaggatatcacagggaaggaagcataatgagtaatgtcccaaaggacagagtgagattagttttgtgagtaaaataaattatactgtctaataaatatctaatacttcctataatctgtgttcttacagaaataataatagagtttaagacaatctttcaggcttatcagttatgaaactaacaatgatgggtttactctcactaaatataaaatacctgaatcctacatcctttcataacaacagttatcaagttaaagtcaggtaaagtgtggttacatgtggaaactggttccagagctggtctccaggcgtcggtggtcaccctccaactttctgctgtgggacccaggattctcagtgaaattctgcctggagtaccagcagggcaccatgctggtgtcgaagctgtcatgggaattccttacattgacaaactcaccaagtagcagatatcctgtctccctagagctcttcctgtattaactcctttaatccttacagtcacctagtaccctctccaatatcatcgtcttttaaaggttaagtggtttaagcagaggagataagtaactggcttgaggtcacacacctcctgggagaatagagacagaatactgggccttggaatctaaaaacactactcctttactccttttctctcccattcctccaccccagcctgggtgcacctttggcagccagatgtcctgctggttgctggccaacacctgtggaattatcgaccagtgactttcttgtgaaaatgccactgggcacacaacttattcagtgtggcgtttagtaacctcacgtcggaaaactatgacataccactgtgtccggaattggtgggttctttgtcttgctgacttcaataatgaagccacggaccctcgcggtgagtgttacagttcttaaagatggtgtgtccagagtttgttccttcagatgttcagatgtgtccggagtttcttccttctggtgggttcgtggtctcactgacttcaggagtgaagctgcagaccttcgcagtgttacagctctacaaggcatcgcctctggaattgttcattccttctggtgggttcgtggtcttgctggcttccggcttcaggagtgaagttgcagaccttcgctgtgagtgttacagctcttaaaggcggtgcggacccaaagagtgaacagcagcaagattcattgcaaagagcgaaagaacaaagcttccacagcggggaatgggaccccagccggttgccgcagctggctctggcagcctgcttttattcctttatctggccccatccacatcctgcagattggtccattttacagagaactgattggtccgttttgacagggtgctcattggtgcatttacaatccctgagctagacacagagtgctgattggtacatttacaatcctctagctggacataaaagttctccaagtccccactagattagctagatacagagtgctgaatggtgtgtttacaatcctttagttagacacaaaaggtctccaagccagattagctagacacagagtgctgatgggtgcatttacaatcctccagctagacataaaagttctccaagtccccaccagattagctaaatacagagtgctgattggtgcagccatgaatcccgagctagacacagattgctgattgttgcatatacaatcctccagctagacataaaagttctccaagtccccactggactcaggggcccaactggcttcgcctagtggatcccacaccagggctgcaggcagagctgcccaccagtcccgcaccgtgcactggcactcctcaaacctagggcggcagatgggaccgggtgccgtggagcaggaggtggtgcctgttggggaggcttgggccactgggagcccacggcggggggtgggggtgggggttggttggggagctagggcatggcgggctgcaggtccccaaccctgagcggggaggcggctgaggcccagtgagaactccagcgcggctcgggcgggctggcagtactgggggatccggcacaccctccacagctgctggcccaggtgctaaaccccttacttcccggggccagcggtgctggctggccgctccaagtgtggggcccactgagcccatgcccacccggaactcacgctgtcctgcaagcgccccgcacagccccgggtccccgcccgcacctctcccttcacacctccctgcaagcagagggagccagctccggcctcagccagcccagagagtggctcccacagcgcagcggtgggctgaagggctccttgagcatggccagagtggacatcgaggctgaggaggcaccaagagcgagcaagggctgctagcactttgtcacctttcactatgtatgtcacatttgtccacatttcagtaaattttaacttacatacagccttcaatctgagcaccaccaactgccactcttcccattaatctactcagcttatataccaaagaagtcactgaatatcttaacaaagtcgcggtgaactaataacaaaagtgaaatgtgattactataacaagaaactatatctgccaaaagtaagtctgctcagctgtctaaacaaggcttcaaacatacttttccacagaagcccttattgttcacacattgctgttgatttgaaccatgcattacttctttgatttaaaaggattttataatgacgagaaaaacattatctgcttgccaaatcattgtggctatgagatggttccaggaaggctgccagcatgtgttcagcaaaacgctgagaaaagtacaagagtctcacttataagacatgcctttttctcctgaataatgccaaataaaatattgtctcataatttccataacctatgctgtccttggagaaacagcaacatagattttaaaactacttttcaggtgttatcaattcatgaagctttgtaactgtggtgaagtttagtctcactagaaatcaaataattttggttttccagtatgtaaataccagtattttttttacgtggaaacattttacttcctgattcatacgtgttgtaatccaaacttaaaagagatacactttaaaaaggaaaatctgaacctcaagtgtgctgaagctctaagacatgaactgttttactggatggaaacacactaaggcagcatttgtccatctgtgggacctgtctgtgactcacacaaaacggagtcctctgtggtgacaccagacacagaaatgcaaaggagcccggggctccattctgactatgctgtccaagaagacacactttggctccctgttaacgccctagatgtggagaaagaacaatggtcacgtaccggaaaaggccagtgtgcctcctctgatttcaagtgaaaactctaaagtgatgttctctcctttcatttccagttattttttggaaaagtcatccaccaaggtgagttaaatgataacgtgtactaaattttttaaaaattatccagtctatcactgatgggcattcgggttggttccaagtctttgctattataaataatgctgcaataaacatatgtgtgcatatgtctgaataaagaaaatgtggcacatatacaccatggaataccacgcagccataaaaaaagaatgagttcatgtcctctgcaggaatgtggacgaagctggaagccatcattccaagcaaaccaacacaggaccagaaaaccaaacaccatacattctcactcataagtgggagctaaacaatgagaacacatgcacgcagggaggggaacaacatacaccagggcctgttgggggcgctgggggttaaaggaggggagaggattaggacaaacacccaatgcacacagggcttaaaatttagactatgggttgataggtgcagcaaaccaccacggcacatgcacgcccatgcaacaaacctgcacgttctgtacatgcatcccagaacccaaagtaaaaaaaacaacaacaaaaaaagaaattataacctcttgaacctcaaaataaaataaaataaagacctacttgtgcatcttttgccaaaggaaacaaacttaaggtaagggggtggggaggagagcagtaaaccctgggaaaagccaacatgatccgaaacttggactgtctaaattattaaaatattctttaaaaaatgaataggttcctgactgattagtctgtttacgagaaacacctacaatacattagagtagacaataaaataactaagggggagtatctcaattacttgttagggtccttcataaaattttattaatggcaccttaaatgtaaacactacagagaaactgccagaagaatgaagacttagcagaaaatacatgtcttttgccacaagtaatgagaaaacaagagccaaatgtttgtctttaaagttggtttgcttacccttcaactttgacattcatttgaaaaatgaggacattttatataccaggctgtatctcgactgctcactacattgcaatacaataagcttatgttcaagcagcagttggagaaggatgctgttagccccaattaaatatccacttcacacagcatgactacagagagatcctgcttcccatgatgactgatcagctcaagtaccatctggagagacaggagaacctggaggcctgctgtcagctgctcagccacatcctggaggtgctgtacaggaaggacatggggccaactcagaggcagatccagattatcatggagaaacttctccagactgtgaaccaaaccatcatttccatgggacaagattccgaactcactgtaagtgcttggtgacagtattttttttttccaggtcactttgtgtgcccaaagccagtcaatggattctttgttggcactgttttgtgccaggctttttatccatccaagtctccctcaacctaccttctagccttctcttccatttctttcaagaacatattttctgttccagtaaaaggacacacttgtgtagccctccacactctgcgtacattcccacccccatagcttaaccatttgttcaataaatgtttaccaagacaaaccaaaatgccaggcaatatgatcaggtgtcataagcaagggtttgcttccttcctagagcttacagtggggcaaacaaatggttatacaaaccaatatgcctgtggcttgataaatactagtgagaatttctggtgctataagtttgtaacaaagtttgaatctagctgaggaggtcatggtggcttccctgaggaggtgagcagagatctgaagacaaagaatttgcaaatcaaaaggaaccaaggggccaggagacagtgggtagagggaacacagcctatctaagggggccttaaggcagctccctgggctgcagtgaagggcctgagagtacagtggaatgggaggtgcctgaggaggacgggtgggctttgtcaggcctggaaagtgctctggtctttatcccaggagcatggaatgccatcaatatttaaggcagagagtcacatgataaaaactgtattttgcaaatagctaaaatttattttagggacttcatgtatattaaccctcacaactgcataaagaaggtgctagtatttatcttaaaggtaaacaacaacaacaacaacaataaaaacccaaaaagcatacagaagtaaagagacatggccaagatcacacagccagagtgtggaagagtcaagatttaagcccagtctcactctagagctccctttttcaccaccatgcaatcaagttcagcaatttatcaatttgtggctcattcggctgagctggaagggccaatgagtaaatggattggtaaggattaggcaggagaatgctcctgttcacctgtttgtcaagcattccgcagcttgatggtatttctctattctaagccatcttaatactttcccatgctctgtgtaggtataaaacactgctgtcctgtcttataccacatcattgtatgtctctcttgttaagactgcaaactgcatctttgaaatctctgtagtgtctagtatcattagacactcaaattttaaaggaaatcattaggtccttgtggtaatggactttggaaagttattgaatctaaaggctgctgtgctgaccagtgtgggatgaagttttcatgaattcaaagtgaaaaaagaaaatacaaggacttcaaagtccattttaataaagctgattttaatattctaatagttgaaactgtaggtacaagaagtcactttttgtaatacaatgttattaactgtaaatgtgtggttttgttgctgtattcatccaatggattcttcccacacagctgcacagacaaaaccaactcactgagactgtgctataacaatagagaaggaattttattaatgcaaggctggccacacagaagatgggagttattactcaaattaatctctcaaaggcttggagtttacgttttttgtaaggataatttggtgggcaagggtttaggaaatggggaatgttgactgcttagaggtgaaatcacaggtgtgtgggaaatggtcctcctgcacttagcctctgagtaggggccataggatgggttgcaccactactgtgggtctgggtggatttagttggtggtcaaaaatgcaaaaatgtgaaagatacctcaaaaggccgatcttaggttctacatagtgatgttatctataggagcaattcagggaagtcacaaatcttgtgacctctggccataggactactgaacagtaaggggttacagaaattatgcctacattttagcagaatgttgcaggaagtcagggacctcgaatggagggaccagctgaaaccatggcagaacataaattgtgaagatttcatggacatttaacacttccccaatcaatactcttataatttcctatgcctgtcttttatctcttaatcccgtcatcttcgtaagttgaggatgtatgttgcccaggaccctgtaatgactgcgttaactgcacaaattgttcgtaaagcatgtgcgtttgaacaatatgaaatctgggcaccttaagaacagggtaacagtgattttcagggaacaagggagataaccttaaagtctggctgcctgtgggccgggcaggacagagccatatttctcttattaccgaaaacaggtaagataaatatcactgaattctttccccagtaaggaatattaataattaacagccctgggaaaagaatgcattcctggggggggggggctctaaaatggccaccctgggagtgtctgcctcatgcacatgtagataggaatgaaacatgccctactctcctgcagcacccccaggcttgctaggattaggaaattccagcctggcgaattctagtcagaccggttctctgctcttgaatcctgttaagatgtttatcaatgacaatgtgtgcacagcaggacgtggacgttcattagtgattctagtttcaccctgaccttgtgatctcgccctaaccttgtgatctcaccctgaccttctgccttgtgatcttttgttgcccttaaagcatgtgatctctgtgacccacaccctattcgtatactccctcccctttgaaaattgctggtaaaaacttgctggttttacggctcagggggcatcacggaacctgccgacatattatgtctcccctggacatccagctttaaaatttctctcttttgtactctttccctttatttctcagaccggccaacactgagggaacatagcaaaggacccacattgaaatatcgggggctgaatttcccccaatagcagaactcaggcccctctcacaatcctaatcttgtggcctttcattagttttacaaagatggtttttagtccctgagaaagaaggggtttagttttagagagggactattatcatctttgcttccaagttaaactataaactaaatctttgccatgattagcttgacctatgtacaggaatgaacaaagacagccagcctatgaggctagaagcaagatagagtcagctatgttagatttctctgtcataatctttgcaaaggcagttttattgttgttgcaatggttaattacctttcttggcacacaaaaaaagtacaatatctgacctctgtttttatttactaatccatgaattccaaagatttgaaaaacactcgtttaaacaatcccatttctttacctatcaaatgtgaagaatcacagcttaaaactaatagcaaataatctgttttatctaaaaaataaattttgttaagaaatacctctagacccttatctataaactaggagacacttgctttcaaaagatccttccaacttttctaaatcccttatgattaatctaaacccctcatatcaaatctaaagcccttagaccaggccaggcatggtggctcatacctgtaatcccagcactttgggagaccaaggtgggtggatcacctgaggtcaggagttcgagaccagcctggccaacatggcaaaagcctgtctctattaaaaatacaaaaattagccaggtgtggtggtgcacgcctgtaatcccagctactcaggaagctgaggcatgagaatcacttgagtctgagaggtggaggttgcagtgggtcgggataatgccactgcactccagcctgggcaacagagtgagactgtctcaaaaagaaaaacaataaaacatctaaaaaactagaaataccatttgacccagccatcccattactgggtatatacccaaaggactataaatcatgcttctataaagacacaggcacacgtatgtttattgcggcattattcacaatagcaaagacttggaaccaacccaaatgtccaacaatgatagactggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagaccacatggacacaggaaggggaacatcacactctggggactgttgtagggtggggggagggggagggatagcattgggagatatacctaatgctagatgacaagttagtgggtgcagtgcaccagcatggcacatgtatacatatgtaatgaacctgcacaatgtgcacatgtaccctaaaacttaaagtataataataaaagaaagagctctccggtccgtgcctccaagatgacaaagaaaagaaggaacaatggtcgtgccaaaaagggccgcggccacgtgcaacctgttcgctgtactaactgtgcccgatgcgtgcccaaggacaaggccattaagaaattcgtcattcgaaacatagtggaggccgtagcagtcagggacatttctgaagcaagcgtcttcgatgcctatgtgcttcccaagctgtatgtgaagctacattactgtgtgagttgtgcaattcacagcaaagtagtcaggaatcgatctcgtgaagcccgcaaggaccgaacacccccacccagatttagacctgcgggtgctgccccacgtcccccaccaaagcccatgtaaggagctgagttcttaaagactgaagacaggttattctctggagaaaaataaaatggaaattgtaaaaaaataataataataataaaagaaagaaaaaaaacaacatctaaaaaaaaataaataaaaataaaaataaaacccttagaccaaatataaagccttgaactgtctatgccttcttacatcctgttttaagaactgagatgagtctagacccaaatgaatacaaatgggatttgaaaagcataaagcttttttttttgtttgcttgtttggaaaataatacatacacatggtattaccataatcttatcaatattatgaagtcgttctaaagcttttttcttctaatatcagctaatagcagatctttgagtctttcttcctaggtattttccaactaaatgcttagtttaaatttccctaagccaacagcaaatactccttaaccttgtacttatgagactgaaagtgaagatttaccaagcctcttgtataaacacaaagatcactgcaccctacctgggcttccaatctgtttgacactgtgcaacaaagactgagaccctaaagtggaagaaaaatcttgttgttcatcatggaaaagggagcaacggaatggcaaataagaatttctagagaaaagcttctacacgtagccacaaagtcaaagaagataccagctttccacgccatattttcagcctaagccatctcttccaccttcattcaatgtgtttcatggtgtgatagaaaagtctgaatgtttcttgggctattttccatctattctataaagaaaatgtttttcttgttttgccctcactgtaataatacagaaaataaatcttaaaaatttagtgtattacttttgaagcctcataatatatctaatgttgaataaatccttaatatatgtttactatctgaaaaaaaatatgtgttcccatgctgtcttacagctttacagtattccaacttcaattacagaattcaattcacctcatccttacttctgtgctactctccactcatcagctgggaaataatgtaacaaaactgagagggcatgaggagacccgagagttcaaggtgtgacacaagctaagagactctgaaccattctgggtcagtttcctcatcagtggaatacaggtaatctagagatgggataattcccttgaccttgatccccctcttgggtgggaactcagtggcctgtttcactcagcctgtcactggccactcctcacgagagagaacatgcaagcaagcaattgtagagactggaacaaacgattgctggaacggccagttgctcctctcttgtgggagcaggctctgtgtgggccctggagcagctcccagcccctgtcctcttggttcttgtctggcgtccaggaagaatcaggtcacatgaacagattgaagggtagtgtatgtggatgattttatttggtgatggaagtggttcttggcgggatgagagttggaaaggggatggtgcaggaagaaggtgatctttccctgaagccacgctgtctgaagttagccacatctatctgtagtttctgatgctcagttgctgcttctcagcttactcctcagccacttgtatccctgatgctcagcagcttatgtgttgctctgccagctgaagtctttttaagggcacaggatagaagtgtggcaggccaaaaaggcaacatttgggtgggaaaaccaagaaaaacagggtcagttgttttctcttacaaccaccattccaggcttaagggtgggggtttagcttggaacccagtggttctgtatcaatatcacttttaaaaatactttttgtttcgtaacaattttatatattatggggtacaacgtgatgttttgatatgtgcttacaaagtggaataactttctcaacatattttttttaatactacatgacatagtgaaataaattttaaaatcactgctacttaaaatgttatctgtggaccaatgacagtacccagactgtttcctgtccctcagcaagtacagaagggcggtcctctaataagcttgctttgatataatgttaatgaagaaaaaaaaaacaaacagattcccagttggggctgctgtctgtgtggagtttgcatgttctccccaagtctacatgggtttcctccaggtactccagtttcctcccacatcccaaagacatgtatatgaggttcactgtgtctacactgtcctggtgtgagttagtgtgggggtgtgtgtgagcgtgccctgtgatgagatggcatcctctacaaggtgcttgccttgtaccctgagctgctaggttctgaccacctgtgacccttaactaaaataagtggataattgtcttacttacttacttgtttttatttatctttattaaatgtatagagagctcacatttatttccatgctaaatattagaagtgttttggtttttgtttagaagtttggtgatatttttgtgaccagaaataggctgtaggaacttgactcttacttatatccatcagcctgtggttaaattgatatcattatatgtcgtttcacttaaaaatcacagtttctgagaatctatcaactatgttaagtgaggactgtgaggacttactgtacagagagcatagttttttagaaacttctgaactgatattacattgccatagcatccaaaagcatgattttcccccaatattttattataaaaatgtttaaacatatagaaaagtttaaagaagtttgtagtaagcatatatatatatacacacatatatatacacctactagattctacaattaacattttattctatttgttctttcacgtatcaacccaatccttcatcaattcaaattattgttatgcattttagaataagtcaaacacatgattttatattttataaaatattccacaatggatgagaaatcaataaataccagtcctttgctgctgataaaatacctcaaaaaaacctttcacttgagaagatgggtgatatgccaatgttaacaaggaagttgggaggaaagagatttctaaaagccaaaccattacatgttccacaatactaccaagacaccagagaatgagttgctaccctctcaaatcctaggtttataaaacataaatcttaaggatagcacgttatttactcttgataatccaagggcctgctgcagaggaatgaagttccaaagtaaaaatggaaaaaaaagtctggaaagtaaatcaattttaaaaacaaacattctgttaaattaaagcaaaatgaacccaaaacttaactaaatttccctggcatacagtggctctcaataaatatttgttgaatagattttatagtttataccttgtagttgtttatttttttaacagatggcaactacatgtggaatagcaatgttattgctttttaatcccagaatctgattcccaggattgtgagcgacccaaaggtataaatccaatcacccttctaaagcttgaattcactcaccatcaccaccactaaagtgacatccaaacaatatcaaactcctttaaggaagagaaactaggctctctgaaggcaataacctgtctacaggcaggaacaacatctgcaaagttgtttccaagtggcaatgctctccctgtagctgtcattttcttattgcatgctaatccctgcaaaaacaaagaaaatcaaattcttcccaagcccattcttcaagcgtttgatggcagctaacactgtcttctgtcttgcaggttaaacgttcctgacacttctcagatgacaagacccacttactatcctactggctctccttaacacaagtttcactttttctgcacaggttctagattaaggccttcattcattcttttcaggtctttgttcagctcattatcttcttggtgatgtctcttctatttaaagctgcatctctgtcttttgtagttccctattctgttttctatttttctccacagcacttataactacgtagcacatgacatttattgtattttcttcccactagcaagtaagctccatgatggcaggcattttatatggttcaccactgtatctccagggcaatcaatatttgttgaatgaatcaatgaacctgccatatgggtaagatcttacaatcaaggaggaagacagtaattcattccagttagagaagcaatgctgttaaagcagaggaagatgccacaaacctttggagggcctacatacactcccaatgccttaccctgaacttattttcacctacattattatggaagctaaactaagtatcccaccagtatttgtgaagctggttttatggacccgaacctagaaatttacatgactcccttctgaatttcacctgtggtccacttttttagtatattgatatcagatctttagtgaatataatggaattaactattctcttccagtgtggactgcccaaaactgttcatacttttcagtttttttctattcttttatttataaattgcaaattatctaaaatctattagtttactcacaactcccttgacagttgtgatagtggtagcggatagagaaaccagtactgggagaggaaaggatttctttgcacagtcatgcagaagtcagaaacctattgtacatgtgaaatatgcctaaatgtatcttgtattaatgtagtaatagcagttactgagattttcaattacactattatactatttttattacagctgtgatgcatcattgctgaaaatgaactatctgatctaagtgaggttcttaaactcgagtacgcattagaatcagctggaggacttggtgaaccagattgctgccccctcctcaagtttctgtaaactctgcagtgagcttaagaatttgcatttctaacaagttcccaggtgatgctgaggctgctcgaagatgcttttccctggggacagaaagtgaatgcaggtggtctgatgtaaaaggcacatgttctttttgaaaagtaactatgctctgcactgttctccaccctgacagagtctcattctgccaggctggtgtgcagtggcacaatctcggctcactgcaacctccgcctcccgtgctcaagcaattctcatgcttcaggctcccgagtagctggtattacaggaatgtgtcactacgcccggctaacttttgtatttttagtagagacggggttttaccatgttggccaggctggtctcaaactcctggcctcgggtcatctgtctgcctcagcttcccacagtgctgggattacaggggtgagccaccacacctggcctaactatgctttttaagcttaaacttttaaaaaggattgatatcaattattaggataattacacaattttttaccccttttgaacttcagcagaaaggcagcctacatcaaaacccttcaaactaaatactttttacacaagggagctactagctccaatatcagtacttcctaaatggaaacatccattcctacagctcaatatttctttttactcaaatcagatataccctggccatatcttcaccctcacacaactcctttttctttcctaattatgttgagatcacgtaaggtatcattcaaccaccctccagctagcactcccaatgcctttagctgggatttttcttccactgtgcatttctttaagcccttaaagctggactcatcctaatgctttgtcctttacttaaaaactagtgtttcaagctaactgcagggtagtggttaagaccatgagctgtggaaccagaacaagttcaaatataggttctgtgtgtcacataccagctgtttaactttgggcaagttactcagtctctctgcgtctccatttcttcatctcaagaatgaggataccaataatgcctatctcatagcattactgttaaggattaaatgagattctacctattaagggaatgtagcaacaccttgtgtattatagctaagattattaccacccctccctctattcctatcacacttgccagctttactcagcctgctaagcattcttgggtgacaaaaatatcttataacatagtacatagggatactacaaattcagggagccaaaaatagtaacactgaaatttacataatagtaaaatcaccactaatataaatgtcattggtggttaaattattttgttaataaatcacaagttagtacttaacatgtatcaagccttttgttaattttttacatttatctcatttaattagtctaagtatagacctatatttccagctatgccatgaacatcacccagaatctgttctatgacatattcaaaatctgtactcttctacttcaaacttaattcacctcattgtcattttccatctcactgaatgtcattattataacatagcggcccaagccagaaagcagggagtcattcttaactcttcactcttcctctactccccctgacccatacccacctcttctgtatccatggtgtgttggtaaattggagatgaactgaagataaaggttaggatgtagagaggttttaaaatcagtgttaccctggtcatggaaaaatgaagtagaaaattcacaccagcaagtgaaatcaaagaacatattatcttgtaggcgacccacccaattcacttgccactgccttcatttatattttcactttatcactcctggatcattgcaacagccttctaagtttcatgtgttaggttcagggtcaggttccagcccatgctgaggtctggagggagtgggtggatgagtggcaaacagctgaaagaaaactcagggagacataggtagatgaaatatggctttattcagaagctctctcatcagcacctctcttagagtgtccgctctgtctcagctgtttgagctggcagctcccacacacagctgtgctgctggctctcccttgccttcagggtcagcagcttaattttctctctctgggcacgagagtccctatatagtgtcagcagggcaatgataccttttacaaacaatagtggcttagagccaaatgatgagccttcccattttatggctacatggttgtggtaacggggagttatacacctgagctctaaactcgctgagtcactcagcctgtccttgacaaaagcacagccatgttccttacactccaccccctcggccaagggagacataggccttggatacacaggttatatacataagctttggtacataggctcgatatatatacacacaggctttatacataagttttgggtacataggtttgatatataggcttggcacacaagccttacattccaccccctaggctgatggagtccttttagtgaggaccggtgcacatagggctgcaccttggacctataggccacagcaacaatataaggagcaacaacatactactaatattcctgctatgctactcatgattattagagcccaatgtaggccagagcccagagatgcccaccatctcttccaggggtcatcatcaaggcgctcaatcaccttaacctcctgggacaccccttgtaaagctgccattatgttctggtggttgtcagggatgagttttcaacattgtgtccctacaagggcacaagtgccaccttgggcagctgtggctatgtctaaggccatccggttttgtagcaccaccttcctgatctgattaaccttatcagttaacaaaaggagggcaactcagatgcaattcagggcccgagctgtgtgctctgcaagggctgtaacttgcatttcctacagtaatgacacctgctccaggaacagttattgctaagggatagaaccacaagggggcccaccccactcacaaaaactggaaacgcagcaccctctagtcatgtaggtgaccaggcaatgtggaaagcacagtggcaggcacatggggccaccctcaggtacagtccaattggctggcagatatggccatcctgtgccctcacagacccatcaactcccagggggtacaaagtccactggggcccagccttggtaaggccgcttattccacaacacccttggtgtagtgatcgtgttatgtttgcacaaacctcagcaggcaaccatcccacagtgactttaccccagtgctgctctatacatggtggtgtccgcaatgggggcaccacgtgttctcccattagacagctccatccatcatggacgctagagtcagccagggggcaggcttgccatgggttttgtgacgcctcctattcaaagcttgatgtgttgcatcccacccactgtccacgaggcctggacagtgtgcagttctgcacagaagctggatgcacacgccagggcaagccatccgcagctgctgctggaaggacagtgccgatccaacagttagagacattggtcacctcagtaaggtgtggaaccagtccacaatgctactggagcatgccaacttacagctgaaacaacaaagcaagcacggatactaaccagggtaaatcacgtccctcaggcaaaattcaagtcaatttttcatccctggataacaatgcagctgccaagggcttctgccctgggtgatgatgctacacctcatcagctttctgtggttcccttgggtcctgcacccatgccaaagttacagggaagtttatgatagtccacacagacagtacatatgttcccggaggagggttccttccctggccgttcccctacgaacggctaattgtggaggtcacacattaaatacccaaggagtaacatgtaagttatactgcagacccttccccacaggaggccacaatcgccaaccatctgcaatgaggggcttggagggtccatggctgacaccaggttttgtctccctacttttaggggtattggggcaggtaataacagattatctctcatcctcgtaactggttggagaaggtcatccttcctctcatggatccggccacatggcctggccctatgtgggttggtgactaggtaattctataactttcacataattaacaacaaggttaagcctcaataaactgcccagctacagctgcagattactgtaggtgtcaccttcttggtgatcaccatccacattgctctgagtttagctcattagctactttgcccacacttggtatcaaaccatatagtgtcagtagaatggccggactgtgacaacagtccaggcagcacaagtatctcgactagacctgtgtaccatgccccattaggaatggggggataccattccttatagtgaaggtgcagattctaggtgtacctccggccccatggccttatcttgcattaggactacaggtcccaagacttcttgtaactctgctgctaagggacttgtactcagcatactccgctgctctaagcaggtgcttcacttcactaaagtggatgtctgcaccgtccttatccggggagtcactacccatgaatgcacccatcctgctatcaggtaagtcgtccatatgacgactgtaacccattctgccacactcttatgagcctgatgggcagcatatgtagttactaactgctttcccagtccagggggtcactacccatgaatgcacccatctgctattactaactgcttctgtattaatgaacactggagctcagctcccttccacagctaggactaaaagcctgttggcacttccaaggtctccatgcactgctataggccctagccaacactatttgtggtcacatgcacattcagtttaaatgggcacccctagtcaactacccataggtcttgtgcctactgaagagcctgcttggctgtgtaagcctcaccatgcaaccccaggcaaggtgggcattgccacttctaaatctgcaagagaaccagaggttcgcataacgtcatcaacaagatcatgacatatgatgaggctatgcatatagtcctgcagtgacactatgaaagtccattgtcaccctcccatgaaggcagactgttcctggctctctggagcaatgttgattgagaggaatgcattggtcaggtccaccacacagtggcaccatcccagttctattgtcaagcagtccagcaagtccgtgacagacagcacagctgtcaagctgtgcaaaacatccacccccagaatgtctccaggcatgggagagatgtgcacagtggacaagcagacagccaagtggcgaacgccaaggtgcagacacaggttccactttcactgactggtcttcataaccattaataaacacagctctgcccggaaatttatccgggttcagagactagtggattgccaagtccgcatatggcctttggttgtctggtgccacccaagccaggcatctcggccagtctcttatcaaacagaaaaggctttacacttccacctgactgcagcaggcaatctgtgaactggaatactcgggcaggaccaggttgtacaccaacgtccttctcctgaatgacttgcactaagtctgtacatgactgccgacattacttgcttgactcccgcaacatagcgggggtgcaggcaccatataaaatgtgttccaccacggtggtggggggagggtccctaggctcacccttggtgcccaacagctactcatgctatattttctggtggatcactgggcgagcctgcaacagaggttctttctccctgcgctgcatcctgcagggactgggcatgcaattcctgcagcacagttacaaacgcccatgtgactctgccagcgaaggtatgcttttccttagtgctgtgcagttcctggtgcttcagtaccttctccacactcatgggagacctgtctactgcctcccacgtttccactggggcccacccaggcagcaccgctgccactgggtaccacagcccatgctgcggccacatagccgacccaagacccctcagaactgaagacccactcacctcatctggccaactatgccaactgtcaggttcatgagtacaccaaacgtcatgcccagggtccagcccctgctgaggtccgaggggagtgggtggatggacagatagctgaaagaacactcggggccgtaagcaggtgaaatgtagttttattcagcagctttcccatccacagctctcacgcactgttctctctgtcttggctgcttgagctggctgcacagcctgctctccattgccttcagggtcagcagcttaactctctctctctgggcacaagtgtgcctatacagtgtcagcagggcaattataccttttacagacaatagtggcttagagccaaatgataaatcttcccatgttatggccacatggctgtgataacaggtggagttatacgcctgcactctaaacttgctgagtcactctggatgtttacctcagcctgtccttgaccaaagcacagccatgttccttacactgtgtcttcaagtttcttaaccaaaattccatgtgacactcaaagctcctttataaaaatactgttaacactgttctctccattagaatgtccttcttcccacaaagtagagttccatttcaaatatcatttccttctttaagtgttccctaattatcactccagttgaaattctgcccttcatatcgccacaagcctttatcaattcctctctatgaggaatagaaatttaacactttctaccttgatattttgatttctaccaagatactttcagtaaagtgaaaataagtcaaacttaaggaaacagaaggtgaaatttgggacctgattaaaggttctttggaacagtcctctggcagtggttctcagtcttgtgtgcacactggaataccctgggcaacttcaaaaactatcaatgcctgggtcccagcccagatgtcatgaatgcatcctgaacactgagacttggaaaagctctccaggtgattccgatgtgcagccaaggttttgaagtactactctatggggactataaaagggagtaagaggctgggcgtagtggctcgtgcctataaacctagcactttgggaggctgaggtgggcagactgcctgagctcaggagttcaagaccagcctgggcaacatggcaaaaccccaactctactaaaagtaaaaataaataaataaattagctgggcgtggtggtgcacacctgtaatcagctacttgggaggctgaggaaggagaatcacttcaacttagaaggaggagtttgcagtaagccaagatcgtgccactgcactccagcctgggtgacagaggaagagctctgtctcaaaaaaataaaagagttaagagattactgaaggatttttcaacagaagcaaagatctggttgacatcagataataataaatattacaacttgagtaatagctgactgtttagaagtattaaaagcagatgtagaaatgattcagggtaggcaaatgatattgtaggaaagtgtaggaggcaaggaatttggtggcacttggtaaaactaaaatgacttacaattgcttctaggctgaagctggaaaagaagagatggactgggaagatagggacaacaattaagggaaactgcttggaatgagaaccaagaataagtctgaagaagtagtggagatgagcagtcaagcaaatgcagagggaattctgaaaaagatgctgtgagttgttaagttttcaaagatgacagaacatgatgtgtggcaacaacagtgtgttgctaaactggacatgtgtagaagagttttgaaatcagagtcaccctggtcatcaacagtgatgaaaaatatgcatggcagcatctaaaaatcatcacgggacacagtaacttggaggtctgataaagatgctgccataattgtggagagaggggttagaagctgtggtgtggctatgaaaaggggaggtaacaaattgtggtagaataacacttactggtaggaaagagaccatctgtttttctaaagtacactcccttccccccacttataaaaccaagtatgtatttaaagatatttctgtgctggtaagtgtattaatttataatctttatttttcatcattaagaactaaatattaaaaaatacagtaagtacaaagccaaaaaaccaaatttgtttttaaaatacaaaaacaggtgttcatggtaaatgatggaatgggagaatggaactggcatgagaaagactccttcacagtagcagcatgtaaaaatttctctgcttgcttcagtgccttcccaaatgctcatctttctcccagttgatacctacgtgctgcttcaaaacccgttaaatgtggtgaaggggtttaaatcccatcagaaaagtcagatccctggctcactaatcctttgaaaggctcacactagtgcaaataaatagctgactaacattctctgcaggacagttgcattataataattctatagcaagagatagggatattatcaatgtagtgtgtcctataacaagaggtactgtatagatggagtgagtcatttcacctatagcaccacccgataagagttgaaatgcgttagaatatttttcactgtagtaaaatattaaacctaatttatctgaggagtgaataaaaaagcaagcttaattcttacaaggaacataaactcccttctgtaattcacattattagtcccatgtcattatgacaagatatgtttgcatcactaggtacaagagaaaatggtatatagcccacagaataagtgaaaatctattataatgaataaatttgatatagtagtgctatttccaagttctatttagtaaacccagagtaaaaggggtttattgatctgtttacaacattctaaacactaagattaaaactgttttgttctgacataaaagaaacagctatgtaaagtgcttagtcctctacctggcacatggtagccactcagcagacagttcccattttcactgacttgaccctttccctcccactccaaatatagattctaaccaccctttaaagaacatccatagaaaattctcagatcaaacaagcacactgtgttaaatgttaaatgtccacattaacaaaggttatatcatagaagtatgcacatgccaatttcttatgcatgggagtaactcaggtcttagattgacaatgatgaacaaaggaaaaggaggagaaaaaagaaaaggaaaaatgaacaaggatgtggagggagaatgaaaaacacaattgcactgtcagtgtgaatagcaaacaaattcctgaactaccagatgtcatggaacaagtaccccacacaagagtacacagagctgcaatgaccctggaactctaggtgcagggactgccaacactacagatgcattcattgtcatagctctagtgattttcttggacaaatggtagaaatcactttagccaccccacccccatccgctgctatcctctagtggcagaaacattaacagtggccaaagaatgacaatttatcctgattaggtgggcagctaatttatccttttagggacagctgtcatggggtcctcagtgtcctctctcttcagtgtggtccctcgtccctcaggaaatgactttactctcccagggtaagctcaaaataacacttagtgttcctgctaaatcctccagtagtccagtgctatgcagttctttcaaagaagagctcttgtgattaacacaaaagtctctaaagttgtgtgtaaaaaagcctttgtgtaccaagcaaggcatggctcacacctggtcatttgcccagtttttgccgattcttcctggccttagattagtgtctctcctcctttagtcttccatgaccccatggtcatggaagcagttatagctaactactgcccttctacctgtgtctgaattgcagtattgttaacactgagcaactcacaagattcctcttcactaggtcaccctccaaggctgcgcagcaattcaaatcccagtgttagccttagagttcaaagctgctcattaaaattatgcatgctgaactgtaataataaattctgggctaaaattataatttaatattttttcaaagtaatttagagtgaaaaacttcaaaattttctgttattttgtataattgggaaaaacagtcaagtttttcaaattaacacataatagttgcattacaacaaagatatttatcattcacttattcattcattcaaaaatactcgagtgccaggaactctgctggaccctgagaatatagtgaacaaaagaaacatgaccatatcataataataataatttctatattgtatcacttatttcaagaatagtctggcatagattaaacattttatttaagaaaacaaattggggagtggggagaaacacatgggaagtaaatttgccatgactaagtatcaaagtcgttctatgtattatgaatatgtaacaattattgtaagtaacactggacactaaaatagttgctgttcacttaaagagtgctagtattttattttaaaatttcactatacagatgcatatcacaaaaaaaatgtactaactgcttgaacagaactatttatcaagaataagaataataagattttgtaaaatgttcatgccaagaatgcaaaagaaaaaaacagcacaataacctcacaactaagacatactataaatatgttatcaaaagataatttttactcttcctagcacataaaagataatttattgttttcaaacttaattgatactttctgtattagaacatattacatatcagtaattttcttaccaaaatagaacccaatatatgtacagtaaatatttaagaaaataagtttgtccttagctttaacatgaatgtgtacatataaatatacatatgtacactcacaggagtaacatacattgacaaaaaattacacttagcaaaggtccaaaattgcacaaaaaaaatcccgctaggacttttttgctatctttgaggttggacaaagaatgtataaaattactgaagtaacaaaaaaggacacaaaaaccacacttcaaacagacaaactgcttgtcagtattaggacctgatttcacatacaggtttaatacacttcctcaaaagtcatgccatcaaggtgaaggatgaacatcttccactactgaatgaggctggatgtcattattctgagaagtagggttctcctccacatggattactttatctgaggttcctgcaggagaaacttcattatttgtctcctcttcactaggtgataaggtttcaggcagttcatttgacattagaacttgcaaaggttctgttccattttcaacaaccacttgaatccccaaaactttaagaatatcacatttgcaaatggggcatgtcccatggggtaaaatccaggggtcaatgcaattcttgtggaaaaaatgtttacaagtcagaatacgaactatgtcattaggcttatagcgttcaaagcaaattacgcagctatccccatttggatttatttcttcatccccctcttttactactcgaagttggagttgtccaaatgtgttctgaagatctgttgttaatcgctgccatctccggttctgaatccttgctaaacaaagtctatgaatgtgataaaagatgaaatatgctaaggtagcagttgtgacaatcacaaaagagaccaaatagtgattcatccagatgatgtgctttctccccacctcaaccacggctgtaatgagaactcccttcttaattaaatggaaaatttccgtgccttttaagttaccaatcataaccacaacgacatcttcaaatgcctgatgaaacatggggaacacctggttgccagtacctggaacgttatagatgatcactccactggctcccttctcagttgccactttaattttctgtgtgaaggtacaacctccccgttcaataagtgcaagccaggtctctgagtactttgatcggctgaaaatggtattgggattacatgcattttggatttttccctctggtggcactataactcctgccactctcttcaaagtggagcttcttccaaagactccagtctctcccaactctgacaacacatgattcccaacatgaaatgatatgttcatataagccatccaaacaacacttgctctgcaacagttctgactaacaagccaaagaacactgaacttcataagccaggaagaggcagtgttgtttctccaagtgccaaccttgagtagatgcatctctctcttctccgagtgacttaagaaccaacctaacagttgcacatctgttgacaattaatttaaaataacgaagagaaaaaaatcttcaggatacaaacaagatccactgtcttccagcatgtttttgtaagaaattcttaaagatggcttatgagtttcagatgtcttactagagagaggtgaaaaactttagattgaaaaataaatcccctactgttaactctagatactgcttactattgtgtgatgtgattatgacatgcaagacccagcagccaattagataagagcttagagcatactgtgaatttattggcttaaatgctgttatgggtgatttctatgttgttataagatggatataatcactgagctacatataatggtagtagatagcacattaaactaaaaattaaatctaaaattcatacaatgtgtgctctttaaagcctgaaagcacatgtaagaatgttttattttcccagcaagtgaaggagatatttccaacaaaatggcaagctaaaaaaaaggataattaaaaattagtgcagtgaccggatgtgaggcaaaagtggtgagcttagtgacattatttttacatcaaaaagtaaaagtcacactgctaatttttgattcatcacataaaccattatattgcatttatttaatttaagctttctgagaagtttgtggcttttgttttatggttttgctgttttaaagtaagggatcctgctcagtttacttctgcctcactttctctgtcttacattgactgtacaaatgtagtaagactgacaggagtaaagaaaggactgatatctagggaagctaatttctctgcagactttgatgtctgttattaatcaaacaatattttgaaagaggaggagaaagggtgtcaagggaaagattaaatatagtcatattagtttggcacaattcattttttaaaaaacagctattaagaaaaacttcaaggtgcacacttaaagttaaccattagcagcaataagtagatgcttttatcaaacatttttgcagaacttaacaaatatccctattagaagattccacaggctctgtccactctgcctatgtttttgccacaatcatgtcagtggcacaatatgacatcaaagctaaaggatggcatgtggactcacaagcatagtaagttcacaagcagccacgctgctactggtacactttcttggcggtgaatctcagtgggttttttcccaccagctaggaaaccgaggccaaagattctgaccttgaacatgaatgtctctggtctacatacgtaaagtgctagaagtcacttttggttggaactcaccaggactaaaggagctgttacttcttatgaaatgtaaatctacaacatggtaatttgagacaagaaagatgaaggaacaaagggccctatgggccaacaaaaactagtataaaaagaatactgatgatataaaacatacccataaaggttgattttctctcccaaaggccattaatccgattttattttcatacatccctgcacattttaaaaggtagtatatggtgtgtatattcacaaagtgacactgaggtatcaaaagtttagcatatcatccagaaacagaaattttcatcaatacaacaatacctaaatctttctgtctctcattgttatataggtgtttattcatctactagaaaaaaggaagatgcaaaataaggcaaagaatataacatcgaaaggcaattgaacaaaattttagctctgccctatgttatcaaaatgcccccagagaaacattcattaccatttggagaggaaaagagaagcatttactaaggacacttctagaaaagaaatctgctaccatagctgagtcactatgctaggatttaaagagctctggcaaacaaaagtgaatgtttgcaatgttatcctaaatgaagcctataataatttagaacacttttccttacatatccaaagtactatcatctaaaataattatttagaacacattaccaatccagtgagtagctttggaaactagatttcctgggtattaataaaattaattaaccatggagaatcagagatataaattattagataccaaaattagtcaaaatgtggaaacaaagtacaagaattagtattaaaaaaggaaactttaaaatagcatggctaattctctatggcaatgtcacaatcctagtaacttgaagaaaaaaaaatttgtttttaacatatactaatgttcttatttggataagggcaaaaagggatacgattaagaaaatgtggcacatatacaccatggaatactatgcagccataaaaatggatgagttcatgtcctttgtagggacatggatgaagctggaaaccatcattctcagcgaactatcgcaaggacaaaaaaccaaacaccgcatgttctcactcataggtgggaattgaacaatgagaacacatggacacaggaaggggaacgtcacacaccggggcctgttgtggggtgggggaagcggggagggatagcatttggagatatacctaatgttaaatgacgagttactgggtgcagcacaccaacatggcacatgtatacatatgtaactaacctgcacgttgtgcccatgtaccctaaaacttaaagtataataaaaaataaataaataaaataaaattcacctaaaaaaacaattaaaactgattagaaagacaagaagttcaaatagctgggcatgataaggagttttatttttaaaacacaaatttcacccttgttcatacttgggtagagaagctgaaattttctctctacataaagtacaataagacaatttatctaatctttgtatttggaaagatctggttacatcttcagaaaattctccagatttcttaagttttcaggatgtcacacttgcacatgggacatgtcctatgggctaaaagccaggggtcaatgcatgccttatggaaaaaatgtttgcaagttaaaatgcgtactacatcttggggtttgtatgtgtcaaagcaaacaacacagttgtcttcatttaggtctaattcctcatccccttctttgagaactcgcagttgaagctggtcaatagctttcttcacatctgtctttatttgacttcgcctcctggtgaaagaattgggcactctaggtgtaagtctccagacgcaatctaagtaaaagtaggcaattgtggcagccaggaaggtaaatagatacatgatgtaatggctcacccactgcatgtgcattctccccacttcaatgatgactgtcacatagactcctttctgaatcgagtgcaaaatttccatgcctttcaggttgcttatcatcaccgcgactatattttccgtcccctggtgagacatgggaaatactttactgcccgtaccttgatagttgtagatgatcaccccatttgctcccttctctgctgccacgttgattttatgtgtaaaagtacagcctccacgttcgatgagggccagccatgagtctgcctgtttgggcctgctgaaattggtcaaaggatgacaggcattctgattccatccttcaggaagtgccaccacaccagacaccctttccagaggagaatgattcccgaacactccactctctcctaattccgatgtgatctcatttccaacctgaaatgttatattcaggtgagctgtccaaatggcttttccgtttgagtcaggaaagctaagtagtagaaagatactaagcctcaaaagtccagatgaaacagaactatgcgtcgaaggggtaattctaaggaagctcatgcctccatttgtctattaagagacaaacatgagaaaacaaaacaacatcagttgtagaagaacataaagaagatagcttgttggcggcagattactaaagcacataaatggaaaaggtctccctggatcaaagctatcttgctccttccagtattttaatatttagtagattatctttctcataatgaaacaaaataacaagacttgtgattggtaccatgtgatttcaagaaaattatgacatccaaatggggaaattatgacatcagaggtagttaaaccaatccaagagtttatattagtgcattgcatcctgaaatcctattggccaaaaagctaagcaatgagtcaagatacataacaatttgaataggctgtaaagcaataaataaactggtaagaattttttaaagccttgggtttcttccttagttctggagagactgaaaatctacccagccatataatgttttttctagctgtaaggcaaaggcaaagataaaaataattcatgtattagtgcatgtacctgggccagttgccagttttcatgcatggttcaacactacccaatatggcattctgtgggatggttcaacactaccgaatatggcattctgtgggatggttcaacactacccagtatggcattctgtgggaagtaggagcaaaccattcccacccacttcccacattaaatgcctatcccacacctaaagatccaacactaagaaaacagtgtaaactcttattgttagcctaatacagtcccatcttctggtaagaacctactatgtgctggcaaatactgagagtggacatatattggagaagaaaatagagacggccctactcttgtagaggctaaggattttggatgatgtcccaaggacaagagaaacacactgtagggttctaagccagggaggtgacaaatgtgtttcaaaatgttcactttggttgctttatggggaaaatgtattggagagggagaataacaagagaatgagcttaggcaaaagaagatagtggcttggactcaaagtagcagcatagatgtagagacacagacaaaggctgaataacagatttagtaactggaaggacagtagtgggaagaggaaaggatggccacaatgataaaaaatcactacatgatttttgcaaattacagaatctttacggctttaaagatgccttattgtttagttttatcttaaatctttatctaaagtctgtttcaaggagccaataaattggcaacacccactcaaaaatttattttctatcatgtataggttatcttctatgtgctcagcatgccacaaagtcctagggatagaaaaagaaaagaccttatttcctagtgtgaaaaatggacatgaacatttaatcatagacatgatagagttttctcatttggacaaaagcatttattgtattccctggcctattttagttaatatttgttagtattccctgtattttagttaatatttgcttttttaaaaaaaaactctaggaaacagtctacttgtcccattcatgcaattctgttgaagcatgattcaggtaacacctgaactgtccttacaggtagactttttttttttcatgttcaaatggagtgaattcctggctgattctattaacagtgacaaattgaagcctcattaagaagacggtttaacatcatcatattagaggtaatttgttaaatctgtgattatttaacctttggaagtaggattacaaaataatataactctgactttttattttgcagattttttgtgggtgaagtgtttaacctgtaactatattttgcttcaaaacatatctcacatcaaaaggttctctgtatggttgaaaggaccaatttgaggaacttagctcattcattctatttttctcattataatataaagtggttaaggcaatgatagaactgccctctcttctgccctcgtcttacaacaaaatagacctataagaaacaatcatctatctcttaaaaagtggttttcaacttgggggcaattttgcctctcaggggacatctggctgcttctgcagacattttttgattgtcacaattagagagtgctaccagcatctagcgagtacacaccagcgttgccactaaaacatctgaaaatgcacatagtagctccacataataagaaattatgtggtccaaaatatcaatagtaaggttaagaaaccctaatctaatgaaacagcctgaggagagaagcatcccaaaactctcccaaccccgatgggtggtcaggtataaattctcgacacaaaataagcttttataattgacaatgcttccatcaaggatgaggccctcaatgcaacttaatttctctagttttccctggaatagaaacaggagagatctgtacaagttaccttttagtccattaagtatcatgacaaattgcatatattttatcagaatgaggtctaagagtcttcctggaaccgcatgtgactgggagacagagagagagactggatgattgaggctactgtaatctgttccttttagatcatttattcaatacatggacattctttctaacagccaaatattgaagagtttttcattctgttgaattttgcaggtaggttacagagaattgaaatatattagtagagataatatataatatgtaatataatattatatattatctatattatatattatatatatttatattatatattatctatattatatattatctatatttatattgtgtattatctatattatatattatatatatttatattatatattatctatattatatattatataatatattttatatattatataacatttatatatattatatatgatatataatatattatataatatatctcatatataatatattatataatatatcacatattatatataatatatcatatattatataatatatcatatattatataatatataatatatataatatataatatatgatatattatataatatatatcatatataatataatatatatgatatataataatatatatttatatataatatatattatataacatattatacatattatatataatataatataataaatataatataatatataatatattatataatataatatataatatattatataatataatatataatatatatataatataatataatatataatattatatattatataatatttatatatattatatattatataaatatatattatatattcaaggatttatatattcaaggaatatatatatgtttatatattcaaggaatatatatatatgcttatatattcaaggaatatatatatatgcttatatattcaaggaatatatatatgcttatatattcaaggaatacatatatatgcttatatattcaaggaatacatatatgcttatatattcaaggaatacatatatgcttatatattcaaggaatatatatatgtttatatattcaaggaatatatatatgcttatatattcaaggaatatatatatatgcttatatattcaaggaatatatatatatgcttatatattcaaggaatatatatatatgcttatatattcaaggaatatatatatatgcttatatattcaaggaatatatatatatgcttatatattcaaggaatatatatatgtttatatattccttttgtaggcaggctaaagagaactgaaacatattactagggttggttcaactggttcaaaaagtcattctacctaactcttgttaacagcgaatatgtatatatatatatatcacacacacttaagagataggttgtgtgtgtgtgtatatatatatagttacatgctcttaacaagagataggtagaacatacatatatatattcttttatatatacatattccttgctcatatatatgtatatatacttatataagagcaaggaatatatatatatataaaatgtatgtgtgtgtgtgtacatacatatatatatacacacacacacatatatatatatgtatgtacacacacacacacattttttttttccagaaacttaccagacttccctcaatgtctctttggctagaattgcttcacaaacccatgcctaatgaaatccttggaaaccggagtggaatcatcatgattatcttaggttaatcatgatttatcctgttgtagagagctctttccctggctgagcacatggccagaggaagggtgaagatttgaatgctgtgttactaaggggaaagacatgaaccagaaggtaagcaggcaggcacaatggcagttacaggctctaaattcctgaagtatccccaaaggaataatacttaaccattaaccgcaacaaacatgtaatatgcactgtacacaaggcactgacatgagccagagtctctgttaatggggacacaacatggctctgaccttaaggagggcatcatctaggcagaataaaagagttacatgcaagttggatgtatatatgcatgtatcctataacttccaggcgccaattaaattttttagaaggttataactattattaagagagaaaaaatcaactaactgacctctacccctctgctattctttgatctctatgggtaagagtgctcacacttccagaaatctctactccaataaagcaaaacagataaatacaatcacattgcactgctcagatagcatctttaagatgaaaggaaaaccaataaactacctcacaagtgtcagtatccagagctataatatcatgagagctctctaggaattcaaaaaacatttattttgcatttaggctcaaacactacaactatgtatgttttttttgcaagaaattaaatgaatcataacgagatctgaggaaaacagaatattgactctaaagtacctcactgagagcagcacaaaagcaaagagtactaatgataatatttttctgaaagcagaatctttacttttacaatttttaatgttttcttatatatatatatatgttattatttgcaagcatctcctctaattacagctaatatattactggttaaaaaaacttcatagtttcatgtaacaaaactagtttatataaaggcatttctggattgtggcaactataattcttatttctatatatatattttaagtaaattttgttgtgtatatttaatgtgtataacatgatgctgtaaggtacacatatatagtaaaatggttgctataatggaacaaatgaccatatctgtcatctcatatagttatccatttgtcctcctgttgcaagtgctgctataatctacccatttagaaaaaatcctgatataattccctctacaaaattaactattctattaatctccttgaaggacaggattaaatcttattctcatctttttaatacccagcttctaggacaatatctaccacatcataggttctcaataaaagttgaattaaattgatagcgtcattatcctctgtattctatccagtaatattccttatgcaaaattgtatctactgagttttatcttcagaaaggtgatcatttcagtaagagtataggatagttagaatattcataatgagttcaactgattctatatatgtacacacaatatgtgtgtgtatatatatatgtgtgtggatatatatatatatatatatatatattggatatgtagatccaaacatattgtattcgagatatatatatatatatatatatatatatatatatatatatatatatatatatcttccttgctcttagcaatcataaaacttgattccttagccataccttaatacaaagataaatgagcatttggaatatgatcaaatccatttaaattgtaatgggcataaataaactaaattaaactctcttcttcattcagaattcaagtcatggtctacataactttaacaataaattgaaaacaattttttccttattcagtctaccgatttagaagatagaatggtaatcagagtaggaactcattattactactctgggaagtaacggggggaaaaattcacattgtagtctttgcactaggaggcagaaggaagaggtaaatagtcttaagtaaacacaagattaagacaatatttggccgtagtataattattatctttgagctcggaacaaaatgtatcttcatattaactcaaccatttagactggatttttgtttgaggcagtggtgaataggcaatatactcaaaagaggaaaaatataccaagcagattcctttaaatcaccaccagcaattgtcctgttctcttaataggctactctgcccttctcattattaagatccaaggatgaggaccaaaaggttctgcaggctgcttctgggactccatcatttcaagattgtcctaaagcttaaaacagactctaaatcttcctaagccacaaggatatgaacagacacttctcaaaagaagacatttatgcagccaaaagacacatgaaaaaatgctcatcatcactggccatcagagaaatgcaaatcaaaaccacaatgagataccatcttacaccagttagaatggcaatcattaaaaagtcaggaaacaacaggtgctggagaggatgtggagaaataggaacacttttacactgttggtgggactgtaaactagttcaaccattgtggaagccagtgcagcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggagtaagaaaatatggcatatatacaccatggaacactatgcagccataaaaaatgatgagttcacgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggttgggggagagggaagggatagcattaggagatatacctaatgctaaatgacgagttaatgggtgcagcacaccagcatggcacatatgtaactaacctgcacattgtgcacacgtaccctaaaacttaaagtataataaaaaaaaaaaaaaaatgaccttctgccaacccaaaaaaaaaaaaatcttcctaagccacaatcagtcattgaaagtttgcatatgcattgccttcctaatacaagtcctatgatggttaactctgagtgagtctgtggttaactctgagtgagttcccagcagtcagaaataacagggcagaggtgattaaggagattttctccttacgtttttccaattcacagatcacaaaaccctttcttatttgttatataatttaatccctcccgtgaaggagcagagaaaaacgatgacaacaacatgagcatagagacatcacactagcagaaacagtgaacagtgtattaaagcaccaggccgtgtgacagatgtgtcatgtagtgaaatccagtttctgctacatgctagccatttaagctgagccacattgagcctcagctttctcatctgtagtctggaaaagtaaagtctgcctctagggccttgatgagtattggatgacatatttcacttctgtttgtaaatcgccaagcacactgctagcttagcttggtaggtattcaataaatgggccttccttcctcttctcaatcctgaaaaactttttcttccattttccagctaataaaattcccatcatctttacagacccatttcaatctcccatttgtgatctccctagccaaaaccacctgttcctatgacacattatttttgtacctatttggcagtcatttaattttgccttatattatatataattagaggcatatatgtctgtctatactttcacttggtttagaatatcttgtgagcagtggtcttatctgattcattttttaaaaatcctgttttctcccttctgtctctacactagcacaataaaacttgctcaaggtccctgacaaaatgttgattttcaagtactttctcttcaaaatattaagacatatctggagcttttataatctatgctttatacaactactcacttttttaaagaaagagaacaggcaatgatttgacaagtcttccctcagttaagaattacattgacaacagttgtccagaaaaaggcttatttaatatcacaggatcagaggccatctgtcttacattttctctccaaaagtcgagaataaatttcatctacatctctgtatctgaaaaatggactaaatatggaataatatgcagccataaagtaataaccatttctaacatataagcagcagcctttacagggataaaaattctcctttaattatttttatgtaaatgaatatatagctatatctctcaagatatttaaatatagatctacaactatatatcaggtcatgagccccaaagagtcattattaagagaaaactataccaattatgtataccatggtacctcagagaaaactctaacattacatcaggagtaatagttaaaagaaaaaatttctaattgcaaccaactttttctccaatccagaatgccttctatttctaccccaagtgacagttgaatcctgcagtccccacaaagcttccctgattaattcagtgcaaagtgagttctttttcctatgaactgtcacaatatatgttttacattttttttctttttttagacagagtctctctctgtcacccaggatggagtacagtagcgtgatcttggctcactgcaacctctgcctccagggttcaagcgattctcctgcctcagccccctgaatagctgggattacaggcacgtgccaccacacccggctaatttttgtatttttagtagagacggggtttcaccatgttggtcaggctggtctcgaactcctgaccttgtgatccacctgcctcagcctctcaaagtgctgggattacaggtgtgagccaccacgtccagccatgttttttatttttgtatttaaacatattttgcagttaaaacagtacatacagcatacatgtacatttttaaatttaaaaaaaaacactcttgtatcttttaagcaataagcactattttcttcatactctacatcctttcttaggaaattatttctataatatcttgtgatatttttcttctagtgttgaaaacaatgttactttttccccctcttacaaaggttgtcatctttacctctcaaattataagattttcgagggcaggacttcgctatgctccttcatcttcctacaggacccagtgcactgatttgtatcaatttcttatttgatttgatataacaaaggtgcttctctggcatgactaaggacctgccatgccttagttgtttttcatattccctctagaagcacaatctaagaaccatctattcaaaatgtctacattattgattatttcactcattcgaatatttatcaagaccctactatgtgcatagtacttaatagtaagtgcacacaattttagggctacagcactgatcaaaaaggaacaatctcctgtcctaatgactcttttgtgtacccagggattcaaagatgaggtcatggttatattttttccaaggaactgactttctgatatgataatacgctaaataaggtatgaaggaaggaccagagaagcacagtatcttagtctgtttgggctgttataacaaattaccataaactgggtagcttataagcagtagaaatttatttttgcacagttctggaggccgagaagtccaggattaagtagatttggtgtctcatgagggcttgctttctggttaatagaaagcaccttttcgctgtgttcttacattgtggaaagagtaagggggtctctctcaagcctcttttataagaacactaattctactcatgtgggctctgctcccatgagctaatcacctcccaaagtccccacctcctaataccatcaccttgggggtcaagatttcaacatctcaaggggaacacaaacattcaggttacggcacacacaaaaataaatcctgtccccaaggtaggacagtttaatcattatatagttctgatatcctaagttatcactttccttaggatatttcatacaatgaaaaacaaagcagcccatacagcatatctgttcacaaagtttccttcattcagatctgatggagctttaaatttttatatttaaaaacaaagctttgttttatataattttcacagtcttaagtctcgttagttttaccaggaatagcaattgttgaattttgcaagtttaattaatttttaagccagactgcctgagtttaaatcctgtacttaacactagctctacaacttaggcaacctatctaaactcatgtgccttagttcccttacctgtaaaagagagataacattagtaccaaatttttgggactcccatgaggattaaaagaaacaatgcacagtctttaaagcacttagagcactacttggctcatacacaaactgatgtgtgttcactgccagcacccatcatatttaaatcattgtcttattcacccaatttactaaagatgatgccatgatctgtaaccatttttttcaatcttaacaattgtaaggaagtttctattttgacataaaatattggtaaagaaaaaaaaaagtgataagtatcacttttccatatataacatatattcttgaagacaagtgatctctttacacaaatacctagtaacacctccagctaagcagctagtatttgaatgcacattagggataaaatatttcatgattcatagaagatgcatgaaaacagtgatagaacttacttattatacattttatagttataatgtacaggccaactttaaaaaacaaaaaggtcttttttgttccctcacatccacagaccacccataaaaacaaaagtaaaacaaagaagtaaagcttttcattagctctgctggcacaatatttttcaatatgttgacaaagagcctggtttctccaactaattattacattcataatccatgtcaaacttcaagaagaacattcatgtcaccaatgattcaaatttagtttgagatttagggaaaagaggaggttaccatgacagaaagcaaatgtttgtataatccacttaaacaactagttctagcaagacctagaggtaaattattattgttctagtagtttctatttatttggtaaggttatactaacagattactcaggtgggaaaagtaaacgatattccataaaaatcgagaagcaaaacgacatggttaatctgaaaatacatgtaagtagcagtctatacctacaagaatacaaagtggacatagtattcactgtttctatcaaatctacaactttcagattgtttctagctgtctttagtatttagcttgatttcctatgtctcattttacttacatttccattttaaaatctttggtaaacaacttcttttaatgttttactatcatcatttttttaaaaaaacaaacaataagtggggctatgggtaaaacagttacaaaaagaatccatagtcaagtggagagacgaaggacccaaaaatttgctttttgcatgttaatttcttaccaaaacaaatacatacaagatgggctatgaagggtaagcaataaatcttcaagaggagactagcacaagatccattgccactcataggaataagtctatttactcacaaggtgtttcgtatagtgttcttacaaaactgtactagctaatatttcaagtgtattacttataatttgttgaataatagaaacttacagtaataataagttccgatttgagtctttacttaacatttggtgtttagcactctgtcttatctcatttaaaattcacaacactgcagtgaagtagacactatcagaatctcgttttatcaattagaaaatggagatcaagtgtgtaattggttaaacgtcatacagctataagtggatgaaccacaggaagacatctcccctagagcttctagagggagtacagccctattgataccttgactacagacttctggcctccacaactgtgagagaataagtttctgttgttttaaacaattccgtttatggcaatttgatacagcaactacatgaagctaatagagcttattggtcatttaagtttcctattctttgacttgttattcatatcccttattcacattgttcagggattgtctgagttttcataccgatatacaggagttatggacacaccttagattttaagcctctgttgactataagcactgtaatgcctttctcagtctttggcagccaatgtccctagttaggactggttaggcctcagaaccctatctcctaggtaaggtttctccttccagaacgcagatggcaaagtggtgacttgagcttgtgaataagacacatgaatccatgattggctcttttataactgacacaggatttccgtgccttgtaatttaaaagtagcaaatattattctgcctatgccttaaaaacatgaaaaagactctcttttctgtacactgtccaaacagaggtcattctgctttgaataaggtctgaagcatacagggtctgcctgtaaaacgaaagctgctttcctacggacaaagatagctttagtcatcttctatggtcaaaattctcacagacacaaggcttaaaacctctcaacacaacgcattgcaaagaaaaaaaaaaagccaattgtacaagtacaaaaaccaaccacagtgcaaagctccaaagtaaaaaccccacatggtctgcccctagtaaggtactaccaaagcttaaagtcatccaccctgacactagcagaaacaataatgacatgattttgctcctctagattttactaagagctgtaatcttctatctacaattcaatatgaaaactctaaaggtattttttccccataagtatgcagcaaattcattgggggaggggaaaaaacctgatatttcaaaattgctagaagaatacatttcaaatgttctcatcacaaaaaaagtatgtgaggtgataaatatgttacttagcttgatttactcattccattttgtatatatgtcataacatcacattatacaccataaacatatacaattataatttgtcaattaaaatattaattttttaaaaaactgatctgaagtaatggaagtctatgcattcattcagtatgactattcatatatgttgctgaaggaatatttgttttatgaaaaaaagcctgcctcggaccttactggggtactatctaacatgtggcatatgtactatgctacatttctgatatctaaaacaatggtccacactgcatagggcaggcccacccccttctgctaccatcactaccaaaaaggcaggaaaatacaacctacgtctctactcctagacaaaatcccttgcaaagctaacagcctaaaagagcaggggtaagggagctcccagtcagcagaaagctccacacagaaaggaacacatttggttttctgtcctttgtagggtcgggggagcggggagggatagcattaggagatatacctaaggtaaatgatgagttaatgggtgcagcacaccaacatggcacatgtatacatatgtaacaaacctgcacgttgtgcacatgtaccctagaacttaaagtataacaattaaaaataaataaataaataagaaaggcaggcatgcctggtttctccttccagcctcatctaccaggtaaatcatgaggagggagtaaaaggtagagtgcgaccaaggggcactgactctgctaatatggtggttcttgggaggggtggggaatggagggaggcccagaaagggaaacactgatttataaacaagaaagcagaacccaaaggaaataatggggttttgtccctacttgcaatgtgaacatgactttttctactagaacacaaaataaaatttcaaatgttgacaaactctgtaacgtggtatcatttctgattttcaatatcccaacaaaatttgccacttagaactttataatgagctaaatggcaaaacaaagactccttttgttgtgtgaatacttcctaatatatttttgatatccatacttttgaattcaggatacaatttatcctacagcttattttcaacatacttgtctttatctttcacttgttataattgtgagttaatttttcaaataggcttgtcaaaacccaattaagaagttatctcatcttctcaatttggtcccacaaagcaagtaaagttgacaaacatttagtagcaatgcctgagtagtctggcaacttcaaagatgtgtaaattgagggtaaaaacacataaaaaccagattacaaataattattcctgcatttttcaaatacttttagaataggtaagaatattaaactgaaaagaccacataaaaatgtttacaaaaattataagacacttacttatgacacaacttacatatgatactggttaaatgtttctatgtggaagttatgttggaactgaaagagtaataactaactttcataactagatgtaaatactcaaaatgaagtagcttcaagattcaggagggtaaacaacactctaatatagaaaatcttcttatacaacctgcagcaaccgaaatctttccatccctttcattgtttagctaatgggccttaaatttataaatgcaccttggtgagggcataagcattttccctgtgtagtaaaattcctgtgcagaaaaatattgaaatacaactcaattatcctagcacaagagcagtatatcccacattcttttttgtctgtttgaagacaaggtcttgctctgtcacctacgctggagtacagtgacacaatcataggtcactgcagccttaactagctgagttcaagtgatcctctgcttcagcctcccgagttgctggtactatataggtgcattccaccacactcggctaatttttttttttttttttttttttttttttttttgtagagacaaagtctctctatattgcccagactggtctcgaactcctggactcaaagcgatcctcatgcctcagcctcctaaaatgttgggattacaggcatgagccaccacgcctggccccctcattctttagtttaaaaaaacacatttagagtttactaagctagaagctttatatatgtagtttatgtgattgccattatacaattcaaccattacatcttaatttgactactcaaagaactgcctgtcagcattctccatcatattcctatatatctggaaatttcttgacatggaaaaatgacaagaagggggaagaggatgtgggaggggcaaaaggaaagcaggtgagtaggggagagagggaaaaggaggtaggagagaagtagaaagagggaggaagaaagatggggaggcttagggaaagcagcctataggatattgccagtgagctcagtcttacaggacaggaaaagttcagatagttaagggtagccatggccttctaaacagggaacagaataaatagcaagttgtatatggcatattcagtacccacaggtttttctccgttgttaacagtctagtgagtgtaacaaagcttagtgaaatgaggatacaagagttggcagggaactgatcaaatggggccgtgttaaggcttttataatccaagcattacaacacaacacttaaagaaagaaccaaacgctgtggtcaagctgaagcgctgaccactgactacctcttagaggaccaagttgtgagctcaagactctaatcataagctggtatgggataacagagaacagatacaatggaattaatctgtttcttagaaagaatgtgcccaacaatcaatggtcatggtggactctatcctgctttctcctccaacttggcttctctagaacctgctggatttatgataataattacttgccacctactgttttgataataaaacttttaggactgacatcctatgccataaatgtacacaattttgaggaagtgagtaaaggaaaagccacaggtaaatccctctacgttatataaacacagctccctttgaattctcatcagagacatgggcaagccagggtctttgggtgtaggaggagggagccatgggcatcagtcactgagagggccctgaggggtgggacagcttgactggtgccaagagctctgcacagaggggaaaggagaagtgaggaaaggaagaaagtgaggggaagaaggggtgggggagagagaaagggaatgagtggcttcatgcatgaggagaacaagctggaagtccccaacacagccttcctccctgctctgaacttgttcaaatcacccacttcctccgactatctgactatccccctatccttctgttaaagaaggcagggggccaagttcacaccagagctgccaccttagtgcactggcatgtgcaatgacgccaatttgaaaaacaaaggcatgctgggcagaaagagagagagaaaaggctggtctccactttccttcctaacatgcacgagcagaggttaagtgtatttaatacttttattcttgaaggttcttcacatccatctacaatcactgacttaataacttctgtccatgctacaccatcaaatgtgcacataaatttattaggaaagtagagaatcaggtcggcaattaaattctatgtgatataataatttttagaacagaaaactcaataatgaagctaaaatctcagcagtatataaagaattaaatatattccaaggtgattgaaaaaaatcatgactgaaaaaaaggaaaaaatatcatcatttatggctttatcaaaatcttgcatagattaatggtcattagggaaagaaaaactacctctctgcagtcatttgttgtaacatagaaaatacaagctcatataaaccatctcaaagaggaaagaacttgctcaataaagagttattggaatggaaactctaattattaaaatagtatttcctaaacattatgcttgaattaaatactgcagtctcctcctaactttggagcactggactatttcaataccaaataatcagtggatacttgaaaggtgactgagtagaagtaaaaccaatagaacgtcatactaaaagtgtcaatcagacctaacgagtcattctagagttaactattttaaaggcagtaaacgtatgccataataaaaccacaataccatttaattacacttttagttataatttctagaaggaatttgagaggacacgcaaaacatatccaaacaaaattaaaaacacatgaaaatagtattaatgctgtaattgtatattcttaaatatactttgacaataaataaggtttcaggtactgtgaaagcataaaagataacttaatagaggtttgtatatatatatacatatatatgtatacatatctacatgtatatgtagatatatgtatgtatgtatatatgtatatgtatatacgtataagtatatatacatatgtgtatgcagatatgtatgtgtatgtatatatgcatgtgtctgtatatacatacacatgtatatgtatatacatacatatatacgtatacatacatatatgtacgtatgtgtatacacacagagcgagagtgagagcccgtgcgaaactttgggatcttttaatatacccctaaaaaggatatacctcctgtaatattcctaaaagtgaatcacctagtttcagattgaaaactgaatgttcataagattactgccacacatagaaacaacgatgagagttaacaagtagaattgattattgctgtttgaatattattaaatttaccgacataaagctggggtgtatttttttgtacatcaaaaatggccaaatattggcagtttcatatggtttaacaaaaaagctatcatttgaaatatatgtgccaggcgttgtgttaattatgttaacatacttaatcttaattttcagagcttcatgagaaattcatgtatcaatttctgtgtgcataatattttcattttgaggtgggcatcatcacattcaagtcctctaggtttgctcaacacaaaaaggaaaacttaaaagaaagacatcattgtcttcagtaccccactccaagctggtaaagtcggccaggacaattctaataattaattcctgcttataaatctgtctctccttagagacacaaaaaacccttcaaaaaaccaacaaatccaggaactgcttgtttgaaaagatcaacaaaattgatagactgctagcaagactaataaagaagaaaagagagaagaatcaaatagacgcaataaaaatgataaaggggatatccccaccgatcccacagaaatacaaactaccatcagagattactacaaacacctctacgcaaataaactagaaaatctagaagaaatggataaattcctcaacacatacaccctcccaagactaaagcaggaagaagttgaatctctgaatagaccaataacaggctctgaaattgaggcaataattaatagcctaccaaccaaaaaaagtccaggaccagatggattcacagccgaattctaccagaggtacaaggaggagctggtaccattccttccgaaactattccaatcaacagaaaaagagggaatcctccctaactcattttatgaggccaacattgtcctgataccaaagcctggcagagacacaacaaaaaaaaagagaattttacaccaatatccctgatgaaaatcgatgcaaaaatcctcaataaaatactggcaaactgaatccagcagcatatcaaaaagcttatccaccacgatcaagtgggcttcatccctgggatacaaggctggttcaatatacgcgaatcaataaatgtaatccagcatataaacagaaccaaagacaaaaaacacatgattatctcaacagatgcagaaaaggccgttaacaaaattcaacaacccttcatgctaaaaactctcaataaatttggtatcgatgggacatatctcaaaagaataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaagaaagaaagggtattcaattaggaaaagaggaagtcaaattgtccctgtttgcagatgacatgattgtatatctagaaaaccccatcgtctcagcccaaaatctccttaagctgataagcaacttcagcaaactctcaggatacaaaatcaatgtgcaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccgctgctcaacgaaataaaaaaggacacaaacaaatggaagaacattccatgctcattgataggaagaatcaatattgtgaaaatggccataatgcccaaggtaatttatagattcaatgccatccccatcaagctaccaatgacttggaaaaaactactttaaagttcatatggaaccaaaaaagagcctgcattgccaagacaatcctaagccaaaagaacaaagctggaggcatcatgctacctgacttcaaactatactacaaggctacagtaaccaaaacagcatggtactggtaccaaaacagagatatagatcaatggaacagaatagagccctcagaaataataccacacatctacaacagtctgatctttgacaaacctgacaaaaacaagcaatgggtaaacgattccctatttaataaatggtgttgggaaaactggctagctatatgtagacagctgaaactggatcccttccttacaccttatacaaaaattaattcaagatggattaaagacttaaatgttagacttaaaaccataaaaaccctagaagaaaacctaggcaataccattcaggacataggcatgggcaaggacttcatgtctaaaacaacaaaagcaatggcaacaaaagccaaaattgacaaatgggatctaattaaactaaagagcttctgcacagtgaaagaaactaccatcagagtgaacaggcaacctacagaatgggagaacatttttgcaatctactcatctgacaaaggcctaatatccagagtctacaaagaactcaaacaaatttacaagaaaaaaaacaaccccatcaaaaagtgggcaaagcatatgaacagacacttctcaaaagaagacatttatgcagccaaaagacacatgaaaaaatgctcatcatcacaggccatcagagaaatgcaaatcaaaaccacaatgagataccatctcaaaccagttagaatggcaatcattaaaaagtcaggaaacaacaggtgctggagaggatgtggagaaataggaacactttcacactgctggtgggatgggaaactagttcaaccattgtggaagacagtgtggcgattcctcaaggatctagaactagaaataccatttgacccagtcatcccattactgggtatatacccacaggattataaatcatgctgctataaagacacatgcacacatatgtttattgtggcaccattcacaatagcaaagacttggaaccaacacaaatgtccatcaatgatagactggattaagaaaatgtggcacatatacaccatggaagactatgcagccataaaaaatgatgagttcatgtcctttgtagggacatggatgaagctggaaaccatcattctcagcaaactgtcacaaggacagaaatccaaacaccacatgttctcactcataggtgagaactgaacaatgagaacacatggacacaggaagaggaacatcacacactggggcctgttgtggggtggagggaggggggagggatagcattaggagatatacctaatgtaaatgacgagttgatgggtgcagcacagcaacatgacacatgtattcatatgtaacaaacctgcacgttttgcacatataccctataacttaaagtataataataattgaaaaattaaaaaataaaaataaaataaaaataaatctgtctctcccagtagactgtgggctcatggaagtcagggaccttgccttgttcatctttttatttccagggcatagggcaatacctgactagcacttaaaaaaattcacttaattaattatttactcagattaattgattgcttagtgtctagtatatgttcagtgtcgtataagccatggtatcctgctctgaagcagcttataattatcacaaagcagtacacatgataatataaattaagtgctgaattgtgcaaaaccatggcagatacttgtgggaaaggaatgctgtaggtaataatagtaatagcagctcacatttagctaaggcagtgtacttagcaatttaacttcattaactggttcaatcatcaaccatccttggaggcaagtacattattatctccattttacagatgaataaactcaagtatgggaaggttacataaactccgtcagtcacacagatctggaagtccaatccagatagaacaaaactcgcaacgttttttcacctttttttttcccatgtgtttaaattctatttcctctgtgctgaagcctccacaagtcctgtaagtcagcgatttctaaccatttttgaatcatgaaccttttggcagtctgttgaagtctagtgattgtgatctcttctcaggattatgcttttaaatgcataaaaataagtccatacgattacagagaaaagcaattataatgaaatagttataaaattattttaaaaaacaaatttgtgttatagtagtatgtgtttctatgacaactcattaacaaagtttaaaaagggatttaagagtaatgtagtttcggtgtagttcatgaacacaaacatattttgagagagctgcagtggaatgtaatgtgatatgaaaatatatgtgtttcttttggtgataatgacacaggcactgctagtactactgtactttattgtctaagtcataatataagtaaatgctatatcttagaggttagtgaatataaggatctaatgttttcccatcctagttcacagaccccctgaattctatccagattaaaaatccctgtttgcaaactacaactcgtccattttactgtgaaaacatctcttttatatatatatgtataggtatatatgcatatgcgtgtgtgtgtgtatatgtggatggatggatggatggatagattgattgatttagggggtataagtgtagttgtgttatatcatggatatactgcatggaccatctgggcttttagtgtacccatcacccaaatagtgtacacgtacccaataggtagtatttcatccctcacttccctccccccaccctctcattttgagaaatgcaaattaaaaccacaatgagatagcatcttaacaccagtcagaatggcttattactaaaaagtcaaaaaatggccaggcacagtagttcacgcctataatcccagcactttgggaggctgaggcaagaagatcacttgagcccaggagtttgaggctgcagtgagctttgatcacgtcactgtactccagcctaggatacagagagacaccatggtcttgcctcacatgtaggttacaaatgccgggaatatactctaatccatactgaaacaggaagtacttaagagcaaggtagaaccaacacgccctgcaggacgcctggatgacacctcacagatagcagatacctatttacaagataaattcatccatattttatatcatccccgtgtccctaaaaagagttggtgtctcctaaacagtttgaattttttttttcaaatagtgtttattcaagacagtaaattttaactcaccagcttaaccactctaaataaaactcccattcacccatctggattcagaggcaaaagaatgcttttcccaatgatcttatgaaaataagattctccatactgtcttatagaaactgtcaatgacaaaaatgaatattcttgacaactgtaagggggactatgtctttagtatgttttatgttgtgtcaaatgaaaattatcctcccaataagtactttgataatcaatacaaaattaaattttataaacaaaaccaatagtgtactaggaaacagacgaacaatgactgtcttagctaatcacaggcttgcgtacgttacttgtttaatgttccatgctttccaaaagcttaatctatccatttttatgacactgaaagagaaaagctttaaatatgtcaaggtgaagccagcccccactgtgactgtgctaacacaggtacacgtgttttctctcaagatctatccctgaagccaaagaaaagaaataaagctctaaaatagaagcttaatgataaaaagaactattgagtaaatctgacagaggattagcaaacgacatgcacgaaactgacttaagagtaacatttgagcaaacataaaacttatgatgctgtcagggtcatagagtcagggaaatgggattatttactcttaaaaacttttaaaaaagaacataaaagaaaattgtaaccgtaaaattaggaagagcttcctgatacaaaaaaaaaaaaaaaactatccacatataagatagagtttgcttgaatgaggtggataactaactataggtgttcaaagaaacattacttaaccttaagctgacaagataaagtaaaatgaataaaactaaataacttcctgaggaaaggcatttaaagttaaagagcatttccctgattaatgaaggagtaatcctgtaaaatggaatctgtggtcaaatggacctccccatcagaaagcttcagcagtgccacggctcagaattcctctaagtactaacttggcatttttccctcatgaaagacacagctttgctgacactggatttaaagaaccaagggtatcagagagcctgataaacaaatgtgcccttcaaaggattataaataggtatgagcgtaaattctttctgaactggggtgccagtttaaagtattaagactatggcatagcacaaacataagcatctcagatctgtcaaggtcctacctttgcaatgtgttagctctaaactgagcagcctttccttgggcctgggaattagaaaatgctacactgaagtaaattgcatgtgcttctttctgttattggcagctacctagcttgggttaaatttctaggccactggtgaaattgagaatttacaccagatttacttacccacagcccacctatatagatgtactatccttttttaagaatatacaagcagaagaaaagagaatgaagagttaacagaggtctagccctgccctctgccacaaatttgctaagtaggcatgaaaaattgacactctcagtttcacctaaaaatgcatgaagagagaagaggaaaatgctcaaacaagatgttttcctcagctatcctcaagcaacaaaattctacaatccatgcattatccagtcttcataacaaaatggatgccatcaagaatgcaggcaactttacagaacacactcacaggcagcagaaacccagatattgtatacaacaataggaatctcagacatgaaaacacattgtgcaaattcttactcaacacttaatttaaaatgccatccttagaatataagaaaatatgaagtgaaacacaatggttaatatcaaaaacagcaaatacaatgtgatctgcagagctcagtgcaaatttagaatatcacttctcattactggttatggatttcatctatgaatgtgttgacattttttatctcctcttgccacagcctgccaatcttggtttacttagcgatcaacaactcactacaaaaaaaataggctttttccagggcattattgcaaagtttaaaaggtatttagacaggtcaaacatcccttgaaatatgaaaagtaaatttttctattccaaagtaaaatgacaaaaatttttcatcaaaatatttaaatgccaatcttcccagctcctctctctctctagcttacaaacataagaccaagcaatgcagtatatctatcaaggataaaaaagtaaggtaattacataaaattttaaaagcctgaaaaggctcttagtttttacaaagaaatcaataaacaactgcaattatttttaagtaaatatgaagagttgaggtataatgttaggggaagaagagagataagtgaaatggaatgataccaatctgatagctggtggtagaaaattggagtagatattcccaaattccttgggaagaagctaatttctgaagtcaagttccttggtattctagactaggaagtaagagtgtgtataaagattgaaaaacaatgacctgaagatttgtcctgaaagtaaagtatcaagtcatgctcctttatttgttctttacagttttgggggactgcaagaatacctaggataaaggaaagagaagtacaacggaagaaattaacattcagacacttgtgcaactggagggagctttgtttttatttttttcaattttatttattttaaatttatcttttgatacattatatttgtacacattcatgggggcacttgtgatattctgttataggcataaggtaacactaatgataattttcttacatttgtaatgatcaaattagggtattcaggatgtctatcacccaagtatttattatattacaagtcgcctctcttctgttttgaaaaatacataattgttaactataggcaccctactctgctatcaaacattagaactttaactgtatgtttgtatccattacccaacctctctttaccctctatccaacacctgctcttcctagcctctggtatttatcattcgtttgctacctccatgtgatcaactctcttagattctacatatgagggaaatcatgcagaatttgtcctcctgtgtctggcttatttcacttaacacaatgacctccagttcaatccatgttgctgcagatgataggatttcattcttttttttacggtcaacagtattccattgtgtatatatatcacattatatttatccattcatctgttgatagacacttaggttgattccacatctttgctattgggaatagtgccacaataaacatgaggatgcaggtattcttttgacatattgatttaatttcctttggataaataccaagtaatgagattgctgaatcttatggtatttctatttttaattttttaaggaaactccatactgttttctgtagaggttgtactagtttacattcccaccaacagtatataggaaatcccttttctctacatacttgtcaacatctgttattttttgcctttttaataatagccattctaactgaggtgggatgatatttcattgtggtttttattttttcatatacatgttggccatttatatgtcttcttttgagaaatgtctatttatgccctttgcccatttttaacggtttttttttttttttttttttactgttgagtcctttgagctccttgtatattctggatattagtcccatcttcccccttctacagatagggaaacagttccaaagcaatggcatgagttgcaccaacataatcagctcttgaggagaacctaaatcacagaggtactaatacacgaggggtggtaactggaatgaagaggagcagcagcagagggaagtatgatgtaaatcattgttatcagtgatttataatcatgaaaacagaatccaaaggaaataaaatgaagtgtagtctctacctgaaatgtgaatgtgtctttcatcctaagagaacagaaaatgagtgaatattggaggtaagaaacttacaaaaaattaatgcaaaatacaaaaaacaaaatgaagaaaataatcacatcataacagagggttaagcatcttcttagtgtataaacaatgcctatatgaatcagtattaagaaaatgaacatgtaaatgggacataggacatgaacagataattcacaaagaaatatgaatgaccaatatagaaatgttaaacttcactaatagcaaataataataataagggaacctaaccattggcatttattttatgataataccaaatgtgcaagtaaaaacagcactcatatatggttatggtagaaaaacctgttactactttgagggcaatttaataatctgtataaataacctaaacagtgctcatcacctatcacccagtaattctacttgcagaaatttatccaagataataaacttatgactatgaacaattatttcagcatttactttttaatagtaaaaaatgaaaacataactaataagcaagatattaaataatatttagatacaagcacacaatgatttattatgcatttacttaaaaccatgtttatattgagtatctgatattaaagtatgctaatgtcatataaatcagattccagttttatacatacaaaacagaaacaccaaactgtaaaaggagttgctatagctattgaaattatacaggcggtatttgttttctttttctctctttttataatgtactatttttagagcagttttaggatgacaaaaacatttcttattttaaatatttcttaaatttgccaacataaacatatactacttctattaaaaagtgttcttaaaataatatcacagtagaaaatttctgaatttcacaattcaagacattttgcaaaaaaaggccagaattagaacatttttgagataaaaatgagtactgttccccaaatttcataataaacatattgaaaaatttttttttaattcattgaaggaatgaaggaatttgtcccattataaagcaggaaatctgaacagcaaatggtggtgggggtgggggtggcaacaacaaagctgattttaatacttttttggtaacttttaaaagattaaatacctctctctcatttattctttggaaccaaagtagaacataaacaaatgaaaacagtaagaaaactatacatcctttctgaaaagttgtgaacaaagccaagtcacaaattttttttttttttaagaagctctagcatccatattttgtacaacagcagaacttgaaagtttgtattatgctgaaagcagctagtaagcaactgtatactgccttttggaaatctacaagagaaagaccatttacttttccacatgtccactgtaaatcacattgtcatttgttatatttggataaagtgcacctgaattctgtgaaacagaagcagatatctgaggggaagaatagcttggaaagtaacaaattgcaatcaacctatgtttacctaactgcagagtcagatgatgtttcctaaattgaaaaatagaccaaaaccaaaaaatggccaaaaacgaagagcaaacacttgtagaatttgtgtacattttagcacttcctttagacaatgaggtgcttaaagaaaaaaaaaaggtgaagaggggaaaaaaaaacccttcaattaacaaaaaagatgaaagtgcagcagaatcaaacaacaattaggaaccgcaaaattatcaagattataactgccaacttttattaagtagttaggtatgctacctgccatttctttcttctcttcctattctggtccgtccctctaccatcatgtctgccaacttaggtggtttagatatttgggtcaatttttaattatgccaactgtgtgtgtgagaatattgaagaaatttcacaaacatacttctttattattcttgttacttataatacttaagacatcttattaaaaatatgatataaattatattgttacataaaaatcattatcattcctcagtatatgcttttatgtaacatgttgaacagtattcatagtaaatattaattataactaacatatacacacaaagacaccccccacccaagaaaacaccacatagaaatacccaaaaagatctaatcctggaataatctagctgaaagaaattatttcctttaaaaaaatgtaccaagaagaaatgaattttgtcaaataacgtggagaaaaagaaatatatctcgggtttcataccaagatcccaggtattaaagtaaaccgaatatctgaaggtacaaccactataagaacagacagaaaactttttttttttgagatggagtaattgtctatagactatatagacctacaatcaagatggaaaaggctattcataaaaatcattcaagaaatagcaatcataaagctgagagagaaaaataatagcaaacagattttgagaaaatgtatatactacgagtacaaagatatcttttcaatttaatttgtaatacacatttattaggattgttcatatatatattgttgaagaatataatataatatatattctaggattagatctttttgggtatttctatgtgctattttcttgggtgggggtgtctttgtaatatatatttgtgtataatatatattatgtaataaatacatatatttacattatatattatatataattatatattacatatcattatatattatatataatccttcaagccaatccttcaacatacattatgtatataatatatatacattatatattatatacataatgtatattatatataatatacattatatatgctatgtatattatatgatatacattatatatgctatgtataatatatattatataatatacattatatattatgtataatacatattatatacagattcagaaatggctatcacagctaaaggattgtaaacataataaatgagcaaattaccacttaaagattattaatagttgacaacagctgcatacagcaaacaatatatataacatccctgaaaacacagacttcaaatgatgtaagaagccacaaaagatcatagaatcacagaataactaggttagaaagaacatgaaaggccaaccatgcttcatatatatctagcatcttcaaggaaacacaaaatcatgaaatgaaggacaatcatattcaaaagaaatttcattacaatacaaaagtaatacttttagaaaaagagaattgtggagaaagtaagaataaaaacaagatcaaaatatacagtttctagatagagcaataagtactgcaatacccattcactcagtcatcaagtattcattgaatatatttgtgtgctaaactggggatacaatggtaaacagaaatggctctttcatggaacatacattctagaagttataaggtctgcatcaatatggttctcaaatgacaatgtgaatcaaaattatcaaggctgtgaacaaatgtgatcccaaaagagccaatccttcaagatggatcccaagtagctaactaggtttacattcaaattgagtcaagtggccatttgctgactagaagtcacaaatgttactctgagttccctgaaaattcacacctctgtttaactttgggacttcaggaactcacctgaacccaccaatcagagctcacctaccttgtccaatcagggcccagtgatatccaaccaatcagaacttgcttgtgttgaccaatgagagctaagcaagtttgaatcctttatttgcataagtggacctgactgggaacctagtgcaaaatctttcactataaaatcagagcccattgcttgagtcaaggatttctaggccacagtaagctatgatcacatcactgcactctagtcggggtgactgaatgagaccttgtctcaaaataaattaaattaaaaatcaaaattaaataaatgaaattgcttttcagagaacttttgttcacaaagcacaggttcaaaattcagatgttgaagccccattctcagaaattcttattcaacaggtcttgtatggaacctaagagtctgcttttagtcagctatggtggtatgaggtccttagctctgcttttaattagctatgcagtattggacaagtcacttaacttcatgagtaagatgggaataattatcttgtttataagacttattctaaaatataaatatatatttaaatatattttaatttctctgatgtctgagattgctaatagattttgaagtgcccacagtacctgacataggtatattcaaaatggcaactgtgaaataacgatagcatgccagaaatagtaaaaaaaaaaaaaaaaaaaaaaaaaaaaaagaaaaaaaaaaaagaaaatctggattcacatttaactcggatgcttacaatatgtaacactggaaaagtcatttaacctctatgagcttcaatttctatttatgtaaagtgtaggtaataatacttgcactgtttattgcaaggagatattgaaagaagaaaagttaagactgttctggtaaactataaaaattactacataaaagtaataatacataaataaaacataaagatcatgatcacaggaaaatatgcaaaatatacttctaaaaaaatgaaaggcattttgggaaaaaaattgagaagcaacttttctaccttatttttccaactaaatttatttattcattcaagagtttgttgcataccaagtgtgtattacctggaaaacagtaactccacaaatgcaccccaggaatgcagactccataatgagcatcacaaatcttaacaccattttgagacgtgcacaaagacatgttagatatagtttcacgactaaacactagctggaaatacgaacagaagtatagaaaaaccctcggtcaccaagtcaaaccacctcttcaatgcttacatctctttctgtaaaaatcctagcaggtagtcatttaattccactggttagcaatccaccaattctaagagaatcatctggaaagctttcaaaagcatgaattctgtaagtctgattcagaaagtctgagacagaaccccaggacctgtttctgtagtatgtttcccaagtgactgtgaaaggccactagaatcaagttgtgatgctatactcaaccagtccattctattttggggcactgcaaccaaactctagatatattaggttgaaatcttccccacttcagtttccacccaagtcctagttttactcttgggattgcatacaacaccataaaccgaatctgtctacaggctaaacacccccagctccttcaacttacatatggcatgtttcaaacctgatcactaaatttgtgcactttttttattcatatatggtgcccagaagagaacataatcctcatgtagaacacaatggggatactctctccttcactggagttacaatatttttattagcacagcttgtgtgcctttttttcaatctgtattctgttgaaatgtgtgcctttttctaaactgtggccacatcatactacgcttacttttaaaaactcacttattttgaaatattctaggtttacacaaaagttacaatgatagtacaaagaactccctcatccccctgctgatccaatttcagtttccctaaccttatcatcttagagtgcagcagtgcatttatcaaaaccaaatataagcctactgtttcactaaaaactttatatctttttatacagattactcccctgagctacatttccttcatcccaaatacagacttttggcttttctttagtttaagtacatgaggcaaatatagaaatttacagttaatactgtaagattcaaatattgaattttacatgatgaaatcttcctctgactcttacaaggtgaaatctaaggtcctatagatgttaaaattttgagctcctataacttgttaagatattctgagacaaggtccagttggacatacccactcttgacattagatttatgttatatacatatttagtcagcaaaacttcatttaattcaataggctgaggcttggggtaaggtaaacttctctagagttgcattaattaacctctgatgcataccatcactattacaaatccaatcagttaacagtacatccaattacttaatatttttacacaaaaatattcttgcctcaggtaagttcagacccattgtatctccacattttcccttgtttattagtctaatatatattcgcatattatgcttcttcagctgaaaggtgttgagtacctgcacaatgaaaggaatccattccctcaaatgactctgaattgcttatgcaaaaagtgaattctctaaactaacagctagtggcaactcactgaagcagttaatgaccatgtgtgaaaactggtgctcataggaaatccatagagaaactcctatgagtcacaagctagaatcagaagaaacagcagaatggtattggtagtattatttctttaggaagcaaagagaattcaattcatcctcttgaaattagttactagctttaattattataaagcttagggaacaaaattgcataagatagcaatttactattgaaatccagatttaaaaggataatttagacatgtggacctaaagatagctatagtcagctgtatcaatcactgccagaagatttttctaaatagtttacttctcctcaaaagatgtgactaatttcgattctgtttatctctcaaaaccaggctgtggaattagagcttttaaattgctaaatagaactgacaatgctttcaaaaaggttgcaaattcacagccttcctgtcagaccagcaagcttctttaaaatgagaaacccataaaaataataaaactccttttaaaatgcatcggaaagccaaaaacaaagctcttcaaacttacctcataataactccgaactgcgttgcaaaatgcttcgtcagctacaatttgggtttccccattgaggaaggcctggaaccgttctttcagtaactgcaactgttgtttgttaagctacaagaaaaagagaaaataagcagataaattggccagtacatgaaaaaataatgactattaaaaatcatatttgctgtatattagatttcacatctagaattaactttatagtaaagaaaaataaaagctaaaacatcctactacttgttctaatggttagacctccatctcaagatggagtcaagctctgtcttccaggctggagtgcagtggtgcgatctcggctcactgcagcctccacctcccgggttcaagcgattctcctgcctcagactcctgagtaactgggattatggtgcctgccatcacgccttgctaatttttgtatttttagtagagatgttggccagactggtctcaaactcctaacctcaaatgatccgcctgccttggcctcccagtgtgctgggattacaggcatgagccactgcacccggacactaatggttagactttaaaacatttccaagccatttcatgtactctgtaatcctgatatggaagtggaatccaaatttctaccccaaatttccagaatcctgatatggaagtggaatccaaatttctaccccaagtttctatctcaaatttccagaattcttgtgattgccacaccagtttcttcatagagacagggaaaatataaaatttggataagaaattaactaatagttaatattaataatattatacaaaatcgccagctgttctaaacagagaaagtagagaggagcttagagatgagggagggatgccttggacaagagttaataggaagaaagactgaaaagacagaacgtaccctaagaaagatccctctggaaagaacagccattgcatgccaaaatttggattccatgaacaaacatacatcaatacctgagtttagataattgaaggaataataaggagaagacaaagaagacaaatccaaaagagaacagagaggcagcaggtaggcagtgaatgcgtctttgagcacataggagaaaatgctctgaactggggaagtttacaaccaagggtccttaccctgggtctagcttccataattaatacagagggtgaattagacatgaaatgtgacttatcaatcatgtcctctagtcatcaactacaagcagggtgagctacttaatttgtagggcccagtgcaaaataaaaataaggagcttcttagtaaaaatattaacaatttcaagacggcaggaacagagagcattaagctgagtgcagagcccttctaggcactaagccctgcacaactgtacacacaggggcatgtacttcactagaaataaggcgtcttagatcttaggtaatgcagaagctttttttttttttatgcttaactggagagaaaacaacatagtcttggagataaaacaacaaattccaaaatacataagaaacagcaaaggaatgatccttccatttcattcgatcctgatcagactttattaacaaactcattccagttctggaatctacagagggatgtgaagcatctggaaacatactgaggataaaatgattaaaggattaggaagactaaacaaactggtatgacttggctcaaaaagaaggctgatgtgaattaagtataaatctgttcaaaaggcttattaaactgccattcaaataaaaggaagacaagctctttcaaaaaatgggttttatttaggactctaacaaataagacagtttttaaagaaactgtagctgggagtaacagactgatttaaaaaaaattaaaaagtgtcctattgtacccagggggggaaaaaaaaaaaaaaaaaacttttgccatgggcagcgaagaaagaagaccattccatctctttactaagattatctccttcattttagaggaagcttaaccaagctgaggtgcaggaacatcatcattatattacaatctccatttctgtaatattaagaaaatggaagcaggtaccttttgtatgggtgcatactagcaacgcaaattaagttcatgactttagctctctaggcatgattcacaaaagggaccaaatggaaatgggacagcaattgctgagagtgaggcggctgaaagcactatagttactaagctctgggaatgccaagaagagcttctccttgcaagccaagtaaaataatggcaatggaaatgtatgcaaagaatgacaatgaactgaaggagaccttactgatcacttgtgccaactcctttgcttgataaataaaatacatactcttcaaaaactagaaactgtgtattttttcattcaattttattttatcaaagatatcttttttgttctttaaaactcttctaaactacaatatttgcaatttctacatcattagtatttaagttccgctattataacagtgagttactctttggtaattacagtgtagaaaattcatggatatgaatcaaggaaaggaggtttgggcaaatcatcttcttggaagctccaacaaagttgatatagttcacaaaataagccagagtcacctggctaaatgtcaggcttcaatatttttatgaatagaggatactgcagttacatttaagacataaaatggatcaaatatgacaattacatacaaaaagcaaataaatgaatactttattagcataaagaagaagtctactttttcacataggcaagatggggcaggaaaagaaaactaaacttaaaatctagcactggggatagctgtcagaaagcagtttcctaaaagctatttgcattatcaagataaaccagactgtataccaagagatagaccagtggaacagatcgaagaaacagaccgaaatacaatcagaaatgtactataaaacacctatatagcaactcaaatcagtagtaatggatggtctactcaatgaatggtgttaaaataatataaaagatgttccacctcatgtcatcagggaaatgcaaattaaaataatgagatttactacaaacccattagaaagaacaaaatccagaacacagaaaacacttgatgctggcaaggatatagaccacaggatctctcattctttgctactgggaaagcaaaatggtatagctactttgtaaaacaggttgatggtttcttacaaattaatacacttctatcatatgatccagtaatcacagtccttagtacttgcccaaatgagttggaaatttatgtccacacaaatacctgtacacaaatgtttaaagtagcttttttcataattgcaaaattcagtagatgaatggataaactcgggtacgtccaacaatggaatattatttagcaagtaatgaaataagctatcaagccatggaaagacatggaggaaccttaaatgcatattactatgtaaaagcagccaatataaaaaggctacatactgtacgactccaacgatatgacattctggacaaggcaaagctatggagacagtaaaaagatcagctgttgataacagtgtaggctatgcatgtgtgggggcaggatatatatgggaaatttctgtaccatccactcaagctcaattttgttgtgaaattaaaatttcataaaaaaataaactctattaaaaatactgaaatgtcatcaatttatttgcattaaaaataaattttacatggcaaaaaataccataggcaaaataggaaaagattaactagaaaaaaaaatacttgcaactcattacccaaagagttcatttctaaccatatagagagttcctagaaattgataagaacatcataaataaaccaacagaaaaatggacaaaattgatatgttcagataaaagacttaatccatgaaaacaagcctacattcataaaaagaatacaaattaaaactgtatgagaagccattttaaaggtacatatccttggaatcagcaattccactttgagattggatcaatactacagatacacctgcacatgtgagaaatgacatgtgtagaaggttatttaccacataattcttaattgcaaaaacaaggaaaataacctaaatgttcatatataggagactaaattatgccacatctataaacagtggtatactattcattgcattaaaagaatgtaaacattctctatgtactgattttaaatattttaaaaatatcttggggcagaaagcaagttatagaacagcagttaaaataagtcaccactcacatagaaaatggataaataacatgtatgtgaatttgcttccatatatagacagaaactagggaagaaggatggctgtgggaactggacagacagaaaatacaggtaaaagagatttttcaacattagcactttattcattttgagttttcaagtgaaacaacccttaaaataagctataacagcagctttgtacatcttgaaactcaaaacagttatgaagcactgtgaataccttaaatcctatcctacacggagactggacagcacaccaattttttccattctttcaggtaaaaaaacttaccttgactctgtgtctatttttttaaatattacaatcttgaggatttcaaaaagcttaaaccaagatcctattcaacattctaatcaacatattaatctgtacaaaatctacaaaagtagactttcagattccagttgggcctattaatacacacacatatacatacatccttttattatctcagtgaatcctattctaatttggaacaagtataaaaattgaaatcagtgtccctatggcttccatacaactctagtactatacactatctaagacaaaacagactgttactttcattctttaacacagcagttcaagactttgagaacaaaataaaatgattatttaagagttttctcttttctagaacaaattttaccagttcgctccaatatcctgggtactctcctaaggatacattccagtttgccataaaatcaccatgttaaataaaactaagtatgatggatacttggatgcaatggatcataagttctgagtttacagatgcgcagagtcgctattatagcttttttaaaaatctaaacaaactgggcgcagcggctcatgcctgtaatcccagcattttgggaggtcaaggcaggcggatcacctgaggtcaggagttcgagaccagcgtggccaacgtggtgaaaccccgtctctactaaaaaaaaatacaaaaattagccgggtgtggtggcatgttcctgtcgtcccagatacttgggaggctgaggcaggagaatcgcttgaacccgagaggcagaggttgcagtgagccaagatcatgccactccactccagcctgggtgacagagactccatctcaaaaaaaaaaattaattaaaatatataatgccctttgatataaaaattcaaaaggaaaacactttgaaaactataagattaagcaaatgaaactcactacaatagcaatgtccctcttaaaatgtactagatagactgatcaccattctcttaggatagtgtggccaacagagagataagtgagagggccacttcccacattctaagcattctatgtctattaattcaaactaaaaacaaattaactcttcttggcagtcacatctactgacttacattgtgcttataatcaacaaaaacttctaaaacattcttacatgtgcctcagtaagccatgttccatcttgctagatgtatctgagccactgttctagttaagaattattttggaattctgattccttcacctgatgactagagagctctcttagctttgttataatcactaacataataacatattatccatagtctcctccaggtcgttttaaaaatattcatcagttcaggattaaggaaagaatcctgaatcctgccattatatatactccttcagtttaacataatcaattaatattatttggggcagttgatttattattatttagcatatgttttaattttgtcttcagactactgtatttaccaatgaataaaatatttttaaatatgaaggaaaatttgaccagcagaaattatctatcaggaatttataaggcacatcctatataaaactaaattgcagaaacttaactaaaacataaatataattgcaaacatctaaatacaaccaacagattagccttgtaaaaagaaaaaactaaattttataaatctgacctggctgtgatacttcatccacaataataactgccaccagaaaaaacacttagattctagggttcagaggtgtctcatgtttcctgttttttcatattcaaattagatttcatccttttcattctgaatcatggatcaactaaagacttaagccaggatttatactactgcaggagaccagccaatatgcaacccaggaacctagcaaccatggctgcatggagcctgccctgacctgcagaacccatcaggagtctcagtacttacagtggaagctgtgtgacatcctagcaagtaaaggtggtcacagtcagattccacagcaaagtggcagaaaacttgtgggtccctccaggattggggcatgggtgtgcatttacctcatgtcaaagagtaataaaaatgagaaaggtttttcaaaaaggtaaaagtctttactctaggcacagatgtttcttaaaattcacaaacgcatagctttaaggtttgtcaattaaagaaagatattaataggaaaacgctaaaggatcagtactattttcttcttcccttcctatcaacactgtcaaaaacagctacatcaaaccactgaagcaaaatcatcagtgtcttccatgtttttgaaataacaatgcatcccaagctgtatatcagaaaaatagggggttccagctacgtctcatacattataaaccctgtgggatgtgctgatattatcagtgtcgtattcaaataaactttcctgtcctcttccataagcacagatatttgggacagtgaataaatatgcccatctaattctacaaatatcaggttcacttgataggtatagacatggtcaaatgaccaagttaagaccaaccagatgcaagcaaatgtatgcctgacttccaggaaactgtaacaggtggctaaagtaaacacactttgcttctttctcttttttcttttcctgctgaatggaatttgatgtgctagctgaagtttcaccttgattcatgaagatggtgaggtggcaagataaaaagtgcctcacaccacagagtggagcagcactgcaaccctagaccacctacctcccaacttccttgacatgagagagaaaacctccatacatcctgaccactcttattgggatttattggtaatatgcagttaacagtaatatggtaccatacctaaccagagggaaaataccatggtactatcgtgtgtttttttgtaagaaatgttcatcttaatttattctaaaacatttttccatgctatttcatatgaaaaactccttatccaataaacttgccccagcgaacagtgaacacctaagctggctggatatagattgaaaacaaagttattttggcaaaccaaattccactgtcacacagtgttgacaggacgatttaaaagcccaaaatttataaacaccatattaatatgttttataataaaatgtaaactaagtgataagtacagaacagcaaactcccattgcatggtggacaaatggaccccaacccagtctaggctcactcagcactaagtgaatgacgcctacccacattctcattgatctcccagtccgattcaaacctcagcaaaattacatgtcatcatggcattgtctggcgtgggcagggagctggtgaatgctaagctccaaatgttaaatccattaattattccatgagtttccttgtcatgttctactgactacattccatgtacatctcatttttctttttttttttactttattgaactataactgacaagtaaaaacgtaaacatttaaggtatacaaagtatacaatgttttgatatgttacactgttaaataattaaaactaagctaattaacacacccatcatcttacagttaccttttgtgtctgtgtgtgtgtgtgcatggcaggagcggtgagaacatttaaggtctactcttagcaaatttcaaatataaaatatattattattaattatagtcactatgctgtacactagatccccagaacattttcatcccacataattgaaactttgccctcttctaacatgtctgattaatcttcttaaaattctctatatttgttacaaaggatgaaactaagctcaaagaagttaaggatcttacttaacctcgcatctagtaagagacagggatagaatttcaaccagcatcttgatcccaaagcctatattctttccgattaccatattattccgtttccctcacagctacagacttctttcaataaaaggtgtttatccctacgcaatgtgttgtatacagcttgtaggcatttatttgcttattatttaagtctttccattagaacaaaagtggctttaggataagaacttggttttagcctaaaaccaagttcttatcctaaagccgcttttgttgtagataaggcctagcacatagaatatcctcttttttttttaaagaatgaataaatgaagtaagggaaagcaaatatcagttggttgctatgaaactattccctactgggatagctacatcctctattctcatgcttgcctgaccccacaaaaaagtcggtttatcatgcaataataaaaattccagataatttcaacacaccacaatggatcagaaaagtctatcatagataacttaacctattttattaattagtaagtttatgtattactaacggggaagtagaaataataagagttctgaagtcagactacttctgtttttatccaagattcccctacaagttgtagggtcttaagcaggtcccttaacctcagtgcctcaagttcttcatctatataataaggcagtaaaaatagacatctaatagggctgttgcattaaatgatagaataaaaatacttaacacatattaaatgctttataattgccatgattttagaaatacatggtcattttatttcagcaattgcagaagccacaaacaaaaacaaatattaagatggatgcccgtgaataattaacaatagatggatccacagttgtgctgtccaacacagtggtcactaaccacatgcagctattgagcacttgaaatgtggctaatccaagttaacatacgttttaagtttgaaataccagatttcaaacattcagaaccacaaaaaaagaaaagaataaaaaaatacctgccaacccccacattatagataagaaaacagactgagaggttaaggtacagacccagttaggtcatagaactgggagcctaacctaggtttcctgaaccccaatccacagtttttactctatcacaggggtgtccaatcttttggcttccctgggccatattggaagaagcagattgtcttgggccacatgtaaaacacactaacactaacgacagctgatgagctaaaacacacagacacacacacacagacacacacacacacacaccctcatgttttaaagtttacaaatttgtgttgggctgcattgaaagtcatcctgggctgcatacgacctgtgggccagacaagcttgctctatcactacattccccttacccactgttatattcttatttgattctaggtcttcattcacctgagccttactaatgataatcaaggtaagtgctgaggagttatttaacaggactctccctgaacatagtaataagtaactaagagagaattggcaagtcttgttggtcattatcttccaaaattctgctttaggactctcttattcattgacagcgtctgcctcactcacttctctgagagtgaaaaggaccatgataatagcctctaatggtccccactaacaatgtaacctcatcaaaagcaaatgtaaaccaattatcacaaatagcagcctgagtgatctctgtggcaaacagcaattgagagatgactgtggaggcagagagttgaagagaaatagaaactttaatgagccattctgagaagttctcattgcaatagaaagccattccccccaacacccagccacccactaagatctgacaaaatccaggaggttttgcaaacaagtcttctcagacatgtgctatggaaaaaaggaggggaaggaaggaagctcaacacacactgtgaccctttaccgtcctacaaaatagaaaacagagcctgtcataagccagagaaaatttctacccaacgcttttctacaaataattccagtggactatgtcaaattaaataatgagggactcattctttagaaacagtatgatatccccttgactacccttaatatatgtctaatgtaacaactagtcataatagctaacatttattgaccatttactacacactcagcacaattctaacctctttacatagattattttaatgtcagctccctataaggtgggttcaatgtttttttccaaatgaagaagctaaagcccagagaatttaagaaagttacccagttcacaaaatttgggggcagaaccaggtatatctgactgatatgctcttagccactggctacacttggggccaatcacatgatttaatcagcttgaagaggtaaaagctcctctcctccccatttaccttcaaaacgccgtcccattcatgttgtttatgtcattgtgcctttgcacagtttgcttcctctgcctagaataccatagaacctaattaagacgacacctccaagaaatctccttctttctgctgcccccaaattatgtcatcttatcctctttgtgccacttctgtacctcatacatacatctgtcacttgcttatgtggccttttccttactaggatgcagatttcttcaacgcagatgccaaccttcaatatatcccaccttaagtacagtgtttgctggtgtaaatcatctacagtagaagaaaattcaccattcactattactttttgaagaatatatcttgtcataaccattgagcaaagactccagcactgaagcaagtgagtgaagaggagggagcagacaaagcctaagaaaagaattctaagatagctgtatgttgtccaaataataagttcatggacagactcaatgaggccaaaagaagagcaaaggatttctttgttgagatgcagcatgggtagctctgttttgcagatgatatcactctcacgcaggaagaactttgtgcctcagtaccatctggcatttcatggcacagatccatatgctgaagccatatttgcaagaaacagtgactttatgtttatcacaaagtattccgacagcctcaggagcagacaactgtgagccagtgtaaaagcttaaagatgctgaccaactcatgccacacaatggccttttccagcaggcagtaagtggtttaacagagttgctttcagaagaagaaaatatgacataaaattactttcctcagaaatgtctgaagtttttgctttctttcttgaccaggtattacatggatgagaagtggctatctgcaaaagaagaaaagtagcagcagaaggcaagggactttcagctcatcatctttgtgcaccatccttctaggataaggagtggcagactctcaatatgataaacattaaggtctatcttacacctttaatgtagttagaatgcttttcactgaaagtaatagaatcctcaactcaaaacgccctgttaaacaataagggggtgggggagggattattatcaggtatctcaaaaagtacaaaagtaagagaattccagagttagttaatttaactcttaagtgaagtatttcagggccctggccttttccacctgtctacattctccacatgctagcttttgtcttctagtttactgcctccaaagaaatccacattaactgtgcaaagcatcctcatacaataataaaccaaaactgaagaagaaaataattttattctaagaaaaagggagaaaattctcccagaatcagcatcctccttctgtcatattttctcccacgtatcactgaagaattgattcaagtgtgcattcctaaagaaatcaatgggtaagggaaatggaatatcacgactgaccaatcaagattcactctggggactcaagaggaacccagccaccactgtataataataggtgcctaatagctgattaaaaccaaggatttgtgagagaagaagggtagtcagagaacagccactggataggcaactagcactgctgctctgtcctggcctatccagtaaggagacctgaactagcaaactgtacataaaagactgagactaccaccttctaatagctaacttgacatttccctaacaaataacaaaattctgctcagtacctaaaacagaaacattagctgcaacccactttaaaataatacatttcaagtaaattaaattatattgattagttattgcatttatattcatgtatttagggacataaaatgcaaggatcttattactccttttataataaaaatcattttatatttattaccttctttaaacttaccaaattttagtggcaaaaatgccatgctaacttcaatacatcattgttaacaaatttacattagcaaattcaaggatttgtgaggattaaacagataaaagccctcttcaggattggcattaaaaaaactggatatctacattagggtgacataaatacatgcttcagatttttaattctaaaagcaattctgattatacatacagaatgctgctaataagaaaaggcaaatttttagcacatttgttcacctgtgaggttaaaaaaaaaaaaaaagaaaaagagagagtatgtaacttccccaggaagagggacaagaaaatggaagtttattctatcagttacaaagctatcattcaagtaattatcaaagaaacaataaacaaactgaaaaataaagctattttaaaataaagcctgcttctggggctagtttaactgaatgactattgtatgctacactgctgagtctcaacagtatgccatggcccttctttcacatcagataggggtgccaaattaaatacagaattctcatttacatttgaatttcaggtaaacaatatgtcatttttgtgtaattatttcatcatcagtgcagaataaatttttagtataaatatgtcctatgcagtatttgggatatatactaaaaagaatccattatttaactaaaattcaaatataatgggcaacctatatttgcattcgtattgtgtcttctgatgccccctctttctatgtctttgacaacatcttcctttgttctttggattgtcctgtttctatgcccagttataatgcctttgtctcttaggacttaataatgtctcctggctccagtcagctccaatttcttaatcttttcagtgttgtctgaaaaagcagctcaaaggaaatttccacagcagaacttgacatcctgtgcaatactaaaaccagacaaatagatgacactaagagacatgtgtgatcatttttaaagaaagaagaacaagtgaacaaatcccaaagccagctaattacaatcccctgaagagctttttttaaaaaatgcaggtacgaaagacctaccccacacctactatttcagaattttgaaaagagtggcctggaaagctgtatagttttaaagttcctgagggagtctgatattcagctataggtttgggattttctggagatggtaattatgagttaagaaatctactaaaagctgaggagagctcagtgagtagatttagacttaaacaacagaatgctgaacccctaaaattttttttggaccaacataaaaacgaaaagataaatatatgggacacacaggataaaactcaaaccgatttttaaatcaggctttcactcatgacaaagaaatatgaggagattcattttctggtttgtataattatgaatcatattttaagatataggcatttctctttgttactgttttttggtagagacagggtctgcctatgttgcccaggctgttctcaaactcctgagctcaagggttcctcgagccttggattcccaaagtgctaggcgcttcctaagagtctatgttttgtctgcttggaaaacaatctaaaatgctaacatctatgcaaatttctcattagaaataatgatttaaaaaaatcatgtcgagggaatgggtaatgaaataagggccccctaaagtttatgcatctattccactaagtggaagactgagagcatagtttcgtggaaactgaaagcttgatctccttcacctgatatccaggacaattctccctcacacacaacctccctgaatcttgcagaatgtaaatgatgaccttttgtcaaaacctacaagaataactttttgtaacagaatactgacatatcataagaaattaaagtaattcaaacaaacatgaaaagggtctcacaatacacacggcacatacaagtctccacagccaacagaaaccacaaggatggagaagggtcactgcacactgcctttcatgagtgaccacatatcccacacactgccacatgctacactgatccaaagagaaaacctacacaatactaaacatattaacaaggctgctacgcagtgaaatgctgtgtaactcaggctatggtatatgcattttggtcctaagtgtattggtaaaaggtatgcctttggctcctcccatctgctgcccacctactgacagatatagggccaggtcaagtccttatttactcccattagcatttagaagcattatcctgaagaagagcgagtccttagatactcccattagcatttagaagcattatccactccattttataggagaaacttgaattcacaaaacagatgtccaagaaaactcaagaacactcaaaacgaattcaggaagctaaaaactgaaagataatctaggatgtgaataaatagaatagaaaaacttaaatatttttgtgctaaagtagatctgaatttttttcatactgcaacacattacctaacattagtttctttctcagttaatttctcttgcacaaaattctattaagaaaccctgtttactctataaagatatctacttacattttaaattatagaataactcaaaattatctctatagcaaagaacagataaacaaaacattctcatactttctggaagagctttctgaaatcctgagtattataaatctctgaaatgtacctggataacactgtgaaatttggcaataaggtagaaaaacatttataacctcaattgagaaattaaagttattaaagaagttaaaaatataatttaacactaaaattgtttgcatattataaggaattacatgaagtaatgaagaaaatgtcaatacatagggcaaattttacataacccaaagacatagatgtgatagtttgtggctcctcacatcttcccaaacattagtcatacaccctacctttgcctaccaaaatgcctagtgttctacaatgacaaaccctttcagttatggtattgtcttcagaactctttccctgtgaaacttcctacaacaggttaatatataaacccctcagtcctttgaagtatgtaacagcttaacactagctcaactgactgataacctgctcccaaaaaagaataggacgcatcaagtaataattttcctcgtttagaaattgagcggggcacataaaagagaaaagaaagacaaacaagagagggcagccaaatggttgtagaaaggaaggaaacaagaagaagatggagaataaatgggagttcttaataagatgctgagattggaaattctgctctccaaagggagacaccccaagaaagtgacacacagatattctggcagtagatcaaagttattcaatggccccggggtaaaatgattacttattactgaaaccaactagtacctattacataaattagtttaatagtgctcacatcttacaagcacatttttgaattaaaatctagtagggtataattaagtcaaagattacttttctaggaaaaagagatgcattttatgctacatacacatggagcacagaaattcattctcacattattcattgtttaagtctaaagcctttcacatcacttctctatgactacattcaccctacagttttctaaatacatgcaaagaggaaactttaaacttttttaaagcaataactgcctcaacttttatttaaagggactaagttccaatttggtgtttattcaaacatccagtaattcaataactcagcaaatatttattgagaacctactacatacctgtactcctacagtgatgggggagacaaaaagtgagataaacctaaccttaaataatggtttagtgatattttgggaaaagtacacctcattttccaacacactgtaagttaaatggagacattttgaaaggaatgttcaaatacagttatgattgaagaaagtaaaattttcttttcctatgatcttggtttgtaaaacagtacactttagccaacagctatggctgccaaaaattagatgacaaatctaaagcaagctcagttgtatacatataaacacacgaacgcttgcatgctcttggggacatacacacttactcccctactcacccactggggtgttgcatatttcacagagcacaatttgcccaatcaatacactgcaggtcaccaaaaacttttttttttcccttttaaacaaccattcaaaagtttaaaacagttgaattttaacattatttaaacattttcctccataaaccttcttaattttcattttggctaataggatgtggtgcagagcactccccaccaggtaggagctgtgcagtgttacacaaaactgtgtctctccttaacctcccactaaatccttcagtcagtaaggttgagtcacaatttatcactcaaaaagtctttgtttacatgcaaatgtatttagttttcattgcaattaatttgcttttgcttttcaaaactgtccctattaacaaagtagtgctgtttatcattaccactattactaatttttcttattattagattcttaaattttaaattttatcagttggtatttctttatccacttctgcttttgttttatttgttaaccaaagtgtgactcttgaaggaatttgataaataagttagaaaaatgtttgcttctaaggtaaataatcaatgaaatttaattaaaatgacttactaaaaggccttgacagcatcagaatatgtaattttgaaacttttgttttcatgaaatgtcttttttctttttttctttttgaaatggagttttgctcatcacccagactggggtacaatagcacaatctcggctcactgcaacgtccgcctcccaggttcagttgagtctcctgcctcagcctcctgagtagctgggattacaggtgcccaccatcacgcccggcgaatttttgtatttttagtagaaacgggtttcaccaagttggccaggttggtctcaaactcctgactcaggggatctgcctgcctcggcctcccaaagtgctgggattactggcataagccaccacacccagagcctaattttcaaacttttaatcttatgaatgtaataacacataatgtaaatgtctaaattttaattactgaattaaatgaaaatgtatacctcagtatctcctgatgctacttttaaacatttccaaatagtctgttttaaaacatattcttaagaacataggagaacttaatttttttaatcaagtttctgaattcataatggctcatagtctcctttagaactttatatctaaatagatttaatttttacaaatctttgtccattaagacaggcagcttcatttttgtttttaaatgaagaatgtcttcagataatagtaacaaataaaaacatttgctactgagcagtatgatgacaattacaccaaatctagattttagatttgtatattctaatgattctttcctgcagtctacatgtcttgttttgcatgttgcatgtaaacattatcaagttatgccaaggtaccaagcaaaccatgctgacgtctttccttaataaattcatcttaaacttaaaaggctatgaagtttaagatcttcaaaattattttatgaactagggcatataactaccagactgaactaaagtcatgcaatgagtagctaaaaccaaaatgcctcacatcaactacaaaatcactttttctttatcagctatatattatcaacactgtattgtatttgggaccaatgaagcaaagaatattgaaagagtatcagttgtcaaaatgtttaatgaagacagagctgtcagatgacagagacgacactaattcaaaagattattaaaacaaaagaacttccagtacataaaatgaatccccagatgttaaaaatggtcctattttaaataaaaatgaaaatccctgaaaagttatgcttggaagaacacgatttgttttgcagagaaaaacccaaacaaactactgggaacaaaatttagagaggctaaaaaaaaaaaagggaaactgataagatatttcataaacaaggcctatgtttgtgttctatactgataggaatatgtaaaggctttgagatcaagagcttattctgaaaacactgcaactcaagtaacacctagttctcttccaaagaatctttgcgatgtagacgttttcctggattccacattaaattatgttaacaaaatagtgaatataataaaatccaagctgctactgtcccatctgttttcagcttttatgtgaaaagtgggatcagaacatcatttgttattgtttcctaccacagcacactgatgatacagaaaagagtttaggtttaatcaggagtttatgagccaaatgttgaagttttttagaacactgaaaatactttattttccctttcagattcattgaatagttactggttacaaaaggcgactaacttaactggcagtggaacaccacaatgaactaaaattatacaaggacttaattaatatatatattggtatgtaccaagtttatgaattcaaaacaaaaatccaacttagaaaaaatcaaatgttgcttagttatcatttgtatcctaatactgtagaacatctaaatatacaatagtcattactttcaaatttttgatatgagaaggttcaattcaatttgaaattcatttacattatcaaaagaaatgtatacaaccacatttcttaggaaagagatgtcaaaatttaaagaataaaaataagaagttatatttttaaaaaaggaagacatagatgttacagaataatgtacccttgatatataattgaatttccaaatactctgatgttatactatgtcataatcagctattattttaaaaatggcataaattctttcccaagggttgggcgcggtggcacacgcctgtaatcccagcactttgagaggtggcagtgggtgcatcacctgaggtcaggagttcgagaccagcctgaccaatatggtgaaaccccgtctctactaaaaatacaaaaagttagccaggcatggtggcatgcacctgtaatcccagctactcaggaggctgagacaggagaattgcttgaacctgggaggcagaggttgcagtgagccaagattgcgccactgcactccagcctggggaacagagcaagactccctctcaaggaaaaaaaaaaaaaaattacatcctcagacctcctacagaacccaatctcaagttcatatctttaagtgcagtatgaaaggaaccaccacactgcacaactccacggacacctttgacaatgataagtgtgagtgctacttcctgagcagacctgtatattacacaaaggtggggaagctctgaactgttgaccaaagggcaatgtttttgaacaatgctggtcttcttctgttaacataagttaggtatagtttttatttattttgagacagggtctttattgcccaggctggaatgcagtggcataatcatggctcactacagcttctacctacctggctcaagtgatcctctcagttcagcctcccaaatagctgggacttgggaggtgcacgccaccatgaccagctaatttttgtattttttgtagagacggggtttcgccaagttgtccaggctggtctcaaacttcctggctcaagcagttgcccacctcagccacccaaagtgctgggattacaggcacgagccactgtgaccagccaggaatgttttttaaagcattctgtactacaataaatttagcaccccagggatggtaatgtttctggttgagattctgccaaactaagaactctcgttcctgatctagatgctttgtggtgatttatgtcataattttaggcagccctgacacccatgtcctaaaaaataggcccaaattttaaaaattattgatcaacactctagtaacacttacgtttggacgttcaatccctagctgagttttttaaaacaactgactaacagctactagatgcctgtcgattaggagaaataaagaaaaacggtaattttattaaaaataccaaggtagtcattattcacacgatactgcttgtgcataacagaactcattttaaaataaagacaaagtgatacaagtcttatttaggccagactcaattagtatggatgtttttctgcatatattcacatagcacagggaaaaaaaaactaacatcaacagaggcatgagataaccattataactctagctacgatttttccaagataatgatgcttttcctacctaaaatgctaaatttaagtttaaaaagtcaacatcatttgacaaactgacattcacagcaaacagaatcaagaaaagtcaagcttgcttctccttatactttaataacctccttataatttttagatactatcttgataaaatgttggttattaatatacatgtattaccatcccatgcccatgaaattataagttctttttgctgaaaattgccaagccttattcattttcatattgcctgcagggtctcaaagaaatgaatttctcactccttttggtattatgtatccatctcagcagaacaaagaaaagttcaggctgaaaataaagcaaaccttttagaagttgaagtagaatatatccaattctttgcaatcactcatattaaggttcttataaacatcgcgtatgtattataatgaccacaggggtaaaacaaagcaaatgcaatctcacatcttattttaaaggcctcttatatttgatgtaaagcaccatgattatgtgaaataatatttttgagctgtattcaaaatactatacctttaaaaaataaactgttgtcactttttaaacaggcacatcatatcaaatcatctctattattcttagaatatgaaatcagatacacaaagacatagagcaaaagcttcaaaagccccaaggaagaagtgatttgcatacatttactggcctttccctaagcagtcctcagagcagatgctaagctacctttcagaattagaaagtactgggttcattcactcaattatttttctaccatgaaagccttggggattaaaaaccaaagtgatagctgcaaaccattaacgtttttaaactaatcttcatcaccagagtttaggggaggaaaaaaacaggaaaaatcaataaataaatgaaagcaccaaggttaacataattaaagcatacgtttgtttagaagaaaaatttttacttagcgcaaaccaaaaatagcatcctaggattttcttatttcaggaaaaaaaaaaaaattaaaggtccttaaaggaaaaataatgagccaaaaaaatcttcagtttcagagcaggaaactacatttctatgaagttgagtaagacaaaaaattttgccattttccctctaagtggagaatcacagtccatagttttagcagccattgccaaaatactgtggagcttgtctgtttgggtttgtttacctgactgacatctttcagcacccacctgaaagtcaggatccagggatgtaatgaaattattatggccctgagtaacagttattgtatcaaaaaggcatatactcttaagagtaatgaagtagatgtcagccagcaaaaggcagagttaaagacacaagacaaggggtggattgaaatgcaaaggttaggaaagaaatcaaagactgtttgaataaagttatgtttcttttctagtttttcaaaagtacaaatagaaaacaattgccagctttgtacctttcatcatacaagtcacattgtaaataaacagatatggtagaggtagtgtttctgagttctcagaaattgtttggggtttcagaaaaaaaggcttttgaatcttctgaacattatgtagaagggcttaattttatagactacatagtcattatactgatttatagaggacttcaatgattttaatggattactgagtagtattcagaaatgagactgcaggaatccaaaatttcttcttgcccagacctttgctattaatccaattgtcaccatttctgaagaaagcaacttatcatcgtaatttgattttaacattactttgcctaattttattcaaattatatggtaaatgtctaaaactagctagcaaaggaagaagcaaaatctaaataggattattcctaagtgagcgtataaaatagaagccaactacacagctaatatgagtctttaaactaattcagtcacaaattttatttatgtgggtgtatataggtgtattttatatatatatatatatacacacacacacacggcacagcacatatatttacctatgcttatagtacaatgaataattttacacacagtctatactagaatcaatatgtttatacatttcatacacataggcatacatagatatagacacactgtataattactaagcaaactatataattataattaactgtacctgtaaaacatattattaagcactgtatatgctaagcaaagaagtcatcagcttcaggtaaaaaaagatgaaaataaaatcatattgtacagcaatccccaattataaatgtctgtatatgtatatttaggtaattatttatagatatagtcaactaattcatttttcatgtttagcagatatatataatattaaattgtattcattcctaacacatctcactaaaagtaaacatttttaagacacactataatagtaagagtcaacagcaacaaaattttggaaactggaaaacacatgaataactattaactgaactagcggattccaaaaagccaaatcctaacctgataatgtagagagttcagtaccatccctagttaataccaaagaatccttgaaaactggactaagaaaatgtggcacatatacaccatggaatactatgcagccataaaaaatgatgagttcatgtcctttgtagggacatggatgaagctggaaaccattattctcagcaaactatcgcaaggacaaaaaaccaaacaccgcatgttctcactcataggtgggaattgaacaatgagaatgcatggatacaggaaggggaacatcacacactggggcctgttgtggggtggggggaggggggcgggatagcatttggagatatacctaatgttaaatgacgagttactgggtgcagcacaccaacatggcacatgtatacatatgtaactaacctgcacgttgtgcacatgtaccctaaaacttaaagtatgataataataaaaaaaagaaaacctcagacactgtcagcatctaatacttctggcactgtatgggtaaaagcaggggtgggaggtgaacaaaatagtcttgttgaaaaattatcatgaaacatatccttatatctcctaacaaattctacactgctgggcaactgcctgtcactattttgggaaaacactgaagacttcttctctgggaaaaagagggtctccagcctgggaaacccagacataactgaaagtgggatgcaatactgaaaaggaaagaattaagtgaacgtttccatacacaatgttaaaaagaaagcttcttcctccactcattcctggaacatgggcagccaggccaatactcatctctgaggaatcaaactaagcccacaagatgaaaaaataaatatagctgatggccagagatgctcacaaagtaatgccagatcacaaattaataagcctcacctatatcctgagagctttcaaacattttttaatccccttaactcttacaaagtgtgcatacaagcaaggattgtctgagaagtatgaaaagtctctaacacaaaatctttaaaaaaattaatggaaaaaggcaacttagaagaatcagaccagcaggacgacaaaaaccaccaccctattcttactttatctgaaaaataaaatacacaacaggaaacaagaatatgaagcactaaaaacgtattaagcaaacaaaaaaaaagctcttgaaaattaaaaatgtaggccaggcatggtggctcacacctgtaatcccagcactttgggaggctgaggtgggcagatcacttgagatcaggagtttgaaacaagcctggccaacatggcgaaaccacatctctactgaaaaaaaaaaaaaaattagccgggtgtggtggcatgcaccggtaatcctagctactacggaagcttgggtacaagattctcttgaacccaggaggcagatgttgcagttagccatgatcatgccactacactctagcctgggtgaaaagtgagactctgcctcaaaaaaaaaaaaaaaaaatatatatatatatatacacacacacacacacacacacacacacgtatatttatgtgtgtatatataaaagtgtatatatgtgtaatatacatgtgtatatatgtatatgtatatataaaacaacagaaaagaagtactcaatagaggcgttggaagataaagttcaagaaatcccccaaagatagagaaaaaagaagaagacagagaaaataaaagtgaagggataaataaatcagagaacaagctgggcggcagtccaacagcagattcagtggaattccagaaagagagaagagaaagctattaataaaaagcaagtcattaacaaataattcaagaaaatctcccagaagggaggcacacaaattaacaaattaagaatgctgagttcccaacaaggatggaagttaatatgaatcaaagcaaatcattgtaatacaaagatgaagaattagaatagcttcatactctttaccagaaactaagaacagagaaaagacttcaaaaatttgaaggaaactgatttgccattaaaattcgttacccagttaaactatcagttgagttggataagaaagaaacatttttcaaaatcaagaatttaaaaagtatttctcccatgcacctctctcaagaaagaggataataaagtcataaaacacaaaaactttaaccaaggagagaggaaaagggaattttcaagatgacagaagagatcttaggatgacagataagcaccagtcatagaaggccaccagtccaaatgggagcagtgtgtctcaaatggcacatttgctaagtgtcatcctgatacacttcatcaccctaccttcctttcaatgatgaagctacagagaatatgttccacccaaacaatgaaaagaccaagaaagagaaagataggaggtcattgggaacagggaaaaggactctgaaaaaaagcaaaaggaaatttcaggaggcctgcgaaggtgacctacagagcaaccagtttcaatagtagatggaaacacacacacacacagatatgtttcttggatatgatcaactttgtggaaggctgtgttaacaggcctttggatgatatgggaaaattaatgattgatacagagaaaactgagcacacaaataaccaagtcatcatttgatttaggaaaaacaaaaggaaggaaatataatcatattgcatagcaactcccaattgcaaataatatttggatgtgcataatataaataatgaatcatgatctaagcaaaaacatgaatacaagtctatgaaactaagggattcctccccagaaagaaagaaaagcaaaggggatagtgtgatgagagtgctgaatcctactccacgacaataagaaatcagcaaataatggctaaaattgacaaacccagttacagcagtatatgaatattatttagaaatatgggtcatatgtatttgttagaagaaacagagaaaagagccaaagtattgatatattttgggataatactgtcagtaatgccatcatatccatcgtcaaaatggactgtatcataaacattctaaaggtaaactccattattcagtgttaagggtctttgtccattttaattcatagtgcttggcacaaaggagttgctctataatgcttcttactgaattaataagcgaataaacccaggaaagtaaatatgacaagctctggagaactttgataattccaaaggggttctattcatgacaaaactgacatgaaagacagacatgaaatgttttcaagatctttccaaattatgaaagcagaaacatcaccatttctgagatcagatgagatcgggcgcattcagggtgttacagccatagactgcactatttccaatacactattttatatgacatgggatttattgtagccaaataaatatgattacatatttgtttcattgacatatccaaaagtgtataaattcaacttggctaaaaagtacttttaagatttcctcatttaggcacataattataacctctaagatgctcgagctttttggtcccctaggcacctccatttggagctccctctgcctggtttgccttccctgctcaactccccacatacttgtttcactccagctgcttctacacagcttcttctgactcagcttagatatcacattctccagaatgccttatctgatccctaaggctgaagaccctcttacgtgttcctacatcaccctattcatatccctgtcacagaagagcacacacagtaaatttcctgtcttacttatttcctctctacttgaaaataagatgttcatcagactagctgtcctatttataactgtatcctcagcaaccataattgtagacacataactatctgacaaatagatttgttcattaatttgaaaaatatttagttcctacaatgtgccaagcgttttcctaggcattgaaaatataatcctaaagaaaacaaatagtctatctttgtggagcttacgttctagatataaatacagaaagacacaacaagtcagtgtgtaaacacagtgtaagatggtgctgaatggaatgaagcaaaataagtagtcagggtatagcaacagagagggagaggaaagagtgctactttagatagaatggtgaaaaagggaagaactcttaaaggatgtaagactagagacctaagtgaaagaataagtcattcaaataatatcagtgggaggaacagaccaagtagaagaaacagccaaacatcaaggcccagagaaggaaatgtactgcgtgcatcgaaggcagacaggcaagcaggcattccattaactggatagtttccaccgagccatttcaactttctaagccttattttccccatctacaaaatctgaagcctattacacttaaacccacacttgtagcccaggtattttactaaataactttgctatttctgtacctcctaccacaactcagcttggtacaatcagatggttcaccaagtaggtgcactttctgaaacacatggagtcacaccctgattcactctctcatgaatttaatacaaacatagtagctcatctgacacttccatggattataccaattgggctgtacatgttctggcatgtaacaaagttcaggcattccaaatagtctgttggacagatcaagatttagaaggctcacagttatattttactccagcaaatgtcagggctcaaattacagttccatcaagtaggggtctaagtctctaattcaagttttaaatttggctatggagaatcgtagtatgcttatactgcttactgctgacctgtatttttaaaaatgataaattaatcaacacactctgggagctgagggtggacagccatcatccagaacagtgcccagaacatggtagaaatctaaataaaaattaatgagtacatggataaatgactgagcagttgggaactaatgaatcacaagtgcctatctaaaggactatggtatcaactttttctgggctccagatcctcctacagtacctacttcatgaacattgttacaatgtctatttaaaataaaactataatagttatctagctaaagtatattccattggttaggaaaataacatgtcctctatatagaggactgtatagaacaacaataaaaattatagttgaagtagcagctatcaataattgacatccttgtatatactatgctagctgaaatctaaactcatttaatcatcaaagcaaactatctggtaatttttatctctattttatagttgagaagacatactccagttaggtgacattgccaacatcacacagagctggctggttgtggagctcttatataaaatccaggttggatttctgggctcaattcctgtagaggaattgtgaagatgaatagacaacgtcttagtccattttgtgttgctttaacagaatacctgacactgggtaatacataaaggaaagtttattggtcttgtgattctggaggttgggaaatctaagatttgggaaccccttctggtgagggtctcatgctgcttcaactcatggtagggaaacggaagggggagcaggcacatgcaaagaggccaaataagaaaaggaacaccacactcttgcagtaacccagttccaagagaaaatgaactcactactagagaaaggcataaaaatgtattcatgaggaatccacccccatggaccaaatatctcccactccctaccacacaacactgcaactttgggaatcaaatttcaacatgagttttggagaggacaaatcacatccaaaccatacacacaataggtagaaggtttctgcattatttgaaccatagtcacataaatgcaatatagagtgactattagccagttgtaatttagaaatattttataccgataagaatatttctacatttctaatcattttaccaatttgccatttagttcactccccacacgcaaacctgttacccagccctaaaaaccaagtttattggaccacaaggtaggacaactgttcattcctttcactttgaatatatggacagattcagctcaggagagtatgtcctttaataaatcaggataattttgaaacgccatcttgctcacaactaagaaaaggtgtaagtgtgtataccagtgtaaaagtaaagctcaagcagtggctattttaaaaactttttaaaactttgtagaacacagagatgtggaagaatgtgtgtcagcagatcatgacatcatagctgacaagataaggagtgacaggtaactgtcactctgtttggcagaactgatattaaatcccagctctatcatttgctagttactgggaaagtaacacattctcatattcttcaaagctgtatttcctacatatgaggtaggaataacaatagtatctatttgacaggactgacataagaatgaaattagtgaatacatataaagaacaaaagacaaatgtaaaacacatgtctagcacttattaaatacttaatacaaaaatcattgtatcctaaaacaatagttgagagacagttgccttccaaagcaggttttagtgcaattaaatagattgttttgaagcagatgtttctagaaattttatttaatgagtttctaaatacatattatgtcattttaatattttcccctacatagttcagacatccacatttacaggatccttcctgggttttagacactaaactaaaaagcatttttttcctcatctcatctttacaactgtgaggtcgatgttattattcctatattaaaggtgagaacacatttcagaagttaaagaaactgcccatgcagataagtgatagagctgggattcaaaacccaggtctgcttggttccaaaggctatgctttgaaatagtatgctaccctaaccccttatttcctcagagaccatagttgtgccaaccatagtgtttttcaggaatgttaagcttctcggttggagagggattactgtgtgactatttctaaaatgaaaagtcaatagttgagaggcattcaaacgcatacagttagaccaacaaaggccctaattctgctcagctggcacaccctttgtgcctttctctcactccccgggacctacccatagatggtgtgtaaataattttagtaactgtaaattagtcatttattaatattccaaataatctaattccaagtacctttagtaaaatatgagaatagaagctattactaatttgaagaactcccagattttcagtcatgcattaggttggagttaaaaggagtaaaagaaagtgttttatagtagaacgtagatgatctgcattgaaaatttgagcttctagaattctgggatgctaactgtgacacggatctgctgcctcttgtttgttatttcactagagacaataagcctacattcctttttgttcacaattctagaaaaataagtgatatcaggagggagagatggttaaagtgagtttctggccttatatacaggttttattaccatctgcagccagttgtcaatcacaaaataacaaagtaaaatgtggtgatgaaagccaaactttctccttaataaagtgaggtttaaagcagataccttcaagttacttaatcaaggacttgaccaagtgagacaagcatccaacatatattagccatagaaaaacagctgatcttggtgagcacacatttcctaccttcattccatcttcatttcctaattgctactttagaatggtagtaaaagtgaaggtaacgtatttagttacccacatcagaaatatgcaacaaagtcatatataaatctaagcaaaatcatcctgttagaaaaacaagaatttttaaagtattcctactttgtttcaaaactgatttaggacatttctaaaattaaatatgggaggcaaatatatgactgcttaatcttaaggtctagaaatctgaaggctttagaaatgccatgttaccttgcctactgatcgttcagtagtgatctttaaaaccgtatcagacaaagaggattctgactttctaaattgaaaacaaaatgcctaaaaaggaatcaaaataaatgttttcaatattgtagagatataaaattcatgatatttttaaaatttcttcttcaatgtgaagaaaatcatactgtggataattagataagtaataacagctcctctggaagccatatgtttaggtttataagcaaatattttctcttttatgtcttgtatttcagtactgaatagcccaaagaccccatgtgtagaaagccacaagagagcatggaagatatattttatgctaaaaagaaaacacaaatgaagaatgacagccaagtttcaaagcacagagcttaaaacggaaaatgtagataacctgaaagacagcatatgctgctaagtgccattatcagaaaaaaaaaaagaaagaaacggtcacagctgtcagatctatatttctagatcacaacaaggctgccattcaaatagcgctgtcaaattgggtctatgtttaatgtgagatacagaccacaagagtttcagagaatcaagtaagtgagtaagacaactgtaagtaatgttctgcttttttactagcactgccctcaagacaattcagcctagtttatgattatcacataagaagactcttagtttgtattctttcaccaacacatggttttaaaattcacagctaaaaattagagtcaaatctcaccctcccctttggatagagctctggcaacatttctgttcactccaaattcctaacaggatagatagagctttccgtatcttgggaaagccatacatggacccacaacttacagggacacaattctgaggactcactgagccctccaggaacagaatccctacattccttcactccacctctttgtgttcattcaaatacgtcacctacatccccaactcttcacctcataacagcaatgaagaatgacagccaagtttcaaagcacagagcttaaaacggagaattcctcctctaaatcatgctatacacagaacacaagtgtttggaaatgttattcatccatttgctaaaagccattttctcaagtctcttagataaaataaaaactaaaaatgtcctaattataaatttcaaaatggaagtggattaaataccttcacctcttgttcaggggcaatacgggatcgcacaaaaggcatgggcttcagggtgagacagacacaggtttgaacctaccaattgttgactgtgtaaccttggacatgtgatttcaattttctgaggttcctttcttaaccccctaaaccacaaatggctgctgtgataaaaaccacaaatggctgctgtgagggttaaattataattgtcatgattttcattacagctaatatttactgagcactttctatgggtcaagtattattttcagcattttacatatattaactcaatccacacaaccacccataagataggaagtactagctctgttttacaaatagggagcctgacacatagaaaggttaagcaactcccaagaacatcaactataactgagggaacaagaattagaaccaggtctcactgaagaactcaaccctcagcacaccttacctcacttaaataagaattctgtgtgtacagtctgtttatgcaatgacagccatacaatgctcatttcttttccttctttcctacccccattctctacccaccctatatcatgcaaatcatgaaatcattgtagtaagtaggaagggaatacaatactgttatagaaaaaaagtatagaaaatatgagggactaagagatcctctaattattattattatttattttttatttttggaaaacctcactttaaagaatacagtgagaaggatcaccttccaccttagccagtgacaaagtaacctccttagagggaaatttacacgtaacacagtatctgctgcaactcacaaggttccctgaccccactcccctgaactcagtacttatgggagaataagatacttttgtttcatctaatgaacagagtataacatggaagagacaaaaaagacactgtttcctcttcaaattagtgcccagtacagcttgcttggagcaaatgcagagatcaattatccagagggctttaaggaacatggcccagcttctgcatgctcaggatctaaaggtgcctgcattatagatggcggcacccacagggcagatgtggacagcaaccatgccacaccatgaggcagaagcatcagcaggtgcagcaggagctgctgcagggcactcaagcaggttccagacaactaggacaaaagggctttaaggcgtcaagtgacgaagcaggtctcagcagaaagccaggaagccaggaaaaattctcagtgctccataaggctttactcaggcatttccacatatactcagtgactggaggctgccagaaattctgaagctgtggacagggcaagttttatcctgctgcagagttagaatcatgggctttttgaaaaatgcccatactgaggctgaacctcagggattaatttaattggtctggggcagggcctagatatcctggaattttcaaagctccccagggaaacataacctgcagtaggagttgacagctgcagccttgggctgttaaagtctggagaaacattgcttaaaatactttatcatatgaatgttgaaagtcactgaaggatttataatgctttgtaaaaggattagactaatctttcagagagaacactccggtagcaatgaggaagaggaaaataccaggctatggatattactataatgtaagctatggttactactataatgaagacaatgggtgctactataatttggctatgggtagtctgttcacccatgcatccatcctatcacccaacaaatatctactgagtctctattatttaggaggcacattgaataagatgaataaggcatatgatttttcctctcaagaaatttccagtggagaaagtggcaaggaaattaattgaaataatgtgcaataagtagaatataaatgtaaaggatacaatgggagtagaaaggaaagacacctaaaatcagtgtgaatagccacagtgttgtaaaacactcccaaggtgagggggatcccaagccaaagagggaaggtgtggtcacgaagaaaacaaggcagtggatcattctaggctgtgaggactccatatcctgtttctgtaaagttaagcaatgcagtaaggctaaaaaagagaaactgtgggtacctgacaacagtccaagctggaaataacacagaaaaagagtgtcaactgaacagtgaggtaaggtgacaccatcatttaactttaacaattgaactggcatgatcagatttgtgttagggagagaaaaatcaggtagggggacaacttaggagacagttccaatagaccaggtgaggaacagtgaggaacagtggaggagatggacagaggaagagatttcatatattcagtgttagaactggttttgagctaatacacttgacatggaggagtgaaagaaaacaaagtttagaattcagtgggaatgttaatgtaatactgcttagatgagaactgaagaacagaggtagggtttgagtagcctataaaaacatccacatttggtgattacactaaatatttgaaagattaaaagtgaatcaattatattaaaataagtatccactaagattgtcatatttcttcaagaacggttcatagtaaaaatgtgattaacatatcacttcaatagtccaaacattttgaaaccataaactgatgttaatacatgccaaataaacagcattcctaacaggtgaaaaattaatgacagtcccactgaaagctagaccaaaattttaaaatgccactttacttttagatactacattccatcagaaaaccagaatgacctgagtaactaattatttgccaataagggagtctggtaaattcaacagatacagttaaatttgcaaaaaatcaacagctttcctgtatagtaagaataattgtttaaggtaacagaaaaatccactggcaaaagcaatcacaaactaaaatacaaaaaaaagggctcaaagattctatataaagaaaacaaatctttactgagatttaaaggatggcttaaaaattggagagacataccatatgtttctagatgggaagctgatgtcagttctcaaatccacatgcacagttattgcagatccagtaactacaacagactatgcctagataagatacttaagccatataaagttacaagaaaataaaggtaaaaatctaagctcttgacagagaaggactttccaggcaaaggagatgacaaaaagtcaacaattttaaatagacaaaatttctgtttatcaaaatagattctcaagaaaattgaaaagccaacaaatgggaagaaaatggcaccacatgaaatgaacaaaaagttaataactttattagagttagatctcagtataatgaaggtcagaaaacacgaacaattcacgaattgctaaattatttcaaatgtccaattgttctagtaatgaaaagaaagcatattaaagtaagttatttgtattgattaaatgaacaaagatttgaaaattatagtattaaatgctagaaaggacacggtgatatggaaacgtggtgaacatgtttccatatcatggaaactggtagagcatttctgaaaaaccccttagcctaaggcctaaagactgtttatactacttaaatcagtaactccttttctataataaatcaatctttagaaggtaataatatccgtgttcatttacttaatgctattaattacagcactaaattatcagcactaaactgctgataatatgaaaatggagacattgtttaaactttaaagataccttcggaaaagatagaaaagataaatggatcactttaatactgtgcattaaacactatgaaacaatgaagagggtgtcttggcacaaaagaaggaatataacccagaccagaagttcaaaaaaggcttcctaaaagagctgtaggattcatacaaactatttttatttgtttacacacatcctttatgttgtgcagtgaacaagtattgctttttcaggcattgctttaatcacagaaaagggttggcataaaaagtacctttttaaaaccttcttttctacttgtagcaaactacttttccataactgtacttcaaattatcatcccagttttcttgcaaagctttccttaaattacctttcacattttaaagaaatgaagacagctagctcttactagttttgttccctgatgtttggcattcacattttccttcaccttgtttgttctgacaatagacgaattataaatttatgtctgcttagctttctgtcttgcataaactttatatattataggtcaaagtttttattaataggctacaaaaaaatgaaaaatagctagaaaaatcagtgtagttcagagacactaaagtcttgcaagcattttagattttaaaataaaaaagagaaagaataacttttcaattacattttcaatttcaatcactattgccatatatattaatctctaaaagtctaaattattgaaagttgattttgaagttaaaaattaatttgctaaaatttattcaagtctcttcaacaacaaatatatatatatagacatagatagatatacacacacacacacacacacacacacacacacacacacacactctggaaacaaaagaactgacaaaaaagtcatctcaaaccaatttactttctttaaaatgtaaagagctgtatttttttcttttctataaatggaacaacgtgttaacacaggcttatatttagccatgagaaccagaaccatttccaagaaaaagttagttaagacagttttctaggcctgaattcttccttcatttattttgggatcagtttgtttaataaaagcataggttataaatgttctaccaattatggtttgcccaattaccataatctttgctatagagtacatttcttatcaattctgcagtctaatttcacatctgatatgctctctgatcctcaagttatttagaagaatgtttagtttctgttagattagaatttttagttattctgaatttctagtttaaatggatgtaggaaagcaaataaagactgaattatttctactcttgagaatttattaactttcctttgaggcctacaatatatatttaatgtatctaactgtttcatgagcacctaatttacattacctttttaataagatggtatgtgtctgtgtgcatatctatatccacaaataattaatatataaccactcaagctttttgagggtgatggccaaatttcctaaaattacttacttttgctcattttttctgttaaattctcaaagaattgtgttagtctctcaactatgtgtgttttttttaaaatacaaaattaacctacttctagaagttttcattttatatattcagttgctaggttgttttgtgttataaaagttttatggaaattatattcattctgggtacaccgtgtcttttatccaatggcgatattaaaaacatttaacaaacagtgcagcacaatgtttgtgaagagtctaagagtctaagcctaagactaaagtcttagactatttgcaagataacaaattagtctgccatagcgtcatagacgctgacacaattcatgaggctcctgggtcagagataaaggatgttactgttcacaacacagaaggcagcaatagcttcatgttcccatgggctgtctttgctgccagatcccaaagggtgattcaaggtagcccagggggatgctgcatctaaagtgcatctgtgtcacacctgagaaaactcagagcccaggaaataccaattattttaaaggagctactagcaaatctacccaaactttgcccaagagaaaggcaacatatttatttggtaccctggttagaaaacaaattcaccctctgtgccatatttcttttgtacttgtggttacctttaatttagcatatctgaacctatatttgattatcaccatccagaattaacactataaatgatatctccccctaataaaacatgaccataagcatggttttaatttccaatccctgtcaccttcctggattgtattgatgttagattttcagtttttttaattagcagtacagctcttgaattttgaaaatcttttcctaacaattgcattaagtttcacaactttcttaggaagtcattcaaatttaatcataagttctgctagtttcaatgtctgctgtgattccttccattccactcctttctctgttcctataagttgttttcatttggtacagtatttattcaagttcaaaaatttttttctagagaagttagatgggcatatactttcttaggtctacataataacaacaaaaaggagggttttttaaatattgtttcattcacctattgttatataccaactatatggtttggctgtgtccccacccaaatctcatattgaattgtagctcccataatccccaggtgtcatgagagggacctggagcaaggtaataaaatcatgtggggcaggtttttcccatgctgttctcatgatagtgaataaatctcatgagatctgatggctttataaagggcagatcccctacacatgctctcttgcatgctgccatgtaagacatgcctttgctcttccttcatcttctgccatgattgtgagggctccacagccatgaggaactatcagtccattaaacctatttttctttataaagtaactacaacagtataggtgatttcttcatagtggtatgaaaatgtactaatacagtaaattagtactggtagagtggggtactgctataaggatacccaaaaatgtggaagtgactttgaaactgaggaacaggcagattggaacagtttggagggctcagaaaaaagaaaaaaaaaaactaaaaacaaacaaacaaacaaaaaacaggaaaatgtgggaaagtttggaacttcctagagacttagagtgctcagaagacaggaagatgtgggaaagtttagaatttcctaaagacttgttgaatggctttgaccaaaatgctgatagtaatatggtcaatgaagtccaggctgaggtggtctcagatggagatgaggaatagttggaatttggagtaaaggtcactcttgctatacaaagagactggtagcaccttgcatgtaactctagcaacaataataacaagaaggccaggtgcagtagctcatgcctgtaatgccagcactttgggagacagaggcaggacgattgcttgagcccaggaaaaggagaccatcctgggcaatatagtgtgaccccatctctacaaaaagtttgaaaattagccaagcacggcagtgtgtgcctgtagtcccagctactcacgaggttgaggcagaaagactgcttgagcctaggagactgaggctgcagtgtgctgtgatcatgccattgcactccagcctaggcaacagagtgagatcctgtctaaaaaaataataataattaagtaaaagaataacaagaaaaataacaatatcttaagtaaaatagcttatttctctcataaaaggaacctaaaagtaggcagtccagggaagggatggcagctccattgtcaccaggttttttgtaccattgctgccaccaaatccttagcagactgattcaagatccagtatggctgttggagctccagctctcatatccacattccaggcaacaagagaaaaaggcgacaccttgtaactttattcattatgtgtgcttacatattggccagaacttgatcacaagtaattgcaaaggagcctggaaaatgacatctcttaaacgggctacaaggtgactgatacagtttggctatgtccccacccaaatgtcatcttgaactgtagttcttataattcccatgtgtcatgggagggaactggtgggaggtaagtgaatcatggaggtggttacctccatgctattctcatgatagtgagcgagttctcatgagatctgatggttttataataggctttcccccacttccctctgcacttctccttgcagccaccttgagaagaagagcatgtttgttccccttccgccctgcttgtaagtttcctgaggcctcctagccctgtggaactgtgaatcaattaaacctctctcctttataaattacccagtctcacgtatgtctttattagcagcatgagaatggactaatacagtaaactggtacccatagagtggggtgctgctataacgatacgcaaaaatgtgaacttgactttggaactgggtaacaggcagaggttggaatagttcagaggggtcagaagacaggaaaatgtgggaaagtttggaacttcctagagacttcgggggctcagaagacaagaaaatgtaggaaagtttggagcttcctagagacttgttgaatggctttgaccaaaatgctgatagtgatatggacaataaagtccaggctgaggtggtctcagatggagataaggaacctgttggaagctggagtaaaggtcactcttactatacaaagaaactggtggcattttgcccctgccctagagatctgtggaactttgaacttgagagagatgatttagggaatctggtggaagaaatctctaagtagcaaagtgttcaagaggaagcagaacataaaagtttggaaaactagctgcctgatgatataatagaaaagaaaaagaaaagaaaaactgattttctggggagaaagtcaagcctgttgcaaaaatttgcccaagtaacatggagcccaatgttaatcaccaagacaatggggtaaatgtctccagggcatatcagataccttcccagcagtccctcccatcataggcccagaggcctggaaggaaaaaatggttttgtggacctggcccagtgaccctttgctgtgtgccacctagggacttggtgccctgtgtcccagctgctccagccacagctaaaggaccaaggtatagcttgggttgtggcctcacggggtgcaagccccaagccttggcagcttctgtgtggtgttgagcctgtgggtgcacagaagtcaagaattgaggtttgggacttttgaattaatgctgaaatgagttaagactctggggactgttgggaaggcatgattagttttaaaatgtgacgacatgaaacttgggagggaccaggggtggaatgatacagtttggctgtgtccccacccaaatctcatcttgaattgtagatccccacatgtcatgggagggacctggtaggaagtaattgaatcatggcagtgggtttttcccatgctcttcttgtgatagtgaataagtcccacaagatctgatggtttcactaagggcagtccctctgcacacactctcttgtctgccaccacgtaagatgtaccttcgcttctcctttgccttctgctgtgattgtgaggcctccccagccatgtggaactgtgagtccattaaacctatttttttttataaattatccagtcttgggtatttcctcttagcagtatgaaaatggactaatacaccaaccaaccacagaatctcagtgcacacaacaataagcctttgttcccacactttaggtgggacagctctacttcaggctgcaggccaactagggtgactattctactggtctcattttggatcaggtgcaaagagtggaagctagcaagacattcttcttgtggtggaggtcagcagctctcagggaaccaagcccaaccatatagcacatttcaagcctctgctcatatcatacccacagacatttcattggataaagcaagtcaaaaggccaagctcaaatctgccctctcaaaaagggcagaaaaataaattctgcccagagtggacaagaaagagagtgagcatttgctgaacaataatctaaactacaatactcatccataatatagaactgagtatagacttcttggttcacaaactttgtttcccccctttctaatagtacttcaacatcttcgaaagttgaatgtcacagcaagcaaagcccactgcaggaaatcacgattctcacaggtagaatccattgatgagtcttccaagggacttcattttgttgtcctatgctctgtcctccccctctccctatcatgctccaatatcttgctactatatacctatggactatttacttctggatgagtcccatccattgacttcctaggtagccattccttgcctgtgttgaatcaaagaccagtcagctctgatgggcatttctcttattctctctgttgcagaaatgctaaaaaattcctcaaagtctcaggctacttggtggcatccttccatgttgccattttctaatttttatgtaatttttggttctttccataattttaggagaaaagaggtatgtagtctcaacttatcctgaaatcagaggtccaaaagagagactatattttttaaaatcttatttctgtacacatataattttacataaaaatataaatataatcacaatcatgattctttaccatgtgcacttgttttcttttctgcttgattccattgaaggtcctttactgaacttctgtatactgagtcttctaactaacccagagcaacatccccctctctgcaactgctaacaactgatgatacaactttgaatattttgctccatactcataattctagagatataaatatgcatccaactatataaattacaataaaataatttttaatcacagctactgtttttaaaaaggtgggaaattaccctgcctttgttagactatacatctaatattaatacctccaggaaccaccaccaccaccctgtcccatcaataatccgatttagcccattctgggtttgtttgtttgtttggagacagggtcttcctctatctagagtgcagcctcaacctccagggctcaagtctcagcctcacaaatagctgagactacatgtgtgtgtctccacaccactaatttttattattttttattttttgagagagagagtctcactatgctgcccagctggtctctaactcctgggcacaagcagttcttccacctcagcctcccaaagtgttagccgttcttttaagggctgtataatagtatatggtatgtggctgcaccacgatttacactctattccctctgacagcgtttatattggttttggttttatgtgactacaaacaatgcaaaaatcactcttacacatgtattcttatttaaggctgcttttattctatgggattaagtttcatatgtgggagtgctgagtcaaagtgtagaggcatttaatttcaatacattttgacaaaacactttgtagaaaatcatatataagaatactttcttaccacactcatgattattaattaatactttcttaccacactcatgactaaaatactattaatctgatggacagaaagtaacctttgttgttactttaatttgaatcttttcataaacttgttgatcatttcaatttgttgtcctttgaactatttttggtttttacccattatcctattaaaatatcttttccttatttattataagaggattttccatgcaattgctataaatactttgccatctacattacatatacaaggggattattattgtcttagcctattgaacttgtttatagcctcttctgccattcaaaagacttatttgacaaactcaaatattttctctttcacagtttgtgtttctactagcccctaaatccaagattctgtcttatttttaatttgtcttatcccatttatacttcactgtattgtaatacataagagatttcacatttatttccttcaactgctaacaactgatgatacaactttgaatattttgttccatactcataattccagagatacaaatatgcaacactcataaataatgtatcctttcttaatctatccttttcctaatcaattgtcaccatcatgttcagttctattatatacaagaatatatttctaaattttatttcactgacctacttatttttaatactatattgattgtaatgaatttacactgttttatttagaaaatctgatttgagtaaccaatttatccctcagtaaattttctttcttaggcatttaatcttccacataacctttataatttttccatcctatttcaaaaataaccacggtgaaatatgaaataaaaaggctttaattctgtctatttattttgggtgtcttgacatttacatgctactgaatctttcatctaaggacatgaaatgtcaatccatttgttcagattttatgacagaaaaattttagttttcatcacataggtcttatgcttatcttgctgaatttctcactattttacagttgtatcatattattctaaataattatttacattttcatttctaaatgcttagtgtgagaataaagaaaagctattgatattgtgtatttaccttatatctagcaaccttagcaaatttccataattctactttttaaaaaaattagactccttgggattttcagggacaaaataacacattagtaagagggataatctcctcttgccatgtctttgtggctattttgctaatccatttgctaaaatcttcatagaattgttaaataacagtatagttcagtatcctgctcattactgaaacaccagtagcaaatctttattctaaatgttaaaaattggcttttaagcctgggcaacatggtgaaaccccatctctacaacaacaacaacaaaaattagcacggtgtagtgatgcatgtctgcggtcccagctactcaggatgctaaggtgggagaatcatttgaaccagggatgttgaggctgcagtgaggcatgttcatgccattgcactccaccctgggtgacagagtgagaccctgtctcagcaacaacaacaacaacaacaaaaaattgagttttaatttccttctttgcttagtcttcattggaaatgatagataaaattatagcacatcaacagatactaagaaagtatttggtcatctgaaccaaatgtactgatacatggattttctgttttagtcacattttattattttttaatattttagctgatatgttgtttggtacatccatattttaaaacttatctttaaagtaaatttgccttttatttctactcagtattcctttttatactatttctccttttcttatattgactctattgaatgactcattttgcatttcccagtattatttatatgcatttctgtatttcaaacgttcttataaactcactaatgacaaaacaataaacagcatatatcctagctaacacagtgaatccccattgctactaaaaatacaaaaaattagccgggcgtggtggtgggcgggcgcctgtggtcccagctactcgggaggctgaggcaggagaatggcgtgaacctgggagggggagcttgcagtgagccgagaggcgacaaagcgagactccatctcaaaaaaaaaaaaaaacaaaaacaaaaaaaccagcatatagctaggtttacttttgtaacccagtctgatatctggcttgtaattttgttattcaatctgtttgtatttaatataataactattgtggttgattttattccttccatcttactttgtgtttattagtcattttatattgtttcttgttccttttccttatgtttgaggggctgatcaagttactatttttcctgccgcagcgttcctcacatggggcaccaactgtggtagcactcctctcacaggagcaccagctgtgggggtgtctgtcccttgcagacccttgacctggtgatggatgaataatgtacactgacacacagatattctgttttgccagtccagctgagagtgtctgtccacgctgcttacagactccttgctgagtgttgtaaacagttgctaccacggccccaatcagctagtgagacccacatttattcagtaagattaattaacaaaggcttgagtcaaaaccattagaggataattgacattgtggactttccgagtaaaaaccacttaagcaactgaggtacatcaaaggttagccttaagaccacatgagtaagtgagctacctaggtaaactactccgccttcctttgtaccaactttaagctatttactaaaggtaaggattaggatgccttcgaccatatctattaccgatgttatgcaaactctcaggccttccaagagggcttgcggctattactataactatctttaatatttttcccactaacctgattgaacccgaacattttccctcactaaattggaaattttgtgtagtgtttcattccattagtagtcacgtctatttaattcttcttaaaattaaatggtatgactctattctttgaaaataagattataacttccattaaaattatttttcccaccatgacccactatttatcatctcacatcccctaataagctcagttttttaaaatattgtttattttcactatctcatcctcctccctaagatctttttagaatgtttctacttctctattcaccattcccaactttcaggtcgttgggtactgtttacttttagatttttgaggaagtttaatatatctttactttgcatttaaattacaaatcccaaaacagctatctccatccatgtactttctaaatacatacgcactcatgtgttaagatttactgtgcttatttcctcttcatgttttcccaccttgaagtctctattctggttcatttactgtttgattcacatctactcttggatacaatatgtgggtgatactttctgaatgattacatatctctcaagtccttttcttaatctaggcaggaaaatgatataagttgaaagtaagattcttggattgtggtctatttctctcagtagtgtgtggatgccccatcttcctaacttgcagatgagaaaaccagtgccaggttggttctcacacttcatccttttcttaaggtaactttagtattttttttttctggagccatctgtatatatcattagagaatttgagaattttatcagaatgtgtctggacatgggtcttttctcatcaggtgagtctagaccttattaagcctttttactttgcgggccaaaatctttctttagctcaggtcaagaatattgtctattatataattattacctttcctatttcctatttatgttcctttttcaccttgttgaacatcaattattttcatttcaggtccctggaatcaaatctccaagactcttatttttcccctcaagatttctaacttttaatcatattttcatatttatgctctgggatttgagatgtgttttacatttgatcaaccagaacagtaaatcaggtctcagcagctaccctttttcccttgtgttacttaattaggaatcatgcttaaaatgttgtaggtgctacagttgaatctccctaggtattatacttttatttttactttttcaaatgttcacgtctcctccaacattgctacttcacatcacacttgttctgactgtctggtgttcctctatttgcctgcaggacaaagagattgtatgattttgtatacttatgtagattgtcattttgtggaggctaaagtctgattgttagttctctaatttggcttcatattagaatcacttggggagttgttctgtggtttatttagtttaaactgataatgcccagaaccagtttgataagagtctctggaggaggtacccaggcattagtacttatgtaaataccccaggtgaattttgaactagagccctaaagggtctgaatcttacttgtgtgagatgtgtaaaaacgagaagctatttccccttcagaaatagcagtggaaagcctttttgctctcaggtctccctgccctcctcttgggctcaaggacatggataatcctatctacccattgaggtcctttcttgggttttgtgggggttagggagactctcatatccctacccccaggaatcttctgatctttgaagaccaggctctagaatctacccctctggagctctttatcctgaggttccaacactattctctcactagggctcagaccatttagaggaagccctcccacctcaagccccacacaccatttcctctcccgaaagcccacacagcacaagggttccctgagatcagttgcctataggtcctctggctcagaagatgcaggtaatgtggttctaaaagaagaaataaaccacatgcagatcttcaaattataacttctagtagtcatgtctatttcattaacttctagaagggataatatggacttttattttccacattccacttttattgttaccacattcagatcttctaactataacttctagtagtctcgtctatttcatataacttctagaagggataacacggacttttattttcttatttctggtctttataataaacatctaaatacaacttttgttcatgtaaatggcaaattagcatcatcgggaaaatggatgagaagccatgaagaatggttgttctcctcataatgagcattagaatgtaaatagcaagattcaaaggagaggaggcagaattaagcacagtcaagacactgggataaaggactgatcagataatgtctggagcaaatcaaaatgatttacagatataaacaaatacataagcagtacatttataaattatagatgttcagctggaggagggtgaatagagagtggcatccttctttctcttctaccatttgtcaatattaggaaatatgacctgtaagaatttatgaagaactttgatattataaatttaacattgagtgtgttgtagccattggtgagataaatatatggcacaacctttgtggataattttgcctttcaattttgagatgtaaatttttttactactgttacgagtttcgtgtttaagacaggaatacaactactactttcagagccctctccattatatgagaattgagtcgaggacaataaagcaccaccatatccccatttttttttctataagagtggttttcagacttatttggtcgtgctttgttcaaaagagagcttaactaaatgctcacactggaaaaaaagatgtgtgtggaactgaacctacttgtgacccatcctcccagccctaagcatcttcccactagaaaccaggttccatgagaacaggtcatggatgtagcatttctcacagctacatcctcagtgctagaaaatgccaggcaggtagtaggccttgctcaagatttaagaaacgaaccttgtaacagtatgcaggactgtttggaaaccactattttcaaccctttcatttaaatattatctagagaagccactccagaaggaatacaaactttaagcaatgaggaacagctaatgtgcatatcagctgaatgatttgagcgtagatatctaaacaccctgcacctcaatctcatgagggttttataaagtgcctctatacacccccaaccccaagaaaaagctgaaaattttatcacttgtgttttatgtcatttgacagcaatgtaaaagtatcatgaacttttgcatatatatgtattccttggagaattcagaagggaccacagaaaccacaggtctaccagctagttacttgttatcaattataaaactttctggatgatactctcattctatctttctcttcaagtccagacatatttcactgcaaagcccaaattctagatgactgaagaattattcaacttcaaagggaagttaggaatggtcagttagccaacagagtttatttacctttactctaatactacagtacactgcaatgatttgcttccatatccatctccgccaatagacagctggttcctggaagatgaaaaccacattgtattcaccttagtaattaatgtaagtgcctagtgcaatgcaaagcacattgtagcctcccacttctgagtgtggggcagggacaaggaagaattcaaacgtaataaagtaactgaattccaggatacttggtattagctgttagagtagccttcaggaacatccttctttactcacaaaagtccaccacattcagggagtgaagcaaagtattatcaaccatctgattcttcatcctcattaaataggctcccaaggtccagccaccagcttaaaaaactggaaaggcttttaggcagtatttacatggtccaactagagagaggaaaggaagatcctgacaaatagaactcaaagactagctgacaataaacatcccccctgtgagaataagagcacactatgggagactgagaaagtagaagttaactcagacaaagaatgtaaaaatctgcccagccatcaggctggagaataacagaaacagagccagcttcagggttaataggaaacaatacttttttcaaggacattctgctactataaagtgtcttaacaacccctttctttgtctactagtagttttctgactcactgggaaactttgtgctctaaaatcaccagaaactctgctgtttgaaattatagtactcagaatgaagcatttcatttttgtctggaggatctaagttactctgacacaaagaaatggcctcgatttatcacctagagctttagaaaagggagttctggacatggcatttcacatcactcttaactttgtagtttgcaagcaaacaggaccctggtccacattgcagtgatattgatgcaaattgtgtgacccattgacacacaagccctgctttgccttaaacttaccaaaaattgctttgtttatatttcacttaaactccgcccttctcaaaaaatcctatgactcttttcctttgattattgagcagctttataagtggtttctctgctgtagagtctacctcattgtcataagtcaacaatcctgccttcgttggactatagctttgaacctgatggctttaggctgattgcactatgccaagacttaaatcttggtatccacctttccatgattgagtttaggttcaagcaaagctttatacaataaaactgttctcctggaggtcatagagctccactttgttccttgcgttcatttgggcctaagtgaacttgtcctcctcagggcttaagtcctcaactagccaccagcactgaggaaaggcctgcttcagcaatgaaaacagttcatcatttcccttttactaacccttgatttcaacacttagaacaccttggctcctgttggatgctgatcacaagaggaagcagtacttgacctctgtaactcttggtcccagaatttaagatgctcagagtccttatgtcctcagtgatgggtggcagaggaaatggtaatggtttttcttggtcctcggcttgggtgcactgattacccctaggaggcaggagcatgaagaggtgaagggaatgtcagcagaggagtagatttcatttatcagaaaatcatgcaaactagggaggtgcagaatgccaactacagcagcccagaatagtctattcagggctcagtgtttttatactcttcagaaaggaagcttactgccttcctatcctatctcccccaaggccagcacattgcaaggaaggattggcctttaactggttcgtttaccacaaaggcccagtaattagtagtaagagctgctatttaattccctcaactactttgtcttgctttgaaaagcattcagaagagcaagagtcttgcaagggatatctgttaaggaatataaaaagctcagctattcactataagcattacactctaacctcaaaacatctttagttcccaaacctagaggacacaaatacaaattttccccctaccacacacactaacaaaataaccacaatatgttttaagaaagtaaatacagttaaaaacgtctacagataaatatgtacatttaacaaatgctttcaaaagttatttgtagataaatcccagatgccaaaagggaaacactaataatttgactacataaaactttaaaacttgtttacagaaaccaaaaataaaacataacacactgtttagaaaggcaaaaactatgtgtggaaaaaatctgccattctgagagatgaagagctagtttcttaaacataggagcaatgctgatcagggatacaaataagcatgtcatagaaaatgaaataaaaatacccctcatccattttcttagaaaaacgaactataaagacagagtactaagggaaagaaacataagaaattctacatgttcacataagaataggcaaacaaatattaagtgttttttttttttttttttgaaaagagaaacagaggtctttgtatcaaagtttgcaaagataagattgtgaattaaaaatagaaaaaggccaggagcaatggctcatgcctgtcatcccagcaatttggtaggccaaggcaggaggattgcttgaagacaggagtttgaggccagcctgggcaacaaaaggagtccctgtgtctacagaaaaattttaaaaattagccaggtgcagtgatgtgcgcttgtattcctagctactcaagaggctaaagcaggaggatcccttgggcccagacattcacagctgcagtgaggtatgattgcgtcactgcatgacagccaaggggacagccagacagcgtttctaaaaaaaaaaaaaaaaaaagaaaagaattaagtttctgagtgaatttacttcaaatgggattttattaatgttcctataatccaagaaaatgtttctaatcaccacctacccctggccaatttaattgttgcaaataaagactgtatagtaataaatttaaaacaggaactacaggacttaaaaatatcaaggcatataaagatcaaaccagctcttatgaataaaacatccaacttaatccatatgaaatgtttttttcttcaaagtgcctaaatctagtactcatagcctcagtcattcttcaaattatagctcatgaataccatccaggtctgaaatttgttttaagatagctcttaaagatactgcaatgcatgactagttctgcctaattgatctaccacttgaaaattcacagtcataaaatccaagctgctgtacagccaagctctcccaagagcccatcattataatttttcctatagccaccacgtctcaacactaatggatgtaggaatattaactatgatcaggtacataaagaaatggtagcacccaaaatacgaaagcaaagggacaaatcatttttatctcagatttcaatatgcagtgtgcccatagagtatgcacaggcacatcaattcccctagctgtctgaatgtctgttcttaaacgttgtgggccatgctgactaccagaacaaaataaagttgtataagattgtatcaacggcgcgaggaaaagtacaataaaactatttgtaatgcatgagattcacatgctgaagttctcatttagacatcacagtcttatataataaattattctccctcctaggtatgaaataatattgtttaatgttcagattttaaactacagaaagaaatactaaggaaaccacggatggtatgagatgaagctcttttgaaagatacacacacacacttcttaaaccttgctactcttttttttttctttcaaatattctaatcttccatgggtcattttctttgattctcaatataaactaaatcttgactttttctttcctgaactcagcaaaggataagaaagtcaagcatactgaaacataccagcatagcaactcataatagctgcccattaacagtagtttttcaaacacaatctggagaaagactatacaggatgccatcaacaagtgtattgtgatttaatgactttatcaacatatttatttcattgctatttaataacactaaccatggcaacacaggataaaagaatttttacaaaacagcctatcttagaagtttttcaatttgagcttaaaattttaaagaatgaacttgatctaattataaaccacaatttaaaatgttagttcaaaattaaaggcctatcagaaattaccaataaaaaaggttgactaaatcacaaataaatacattttatctcaattatctcatctacataaccattaaaaacagtctgatttgtaggaatccaattattttgaaaaatcatcaatggtaaagaaaatacattttatgttaatttttgatgtcctaagggaaccaagttaaatggctaaatcagtttgtagacaacagatcaattcccagatagcccatttgctttcccctgaatacagtaatggaaggaacctcaaaggcaaactcagtattgccaatcaagccataaccttgtaccaagcaaaatgtgttgtgaaatgctccctttggtaaacagaggataccacagttattctgctaacatcctgagaaaagctaatccataaaacatttcattttaaactccctgctatggtctgaatgtttgtgtcctcccccaaaattcatgtgttgaaatcctaactcccaaagtgacggtatttggaggtgggctcttaagaggtgattagttcatgaatggagcactaatgaataggattagtacccttataaaggaggctctaggccccagagagaccccatccctctttcagccatgtgaggttatactgaaataacagccacctataaaccaggaagcacggcctcacgagaggtgaaatcttcagtaccttgaccttggaccttccagcctccagaactgttagaaataaagttctgttgtttataagctacccagtttatggtatcttgttgttgcagcttgaacagactaagacactattttaaaaaatgcaacagactttagagatacacctataagattaacaaacttatttagtagtatgtcattatagatttcaagtacattagatttgctgatctttccaatagtgtattttctttataaagcaaagcaaagaaatttaaccaattataagatattcactgttaaacatgaatacagtgaacaaagaaaggtacactgctcaccctaggccaagaaacagctaacagcaaagcatctggtctctccagactaactgctcacctaatagcactatgcttctggcaacttctagttcaatatatactgaataggatttgtgcaactctaatttaattcaccaccaactacatatttgtacaaattaaagcattcatattggatctttgttcaaagagtcctgagtgcaaatgaaaaaattaaaatgctgtacctttcagccatatcattacatgcactaaaagcctttctaaaagaaacactgatttgttatatcaaatgtgtaaaaggaccattcaggtcctcctttactgttgtttctcttcatttttcatttccattgattgaaactccttggtgcatccctccagcccctatttttgaacataattccttttttgaagatcagaccccaattttcattataatatcttcaaaaatgtttacaactgtgtgggagtctaagtctcttgagaaattctaagaacttgctttatgaatctgggtgcttccatgctgggtgcatatacatttaagatagtgagagcttcttgctgaattgagccctgtaacaattatgtaatgcccttctttatctttttaaatctttgttggtttaaagtctgttttgtctgaaactaggatcacaatccctgcttatttctgttttccatttgcctggtagatttttctccatccttttattttgagcttatgtgtgtcactgcatgtgagatgggtcccttaaagacagcatatcaatgggtcttgcttttttatccagcttaacatggtgtgtcttttaattgggacatttaacccatttacattcaaggttagtattgatacgtgtgaatttgatcctatcctcatgatgttagctggttattttgcagacttgtttatgtggttgcttcatagcgtcactggtctatgtacttcagtgtgtttttgtagtggctggtaatgatctttcctttccagacttagtgcttccttcaggagctcttgtaaggcatgtctggtggtaatggactcccttagcatttgcctttctgaaaaagatcttatttcctcttcacttatgaggcttactttgcctgaaaacaaactctaggttggaatttcttttctttaagaatgttgagtattgacccccaatctcttctggtttgtagggtttctgctgagaggtctgctgttagtctgacgggcttctctttgtaggcgtcctgacctttctagctgtcatgaacattttttctttcatttcagcctagagaatctgacgattacatgtcttgtggatgatcttcttgcttcatttcctaaacctgaatgttggccactctaggtagattggggaagttctcatggatgatatcctaaaatatgtttaccaagttgataccattctccctatctcttttggggacaccaatgagtcatagatttagtctccttatataatcccatatttctcggaggttttgttcatttccttctcatttttttctgtactcttgtctaattgtcttatttcagaaagccagacttcaagctctgagattctttcctccacctggtctgttttgatattaatgcttgtaattgcattataaaattcttgtagtgtgtttttcagctctatcaagttgtttacattcttttctatactggctattttgtctatcagacttcaactcccacgcaataatagtgggagagcttgacatcccactgacaatattaaatcatcaagacagaaaactaacaaagatattcaggacctgagctcagtactggatcaaagggacctgatagatagctacagaactctcaatcccaaaacaacacaatatacattgttcttatcaccacatggcacatcctctaaaatcaatcacataatcagaagtaaaacactcctcagcaaaagaactgaaatcattttaaaaaaaaaaaaaaaccctttctgacaacagcataatcaaattggaaatcaagactaagaaattcactcaaaaccatacaattagatggaaattgaatcaactgctcctgaatgaattgggggaaataatgaaattaagggacatatcaagaagttctttgaaactaatgagaacaaagatacaacataccagaatctctgggacacagctaaggccatgttaagagggaaatttgtagcgctaaatgcccacatcagaaagttacaaagatctcaagttaataacctcacatcacaactgaaagaactagagaaccaagagcaaacaaatcccaaagctagcagaagacaataaataactaaaatcagatctgaactgaaggagattgagacataaaaaaaaaaattcaaaagatcaacaaatccaggagcaatttttttgaaaaaattaatagatcactagctagactaataaagaatagagaagattcaaataaacaaaatcagaaacaacaagggggatattaccactgaccccatagaaatacaaacaaccatcagagaatatcatgaacacttccgtgcacataaactagaaaatctagaagaaatggataaattcctggacacatacaccctcccaagactcaaccaggaaaatgtgaacccctgaacagaccaataatgagctctaaaattgaatccttaatgaacagcctaaaagcaaactgaatccggcatcacttcaagaagcttatccaccatgatcaagccagctttttccctaggatgcaaagttggttcaacatacacaagtcaataaatatgatttatcacaaacagaactaaagacaaaaaccacatgagaatctcaatctatgtagaaaaaactttcgataaaattcaacacctattcatgttaaaaactatcaataaactagatattgaaggactatacctcaaaataagagccatctatgacatacccaccacaaacatcatactgaatgggcaaaagctggaagcattccccttgaaaaccagcaaaagacaaggatgccctctctcaccactcctattcaacacagtatgggaagtcctggccagggctgtcaggcaagagaaagcaatatagggcatccaaataggaagagagaaagtcaaactatccttgtttgcagacaacatgatcctatatctagaaaaccccatagcatcagcccataagctccttaagttgataagcaacttcagtaaagtctcaggatacaaaatcaatgagaaaaaaatcactaacattcctatacaccaaaaacagttaagccgagagccaaatcaagaacacagtcccattcacaattgccacaaaaagaacaaaatacctaggaatacaactagccagggaggtgaaatatctccacaaggataactacacaactgctcaaagctatcagagatgacacaaacaaataggaaaacattccatgctcatggataggaagactcaatattgttaaattggccatactgcccaaagcaatttataattcaatgctcttccattaaacttccattgacattcttcacagaacttgaaaaaaactattttaaaattcatatggaactaaaattcatatggagcccaaatagccaaggcaaccttaagcaaaatgaacaaaggtggaggcatcacactacccaacttcaaactatactacagggctacagtaaccaaaacagcatggtgctggtataaaaacagatacataaaccaatggaacagcatacagagcccagaaataaggctgcacacctacaactatcagatcttcaacaaacctgacaaaacaagctaggaggaaaggattccctattcaataaatggtgctgttattactggctacccatatgcagaagactgaaactggactccttccttataccatatacaaaaattaactcaagatggaaaaaagacttacatgtaaaatccaaaactgaaaaaaaaaaccctggaagacaatctaggcaataccattccggaaagagcaatgggcaatgatttcatggtgaagacaccaaaagcaatcgcaacaaaaacaaaaactgatgaatgggatctaactcaactaaacagcctctgcacagcaaactatcaacagagtgaacagacaacctacaaaataggagacaatttttgcaaactatgcatctgacaaaagtctaacatccagcgtctataaagaacttaaatttacaagaaaaaaaaacattaaaaagcaggcaaacgacataaatagacacttttcaaaagaagatatacatgtggataacaatcatatgaaaaaaaaagctcaacatcacctatcattagagacacgcaaatcaaaccacaacgagatatcatcttatatcagtcaaatggctattattaaaaagtcaaataacagatgatggtgatgttgcagaaaaaggaatgcttatacactgttggtgggagtgtaaattagttcaaccattgtggaacacagtgtggcaatttctcaatgacctaaaaacagaactatcatttgactcagcaatcccattaccaggtatatacccaaaggaatataaatcattctattaaagacacacatgcacgtgtgtgttcactgcagcactattcacaataacaaacacatggaatcaaactaaatgtccatcaatggtggaatggatagagaaaatgtggtacatataccccatggaacagtatgcaccataaaaaagaacaagatcacattctttgcagagacatagatggagctggaggccattatccttagcaaactaatgcaggaatggaaaactaaataccacgttatcatttataagtgggagctaaatgatgagaacacatggacacctagaggggaatgatggacacagacgggaacaacagacaccagagcttattgcagggtggaggcagggaggagggagaggataaggaaaaataactaacaggtactaggaataatacccggtttgacaaaataatctgtacaacaaacctccatgacacaattacctatataacaaacctgctcatgtacccctgaacttaaaagttaaattaaaaaataaataaaaatatttcatcatatgaatgtatgattttaactcattctctaattcatagagatttgcattattttgagttatacatgtttatttaatatttgtgtcaagtttttttgtgcaggttttttttttcaatgttatatatcaaggagtaaaactgctttgtcacagagcaagttcaattttatgcaaaactgaataacagttttccaatgcagttgttgcattaaaaaaaaactctataaaacattttaacaccacaatacaattcttaccaatgaggtttccctttccttccctaactccttattctatcaaaaggaaaaaacaagagaggaaaaggtgctgtgatcgtccctaaacacatcctcctccttgacccaaacatcaatacttgtccagggctgcagttcacccagcccctagaccaaggtaaaatgccactctccctaatgaatgttcaaaataagtgtataaacttcaccacagtctaactaggccatctaaagtctgaagtattaactgaaacaatattaagctccctatttaaactggaaccaggactacccagaggacatttgtttatagcctctgcagctacatcaatgtatatagatgtcctatattatcccaaatgctacaaagccaacaaaaggttagttttgcaaagcttacttttattttactcgatatgtaatattacagggaaatctttctgacaaaagtctcaatgagggccccttactgaaattgctgtaggaaactctaccattgcctccatcacaagcaatttttttgtagacttaattatattgaaactctagagaaacttctgttttactataaactctacttcatcaagaacttgttccagaaggaaaataaaagagttacactatgaaagtaatgtttgagttttcctgagctcacagaaaatacttatgtacacttgcctcaacttctgcttgatttttgcaagacagggagtcaggaggggaagaaatcttcctttgtagaaggctctcattaacacagttaccttggacagctagatgttcacctgatgaaagacagccttatccctgtgacaaggaggacaagtgcaatcatttgttcaggtgtgcctcccatttagagaaatggtcttccaatcgtaaaaatgctgtcacattttcatacagtcacaagataaataagaaagtgccttataaacaaatcttaaatagattcaagtttgtagtctttgcaccattcaaaaatatggccatttcctttaaataccagctctcacatttggccaattgccttggcaataatattgccttaaaatgtagtgactaactaatgccagaaaaaacagaacacagatacagtattattcttttctttctagattgagagaagacagaagcatatttttaagaagtatagctatgtagggctgggcgcggtggctcacgcctgtagtcccagcactttgggaggccaaggcgggtggatcacgaggtcaggagatcgagaccatcctggctaacacagtgaaaccccgtctctactaaaaatacaaaaacaaaattagccgggcgtggtggtgggcgcctgtagtcccagctacttgggaggctgaggcgggagaatggcgtgaaccccgggaggtggagcttgcagtaagcagagatcgcaccactgcactccagcctgggtgacagagccagattccatctcaaaaaaaaaaaaaaaaagaaaagaagtatagctatctagaatgcaattaacctaaataatttaaatggaatcaaatgcaagattataatctatgtgtcaaaaggagtctgaacaaggagattaaaatgttaacactggcactcatattagtcaaaatacacctagcaattaaaagttttttaaatgttcaactgttcactttctatcatagagagtttgttcaatgtctcatattcatacttctttcagtcaacacatctatcggcattgaggaaaggccactgaaactcaaatcaggtggtgtaaatttatattctcacttggccacttacaagctatgtgactgttgaaagcctgcctctggcagctcttcagaaaaaaagatatgtaacctctactactcggttatcctgggtagaaaaccacatcatatgcaaacactacatatggcataaattgtatttaacaagtggaaaagtagcatttacataaaagatattattttactatctactagcaagttcagtgcctggactatattaaacattgaataaaataacatgcaaaaacatccacggttataatactagttttattcctactcaacatttattggttcacaatataaaatttatgagaaatattttgatatatgtagaatcatactggaaaatttaacatctccttcagatttctcaaaataaaaagcacatagaggttcaacacgacaacttgccaaaatacattattagagagaaaattttacctcataaacagataagcttttaaaataaaaacactgttgtaatctataagctttacaaaaactgatcaagttccagagcagtgacttctaaacattaaaattcataggaataccctgggatcttcttaaaattgagattctaaagtagtagatgtaggttgggggctgagaatttgccttaatgctgttaactgcctgggaactacattttgaatagcagggtcctagatcatgaagtaaaaaaaaggaaccacattatatgaggcttcaataatagagctagtatagtaaaataagaatttacaactaaaggaggaaaagagcaaacaaaaaattcagctgggtgtggtggctcacgtctgtaatcccagcactttgggaggccaaggcaggcagatcactttcgaagtcaggagttcgcaaccagcctgaccaacatggtaaaaccctgtctctactaaaaatacaaaaattagccgggcgtggtggcacatgcctgtaatcccagctacttgggaggctgaggcaggagaatcacttggactcaggaggtggagatttttggtgagccaagattgtgccactgtactccagcctgtgcgacagagcgagactctgcctcaaaaaaaaaaaaaaaaagaaaattcaagtgaacttcttaccttggggtaattaagaaaaacactatttgggctaaagagaaaattaaaatgaaaattgtacataaaaactgggcaaagaaagcacatttaaaactagaaatgctataagccaaagcaatactcaaaaatatgtacatatagggagagatagagaccaaaacagaatgttcaactgtaagactaacataatccactaaccaaaatcagacaaagacagcaccaaaagccaatgtacgttataagaaatgctgcaaaaatcctaaacctactaatgtttataccagatatgcttaagtggtccaatatgtattaaaaaaactcctaaagaaatctgttacattaacagattaaaggacaaaacccatgtgatcatatcagtaagtgcttgaaagattttgatctaagtaattcatcactttgctaacaaaatgtattagcaagcaaggaacagtattcaaggtccttcatttaataaaaaatatctagcacaaatcaccacatgtaatagtgaagaaatattacacatgttcccattagatcaggaaaaagacaaggatacctattatcattgctactataaagttacataatggaactttcagtaaatgcaatgagaaaagaaaatgttaaccaaaaagaagcatatgtaggaaagaaaaaaatgtaaaaattgtctttcctgaacaaattatataactacatgaaaatgaaaaagccaagagaatctttttttttaatttttatttattttttttttctggagacatggtctcactatataccccaggctctatcaatccaaccaactcagcctcccaaagtgctgggattacaggcgtgagccactctgcgcaggtgagaatcactttttaaaaaactattagaattgataagactctggtaaagattcaaatataaaatcaacattcaaataattaaaaagtattacttaaaaatctctcataatagaaaagctacaagatgtctaaacagtatcacagcatgtataaaatctatttagaaaagctataagatgtctaaacagtgtcacagcatgtataaaatctatttataaaagcaaattactgaaggacattaaaaaaactcaaataagtaaagagttttcatacttctattttggaggactctatactgtaaatgtgtgaaatatccccctgattaccctacaaatgcacccaaaaaagctcagctcttaaaaactgacatgcatttacaattcattttcaatgagaaaaaaagaaataccagagaacctacgattattcccttcttagaacaagctgtgctgtttcctgcctcaggccctgcctaatgcacttcctgttccctctgcgtcacatgctgtgtacctccactcttcggtaatcgctggtcagtctcactcattggatctcagcccccaaaaatccgttcttggacttctttatttaaggtaggcaagcacatacaggtccataatacaccctaggtgtgatctatccaatcatccacttcaaactgtgaccatctcatctatgagatgtttatcctctaaacaactaaacaatgcttaccctctagcactcccatcagaactatgttccaagagctcagaaatcatgtctctcttgtcatttccagatagctggtatcacaatgactgacacatgagcttattgttcttaaaattcttaaagcacgtgtctactttcaccattagcagcaatctaaaaacctacagagccaaagaattacacataaatacaatggaataatatacagccattaaactgatgttgctgaagaacaattagggacaggaattaaagcaaatggaacgtagagcacaattccatttttgtagtcaaatttatgtgcacaaaagacatatatggatgcacataatacaacaattacctccactcatatattttaaatgactttatttgtatttaatgttttattttcacattttctaaaaaaatatgaattatatttaaaggaagaaaaactcaatataggtttgttattgtatgcataggtatgtgttttaagaaaacaggcctcttcacttcctccaactcccttattacctttgtcacaacatatataaactcagaaaaaaacattcaaaattataaccttgaactcaacaagccacactggaaatacactcagtgctgctcatagaaacccacttaatccctgtcctgctgctttaaaaaatgcaaaatcttaagtgaaaaaaggtaaatgttgccagcatttgttctgtaaagggaaatcacaattcagaaagactcattttttccctttgaagttaggaacaagaacaaaacctccctaaattctcaccctgctgctgcaagaggaagaacagaagagagaatgttctgtgatggaatctcattttggagtctgaaagaacgctacattgctgcctctgtgacacagagcttgccattttctatggtgttttctatcagaatcacatgaaaatgtgacaaagccataaatcacaggaaactttcaccactagatggtgagcttgtggcttggcagctcatgcctctgatcattggtctcttcaaccaaaacatttaagaaatcagatatccatttgattcattttaaaaatttatagtattctttgatggtagtttgtatgtctgtgggatcggtggtgataaaaatttaatgaagaaaacaagtactttgcaactaagcatgatacaagtcaaatgcagatagctatcaaaacatttttaaaataaccaaagtgattacacttaagtcctgttaagtcctggttttcctaatacacatcttatattcaaatttctctaggggatgggttacttaataaagtgagaattcctgtacttaggatccctagttttgacctgctgcttatcctgtctttttaaaaccaggcttgaatggaaaaaaaaaaaaaaaaaaaaaaaacactgcaaagcacactctgaagcttttgcttaagggacagctctcctttggccagttcactgtggtcactcattcccagctaccacactgctctcttatctctggttcctgactgacctgcactctagtttgttcagaaaagtctagaggtgaagctttaatcctagcccacttagtttcctttccccgcatcagtgccaaggcattagcagaaccagtatttctccataagggaaaactaatgaattcattttaaaccaacttcttataagccaagacaaggcattagctatcagtcatgacttcaaatagatacaactgctgaggactagcacgttgcatttttccagccacaggtataacctgtgcatttaggttattttatttttctttcaggaaaatactcaatataattaaacatctgctctctaacatcctatacaaatgaatggctgatgattttagaatcactgacagtttggtttaaagacagaagatcatttaatttattgtttttaatagaaaatttcttaaatgacattttaaggaaatgtcaagaatgttggtagaactagagtgtgtagtgtaagaaaaagatgcgaaatttaagcctttcttaaactgcggaattatcttatgaatggcaattatactcaatattgtgatacagagacacctcaggacccaatgcatcataaagggtcagtgttcctatatcaaatgatgctggattgccatccttttcaaattcttatatgctctgtaagatttcctatgtcttgccttgaagtcaactgtcatttttcatggtaattcactatgctgcctatagaaattcttatcctcatttgtttgctatttctaataccatatacttaaaaattaaataggcttactaaaattgtacatgaaacaatgaataagctctggggattggtaaatagaattcttatctatcacaaccttgtgtacttcagtgagagaactctgttatactcatttagagatacattatttaataataattgtgtatgtatcttgtgttcctttattaactacaagtttcttaagaacaagagccacatgaatcacctttgtaaccccatagctaacccccagcaaggtaccctgataaatgctgaaagcattttcaatcattattattattattattgttattgagaaggattcttgctctgtcgccaggctggagtgcagtggcactatctcggctcactgcaacctctgcctccagggttcaagtgattctcctgcctcagcctccctagtagctgggactacaggcacttgccaccacgcctagctaatttttgaatttttagtagagatgggttttcagcatgttggccaggatggtctcaatctcctgacctagtgatccgcctgccttggcctcccaaagtgctgagattacaggagtgagccaccacacccggtcttcaattatttttattgtttacttcccttatattttagatagtttaggtccagatgagtaaggttctagtaattttaacagtggaaccaaagatcaaaactctctatacttatcagcttacagcctaagttgtggtccttccaaaattgccttctctttaattcagacatgtcacataatcaccattcctggttatgagtcaagcaaccaggtatcaggagaagccacagcagagggtctctgaatgtcaagggctggtgaaaggccaatgctggtagtatacacaaaggcaccagttagataccaggaaatacgtgccctataactcacaagagagacttctctcccaaaaggaagaaaaaatgcacatggatacctttaatttgctacagccctgtgaatgcttaaatttggatagggcagcaaaatgaggcacacagctgtaacattagctcttcatggatgttttaaatatttttaaacttgccaacaaaatagccctttctctgttaagtaggaggtatggatttttatatgtattaatatttatattagagcactgaatgtgcaaacctttgttttatgatcatttctgaaaatataaataagaagtactagccctgatttcttgaggcttttggattttcttaatgtggcagtcacaatagatgagactcacattgttagaagctattcataagcaatttacaaaattataaattcaagttaggaaagttgactatctaaatgtttccttatatctctgaggatgtggaagattagtgttcactttagaatgaataaatcagtattgtgatgatctcagttctacaatgaaataaaagtgtttagaactggtaataatcataatttgatctatgtcatttttttctactactgtacccacagaactaaaaacaaatctaacgaaatgtgattgggaaataagggccagaatctacaatttattgcccaattaattatctctttagttacttcactatattggcatggacaattaatgggtttacaacaccaatgctgctttaacactgacttaaatattttaagatgtctaaaaaacaaattgacaatcagagtcctgccatctattaacaacaacccgaatgattttatctttctctcacagcttaacattaatgcagtccaggaaatattctaacatagtaattgcaacaaataatacagattatctaaaccatgagtgatgaagttagtgctaagaatttcccccagacctaccacttaggtaatcttttcttctatgattacttaataatattcaaatatagaaatctgttagcttattatctaaggacagattatattaaaactaaaataagttgttgcaaaatttgtttttgtttcatgatttccaaacagccttaaagactgtgttaatctatgggacaggggagaatacatgtgacaactatcaatctattgcctcttagcaccaaatccactgtttattttctaaaaagagagctgaacactagaagtaagcattcctcctttgcagtgaaaatgatgctaagttttgtcattaggggatactgtaaggacagagcaagaggaaggggctttctttcctcgttccagcacatttgtatttgcttctttatgctcctgccaccctgctacaagcagtgcatgcagggggcatgtgctggtggcctaccccagcggtatgccccaacccacagacccttggtaagttcatagccagcccaactctggcccagtgaacatgtcaccatggccctcccaacacagacactgcaggctccaagactcacatcacttagccagtgatcatatccccagtgcctgaatccctccatgtgtccatccaccaggctgggcccacctgaacccatgagaggtgttccaggcctgccagcctcaagttgcctataatctggagagaaattttctgctccactggaaagtatggaccaactctggcctggacaactcagcaaacttctctgacatccaataggccacaatcataatgtctacaatgaggtctgaaacccagcctcgggaggcggctccccttccaagtttgttccttttggggttgctattaatataacaaaatgccacagactgggtggcttaagcaacagaaatttatttcctcacagttctagaggctggaagtccaagatcaaagtgttggcaggtccggtttcttctgaggcctcctccactgacttgcaaatggataccctcttgctatatcctcacatggcctttcctctgtgtgcacatacaatcttggcatggggggcattgggggaaggtggtctgtttcccaagtttccttttcttagaaggataccagtaagaccagattagggatcaccaaaaaggcctcattttaatgtaatcacctctgtaaagaccttatctccaaatatggttacattctgaggtactagggattaagacttcaacaaatgacgtagatataaagttttcactgtagatgtaaaacaaatccagttcagatagctctaaacagaggcacagtacccttccaacatattctgaagcctcagcacttgccacaataacattctacttcaatacaactaatatactgaataaatttatggaaagcagtatttcagaacgtcaagtcttggtactaggagtgctcacgattaccagattggttattgcttctatgtgtcttctgtagaaaaaaaagctaggaaatatgggctttctgatatgtattaatggtgcagtgtgttgttaaactgcttccctggcaacattctatgttcatgtttttacaacattagtatttctgcagttcgtacccttgtgatttagaattaagaaagtaaaatgtggttttgcaatatcaaagtatagcccagttacattctctgccacttattaatcttaactactgtgacaactttgttgatcaagaacatgaagtcctgtggtataacattaatacacaagataacagtttcattaccttctgctggagtgataaaacataaaccacttgcttggtctaagacagcccacacagacacttaaaagtgttgctttgaggcaaggaagttagatgtcaaactgtctacttcttatacataaattgaagttttccttgtaaatgtaaaacaaatccagttcagatatctctgaacagaggtatagtacccttatggctttttctgaaatcccagcagttgccacaataatgttctgcttcaatacaaccaagatattgaatgaatttctggaaagccttatttcaggacttttatcttggtcctaggaatgctcactatcactagattggttactgtttctacagattttcagtacaaaaagaaaagatctaggaaatataagcttatttatctttcattttatatatgtatggtaaatatgcatgatatatgtatgtatataaaagttcagattgtcatactaataattttcattaaatgtaggactatatgttccttatattcttaacaggaggggacacttacaggctcctggagtacttggcaaggctctgtatccccttgttaccaaaacaaggatgtttgcctttagtaactcattatgcttcatatctgcttcatgtggttttctgtatatacattgtataaatattgtttcatataacaatgttttaaaataccaaaatggcaaagttaaaaatatggcaagggtctaagacaaaagtgtgctccctcacctcctagtgtgaatcagctttgtgatatggtatctctttaaatctacaatcatccatagactgcctcagccgggcgcagtggctcacgcctataatcccagcactttgggaggccgaggcgggtggatcatgagatcaagagttcaagaccagcctggccaagatggtgaaaccccatctctactaaaaaaaaaaaaaagaaaaaaaaaatttaggcaggcatggtggtgggtgcctgtaatcccagctactcgggaggctgaggcagagaattgcttgaacccgggaagcagacgttgcagtgcgctgagatcgtgccattgcactccagcctgggcaatagagagagacactgtctcaaaaaaaaaaaaaaaagactgcctcatactaggaattcaagatgatgttccccagttaaatattttggtctaatttggcaattttataatggtccaaggaaagactaattataagaagtcaaatactaacaactcctgtgggaaataatgtctcctcctgtcttgttattctcgggatatacagaacctggaatgtataagttcatgcaagtgtccagtccaccctcatagggtaagagcttgttgcctatatatacaactctaaagacaacagattctctcgtctttccacgtgtcaacctctaagccagaatttccaaaatttcagtcattcaaaggtactaatggcaggtgctaatggttattacacacatatacacatatgcacacatgttctatgtcaaatgagctggaaaacagttcatggtgtattctacttgaagacccaagctctgagatctcagctataccttgcagtagaggacctgattaaatttgtttactctagcttttgcccaagtaagtttacatctagcatccgtctgtccttgaaactaggtttggaaaatgttgtaccaagtaatggctttgcttcacctctaaaaataatttaggaagaagcatatgatttcttccttccccagaactcttcagattccctagtaagtgggaaggtaagtaaggaggtaaataaggaagcttgtggctcctattgacctacttccaccccttggaagatccatttgcatttagtgcacacagaatttgtcatggtctcagaccagaaggtgaaactggtgtatgtcttccaggtcatatgtatgatttttatattgctcatagcacaacttgtcatttctctatgaaattctcaagaaactggttgaggaattttggagaccacagtaatcagggattctcaaactttaaagtaaaaagaatcaccttaagtccttaagtcctatttaaaacgtagattccaggagctgattcccaacaggctatgtaataatgtaataatgtttaagaaagcaatataaccatttattcgcaggattttatctatattgttagataggtctggggctcaggaatttgcttttttagctcaagtgatccttctgcctcagcttcatgagtagctgggactacaggcacacaccacagtgcctggctaatttttaaaaattttttgatagagatgaggtctcactatgttgcctaggctggtatcaaactcctggcttcaagtgattctcctgccctggcctctcaaagttctgggattatgggaatgagccaccatgcccagcctaaaaaaatattgcttaatactgatttagctgtttgtatccatcttgcctcctacttctgttaatgtgttagatgttggcaactaatatattctagtgcttgtataaactacatatgaaagcaagatccctttggtaaactagagtatgtcacgttctgataaacacatggaatgagggaagaaaagcattttctaataaataatagctatttttaactttgacaagataggcaaatgaaccaccattttctgaacatatgctgtccacaggcaatgtgctacccatataatctcattcaattcttctagtaacaccctgtaaatgattgctttcccattcagctgatgagaaaagtaaggacaaataaattacaaaggtcctttagatagtaagtagcatatggctgccttccaagttaatctggaggggtgattaacttttctgtccctatttcctaatcagcaaaataacacagctataaaattatctttggatatgttgatgaacatctagcatgattttctagagtccaaaatgtagctgcttctagtaaattgaatatctggataattttggactttcaaaataatttttcatgtttttacatattatgccatttatttttaaagtaatttaaactatttgcattttagtatttaactaagattaagataatatacctgccagcagaaaggttttcagtcaccaataattgaaaacccatgtatctataatatagctattaaatctgaatattttaaaacaaaaaaagggacgacagacatgtataatggtaatttttaaaaacaaattatggtctttggtgcatattagataaaagtaccttgttctcctatgtcatagttacctaagtacgtcaacatatttctttgatatccttcccagataaaagtggcttcttagacacggagataaagaatcagtttttttcaaggacattttattacatgacactgtgctaaacagaactactgattagacagatcatttgctaagtggaagaaactctctttcatttaattatccactcaatcacttatttactgttctcttcctcctttagaatttcagtattctcagtcctcagttaatctgggaattcacctatttttttttttcactcctctatatttcctttcatagaacttagcagatagaagtcccaaaggactaaagattctacttgtcctaatgtcttccccagggattcctgaagcaaatcaattccccatctataagatggaaaattagtatattcatggaggttatatatgttggtaaagaactgttctaaaagagtttcatgacccattgatagaaaactgaagtaaaaaaaaataagtagcacttattctggttagctataatgttgtaaaactttgaacaatgctaaagctaaaaagtctattagatgataaatgtagaaaacaaatataaaaaaatttaaatgtctttttaaggtggaaatcataaccattaaaaacacttgtttggaaaaaaaaaaaagagagagagagagagagcaagcaaagaaagaaagaaaaaaagaaagtagaggctctggcccagcagctagcccaggacctgtcatgaattaggtgggaataactgtaggatcgaacagaattcctaggtaatggcttgaattttattttcaaaaataggtactggaattcatttttcaaataataagtcttctattttttctcctaaaaaatgtgtgtatattggtgggacagggggagaggagagtttgctttctttatgataggaccaatgtcttatttatcttcagactctctccaccgtgctcccaacacatgatggttattcattcaacaaataatacagcccctaccaccttccaggtattatggcagaccagatgctaaagataaaacctagttctattactaccattacagccatttttaaagtaactacagtgcactagtacaaacttactctacagaaccaacattactgtttgatgcacactgaaaacacatcggatgtttttagttcattctctatgggctgtttgccaattgggccttggaccccaaaatctagtaatcagattatttggtgatatatccaatatgggacacagcaggaaaagcctcaataacaggactgaggccctatcactttccattcttcttcctctgctcaatcagatttcaaagcagcacaggtacggaaaaaaaagtttttaaaaagttggtgttattatcctagagaaaactgcaagctaattatgtccatcagtaccaagcttctttgaccctccctgcaagaagtaagtcaatacctacattttacatatttttcttctttcccactcccaattaagaaaacatacttaaagcaaaatcatgaaaaggaacaaacactttaattttctatacaagtccaatttttagatttaattatatgaacaacctacagtaattatattttttaattatgctaatttgtaataattacatttaagtctctttgctaaaacgttactgtgaaattacataactcatcatttcaaattgtttattaccatcaacggagtgtttatagttctctagtcaaaaaccattcaaaactactgtcactcgtaaattacctcacttttttatgctgagtctttcaaatgcagaaatgttcttaaaagcagaactttattatcaagttggacttaagtaaacgcctggaaatgcatggaggctgcaaaggggcattctgacaatttcattgcataaaaaccgcattattctaaggaaaagccttatcccaattattttttgaggctttatatggtaacatcatttttagtagagcacaataaaagacagtggatattggaaaatacttaatgaatagattatatttatttttaaaccatatatgtactaacttcccattttttcaaatatcttcccttaaattaatgctgaacaaataaataagtcccataaaatgttaaccagagagatgtgagggctgagtgaaagttttaaggtaatattgactatccattctagattcaattctttgatttaaaaattacttcgtcaatgtgtatacaaggacgtaagggcaaagctagtcatgttatccccattttatagctaagtaaactgagtctgagaaaaatttcagtaacttggcccagatagcatacctgggtatgtggaagctgacttcaaagttcttaactaaaccaagctattctggttcctatatgataacatggtaagaatttggaagggaaaaaaaaaaatcaagcagaggttttgatggtaataacgtgactagtaaaatcttaacagaaataaccaaattaaggagacttatactaagcagaccacttaagcaaaatgatgacatgatatcttcttaacttagtgaagctcaaaacaaacagatttttgatacatcaaatggattactcagagaagcatctgaatcacaccactagatccataacatggttggtaaaaataataaattctatattctggaggtcagcaaactggttttgtgtgtcctgaaagctaagaatatcttcacatgtttaaatggctaaaaagaaaaaagataattattcatgacatgtcaaaattataagaaattaaaattgtagtgtctataaactaagttttattggaacacagccgtactcattcatttgtgtacaatttattgctgcttttgtactacaacagcagagttgaactgtcaagacagagacaatctgatccataaagcataaaatatttaccatgtggccctttacaaaaaaagatttgctaacccctaatctaacacatacattaaattgaatccgttgttttcattacatggaattgaaaataaacagcatttcgctattttattgagaagaattactatgaatcaagaaactatgatgtcaaccatcaaatggaatgtacattgtttcattaaatttgccatattctgggtaagtagaaacttcctttagacaatttggattcaggctctgtttactataacaagctgtgtggaattattcctaggtcggccccagaactcttgcacaaagaacccaacttagaaggcagaaaggctaaaaacaaaaacaagcagcagcatgcagttttatatgccaatgccaagaaggagttaagatctaaagaaaagaggtttaacaaaacagagacttccatatagactgcaacatagctacaataaagaaagtggtttgagcgtgttactcctgcacatcattaaaatttcattctacacataatgtaaggtttgtttcctctagttaaactgttaagtcagtctgcaaagctcatctactagagatgcactcctaaccaaaacaaaaatgttagctaatttgcttctggcaagaaatgtgcctaggtcccaaggaatactcaagagctataaagttattcaaatgatactgcttttatcccacatctggaaaagccgataacagctaatttcacaaagccttacctcagaaaagttcatccacaatttgtaacaaaagatcaaaacattaaccctcatttagaagtcaatgaaaacaagtataagttttccctgtctcactcaagaaggcagacatgctctaagagggaaaaacagaaacacaatagcaatagacctggaggaaaaaaaaaatccatgggtaataatgaaatacaaaaaaaattcaaaatatattgcagcgaaacgttagacatcgacaaagctgatagagcataaatccatataaatttctacatcattataaagccacatccattattaccactaaactagcagtcactgatagaagaagttgtttccattttactgtcagaaagcagctccaactgaaatcattttgctaaagaattaaccaaattagcagaaagaaaagacaaggaagttctgctttctcgaaggttaatttaaaaaaaaattaaaagttttattgatacctaatagttgtacatatttaggagtacatgtgaaattttgatacaagcatacaatgttaattatcaaatgagggtaattaggatatccatcatctcaggtatttatcattttttgtgctaggaatattccaattccactgttttagttatgttgaaatatacaataaattattattaactacagtcaccttatcatgctactgaacattagatcttatcctttcttcctatttttttaaccactagccaactcttctttatctttccccacccccacccaccccttacccactatctttcccagcctcttctaaccattattctactctctatctccacgagatcaatttattttttagatttttttagctcccaaatatgagaacatgcaaaatttgtctttctgtgtctggcttatttcacttaacataatgtcttccagtgccatctgggttgttgcaaatgacaagatttcattcttttttatggctgaataatatccctgtgggtacatgtgcacattttctttatccattcatcagtggacatttacgttgattccatatcttggctattgtgaatagtgctgcaataaacctgaaagtacaggtagctcttaaatattatgatctcctttcttttggacatacagcagtggaattgctggatcatacagtagttctatttttagtttttggaggaacctccatactgttttccataatagctttgtgaatgtacattctcagttacactgtaggaagagttcccctttctccatgtcttcggcagcatccattattgcctgtcttttttgtaaaagtcatttttgtcaggcctctgagcccaagccaagccatcgcatcccctgtgacttgcacgtatatgcccagatggcctgaagtaactgaagaatcataaaagaagtgaatatgccctgccccaccttaactgatgacattccaccacaaaagaagtgtaaatggccgatccttgccttaaatgatggcattaccttgtgaaagtccttttcctggctcatcctggctcaaaaagcacccccactgaacaccttgcgacccccactcctgcccgccagagaacccccctttgactgtaattttcctttacctactcaaatcctataaaacggccccacccatatctcccttcgctaactctcttttcagactcagcccgcctgcacccaggtgaaataagcagccatgttgctcacacaaagcctgtttggtggtctcttcaaacggacgcacatgaaatttggtgctgtgactcggatggggggacctcccttgggagatcaatcccctgtcctcctgttctttgctccatgagaaagatccacctacaacctcaggtcctcagactgaccagcccaaggaacatctcaccaattttaaatcaggtaagcggcctcttcttattctcttctccaacctctctcatcactgtccctcaaccactttctcctttccactcttcaatctctcccttctcttaatttcaattcctttcattttctgggagagacaaaggcgacacgttttatccgtggacccaaaactctggcgccggtcacagactgggaaggcagccttcccttggtgtttaatcattgcagggacgcctctctgattattcacccacgtttcaaaggtgtcagaccacccagggatgcctgccttggtccttcacccttagtggcaagtcctgcttttctgggaaaggggcaagtaccccaatcccttctctccttgtctctaccccttctctgcttttctgcgggaggggcaagtacccctcaaccccttctccttcactcttagcggcaagtcctgcttttctagaggggcaattaccccaacctcgtatctctgcgccccaatcccttatttccatgccccaacctcttatatctctgcaccccaatcccttatttccatgccccgacctcttatctctgcgccccaatcccttatctctgtgccccaatcccttatttccgtgccccaaccccttatttctgtgccccgaccctttatttccgtgccctgaccccttatttccatgccccgaccccttatttctgcaccccatcccttatttctgtgccccatcccttatttccatgccccaacctcttatctctgcaccccaaccccttttcctacttttctggaaggtaagaacccccgaaccccttccctccatttctctactccctcttttctctaggcttgcttccttcactatgggcaaccttccaccctccattcctccttctactcccttggcctctgttctcaaaaacttaaaacctcttcaactcacacctgacctaaaacctaaatgccttattttcttctgcaatgccacttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacgtcagtcccttcctagtctctgtgcccagtgcaactcgtcccaaatcttccttctttccctcccgcctgtcccctcagtaccaaccccaagcatcactgagtctttctaatcttccttttctacagacccatctgacctctcccttcctccccaggctgctccttgccaggccgagctaggtcccaattcttcctcagcatctgctcctccaccctataatctttttatcacctcccctcctcacacctggtccagcttacagttttgttccctgactagccctccccatcctgcccagcaatttactcttaaaaaggtggctggagctaaaggcatagtcaaggttaatgctcctttttctttatcccaaatcagacagcatttaggcactttttcaacaaatataaaaatccagcccagctcatgacttgtttggcagcaaccctgagacgctttacagccctagaccctaaaaggtcaaaaggccgtcttattctcaaaatacattttattacccaatctgctcccgacattaaataaaactccaaaaattaaattccagccctcaaaccccacaacaggatttaattaacctcgccttcaaggtgaacaataatagaaaaaagttgcaattccttgcctccactgtgagacaaaccccagccacatctccagcacacaagaacttccaaacgcctgaactgcagcagccaggcattcctccagaacctcctcccacaggagcttgctacatgtgccagatatttggccactgggccaaggaatgcccgcagcccaggattcctcctaagccacgtcccatctgtgtgggaccccactgaaaatcggactgttcaactcacctggcagccactcccagagcccctggaactctggcccaaggctctctgtctgactccttcccagatcttctcggcttagcggctgaagactgacactgcccgatcgccttggaagccccctagaccatcacggacgccaagcttcgggtaactctcacaatggaaggtaagccccgtccccttcttaatcagtacagaggctacccactccacattaccttcttttcaagggcctgtttcccttgcctccataactgttgtgggtattgacagccaggcttctaaacctcttaaaactccccaactctggtgccaacttagacagtactcttttaagcactcctttttagttatccccacctgcccagttcccttattaggctgagacactttaactaaattatctgcttccctgactattcctggactacagctatatctcatcgccacccttcttcccaatccaaagcctcctttgcatcctcctcttgtatccccccaccttaattcacaagtataagatacctctactccctccttggcatgatcatgcaccccttaccatctcattaaaacctaatcacccttaccccactcaacgccaatatcccatcctgcagcatgctttaaaaagattaaagcctgttatcactagcctgctacagcatggcctttataaagcctataaactctccttacaattcccccattttacctgtcctaaaaccagacaagccttacaagttagttcaggatctgtgcctaatcaaccaaattgttttgcctatccaccctgtggtgccaaacccatatactctcctatcctcaatacctgcctctacaacccattattctgttctagatctcaaatatgctttctttactattcctttgcacccttaatcccagcctctcttcactttcacttggactgaccctgacagccaacaagctcagcaaattacctaggctgcactgccacaaagcttcacagatagcccccattacttcaatcaagcccaaatttcttcctcatctgttacctatcttggcataattctcataaaaacacacgtgctctccctgccaattgcatccgactgatctctcaaaccccagcaccttctacaaaacaacaactcctttccttcctaggcatggttagtgtggtcagaattcttacacaagagccaggaccacaccctgtagcctttctgtccaaacaacttgaccttactgttttttgttttttgtttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgaccttactgttttagcctagccctcatgtctgcatgcagtggctgccactgcattaatacttttagaggccctcaaaatcacaaactatgctcaactcactctctacagttctcataacttccaaaatctattttcttcctcatacctgacgcatatactttctgcttcctggctccttcagctatactcactctttgttgagtctcccacaattactgttgttcctggcccagacttcaatccagcctcccacattattcctgataccacacctgacccccatgactgtatctctctgatccaccttacattcaccccatttccccaaatttgcttctttcctgttcctcaccctgatcatgcttgatttattgatggcggttccaccaggcctaatcaccacacaccagcaaaggcaggttatgctatatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcaaggatttgccccacccaggactggcaaattagctttactcaacatgccctgagtcaggtaactaaaataccttttaatctaggtagatactttcactggataggtagaggcctttcctacagggtctgagatggccaccgcagtcatttcttccgttctgtcagacataattccccagtttagccttcccacctcaatacagtctgataacaggtgagcctttattagtcaaatcagccaagcagtttttcaggctcttagtattctgtgaaacctttatatcccttaaggtcctccatcttcaagaaaagtagaatggactaaaggtcttttaaaaatacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaacttgtcatccctactatcttctgtctagtcatactcctattcaccgttctcaactactcatacacgccctgctcttgtttacactgccggtttacactgtttttccaagccatcacagctgatatctcctggtgctatccccaaactgccactcttaactcttgaagtaaataaataatctttgagggcaggactatgctgaatctccttaggcactctctaatcagatatcctgagtcgtcccaattcttagaccttttatacctgtttttctccttctgttattccatttaatttctcaattcatccaaaaccgtatccaggccatcaccaatcattctataagacaaatgtttcttctaatatccccacaatatcaccccttaccacaagacctcccttcagcttaatctctcccactctaggttcccacaccgcccctaatcctgcttgaagcaaccctgagaaacatcgcccattctctctccataccaccccccaaaaattttcgccaccccaacacttcaacactattttgttttatttttcttattaatataagaaggcagaaatgtcaggcctctgagcccaagccaagccatcgcatcccctgtgacttgcacgtatatgcccagatggcctgaagtaactgaagaatcataaaagaagtgaatatgccctgccccaccttaactgatgacattccaccacaaaaaaagtgtaaatggccgatccttgccttaagtgatgacattaccttgtgaaagtccttttcctggctcatcctggctcaaaaagcacccccactgaacaccttgcgacccccactcctgcccgccagagaacccccctttgactgtaattttcctttacctacccaaatcctataaaatggccccacccctatctcccttcgctgactctcttttcggactcaccccgcctgcacccaggtgaaataaacagccatgttgctcacacaaagcctgtttggtggtctcttcacatggacacgcatgaaaattttcactaggtgagatgatatctcattatagttttgatttgtatttctctgataattagtgatgttgaacattttttcatatacctctgggacatttgcatgtcttctttttgagaaaagtctattcagatcttttgtacattttaaatctgattatctgtaacagaattatagcaaggagtatactccaaaaaaattcaatctttatcattaaagaaacatctaatggtcatctcatagtaatttctcaattgcacaatgccattctattttagggggaaaaaatcttccttttgccttggtttccacctctatgaaatgtatagatccgagtctatctcctaaatgtaagatatttagtgcataatatgtatacagtgtttaacataagtgaatctctctcctgctcccctcccccttgtttactttaccccctgcccccagacaggtttactataagagtattggctatgaaatgcctctcatatgatttaatgtgcatagaagtctcttggagagcgtgcttataggcagattctaattcagtaggcttgggggtgggactagagaatcagaatttctaacaatctttagtaaagctgatcttgcctgtccgtagactttcagtagcaaggctctataattaactatgaatggagaacggatgcaattagaaggaatattttcattgcaagtaacagagacttcactgagagttaactcagaaaatttaagaaaatatatgacttggaatagacctaactccgaaaccaagtatctggaagtctctctcctccacttggcacctgttcacccttctcttctgcccagattcctcaccatctattccagtaggtaagcatcagactcaggggttgtgcaggagggtgttccttgtttttttaaaaaaaagctcactgggagttctactgtactgcctcagtagagagctccatttccacactccaatcttccaaccccagtaacttacacatgcaaaagacattggcttgtactttcccagtctcagactcaaaatatcattttgtccctttgatctgcagttaatggcttactctacatttcctaatcccttaaaaattatcacccaacatttaaaagaaataaagttgaaaaaaatatagataatacagtaaactgagtgtttgcttatatcatttgattctcacagcaatcacccaagataaatatttttatgattgcccatttcattgatgaaaagactaaaactgagggaggataaggatcttgtgcaaggtcacatggctagtaagagctaaggtccatctcaatataaggtccatgcttttaaccattaccgccaacacaactctcatataggcactggtgaatttgaactcataggcaatgtctaaaagtatttgttttcttgaagctctgccagcaacaaatattaaacttctggattcttgacaatctgatatctcattacagtttaatttttttgagaattaagtatattttcatatgataaagggccatttgtatttagttttcttttaactgtctgttcatatcctttgctctttatttagttattacatcttcctaattttttgaagttctttacaaataaatacttttagtcctttagctatgataggctgcatgttttttccaaaatttgtcagagtattttaatcctgcttatgaggttttctgccatgtcagtgtattaagattttttaattgtttctcagttttgaatcatatacaggagagtttcctccactcctaagtgcttgcatgattttattttttatatttagaagttacccggaatttggaatttgttctagtatatcatgtgaggaacacatctagttttatctttctccatatggctatctggttgttccaacactatttattaaaaagtccatctttttctcactgatctgactgagatgctatcattttcatatactaaatttttggccaaggaaacgaaaaaagtaacagagacattatccaatagccaaaaactaaaaacaatccacatgtctttcaaaggttgaataaagagttcaaggttgaaaaataaatagcaaaaatagctagaaaaagtgcagtaactggatgaggagggaggttgtctagccctaacagatattaaatgttataaagtctccacaattaaaaattgtggcaaagttacaaatatgtttactgttgattcagaaatcccatctgtagtatttcccaaaatacactttgtaaaatagaaaataacccaagcatgaggatatcatgccatcaattgtaaaagcaaataaactgtgattcatccattcaaggcaatgaggaaaagctctagatctctcatacagagtgatctcaaggaaaacaactaaatgaaaaagcatggtgcaaataatgtttcaatataataccttccttatgagtgggagggagagataaaattaaaatgggaaaaacaacaacaaaaaaaggattgccaaaagaagcaatagaaagattgaccaaaagtggttaatatgattacttacagaagcagagaaagaacaaggtaaaggaaacagggctgaaagatttttgtgaatatatcttattatatattgttttgactctgaaaacaaacatttttccttaatttttatctttacattctttaactttttttaattaaaatttttactgagataattgcagaataatatgcagttgtaagaaataacacaaagacattcaatgtcagcatgccccaatgttaatgttttgcaatactacagtataatattacaaccagtatattgactttgatacaatccatctaactaattcaagtttgcccacgtcccctccaggccagccaaggtcaagtgggagcgtagaattctgctctggagagaatttcaaaaggtgcctaacattaataccagggtggtgtaagaacgccaagtagcaagctacaactatggtgcacactgggtaacaagatcctaccacctcctgtgtccatggagacaacatggggagcttaacttcaggtcccatacagcaaggcagcacccttccatttccactgaagtggtgacagagtaggcctagtggagagtagcgactttcatcatcacccagtgggaataccatggcatctgtagataggagacaggcagaaatcccaccccaacccaggagtgataaagagccccatccccatgccaactagggctgagtgaggaacctgcacttctacctccatttggacttaagaaggcagtgttctcctttctcatggaaaatgctgctggagcagtatccaaaactaccagttaaaacacaaagtttaaacaacatcccaagtctcataacataatacaaaaatagctaggtttcagcagaaagtcacttatcataaccaaaaccaagaagatctcaaactaaatgaaaagagataatcaacagaaatgacagaaatgttagatttatctgacaaagattttaaggtggccataataaaaaataaacaatcataaatatgcttaaaataaatgaatataaaatagaaagcctcagcaaaggaaaagaacatctcagcaaggcaacagaatttatgaagaaaaaaaaataagaaattttagaaatgcagtatacaataatcaaaataaaaatgcattggttggactcagtggcagaatagatgggacaggggaaaagatcactgaaatggaaaacaggacagaagaaaatcccagcacattaaaacttgtggaacacagctaaaacattactgaaaggaaaatttgtagcattaaatgcatagattagaaaaaaaaatgtctacaataacctaatctctcacgttaagaacccagaaaaagaataaattcaaagcaagcaaaaggaaggaaataataaacataagaacgtaaatcaatgaaattaaaaataggaaaacaacaaaggaaaatcaaacaaaagctggatcttggggagaaaaacaactggtaaacctccagcaacagtaacaaaaaaagagacaataataagaagacacaaaacaccaatgtcaagaatgagatgggtgctatcactataaatcttatagccagtaaaatatgagagactactatgaacaacttgatgctcaaaaatatgacagcttacagaaaaatgtaccaattcctgaagaaacacaatcttctgcagatcactcaatataaaaatgatcatttcaatagccctctcactactaaggaaattgaaatttaaaattgtgatttaaaaatatccaaaaaagaaaatctccagccctagatggtttcaaagaaaattctagtaaatatttaaagaattagctataattggccaggtgtggtggctcacacatgtaatcccagcactttgggaggttgggagtttgcgaccagcctgaccaacatggagaaacactgtctctactaaaaataaaaaattagctgggcctggtggtgcacacatataatcccagctacttgggaggctgaggcaggagaatcgtttgaacctgggaggcggaggttctggtgagccaagatcgtgccattgcactccagcctgggcaacatgagcgaaattccatctcaaaaaaaaaaaagaaatgaaaagaaaaaagaattagctacaattctaaacaatttttccaggataaaaggtaggagagaatacttcctaactcattttatgaaggtggcattatcctgatatcaacatcagacaaaaacagtacaaaaaaaaaatacagacaagtatcactcatgtctataattgcaaaactccttaaaaaatatcaacaaaaagaattcagcaacacataaaaagaattctacactatggtgaagtggaatttatttcagcaaggcaggttcaatattcagtggtggtttgtgttgtttacattttctatgaccttgctgatttttgtctagtagttctatcaacactggcttgagaggggaatgcttaagtccctgccaataactgtggatgtctgattttcctttcagttctattaatgttcacttcattttgaggcactgttgtttgatacatatccatttaggatcatcatgtctctgtggtaggtttaccctgtcatcttatgttgcctctaataacttcttgtctagaactagtatctctaataattttattttctttgaagcctaaattatcaggtgttgatataaccatttctactattttttatcatttacatggtataattattctcttctactttcaacttacctgtcattgaatttgaagggagtttcctgtaagcaacatataatgggttccttttttttttatccactctatctctgttttttgtaagcttagaactttcatttttaagataattattgagatgttcatattaagtctgtgatgtgtgttttctacttgtttcctctggaaatctcactttcacttagttctctttgccttcatcactttaaaatatcattgtcttgagtattatatggcactacaatttttgtttcaataaatcaaatataatttataaaagtcacggagacaagtttagcctattgtatgtactcatatttaagttatctgttccttccttcttcctggttctctaagatttattctatgatttcctttctttttgaagaactttagccaacttttaagcaaaagtctgttagcaacaagttctttgccttctttcatctgagactgttttttccccttttactttcctggataatagctttactggatacaacacctgcagctgatagctctgttctagcacttgataatattctaagccatgggtcaagaaatgctaggtcagggtggacttctgttgagtctgggggaacagaatgtatcctaccactgtgctgtcccaagctgcctcaccttcttaccacattttagacttctcctttggttatctcttataccatcttttctggacctcatgtgtgcgaatgttttaaatcattttaaaagcattatatatttaaaagtttcatctctaaatgaacattctaaaatacaaaatcagataccaaaaatatgatgatgttattctgtttttccttaagaaggaacaggtccattattgtcagggtgtgctcagcctgaggtcagtaataatagaacctaggtattatcttcatcatcaaaaagcactgtcctccactctcaccaaccttctactcaccacattttaaagtaatatataaaatttatactactggcactaataaattcaaacatgccatatttttccttcaacattaggatgaagcagagaatccaaaaggattagaaatgctctccccttcacactttgaaggaaacatcgctggatcaatttagttcacaaatgtgttttacaaggagaaatgagtcttatatataggtaattataagaccaactcctcagattcctactcttgtgtgcaaaagccacactcaaatcaacttttatttatcctatggaaaaaaaggtaaatgttaaactaaatttaaactatcttttaaaatatatcgtgaaaaatgcatacaaaaagcttgtgacatagttcaacagttacacagtctacttcacttttaacttccagccatcagcttccatcatttcatgtattaagtgtgttttagaaccactgtaaaaatataatttgaaaggtgtcttttaagaaaacattcagaagtaaaaataaaacctctatgttataatatttatttttagaagtcttcattaattacaatatccttctatggtgccttaaagatggtgttgtatctcaaaagtcaccaatcaaataatttatttaagccaagctaattcaaaatagcaaatgggcagccacttttccaaacattgtgatgtccagtaagaagagcaagagagatgagatacctatttatgtataaaatgaggtgtactatataactattcattatgccttataccacaatatcatattaaaaaaaaaaacagtacaagtagggaccattatcactgtttcaaggagagaaaactttggacacagaaaggttaactggcttgcccaaggtgacacggcaagtaacaggcagaaccgctattcaaacccaggtagtctgtctccaaggtctctggatcttaaccaaacaccacaatgcagagagacttcagccctaggaaatcaccaaaggagtgcatgtctggctgcaagataaaaaggcaaaataaatgtcaaatctttaaaacaaggattctattttaagagaaataaggacaaaacaaatggcattccattcattgacactgcaacaaatacagcataaaatcagttaaatattcttattctgacactgctaaaaaaaaaaaatcaaaggatgcaaatctcactgatctcaaaaggtctgcaaagaagtgaaatactcctgaataacatgcaacaattttaaaataagcaaacagtagttatcaaaataaactaaaaggaaatttaattgctcccatatatagcgcattagcaaaggataatgaatatttttcaacaatttgcatatttcaatttgtaacaaatgcaaaaacattggatttcaatgctgaggcgtcttcaattttctatctcataggttattctgagaacaaacatgaaaagcaaaaagtctcatcataaagcaaacaatctgtggactgcaaaattaaaagaaggtttaagatagtttcaagtccaataacaaaatatctcttttagctattaaacgatctcattctatttaataaacagaatcacttaatgctttccatctgcaaatctctggtataaaaccatgaaactacaaataaagtacttataaaatgtcctcattataaaaaagcaatcagatctgtcaccactcagaacttaaaaacaaatagaaaaactagaggatttgagtggaaacaggaagaaaagtccaacatcagaatattgttttattaaatttaatggagaaattaaaatttaggggccctactattaggctactgaaagagaaagagaagtttagaagttgtgctagaagaagcactaccatgcaaaactcaatgacctacaagaaagtcagcctccttttccttctttctcttgaacataatcaactggggttattattattattcaactcctgtccttactgtaaaagggaaaccaagtccaacatcacaccatcaagaaaggtgtaagcaactagtcctataatacaccactatctcaagcaacaaaatgactgttcattactggtgctgtcatttgggtgttttcgctcaactggaaatgtaaccctatgtcatttgtaccataaaaaagaaaaacattctagtcttcaaaaaccatcagtatcttcaattatggaaattcccatcagaacttataatcacacttgtatttcaattggagacatgtaaataaaactcatttttaaagtaaaaggacctgaattatatccccaaatggggaagtacttcaataattcttcctggaggagggaaagaattgctgtttcacattaagtccctggaattcctgccaatagaatttcaaccgcctgaacctcacttctagctttccatctcagcacaggccaaagcctgtacttgtgaaaaattcatcactctcccaataaagcaattttgccaaaaactgtagatccctttttactctgagtgctgtaagaggggaccatacagaagaaaggcatacactgagatggctactgcagctccactctcaaatataacaatgaaagactggtttgtgataaattataatattcttgccatgctagaaaactaatgaaagtctgtctttaaaaagggaagcaccaatctagagagaaaaaaactatatttcaatactccaaagagaagagtggatgctgtcatcctggttatatgaatgcaacataaattatgctataatatactctcactttaggtgtatagttatggtttatgtacatgtatatatttcactctaaaaccattcaaaaatatctaatgattaccaattatgtatcaagcattgtcaagatacatggatgaaaaatcagttctgcccttaatgaaattctagtctcatggtgaacaaacatttaaataaatactgtaatcccctcaaaaccatcagcaggttactttctttaaagtattttggcaaaattacagttttcaagatcaaggtcttaggtaaaacagagaaaaaaaactggagatagacaaatacaaaaagtgtgtaaaaaaaaaaaaaacccacccatgtgtgcacacacacaatagtaagtaaaacttttaaaaagtgtgagcttagagacctggtcttctaagtgacccttttcttgtatcaactgtgcaagaaaaatgtggtgacattcaaaaagcctaagttaatcttacgcagccatctctgtccagcggtcatttggagatataagcgcatatttccctgggtctagtcttccatctgcattaaataatggtagaatacaactagacctcctctgcctgtgctaccagagacctaccagcatatctgtgggagtggatggcagtaatgttgtctggctttaccactgaaaggtaacaaaagtaaacatcacatatgttaaactgagcagatgttaaaatgctggttacaaatataaactgaagtaattcaaaaatgtgtctgacaaaactttaatagtggagaaatcacagtacaatatgggaactgccataagatagtaagatccatgcaagtatcacccaaattcccctttttctatgaaatgaagcaatttttatactgagaatgagagactgctggcttttttttaaaaaagacagcttaattataatgaaatagtgcatttctcttcacttttgtttcccttcccagattatgtgaatacatttctcgtctttaactgcagaacagcaatatggcattctaacatctatttcctatgaaaaattgtgagaaacaatcatctagggaggaaaaaagatagattcactatccatgcacaactactactaacatcttcatatttccttccagcctttgttctgtctgtaacatgtttgttttacctaattttgatcacatgagacactattttcatggcaacatgacaggtgattacagaattcaaaactttgtctaatctaatagatggaaatggtatttagttgtttgcgctgttttaagtactactaaaattgaccatttttcaccatattgttattgtaaatcaattcaagaaagaattaataaattgatatgtaccatgctttatttatttattttattttatttttgagatggagtctcgctctgttgcccgggctggagtacagtggcacaatctcagctcactgcaacctttgcctcccgggttcgagcaattctcttgcctcagccctcagcctcccaagtagcttggattacaagtgcccccgtcctcccaccacacccagctttgtttttttttgtttgtttgttttgttttgtttttttgtaattttagtagagatggggtttcaccatgttggccaggctggtctcgaactcctgacctcaagtgatctgcccacctcggcctccgaaagtgctggggttacagacatgagccaccacgcctggcctttatgtttaaatactaaggctgaagaaagagaagtggttaagtaacaaaatattcttaaaaggtaaaagataagagtatatttctacttctcaatgttcaacatgtacccaaagacggcacccttaaaaaattcacctcaatagcattaaagaagttttttaaagcacagtttaaattaacaataaaagtctttgattaattggaacatgacataacaattgctataagaattcaaaaaatatatatcagattggggtgccctggaaaggttttagatgagaaacagatttgagctggttcttaagcaagcctgcagcctgggtggaaaaaaagacggacatacagaaaccagagaacaacttaaaaaacaggtttggttaaagtaaacttataaactgttcaggaaggtgtgccctttaagttaacaagcaagacagacctggaagagtggagatgacagctaacatgatggtagaaggtaatatggtagaaagtaagaaaatagcaaacttcaatggaaaataactaaaattcaaagcctaacctttgggaaattaccctaaatacagagttgaagaaatctgaaatgctaaataagaaaaagaagagccaggcagttccaagatggctgaataggaacagctccagtctacagctcccagcgtgagcgacacgggtaatttctgcatttccaactgaggtaccgggttcatctcactgaggtgtgtcaaacagtgggtgcaggacagcgggtgcagcccactgagcgagatccgaagcagggtgaggcaatgcctcacccggggagcacaaggggtaagggaattccctttcctagccaaggaaagccgtgacagacagcacctggaaaactgggtcactcccaccctaatactgcacttttccaagggtcttagcaaacagcataccaggagattatatacggcgcctggcttggagggtcccacacccacggagccttgctcactgctagcacagcagtctgagatcaaactgcaaggcggcagcgaggctgggggaggggcacctgccatcgctgaggctcgagtaggtaaacaaagcagcctggaagctcgaactgggtggagcccaccgcagctcaaggaggcctgcctgcctctgtagactccacctctgggggcagggcatagctgaacaaaggcagcagaaacctctgcacatttaaatgtccctgtctgacagctttgaagtgagtagtgtttctcccagcacagagtttgagaactgagaacggacagactgcctcctcaagtgggtccctgacgcccgagtagcctaatggggaggcaccccccaggagggacagacagacacctcacatgtttgggtacccctctgagacaaagcttccagaggaatgatcaggcagcaacatttgctgttcagcaatattcgatgttctgcagcctctgctgctgatacccaggcaaaatgggtctggagtagaccttccacaaactccaacagacctgcagctgaaggtcctgactgttagaaggaaaactaacaaacagaaaggacatccacaccaaaaccccacctgtacatcaccatcatcaaagaccaaaggtagataaaaccacaaagatggggaaaaagcagagcagaaaagctgaaaattctaaaaatcagagcacctctccccctccaaaggaacgcagctcctcgccagcaatggaacaaagctggatggagaatgactttgacgagttgagagaagaaggcttcagataatcaaacttctctgagctaaaggcagaagttcgaacccaacgcaaagaagctaaaaaccttgaaaaaagattagacgaacggataactagaatacccagtgtagagaagtccttaaatgacctgatggaactgaaaaccatggcatgagaactacgtgatgaatgtacaagcttcagtagccgattcaatcaactggaagaaagggtatcagtgatggaagatcaaataaatgaaatgaagtgagaagtttagagaaaaaagggtaaaaataaatgaacaaagcctccaagaaatatgggactatatgaaaagaccaaacctatgtctgattggtgcacctgaaagtgacggggagaatggaaccaagttggaaaacactctgaaggatattatccgggagaacttccccaatctagcaaggcaggccaacattcaaactcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcacatcagactaacagtggatctctcagcagaaactctacaagccagaagagagtgggggccaatattcaacattcttaaagaaaacaattttcaacccagaatttcatatgcagccaaactaagcttcataagtgaaggagaaataaaatcctttacagacaagcaaatgataagagattttgtcaccaccaggcctgccctaaaagagctcctgaaggaagcactaaacatggaaaggaacaaacagcaccagccactgcaaaaacatgccaaattgtaaagaccaccgaggctgggaagaaactgcatcaactaacaagcaaaatagccagctaacatcataatgacaggatcaaattcacacataacaatattaaccttaaatgtaaatgggctaaatcctccaattaaatgacacagactggcaaattggattaagagtcaagacccatcagtgtgctgtcttcaggagacacatctcacgtgcagagacacacataggctcaaaataaagggatggaggaagatctaccaagcaaatggaacaaaaaaaggaaggggttgcaatcctagtctctgataaaacagactttaaaccaacaaagatcaaaagagacaaagaaggccattacataatggtaaagggatcaattcaacaagaagagctaactatcttaaatatatatgcacccaatacaggagcacccagattcataaagcaaggccttagagatctacagagagacttagactctcacacaataataatgggagactttaacaccccactgtcaacattagacagatcaacgagacagaaagttaacaaggatatccaggaattgaactcagctctgcaccaagcggacctaatagacatctacagaacgctccaccccaaatcaacagaatatacattcttctcagcaccatatcttgcttattccaaaattgaccacacagttggaagtaaagcactcctcagcaaatgtaaaagaacataaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaatatagatgttctttgaaaccaatgaaaacaaagacacaacacaccagaatctctgggacacatttaaagcagtgggtagagggaaatttatagcactaaatgcccacaagagaaagcaggaaagatctaaaattgaaaccctaacatcacaattaaaagaactagagaagcaagagcaaacacattcaaaagctagcagaaggcaagaaataactaagatcagagcacaactgaaggcgacagagacacaaaaaacccttccaaaaatcagtgaatccaggaactggttttttgaagagatcaacaaaattgatagaccactagcaagactaataaagaagaaaagagagaagaatcaaatagacgcaataaaaaatgataaagaggatatcaccaccgatcccacagaaatacaaactaccatcagagaatactataaacacctctatgcaaataaactagaaaatctacaagaaatggataaattcctggacacatacactctcccaacaataaaccaggaagaagttgaatccctgaatagaccaataacaggctctgaaattgaggcaataattaatagcctaccaaccaataaaagtccagcaccacagggattcacagctgaattctaacagaggtacaaggaggagctggtaccattccttctgaaactattccaatcaacagaaaaagagggaatcctccctaactcattttatgaggccagcatcatcctgataccaaagcctggcagagacacaacaaaaaaagagaattttagacgaatatgcctgatgaatattgatgcaaaaatcctcaataaaatactggcaaactgaatccagcagcacatcaaaaagcttatccaccatgatcaagtgggcttcatccctgggatgcaaggctggttcaacatatacaaatcaataaatgtaatccagcatataaacagaaccaaagacaaaaaccacatgattatctcaacagatgcagaaaaggcctttgacaaaattcaacagcccttcatgctaaaaactctcaataaattcggcattgatgggacatatctcaaaataataagagctatttatgacaaacccacagccaatattatactgaatgggcaaaaactggaagaattccctttgaaaactggcacaaacagggatgccctctctcaccattcctattcaacatagtgttggaagttctggccagggcaattaggcaggaggaagaaagaaagggtactcaattaggaaaagggaagtcaaattgtccctgtttgcagatgacatgattgtatatccagaaaaccccattgtctcagccccaaatctccttaagctgataagcaacttcagcaaagtctcaggatacaaaatcaatgtgcaaaaatcacaagcattcttataaaccaataacagacaaacagagagtcaaatcatgagtgaactcccattcacaattgcttcaaagagaataaaatacctaggaatccaacttacaagggatatgaaggacctcttcaaggagaactacaaaccactgctcaacgaaataaaagagaacacaaacaaatggaagaaaattccatgctcatggataggaagaatcaatatcgtgaaaacggtcatactgcccaaggtaatttatagattcaatgccctccccatcaagttaccaaagactttcttcacagaattggaaaaaactactttaaagttcatatggaaccaaaaaagagcctgtattgccaagacaatcctaagccaaaagaacaaagctggaggcatcatgctacctcacttcaaaccatactacaaggctacagtcaccaaaacagcacggtgctggtaccaaaacagagatatagaccaatggaacagaacagagccctcagaaataataccacacatctataaccatctgatctttgagaaacctgacaaaaacaagaaatggggaaaggattccctatttaataaatggtgctgggaaaactggctagccttatgtagacagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaactaaactaaagaacttctgcacagcaaaagaaactaccatcagagtgaacagacaacctacagaatgggagaacatttttgcaatctactcatctgacaaagggctaatatccagaatctacaaagaactcaaacaaatttacaggaaaaaaacaaacaaccccatcaaaaagtgggcaaaggatatgaacagacacttctcaaaagaagacatttatgcagccaacagacacatgagaaaatgctcatcaccactggtcatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactggttcaaccattgtggaagacagtgtggcaattcctcaaggatctaaaactagaaataccatttgacccagccatcccattactgggtgtatacccaaaggattataaatcatacctctataaagagacatgcacacatatgtttattgcggcactattcacaatagcaaagacttggaaccaacccaaatgtccatcaatgatagactggattaagaaaatgaggcacatatacaccatggaatactatgcagccaaaaaaaggatgagttcatgtcctttgtagggacatggatgaagctggaaaccatcgttctgagcaaactatcacaaggacagaaaaccaaataccgcatgttctcactcataggtgggaattgaacagtgagaacacttggacacaggaaggggaacatcacacaccagggcctgttgtggggtggggggaggaggaagggatagcattaggagatatacctaatgtaaatgatgagttaatgggtgcagcacaccaacatggcacatgtatacatatgtaacaaacctgcacgttttgcacatgtaccctagaacttaaagtataatttaaaaaaagaaaaaaaatgcacacaaacatgaaatcagaatgtagactcacatatatcctttcaaaatctcattaaataaattgtgaattattttttaattaaacactttctatttttaaatgcaaaaaaaaaaaaaaagaaaagccatcaaatcagcaagaaaaaacttagggtaggccgaattaccaaaatgtagccaggagaggcaggcatggtggtatgcacctgtagtcccaggtactccagaggctgaggcaggaagatatcctgagcccagaaacttgagactagtctgagtaacacaaggagatgctgtctcaaaaaagaagcccactatcaccattaatattctttaaaaatttttgaatgtgatatgaaacagagtaatactatattttgcagaaataataaatatctacagaaaatttattaacaatgtttagtaaagaagccatgtacataataaaaaattgcagtctcttatactaacaactaggtaaaaattaacacaagaagaaagcccataagaacaacaaaagttataaaatgcttaaactgagcaagagtttatgtaacaaaactgttttacaatactgtaatttaacaaattgatcaatataagaaatcactcaaataaatggaggaagaacatgtttccttatgaaataggtaaatatggcaaaaatgtcaattcctttttagttaatgcctatatttcttggaatattagtcaaactatcaaatttgttgacaaaataaatcaaaacttaatctcaaagaatatgttgtcaaataccctaaaaaagaaacatggaagagacaaggcattgttgcctttcttgacatacttattacaaagtaccaatcattaaaaccctagtgtattatcacgaatttagaaaaggaaattgatgtaaaaagtaggagccccagaaaaaaaactaattatatggagtttaacatatgctaaattagatatcaccaagccaaaagattgggaagaattacttgaaaaataattagggatcaccataggatactttcaacttaaacctataccttactgtataaaatatgctatagtagtgataaattttaaaaccaacttatcaaagtagagacagaaatgaaaactgagcatttcttaggtttctgtaaagatactaattttcctcaagctttgccgcaagagtaggagaaaacacaaagctgaaaaagagaagatccaaagatctgaatatgcaaaaaatgtagaaaatctccacacaccattaaataactaaagaaaacgaagagttgccttaaattttcagctgttctttataaaaccattctaagaaggaagaactgaagaccatcagcctgagtcaatacaataaaagtttagtactgtattttttttaccctaactcctattagaggtagtatccagaattttccactctaaggaaagttccagcgtgaccactcaataggaaagagatgggatactcaaaatgggataacatggagggtttctttacagaaggatgatttacaaggtgtgggtgaagagaaaccattagggatgggaagcaggcctgggttagcagcagctgagttgttacctcctaggctggaaaaggagagatgaggagcagctcctgaaaccccaggaatagtcacacatgtggttgctttatggggagcatgagctttggctcaggaacacggcccacttcagatgcccctgcaagggaagagccaggggaatgaacattttgacttctctttcctccctctgcttctgtcaggctctccatggaccaaactcgactacagccatccacaggggaaagcctctagagcagaaagcaggacggaggagggtggaaaatgggtctagaaaagcaaatgaaaaaaatctggtacaatgggataagctcattgtgtgtccatcctcatgaacgctttctgcccaatttctggtttgcagctgtgttcttgccagtttcaaccctgccctgaaatccagtaacaggaccttgataatctgatgccttctcctatttcctctttaaccaccacaaagactttgatgcttaatatcaaaaaccaaaaattcaagaacaatccaagtgaccaacaatatgataatacagaaatgatcattaagctactataaaggccaatgtagaaaatgcttacagtattgtataagaaaaacaaatgtcatatttttattatgttagagttataagcatgtgaacaatatatgggttgaataaaaaatagaaagttgatagtaaaaattggtatattttaatatatactagaaatacaaagataattatgccacaaaatatagctagaaggtgtaaaggagggaggaagaagacaagaaaggaaaagaaaacccttgcctacactatccactaagggcccaagcaatgcttaggttgaggacaacatgattttgctctaaggaaaattaaaggaaataagctagggagccttcaaagcctttcagtgaccacaatactaggaaaatgtttttaagaaggaactataatgagggcagaaatcaaaacaaactatcatatttgaatgtggaagaagacacaagggaaaaaatgctttaatctcatataattaaagtacttaagagattgtgttgatttttcagaattagcttaggataccgaagctggaaaaacaaaagccttcattaaaaggagcaatgctttctgtgaataccagataactctcatttttgaatgaatgctagacaaaagcatgtactcaatcacacatcataagagttgcttttttttttggctttcctaatgtaatcacatagtagatgaaatttctcctcaacaatatataaggatggagatagaaagctacaggacttaattacacttatatctgccacagtggaaaaaaggtatcaaaacagcatcaaaatgataagtttaggacgactgactgaccaactactttgacctatggggtgtcactgtctgtcaaaaagctataaccagcttttggcatgaggggatatttgaaacaaatagtgagatcacaacttaagatatactagtacttaatgataatggacggtaaccccagcacagcaaacaatgcatgtgtgagttctcaaacaatgagtccagttctttaggaagctatgacattatatgccagattgtgacatttgacaaaagaaaggtaatttcaccataaaactgagcagtctgacaagagagactggggaatgcttgacttgaaattgcacactgatgagaacacaagagctagaaaaaaggagagctgactaatgaagagatggtaaagagggccatgggtctagcagcagatctgaaatgggcagatgagtctacatgatgaaatggcaggcaagggtcaacaggaggcaaaagtgtaaagtgaagaaaggatccaggtgaggaccagcatgcttagaaggcattatgagcagagaggcccaacaaaaagggaagcaaagaattcgagatgagtacctattgaggctgaaaggaaactgggataaccagcagagacaggatcatagacgagttagttaggaatccagtttccaggcaactgggcaccaaggtgagcacaggaccaaacacaagccccagccacagtgagtctgtagccttctgcttccagaagctcctcacacggccccactagggacaggacgagcctcacctggaggtgagactgaagttacaggttggggttaactgttacaaggcaagaggcaaagaactaggggaacaggaacacaatccagatgtaactaagttggatttcacatttgtatgaaactttatcctttaaaattagtggtaatcacgccctttcatagttttaaagttaaaaaaacatcccgcttgcccttgactccaaatgagatactcaatgttatgttaaaaatcaggattctttgttcactactacaactctcatttccaggagatgaatcacctaaacgacatatcttttcaatcactttttataagagtttccttctcaaagaacatctataatattcaaactgtgagaggaattaaaaatatcatgggatatcctgttttatcacattaatgcacaggaaatattttagaagactggcactcaaatattagcacagaaaacaatattgcttaactaaatagaaaagtctttttaaaaatacatctatagtaatgtatcctaagttacatagtttatgctcaggggctcaggtataatgtatacaatcaagagtttatccaaagtcacatcagataaaggacaggaaatccaggaagtctgatgtgattaaaaaggtcaggcaaatatttaagtttcagagacaaagtgagtggggaggattcacataaggctgaagagattgagcaaaccttggatgtaaagatagacatgtggcttaaaacaacatcaaaatgaaaaaaggtaaaaaaaaaaaatcattttattctaaggctccttttttgcatttttccccctagtttttaatcatcctataagcttatagtacaggcaagatcaagatgcttttgagagacttaaaacttcaaataaggcttcctagtcactattccctgctgataagccaaataaataacctacattctctatcacaaatcccagaaatgagggagaagaggggatactgtcatcagtcagaagcaggataataaacataaaagatctgaagtaataaatacttttctctcatgtccagtaagtggtggctcagcaaattgcccccacccatctttgggcccaggtttgtgtgtgctaagatgtgacccctgaagaagggacccaggacttattctaagagcaacctcacacaaagcagcttcttgcctagcatgagatggtctcaaaagaaaatgggtaaaggtttgatgtcagataaaaaacaaccacaagcgtggcactgccagcaacacaaagccagagttggatgctctcaggaagaaatcttccaaaaatgatggcaatgaaaactggaaaacatccacacaagagagttaattttaaactcttgccaaccccggagtatgaaaatgccatatggcatcagtctttcttgagtggcactgccctttctccattctcctcgctacatcccctcaggagtcacacaccaggccagcaagcttgggttgaaaagccctccacatcaactatcccactgcaggcttccagcctagagcaggttcacatgcacaggggagagtcttcaactttaaatgcagtttgggcttttaactatgacatagcacaggacatgaattattgaaatagtcttttgggggctacaagcaacaggaaaacttgataaattgtccatgttattacccaagcaaagttatggcaccaatctgagattccatccaaaggggaaggttggtcaaaaagtactaaaagggatagagagggaaacacaaaatagcgttatgattgctcgccaacacggtggtccctcattcaacacaatggttaaaatcacatcaaagaggaaaactgaagcatctatgtattctaaaaattaaggagtaagaaaatatgatgagttctggctgtttatctgtaagatttcacagttaaaattctaaaacatttattgtaatgcagggtactaaatggcaaacattgcatcttacatattccatttagccatattaaaattaaagtgctaaggatgttcaaatattaagtgataaaggtattacaaaatctagtaagcaaggtttattcatctctactccaaggaataaaaagatataaaactgatttaacaacccagtgcaagaaaaatagctgtaaagattgtacactaaattgcaaactaaagcaaaaggtataaatctctgatataacaagaaaatcactgtaaatactttacaaattttgcaagtttttatgagtgtgctttgtacatttcaaaagtaaactttaggctgaatttggttagctacaaaagtggtgttacacaggcaaactaaagccaagaatgaggtatttgaaatgccacctcagattatttaattgaactatatatttatattcagattcagcattaaaattaatatacagataaaggaattgcaatattagttataaagcagaagactatgttgtggcaactctttaaatataggagccaataattttaaggaagaggctgcccagttatttacatctcgataaggagcaaggaagagtgaataggctgagcacacaaaaatgaggtcccaggaaacaaaacacaaaagtactaaagctgattaagtggtaaggacaataacagctctctttcacttcctgagatgatcttcaagctggcaccactcccttatagaagtatgccatgctgtgcatgaccctgcagcaaatctctaccaaaagtttcttagtatggccagtagccaaagctggagtgcttattaaaatgcagattcctaggcctcataccaaacctactgacccagtatgcccggcagcagatccaggaacatgcattttaaaggactccactggtgactttacacatgttagagtttgaaagccactgctctaatcacctcaattgtctcccttctccattattcttcacattcatacctttttttttcttttttgaaatggagtcttgctgtgttgtccaggctggagtgcagtggcgcaatctcagctcactgcaacctccgcctcctgggttcaagcaattctcctatcttggcctctcaagtagctgggactacaggctcatgccaccatacccagctaacttttgtatttttactagagacagggttttgccatgttggccaggctggtctagaactcctgagctcaagcaatcctccctcctccgcctcccagagtgctaggattacaggtgtgagccaccgtgcccagccggtattcatctcttctaatctagctcaacactcaactcctgttagaaatctgtgattaaactcctttcaactctgatgagtcttttactttcttcaataattatgtgttcagctctgtgtctttggccattttattgtattgttctcataccattagtttgttatataaaaatggccaaaacatacaaagcctttgctgtagctacttagatttttttttttcttgtcatcattaacaacagttctatgggaaagatactaagcttatggcgtgggaaaacttagattttccaaagtaaatttgccttagctcacatttctagaacattgtgaagattcagtgcaaacccacatagtcttactggttactgctccgaactcatacttacttagattttaatctccttaatgcaaattgtttcacatatggaaaggaacaaaaaatacaataggagtagctgtggttagaatggttgatagcatgtattaaagtacttgttaaacaaatgtggttgaaagcaatacggtagcaaagccagtaaaacatcatcctatatgaaaacagcaataataggtgggaacaaaagaaaactaatcttctagagcaactgcatggtgatttgccaggacagaaggtttgaacctgatctcattagaacactcaactctttgcctatggctaagtttcatcatcatatgcaatattttgcctatagctaatgtcttaatcttattagaatactcaacattttgcctttagctaaggtcttgtagttttaggaatgtctctgataaaagcaatgctcttactctcaagcctagcaaccagcataactaagagaggagtacccagtaaggcagtgttgcaggaagacaaacccttcctctgcgacagagcccacagaggtcactgctggaacaatggggaaaggagaaactgaatctctcctcaatttcaaaggaaagattcaagaggaaatagggccctccttaaattggcaaacacttgcacagcctcctagggaagagcccatttatctacaggctaccatggccaggtctaggctgaacgttctcacagtagaggagccaggacccccaaaggctctaaaatattcaagatcagatgctatcagtatctgtccctggttggtgaaaaataaagaacttttataaagctaaaaaggatcagatactagaaagaggcaaaactgcgattcaaacatatgccacagcctcaaatgcctgttttttccccattatactgtgtttcattctctcattcagaggttacttcaggttaaaataagtatttccatgttaatggactgtattagtatcttgcatctgtgtgtaaaatgccatgacgtctctgactttttccccaagagtttcagacacctaagtaaccggcagcttcaagcaactcacataaaataaggaagatgggaaagggagaggaactacatctaggaacctggggatttacacagaaaagctatctttctgaagactttactaagaaaaaaaatgctcctgaagtattttggaacagcttttcatattctattaagagttttcatgcaaaggcatgaaaccagctttccaaagtcccaggcaggttaatgaacaattactaaacctttcaatcttctgattctaaagtttccatttgaagactaagggcaaaattcaacctaaacttagtctccttactaaactatacacggacaactcagaaatttgcatttatatcaaagattagcttaattaagcatgttggttgcccactatttttcataaacacaaacctgactgatgtttatcaaaaaattttaagctttgtttacaaagaacgttggaacattctgaagctctcctcaatctgtaaaatatctggaggaaactattttttcacttatatttaatttgcttagtcaaaaatcaccaaaaaacattttaatttgcattttaccaagcctcttttaaaatattcttagggcatagaagaattctgaaagcttggttatttgtactcaggacatcagaaatgccactgccatagatttccaaggacgtttccttggtaaagtcacaaagttcataaactatggagcttctcagtctctgcggtccccagctgtccgcaacatctttatcacctattcacactttccaagcaaagtgaaaacagagtctgtgcgttaaggaatgttgatttaacaaattgttattaagcatttatatgtttactactgtagccagctgctatggctgctataaaagaggcatttgattgggtctttgcattcaaggagctttcaatttaaaaagccaatactatttctcagtagaagctccaacaatggccagtaaaaactgtccccaagccagcccccagccctctccctttacatcatccctcagcaccatcaactatgatgagtttcccactatggtgtttccttctgggcagatctcaagccaggcctcagctttggccccagcccctgccccaaccatggcatcagctctggcccaggccccagctcctggcccagtactagccccaggctttcctcaagctatgggcccacctgcccccaagcctgcctaggctggggaaggaacagaaggccctgctgcatctgcagtttgatgatgaagacctgggggccttgcttggcaacagcacagacccagctgtgttcacagacctggcatccatcaacaactccgagttttagcaactgctgaacagggcgtatctgtggcttcccacacaactaagcccatgctgatagagtaccctgaggctataactcgccaagtgacagggacccagaggccccctgacccagctcctgctccactgggggccccaggactccccagcagcctcctttcaggggatgaagacttctcctccaatgcagacatggacttctcagccctgctgtgtcagatcaccacctaggggggtgacaccttccctccccagagcactgggttgcagtggattgaatccctcccaaagcacttatggattcttctgaggtgtgctccaactgcctccagctttggagatgtcttccttgtggcaggggggcggggagcacattttattcttttattggcaatatctgtatctctccctctttttggaggtgcttaagcagaagtattaacttgtctggaaagaagggagctggggaaactcaaactctttcttcccctatcctgatggtcagctcccttctctgtagggaactctgggggtcccccatccccatcctccagcttctagtactctcctagagagaagagcaggctggagctaaggccttttagtccacaaagccttattatcaagtgtcttccatcatggattcattacaccttgatcaaaataatgccccagttaccagctcctctatggcactggcattgtccctgtggctaacaccagcatttaaggggctggccctcctgctttgcaacccagtttagtagatgttctctgttcaccctagcaatattcttaccctgcccagcatatggcagctggtaagcactggccaagtatctctctactcccactaagaccagctaagttgtatgcctacaatgagatagttgtgtctcccaactcacatatgtcacttatcactgtaatgagttataattactaatatttcaatatcatgtgcattcatttgggttgccaagaagcaaacactacacaaaattaaacatgcaaaagacatcttgcagtagggaacaggagaaggcagggagcactctcagaacaaggtgcaggtgtgatgtctacagaaggaaagagggaagatatgagaattggactacagtgcagtccccagggatgttcaactgggccactgaggagtccttgagcttaaagtcactcaatagaggacaggaatgggtctagctgtcccttctgtgcccaatcactggctcaggaaagtccacagaaaccatggcctcagagtgaaggtggactcagaggagcagcagttcagctatcaattatgcttcccacagcaggaagcctgaggggtgcattcttccttgttgcagcatgtaaaccagtactaaaaataatagctaagacttaatgaacctgtattagtctgctctcatgctgctaataaagacatacccaagactgggtaatttatcagtaagaagaggtttgatgaactcacagttccatgtggctggggaggccacacaatcatggcggaagaggaagaaagagcaaagggacaacttatatggcaacagtcaagagagtgtgtgcagggaaactcctctttataaaaccatcagatctcatgagacttattcactatcatgagaacagcatgggaaagacccaaccccgtgattcaattacctcccactagatccctcccacaacacatgggaattatgggagctacaactcaagatgagatttgggtgggaacacagccaagccatatcagagcccttactgtatagactatttaaagcatctttcatgcatcaatgtaatactcatagccacacagacatgggtactattatcacccctatatacaaaccaggaaactgaggcataagccatggtcaaacagctagtaagcggcagaactgtaatttgaatccagaagtctttactgactcaaaaatttaagtgaaaaagtttttttctattaaaaatgaagttaaacattttggaaagactcactaaaagcaagctgataaattattgctgtcacattaaatataattaacacaactgaaaaagattaggggaatgaaatcttaagaatctaggaaggactctacctaggagatctaggaactcattcaatggtacctgaattcaactgttcattcaactacaacatgtgctagacattgttctatgaacaaaactgacaggagaatttttaaaaatctctgccctcatgcagcttacatttatgtgtgtcaagggggaagataatgaatgtgttgtatagtatattaagaggtaattagtgcaaaacagggaaggaaagtagaaagcttacagatgggtagaagtgtatgtgggtggggcagggtgtggtagcaactttaaatagggaggccagggaaagcctcattgagttaatggttgagcaaaggcaaaggaggtgagggagagatgcctggggaaggaactttcaggtacagagaacagtaagaatgaaggcaaaggtaggaacatgctggcagttccacgaacagcaaagaggcaagttttagctggagcagagagagcaagggggagaggtgggaggacagatcatgtagggtctggtgtgccactataaacacttacgcttttactgggagtgagatggaacccactggaggtcatgaacagagaagcaatccgacttctgttataacggaatccctctgactacatatagagaacagataagggttggggatggtaaggatggaagcagaaaaacaaatttaggaggctactgcagaatcctacatgcagactgctttgcaatctccacttcgaaaatccaccataaaaaaatctaaaatgttaatgatagaaagtgcattagggaagtgacttgcattaggaaaataatgcatgactataatcataggaaccacagttaaggaaaaggccttggcctcagtgccagtcctctgtttggtctcccatctattctcctccctcctatttcacatgactgaaccctataaactacagtcctagacagctggcttctgatgtcaatagacaaatgagatactagcaggagatcagataaacgaggaagaaaaaggtcagggtatttctccccctgcctcctctactccatgtggcatttgcagagtggccacatcctccattattccagccccctgtggggtacaccctccatggttccaattacccctgggtggcccagatcccgggttctgctctcaccaagcagctcctgtgctgtagctgagttcgcaccaggcagctcccttgttggctctgataacaactcctccctttgttgctttagcccaaagggtggtaatggctacctgcagttggtaacctctggaatatataacagatccctatttgttcttttagctttttcaatacctttgtaattagctccctataccaaatccccctattgaaccacttggtgatgttttgtttttctgactagatcctgactaatatacccttacatcaagagtcacaaatgaatgtacatgtatgtaactgtttaaatcttgaagatatgcatacattgttctgtatgatccataatattcatatcaaatccttcccaggggaattaggctggaggagtgacaggagagatggaagaagagaggggaagcaggagcgaaaagcggatgtggggaagggagcaggagaaaaggtagaggggcatgtagtacatgccaaagcttcagcgctttgcaagcattctcttacttggcgcccaaggcaaagtcccagaagctccttctactgtggggaggagtccctgatagaaaacgccagccctgtccttccttcaaagagcctacagcaattcgttaacaccaacagactccaggccatagtaactgctggagcgatgtcctcggagctgccagaaatgaaggtcttagctgggcgtggtggctcatgcctacattctcagcattttgggaggctgaggcgggtggataacttgaggccaggagtttgacaccagcctaggtaacgtggcgaaacctggtctccacaaaaaatacaaaaattggccaagagtggtgggtgactcgtgcctgtagtcccagcttcccagctacttgggaagcaagatggaagaatcacttgagccctggaggttgaggctgtagtgagccatgatcatgccgctgcgctccagcctgggtgacacagtgaagtcctgtctcagaaaaaaaagaaatgaaggtcttgcgttcactgccttctactcacagtattcaataatgagaaagtcaaagaagaggaagcagatgaacagaaaaggcagtagagagaaacttgagccactgaggtgtcaactcaaagacaccatcctaatttacaatagaatatcaccaaacatcacaccaggtatcatgttgcctagctgtgccagaacaaggtgtgctgcacacatgcaaggacaagagaggctcccgtgagcaacctcaggactaatgctttttattgttgcaggtaagtaatatgcattaacaatcatagacaatttagcttcaagtgtgagcagccagcaaaagcttccatacaaaaacacaaaaggtgatagtcttccaaaagtgtttggtataaaggaaatgctgaatcaacccgaggaacaggtactctcactgacatgaaaacactgtttcagcactataggtattagatactacttagtttaattcaaaaaggaatcatgcccttcaaaatcataatataaaaggacatcactatatttgtgtaagacctaaaaaattagataatgtttactgatttgttatatatatgaaaatataacccatacaaatataacccataaaagccttcaaattacttaaaagcctttctccctggagaggaagtagtttgtggcagagactgaaagctttttaaagtgtgactttgatccccatctgctgtagtcagggtgggagaagaacactgatgggacaaaaagcaagaccctagaaaagagggttgctattttcctggagggatcatttctttagtatagtagtagtattcattagcagtattctgcctggaagccagttcttcctatatcaaattgtggacacgaagaaaggaagggagcagccactgaaagtgagaggtactatacacacattaatttatttatcctaatagcaatccattacctgatacaataaggtacatacagagaaaggttgaaaaatgtggttattgtcatacttctaataatatagtctggaattcaacttccaaacacaaataaagtgtccttccattcacactataagcacacccaagaaaattctaagggcaatttaaaaaataacagtggcaaatttgcccaggatggtaggatgtcatggggagtctgaccctgtggctggtaggggcaaagtatggtcttgaaagaagaatgtgaaataagacataatgaatgaaatttggaaaacaagagatgccatggaaacagcaggaaaagcctagaaacaggaatttttaagtcctttagacatacgactgaatatgaaaagaatgcagactgcttctacatctatctcgagccctgacaacttcttttaaattctaggcactattttccattgcagaagtctcttccacaaacatggtcaaaattaaatttattatctgcctccttgtttgcatatttttggtgacttaactctcattccaaatcccttctcctctcttttcctccaggacagagactggtcatgcaaatattaataccccagtcttcctacagctacagtttgcctgcaagatgtaaaaagaagttgaggtggggaggggtgctccctgtccataagaaagtgtctctgtgatggagcccatggccccttcccccttccttctgcctggaacatagatacctttgcaggcagttgtaatcatggaagcaaaagcctcatgctagggatggaagagcaggaaaacaggcagaagctgctttatgatggtgtcactgagccaacatcccactccctgtgttcttgtgaagtaagcccagtggtttaagttactattagacatgctttctgttcagagccaacataagcctcattggaatatccccaaatctttttcttctcatgtgcttcacatcttggtagtggtatccccatcccaccagtggcatcagcaaaatccaaggaatcatctctaaatcctactcattcagtcttgcttgcttctcactctatttctgaaatgtctcttccaacccttctctttcttctcttcttgttcatctttaccttcaccacctcattcatgctgtagttccctacactactaaaatgtcaccaaactcctcttcctgccactaatcttcctggaacacacaaacctctacttacaggttttcacacacctcaaaccttgaagtcttggctcccagcttgcttcacaagagccctcacaatactggggccagcaatggctaaaaaaatatgccaagtgtacattttaactgacattaaaaaaacaagtagatacaaagtaaaacaagatatcttttgtgttcatgaaatatataaagacatctaacaatctctataaaacatagtaagcactgcatacattttggttaaaaaatgaaacaagccaacaataaaagacatctttaatatgatttcaagattagcaatgctgcactgaggtgaatattcttacaaactattcttagtactatatatatcagctcacttgttccagagaattattcaatatatgttacaagtctcaaaaagtatacacttctaatataatatttccagtccaggaatattgtgaaacccagccctcctctccccataaggtttttgcagatattcatcatggcacaaattatgatttgtatgtatgaggaaagaatatataaccattgaaatattagagtttttgaacagaaaaatattcaggatacaatgctaagggaaaagcaagatacaaaattgtttttatggcatcattaaccgaggaaaataggcatggaaacgataatgataaggatgaactgctcagcactcattattatggctggtcatatcacacatttctccccctctatttcttttttatgtttctgtactttccaaatactttactataggcgtatattatttcttcattcagaaaaacatatgacaggtctggagatgtatgagtaataaagaaacaaaaaatagtaaaaactgaaaaagtaaaagagaaattcaggttgagttacatattaaatgatggtaacttgctataccagatccaatgttactttggggaaaggagtgggaagccctgagtatgcagcacctaagggcagggacttgcaatcaagatcaataaccacctgggcatttaggcagagtctattacagcttatgtgcattcagaattccaattatgaggtcctgacattttaagatttcctattcaaacaagtttcccaaacaattctaaatagctccctttataaagccgctgtggaagatgacaaaaatactcaagtcacttcatgtcagcctttaactgtgtgtgttaatgagtccagagtttcttccttctggtgggttcgtggtctcgctgacttcaagaatgaagccgctgacattctcagtgagtgttacagttcttaaggatggtgtgtccagagtttgttctttcagatatgtctggagcttcttccttgcagtgggttcgtggtcttgctgacttcaagaatgaagccaacgacctttgtggtgagtgttacagctcttaaaggtggtgcagacccaaagactgagcagtagcaacatttatcgtgaagagcgaaagaacaaagcttccacagtgtggaaggggaccctagcaggttgctgctactggctggaatgcccaggttttagtcccttatttgtccccgcccacatccttctgatgggtccattttacagagtgccgattggtccattttacatagtgccaattggtccatttaacagagtgctgattggtgcattttacaatcctcttgtaagacagaaaagttctccaagtccccaccctacccagaagtccagctggcttcacctctcattaatgcttcagtgcccaagatttgtcctgcaatatacccacaaactctcgaattcagtgtaatctaacaaaatggttttaaatagagcttttatacaagaaacaaagttcttattttgtaagaaaaaagacactttgagaaacacctgaggtaaagatctaaggatttagaggcacaaaagcctcagttcaaacaccatcatttataaactgtatgaccttactcagattgtttacattctctgagcaaatacagaaatagaaaaagataagctccagcttctaagacttcaagtgtcagttaatcacactcacttcttttaaaagccatatgtgtttcatcgcttgcttttaaccttcattctctaaagaacaacatctcagaacctgataaaagcattaatatttgaaacacgttatatatagttgacattttaaactaaatattttcatgacattatagagactgttctgctgtgtggccactggacatcaatatgtaactctaaaataaatgaaaacattgggggcatagtgaggtccctggtaagaacaagtaaaaagtgtggtatttaagcaaatatgctacatacagctatctttaatgagaaaaaaaataagttgccagtaaaatgttaatatgcatttggcccttggggaacagatggtgctacctactgcaagaattacatattgatttggtcagggaacagggcctgagggccaggcatataaaaaaaaattaggtaacttctgtcagaaagtttctaatagaattcaggtctctttcaacctcaacacatacctcaaaagttacttttcagaatacattcctgattccccttcttactcttggtttcttgttttgctcctaaaactgcttaatattttcaatttcactgggtcttaattaattgaaagtttatattatgttaaagaaaaatatcccaaaagactttcttaaaagtttaaagttttatagatgattgactgaatatgggagtcatctgttgaaaagaattggataattaattagatgacatccttctaattttttattcctgtcttaatgtatataatacctggttatgcctctaggcaaaaatatgccacagaatgagttataagtttcttttgaaatcgctttctccagtcaattgtgtatttcatcatatcaaggtcattttagaaccttggtcatttagaacctataggtcttattatagttaatggctccagtaatacataggggagtcaaagataaaactattaagtcactcaaaaacaaaatgaaaaacataagaaaaatagagaatattttaattacacacatatgactacactattatagtcatcctttgttatccatgagggataggttccaggacccccatgaataccaaaatccatggatgcttggggcccttatataaaatggcatagtatttacatacggtattctcctgtatactttaaatcttctccaggttacttataatacctaacacaatataaatgttatataaaccattattatactattttttgtttatttgtaattttatttgtaattttttcccaagtatcttcaatctgcagttggttgaatccttggaccccatggatgtggagggccaactgtataatgattctccagagcaaacttcatacctctgtatatctccagtaaagttgaaatgcagataaaaacatccctttgtcaatgacaaacagtcttaaaaggatgatcagaaaattcatccaaatagaacgttctgggatttataagtgcactaataaaaactgtaggatgacttcaaggagctgcctcaccccaaagaaaagaaaaccccactctttacctcccaacttcctcccaagttcacaaaaaataagagactagccaaaggttggaaggatgtgctcctatctctagattgtaaccaacaagtacctgacacaacattttttttttaagacagggtatcactctgttacccaggctggagtgcagaagtgtaatcatagctcactgcagattccaacttccggttcaagtgatcacctacctcggttttccaattagctgggtctacaggcatgtgccaccacacctggctaaattttttactttttatctttttgtagaggcagggtctcactttgttggccaggcttgtctcaaactcctggcctcaagcaattctcctgtcatcctcccaaagtgctgtgattaccagtgtgagccactgtgcccagccataatatattttttttaaagataaaggtaattgcaacattttagaacccccaaggataaagaacattaaaacatttaagaaagaaaaaacaggttattttaaaatgaatgaatatagccactctactatgcaatagaatatcaggatttctcttataaaactgtaattttatacctgctgaccaacctctctaaacccctgtacccaatacttttcccagcccttggtaaccactattatactctctacttctatgagatcaacttttttaggttccatatgcatgagatcatgcagtatttgtccctctatgcttggtttatttcacttaacataacatcctctaggttcatccatgttgtcacaaatgacagaatttcattctttttaatagtaaaatagtaatctttttatagttaaatagtaatggtatgagtatatataccatatttgctttatccagtcatccaatgatagacatttaagtagatttccatgtcttgactattgtgtacagtactgtagtaaacatgggaatacatatatgtcttgacatatgaatttcatttcctttgaatagatacccagtagttgattattggatcacatggtagtcctatttttaatttttttgtgggactcccattctgttttccataatggctgtgccaatttacattcccaccagcagtgtttaagagttcacctttccccacatctttcccagcatttgttgtcttttgtctatttgataatagccattctaacttgggtgagatgatagttcactgtggttttgatttgcatttccccgataattagtgatattgagcattttttcatatatctgttgaccatttgtatatcttcttttgagaaatgtctattcagattgcttgcccatttttaaattggattatttgtttgttattgaattgttggagttccttgcatattctggatattaaacccttgtcagatgcacagtttataatttctctcattctgtaagtcttctcttcactctgttgtttcctttgctgtgcagaagctttttagtttgatgtaatcctatttgtctatttttgccatagtcaacaataatgtattgtatatttcaaaacaactagaatagaggatttttaattttctcaccacaaagaaataacaagtttcaggtgacggatatactaattgctcagattcgatcattacgcactatgcgtatatattgaaacatcataatgtatcccataaatatgtaccattatctgtccattcaaaacaaaataaaacatatttaaaaataaacaaaaccagactgcatgcttttcattagcaacactagaagctagaagatagtggagtaataccttcaaagttctgagggagaatgatttcaacctggaattctatgcgcagccaatttccctgttaaaatgaggaaaattttagacctccatagaatcagaaaatttctcacacactatttcctacaaagatggcagatcagaaaacagaggctccaattcaaaagaattatgaagaaataatgacaactctcagcctgctgtccaaacactagttcagactgaagcaagctataggaaggctacaggaaggacatatctgcagagagaggtaaaagtggagagattactgctgtactttggaatagtgattctcaaactaaatcagacaaaacatcccagtctggatattcttcctttgtcctcaaattcaccgtctattctctgctctgtgccttgggaggctaaggaaccctaacagcttacatttttgcttttcagattctcttttggtttccctttttgtgaaatgtcatcacataatccaaggaaagaagagaaagaagacaggagatttatccctagcctccctccttgccacagaaggtgggacagtgaccagaggcctcactaaaaaccacagcttccatcagaaggcctctctctctcatggctatagttcccacccagttctggccacagctcccttctgcccactgagccttaagaggagtaagggcttccctccatagtcaatccctgaatgactcactcatccctaaatcctgcccaaccctctgtaatttgtgaattgccctttagagtgtgacaactattttttgctggaccctaactcaataatgatcaataagctccattttgttttttttaaaaaaaaaagaataaccctttttgctatccagaaatgaaatgtattgctaaattatctgcacaattccaaataaataaatacatgatcctaactggaatagaaataataaaataactgaaataacgtgtatttcagtatgtaaacacttagatataactagtcaagaagataaagtagatgtgtacacccacttatataataaagaagtctgggtttaggggaagttaagcaatatttaactgaatgctgtcaacactattctctttttttgacattttgaaataagggcttaatagtttttgcatatagccttaaaatcaagaaaaatgtgacaactgaaaatgaaggctgatacaagcatcctgtattgataatacaaatatcacaaccattattgctgctggtgacattgtttttcaaaatggtgagcaattctcagaaaagttgctaacaagaaaagttcagtcttccctcaatttacctgggtgtcttctacatatctgcgaaaacttgctatatattaaaatcatataaaatacactttatattttataagtaaataattatttctaggctcaaataattatgaacaagtttttgcctacataatgtttaagagaacactgagatgtgatgtaggatgaagaacaattattcatcatgcatttcagaatttctagaatccctagaccctacccactaaataccgtagcaatgcccaatcacagagaaaattcaaaaacacccccacaaatgttttaaatgtctactagggagtattaatattcccactgagaaccagggtttataatctggaacaacttaaggaggcaacaaaggaagacaagatgggtagagaagaaaaataaagttaaaattacaaaaaaagttcaaatgaatgaaatggtaatcaacatatatgtagctgtgcagacaaatgtagttgatcttgatcatgtaaacaccattaggaggttttcaatttgtagaatcaacaacttaaagtgtagataagccaggtgcagtggctcatgcctataatcccagcactttgaaaggctgaggcatgcagatcacctgaggtcaggcatttgagaacagcctggccaacatggcaaaaccccatctctactaaaaatacaaaaattagctgggcgtagtggcaggtgcctgtaatcctagctactcgggaggctgaggcaggagaactgcttgaacccagaaggcagaggttgcagtgagctgaaatcacgccactgcactccagcctgggtgacagggcgagattccgtctcaaaaaaaataataaataaagtgtagatagagatcttcatgaggattacagaacataaaataatcaaccttaggaggattatagaacataaaacaatcaacctccagaaaaaataagtttggaatgcagatgctgttggcaatggtttcagactctcttatgtctgagtcagtacctctgaaattcccttagtattttccccagagtcataatatgattgctacagctccagacatgggatggaggcagcaaggctaaaaatgtgttatctgtcatacaccaaaaatacaaaaaaaataaaattagccaggggtggtggcatgtgcccatggttccagctacttgggaggctgggtcaggaggattgtttgagcccaggaggtcaaggcttcagtaagtcatgaaattgccactgcactcgagcctgggcaacaaagtgaaactctgtctcaaaaaacaaaaaaacaaaccaaaaaaacttatgtcacatggccacttgtagctctcaggaaagctagaaaagcaagtaccttacctagggctggaactattacagcaagaaagaaataaggaaaatgaccgtcaagtaggcaattaatattgtcagcaagaaatgcagggccataatgtctatacctaaaggaacaagacataaagggataagtatattaattaaattacaaagagatatgtatactatttaaattacaaagcaaactgtagttaagatatgggccctagactccttccaacttgtagctctgttatcctcaataagtagcaacatcaatttggccaaatggctgctctaactcctaccacactgacattgacattccagccagtaagaagggggaagagaccagagagaaccatttcttccctttcagaaaatggcccataggtttgtactcatcacttctgtttgtatgtttgtccccaccaaccctcatattgaaatttgatcccaatgttggaagtaggggcctaatgggaggtgtttgggtgatgggggtggacacctcatgattaatgccctccctgtggtgggtggtgagggagttctcactctgttagtttccgtgagggatggttgttaaaatgagtctggcatctcctctctcacactctctcgtttcttctctcaccatgtaatctctgcatacactagcaacactttgccttccacatacgttgaattagcctgagactctcaccagttgccagcgccttgccagcaccatgcttcttgtatggtctgcagaatctcttacctttataaattgcccagcctcaggtatttctttacagcaacactaaacagattaagacatcccactagactgaacttaagtcttggctatagctgcaatggaagagatgctgtgacacatgtgagaccctgactgttccacagccagctactgacagatttttgaggcaacaattctaagccaattcttgctcctattgcagcaaaacttactttctactctcctcagagaagtatcagcagtctctggcttgtatctgacttctgtacaaacattgcctctgcaattcctcattaagactgatgatcttatgggacctggtcctatttcgcatggtagaaataacaaagctggtgtttcccacagttgtgttattgacccacattctctatagacaatcatggtctgtcccattgttaatgaaagggggaaaaggaaaatgagaaatgtagacttcaaccacacagcatttatccaactaaaaattctgttgcttataagaatgtgagaacatcttggaggtccactagcagtagataaccatattccaagtggaagaaaggggagccacatgtctgtgtgagtgagctaaatcttccccacccagcaccctctgcaggaagtactgtaaagactaaagtctaagaagaatgaatgaaggaaagtggtgtaggcatcttattttgatgttggaagtattttcccaaagaattaaaaacattaatagttaaaagaatttcttctgggaatgtgactgggaatgggaaaaagtggggcaggggactgctgctttctattttaagttctgcaaggcttatttaaccacataaacatatttattattttaataaaatagcttaaacatttttaaccatgttataatctcaaaatagcacagtttcaccctactgcatttataaacttaaataatattgagtaaatactttcaggctatattctatattacctctcaggctaccacctattcaaactttaaccattgctatagtctccaaattggtctttcttcttctactcttgcccctacaatctattctcaagactgtacaactctaagagggtgccttaaattccatcttaacaaagtctctggtggccgggtgcagtggctcagaccttgtaatcccagcaatttgggaggtcgaggtgggtggatcacctgaggtcaggagttccagatcagcctagccaacatggtgaaaccccatctctactaaaaatacaaaaattagccagatgtagtggcacgcacctgtagtcccagctactcgagatgctgaagcaggagaattgcttgaacccggcaggtagaggttgcagtgagttgagattgtgccactgcactacagcctgggcaaaagggcaagactgtctcaaaccaaaacaaacaaaaatacccctgaagctgtgccatgtagtggcactgtctattctcagatcagacaaagagatgtttttagaatcttaatcagatcatttcctgaaacttttgaaaaccttccaacagcttcccagcacacctaaattccgaacatcttaccacggcctaaaaaattcatataagctagcctctgcatacctctccagatgcaattcttcccactttcctcttctcacatcatgctagccaccctgcacaactttgctgctttttataggaaaagcttattctattccaccacaggactttttattcttgctttagtgctatattggatactctttcctcctctgtttccaaggggctcagtccttcacttaattaatcctgatcaactgctacctgcttctacaagaggcttgccctgaccaccctatctaaaataaccactgacaccaaaccccctcccacagttactctcccttaagaggaatatacatatatgtatctgttgcttaatccatctcctctactagaatataagcttcaaaagggctttcttgagcaacatgataaaatagggggctcctgactgtccctcctctcacacactgagaaatcaattctctccaagagaaataatccagttgaaagactcctgtgtaccagacaactgaggaaatacccttgtcaaaatgggtagaaaaagctgagatatacttgcacactaactccaccctgagcacccaagaaggaaatatcaactcccagcttattcttgaagggtaatagtcttgtacaacatataccctgcccaacttttagagtccctgctgaagggctttgctcttaaatcaccatgcctgaggaatggcagggagagggcatcagatgatttctctcaagcacaaagaacaaagggagttttgactgcatggtcattcccagcagttgtagcccccaggatcagcccaacttctataaacctgcatagcaaataaagaataaacttatctgagcctaaatgggaaacatggcactccctttgccccagggacaattccagacccatggaaaatctctctgtggaaagagatgggaggcctctgccaacaacaatgaaagagaaagcactccctaagccttctttcctggcttgcttttgagatatagtcctgcaatctcacattggaaggaagctggggaatgggcctcttcatacctgaaggggaaagtgagcaccctctgtgcctttctccctggttcatttcagtgataactcccaactagaaatctcttcctgctagaagggtgtgagacttctgcttgccttaatgccagagtgagcacttcttgatctttcttctctgacttgcttcagcaataaatctatatctgcagactctccctggaagtagtttctgcatgcatcgagtgctccaacttttacagccttcacttgagtgactggctcctaaatcacctagctctggaagttgatggagctctacactgctggtctcccagaccacagagaacaaaagtgacttttaaacttgcaaaccttcagcaactatctccccaggttaaaagtgagcactctgaccaagagtacaagattcttcctcagactctcactttagtgtagggcagaatgagtgggggataaattccagctctccacttctcaaagaaggaacagaaatatatatttaacattctaacctctccagctacatctcaagaggctgtcttctctcacctctctcaaggcaatatcatgacttgacactctaatttcctaggagccactaagaacaaagacagcaggttggacaaacacaaagagcttagaatatagaatccctgattggaaagaaagatcttttacgcaagaccactccaacaagacaggaaggggtggttctcttatctaatgcacagaaaccaacacagagagtcaaggaaaattaactaacagaaagatgttccaaataaaagaacaagatacatctcctgaagcttatgctaatgaatggagatatgtttctgaccagacaaggaattcaaaaggacagtaataaagatgctcgctaaagtaaggagaacaatacaagaacaaactgataatttcaacgaagagatagaacatattaaaaactactaaacagaaatcattgagctgaagactataataactgagctcaaaaattcaacagacaggttgaatagcagcctaagtcaagaggaagagaagattagcaaatttaaagacaaaatcattggaaatcatcgaatctgaggagctaaatgaaaaaagaatgaaaaagactgaagataacctaagggaattatggaacaccatcaagtgaataaactatgcattatcagagtaccagagggagaaaagaaaaaggaatacaaaccatatttaaagaaataatgacagaaaactgcccaagtctagggaagaaattagaaatccagatccaagaacctcattggacacctaatatgatgaatccagagacccacaataagacacattataatcaaattgttataaataagttaaaatattgtttctaaagtgaaaacaaagagaaaatattgaaaaatctgcataagaaagtgacttgttacatacaaaggaacttctataacactactagcagatttttccaagagaaaccctgaagaccagaagtaaatgggataatatattcaaagagctaaaagaaaaataacaaaactgccaatagtattatacccagcaaacctgtccttcaaaaatgtaggggagataaaactttctcagacacacaaaagctaaaggaattcatcaccactagacctgctttacaaaaaaaaaatgctaaaatgtgtcattcaagctaaaggagaagatcactaaggagcaacacaaaaatatcaaactcaccggtaaaagtagttatgtaataaaacacagaacacacttatactgtaatggagttgtgaataccaaatatatctctagtatgaagattaaaagccaaactattaaaagctagagctttaataatttgctaactgacacaaacagtaaaagatacaaaatatgtcatgaataataaattgtgaatgggaaaagagtaaaagtatagagtttgtgcaagcgatcaaagttattatcagctttaaacagcctgttattagtataaaatgttttatggtagcctcatggtaaccacaaggcaaaaacccttagtagatacacaaaaagaaagcattcaaagcataccatagagaaatcctcaaaccacaaaggaacacagcaaaagaagagaggaacaaaggatctacatattaaccagaaaataattaacaaaatttaatagtaaatccttacctatcaataatgactttgaaaataaatgggttaacttttctgatcaaaagacatcaaacagcttagtggattaaaaaaagaagatgcaactacccaactatatgcttccaaaaagagactagtttcatctctaaggacacattcagattcaaagtgaagggaagaaaaaagatattccacacaaatgaaaactaagagtgcaggggtagctatacatatcaggcaaaatagactttaaatcaaaaactgtaaaaagagacaaagaaggtcattatataataataaaggggtcaattcatcaaaaagttataataattgtaaatatatgtgcatagaaacagagtagaaagatagccaccagaggctggagggagtgggagggatggagaaaggagagatgttgatcaaagggtacaacatttcagttgaactggaagaataaattttagtgatctactgcattgcatggtgactgaccacagttaataattatgtattgtatatttcaaaattggtacacaaatagatttttaacaacctcaccacaaaaagaagataagttggtgaggtgatggatatgttaattagattgaatcattatacaatgtatacatagattaaagcatcacattgtaccagacatacacaattatttgtcacccaaaaagagattaaaagcgctatcttgtccatgtctatattccagtgtctgaaatagttcctaccacatgaaatctgttcaaatattgcctcaatatttgttgataaatgcaatatgctttatagcagggaacatttttccctgaatgtaaattattacaaaatgttaacaggaaactttttgaagatatagtccaggtcagacactgaactaagtgcttttcagaaattattttatgtatcttcccaccatctcactgaagcaaatattaatcactttattgatgaagatacagcaatttagaaaggacaaagaagagtagatctttactgcagatagggtcctaagatagaaaactgaaaatggaaaagtcaaacaaaggaagacaggggacaacggaggaggggagagattgccacagtgctgggaaaaaaaaaaaaattacaccctggtttcatcccactttttgacttatgtattccagcattttcacatgttgagttttctcttttcattctcaaatgaaatgaaaaacaaccaatcttaagtactcaatatcaaggattttctatttgcaggatacttcatgatcttgatctcagttgtaccacattcaaaatatatgcttatcactgacaatttttaattattataaaacaaaagcacaacaaatacatgcatatgtacatttatatttatacagtattcccccccacaaaaaaaaaacaggatataaaaacacaacactgttgaagcttaactgttgagcagcaaagccaccaagtaataactcaagctgttcctctgctaaagaaagaaaggctagattcagcatacaaaatacggtttaggaatgtcaatgtctgaaaacgtggcttgtgtgaaatagaacctaaaatgagttccctgggtcaccaatgttaagggtaatctccatattgcaaaatccaattaacattttcaatctccatcttacttgatcattcagtagcacctgacattgttttctactcatcctgttaagtagctctttcattagtttctgtgacatggaccatcctagttttcttctaatacatctggctacttcttctccatttccttctccagctcagccttctttccagtcttaaatccagtagttctttaagaccagtccttaaaatcttctccttgctagactctcttttcttgggcttccttatccaaacccatggttccaatcaccatacatatgacaacactcaaatttaactcttgtgcccaaatctctcccctgagctccaaacaactgacttgtaaaaatctctctttatttgaaggatcacaaagttaacatcttacctattagatttcagcttcttataccaagatctgtggtggattaatctgtatagccccacattgcttatctcttacatagttttaaggtgatttaaaggaaagaaaaaggataaagttcaaagcctaggactctaagatatggtgatcaaactttatagggattcttacagtgttgcacaatttaatcatgtaactttaaattttcataattacttgaacattttggcctccctctctgtcatttcaggtgttccagttaaaaacaatgagattcattataggaacctttgttttgtcaaagaaagctttatacaaaagcttataatataaaacacgtcaaaacacagtggacctaaagcaaggacgagggaacaagaatgggctttatctcaatctccctacttactactgcttgagaatatatgcaatccttctgagtcagaaaagaagagcttcaaaagtgtaggctaaagttgtcttgttatatttcagaattttttcttatgatattcagcattttgtaagcctttttaactaagcagtatttttagttttagtttttctagagaaccaaattaaggctctcatctctttaaataaaatttggaatgcattttcctaaatatgttaaactagtaagaatacaagtttcatggcagcagaatttatttttcccatattctaataaaaaattccatgcagatccagaaaaaaaatttaaatagggtaacaactttgtaaactaaagttaaaactgtaatccaatttccagaggaatgtccacggactcacaacccaagaacaaaactggagacacagcctcttaaaatacatgtgtcctgccctttgaatcagaatagtaagcacaaacataaggaaggcgaaggaagagttatattgtttcaccctatctgtccctagctccaggaaaggagtacagaaatgcccttaaacacagggagccaaatgcctccctaaggaaaatgatctttggagaaagtaaaacccacctactgtacttggcatttcgttttccagatatatattttttaaatggagtccatatagcaaaaggcacaaaacaaaaatttttttaatattttaagttctgggatacatgtgcagaatgtgcaggttacataggcatacacatgccatagtggtttcctgcaccactatgtcatctacattaggtatttctcataatgctctccctcctctagccccccaacccaataggccctggtgtgtgatgtttccctccctgtgtccacatgttctcattgttcaactcccacttatgagtgagaacatgcagtgtttggttttctattcctgtgttagtttgctgaggatgatggttttcagcttcatccatgcccctgcaaaggacatgaactcatcctttgttatggctgcatagtattccgtggtgtatatgtgccacattttctttatccagtctatgattgatgggcatttttggtggttccaagtctttgctattgtaaatagtgctacagtaaacgtacgtgtgcatgtgtccttatagtataatgatttataatcctttgggtatatacccaataatgagattgctgggtcaaatggtatttctggttctagatcccagaggaatcatcacactgtgttccacaatagttaaactaatttacactcccaccaacagtataaaagcattcccgtttctccacatcctctccaacatctattgtttcctttttaattatcgccattctaactggcatgagatgatatctcgttgtggttttgatttgcatttctctaatgaccagtgatgatgagcttttcatatgtttgttggctgcataaatgtattattttgagaagtgtctgttcatatccttcacccactttttgatgggttttttttttcttgtaaatttgtttaagttctttgtagattctggatattagccctttgtcagatggatagattgcaaaatttttctcccattctgtaggttgcctgttcactctgatgatagtttcttttgctgtgcagaaactctttagttcttttacatcccatttatcagttttggctgttgttgacattgcttttggtgttttagtcataaagtctgcccttgcctatgtcctgacagagagccaaatcatgagtgaactcccactcacaattgctacaaagagaataaaacatctaggaatacaacttacaagggatgtgaaggacctcttcaaggagaactacaaaccactgctcaaagaaataagagaggacacaaacaaatggaaaaacattccatgctcatggataggaagaatcaataccatgaaaatggccacactacccaaagtaatttatagattcaatgctatctccatcaagctaccattgactttcttcacagaattagaaaaaactactttaaatttcatatggaaccaaaagagctcgtatagccaagacaaccataagcaaaaagaacaaagttggagccatcatgctgactgacttcaaactatactttgaggctacagcaaccaaaacagcatggtactggtactgaaacagatatatagactagtgaaacagaacagaggcctcagaaataatgccacacatctacaaccatctgatctttgacaaacctgacaaaaacaagcaatggagaaaggatttcctatttaataaatggtgttgggaaaactggctagccatatgcaggaaactgaaactggaccccttccttataccttatacaaaaattaactcaagatggattaaggacctgaatgtgagacctaaaaccataaaaaccctagaagaaaacctaggcaacaaacttctttaaaaaagaaacagaaaacactgaacaaaacagaaaataagattaaacatatcagtggtaactaataaaatgtttaaaccctcttattaaagcatgggactaggcataaattgttgcataattttcctcaatacaaagcaatccagaaatgtgagtgtgtatacgtttgcagatgtgtacacgtttgcagatgtgtacatacgtgtttacattagacgcataactaggtgaatatgagtgtaggtgtatacgtattatggatacttttcaatctctctgataaactccaccaaaagaaagtaaaatcagtgttaaatctgaacaaagtagaatccttgtcccatatacacagtaagtggatcaaacgaagttaattttcagtgattgtaagcatatactcatgaatctttacacaactaagagactggaatcaaaacatatgaattaaatatggctggaaatgcaaaataaattaatacaactaataagataatttagtcaaagaagacaaaaataagataggaatgattactataataatgctaattattagatatatagcaaactttttatcttaaaatcagtatattaatttgtgatgaaaaacttaaattacatacaacaatgctaagtaccataagcaacattctctgtcaacctaaaattggaaatctattactaaagagaaaacaaatttttcaactgcaatttctaaattactcttctgattaaatatgtaaatactggttcaaggaaaaaagtaaaatctgaaaagagaatatttaaataaaaatgctttataacataaggactgaggccaaactgcacttagagataaattcatagctttcatatattctcattatcttattacaaaaccaaaaataaagtaatcctaaaagagaagctagatgagagaaccactctctcacgtctctctcccattcccttggtcctctttaaaagcaacaacaaaagacaaccctaagggaaacacaaagaaaggatacaaactattgatttctaaaatagcagaacttataaagttaacagatataacttaaaaaaaaaatggaatctggccaggtacagtggctcatgcctgtaatcccagcactttgggaggctgaggcgggtggatcacttgaggtcaggagctcaagaccagcctggccaacatggcaaaacaccatctctactaaaacacaaaaattagccgggtgtggtggtgcacacctgtaatcccagctacttgggaggctgaggcaggagaatcacttgaacctgggaagcagaggttgcagtgggtcaggatcgtgtcactgcactgcagcctgggccacagagcaagactttgtgtcaaaaaataaaataaaataagggaatccagcaaatctaattttatatttattttttcttttgagacagggtctcactttgtcacccaggctggagtgcagtggtgcaatcacagatcattgtagccttgacctcttgggctcatgtgatcctcctaccacagcctcctgagtagctgggaacacaggcatgagtcgccatgcttgactaattttttctattttttgtgcagactgagtctcactgtgtagcctaggctgttctccaactcctgggcttaagtgatccttctaccccagcctcccaaaatgctgggattacatgtattagccactgcactccaccattttatatatatacatgtatatttttaggaagaatataatctaaaataagacttatagctaacataaaggatattggaaaaataagtgaaaaattatgttatatctgaaaatagccacttttctgaaatcgtgcaattatcatattttaattttgaataagaagaaaaagcaataggctaaaaaaaacagggtctggatgcaggtaatttcacgagtgaattctttcaaaacttcatgtatcagatgatttacataccaaaaacaaaacaaaaaaactattctagagcacatataaaggtaaaatgtttctcagttaacacctttctgatagacctttctcttatgaacatacatgtaaaaattaaaagtacaggaaactcagactcaaaggtgtattaaaaaaaacagtcataatcaggtagaaattacccgagaaatgcaaatatgctttaataacaggaaacctagtaatctgatctgtcacatcagtaaaacaaaactaggcattcacctctattaatacaaaaaaaggaatttgataacattcagtatcaattcttgatgtattttattttcttaatgtaatttttgaaaaaggataaacaaagaataccagaattctatccaagaatcctaaccaacagtatattcactagtaaagcaccaaaaacatttcccagtgaataatggatcaaaacaagggctttggcaacaagtacaaatactgttctattctaaagagtatggtgacatatgaaacaaaagaggtatagctattggacaggaccagacaaaagccatcactatcaacagatgcttcaactgcctacctagaaaatctaaaaggatcaacactgaagacaacaattaagtaacatcaatgaccagttaattacaaaaaaaagcttcccatttatccataatgagatttaaaaagatgtcacaataaaaatataaaatataaaaattaacttgattataaatgcaagagatctatatgatgaaaccttcaaaaagttacagagtcttgactaattgaagatatcgtatgctcctagaaggctgaatatagtaaaaatatcattgtttcccaaacaggtttaattaacaactagaaacgatagcgtctaatcaggagcatgtactttataggcatctcatttcgtcacaacagaaatcctatgatttttaaattatcaacattttactgaaggagtagttaggtcccagaaagacgaagtgccttgttcacacggtgagtgagtgagaagatgaagtccaggccctctgaagccagtgctttcctaacaaagacgctatactactgcactatttttaaaaagtggcactttgggaggccgaggcggtggatcatgaggtcaagagatcaagaccatccaggccaacatggtgaaaccccgtctttactaaaaatacaaaaattagctgggcgtggtggtacgtgcctgtaatcccagctagctactcggggggctgagacaggagaatcacttgaatctgggaggtggaggttgcagtgagccgagatcgcgccactgcactccagcctggcgacagagcgaaactccgtctcaagaaaaaaaaaaaaaaaaagtgggaagggaaagacgaatgatacaagtaaaaaatttctgacacattagagagggaaataaccacaccagaaattaaaacgcaatgttgtcggccgggcgcggtggctcacgcctgtaatcccagcactttgggaggccgaggtgggcggatcacaacgtcaggagatcgagaccatggtgaaaccccgtctctactaaaaatacaaaaaattagccgggtgcagtggcgggtgcctgtagtcccagctactcaggaggctgaggtaggagaatggcgtgaacccaggaggtggagcttgcagtgagccaagatcctgccactgcactccagcctgggcgacagagcaagactctgtctcaaataaataaataaataaataaataaataaataaataaataaataaatacaaagttgtcataagttaaaattacatgaaaatttgaaaaaagaattaaattaataaacttatagacatacaacctgtaattattgaacattagcccacaaggggattatttgcttgttttattttcttactatatcctcggaacatattggatagtgttaaattcacataatagggactcaataaatagtttaccaaggaaataattaaattgggccataacacttagtaatgaaagtagagattcatcaaaagtcgggctgcaggccgggcatcttgactcacacttgcaatcccagctttttgggaggctgaggcgggcagatcacctgaggccaggagtttgagaccagcctggccaacatggaaaaaccccatctctactaaaaatacaaaaaattagctgggcatggtggtgcacacctgtaatcccagctactcgagaggccgaggcacaagaatcagttgaacgcgggaggcagaggttgcagtgagccaacatggcaccactgcactctggcctgggcaacagagtgatactctgcctcaaaaaaaaaaaaaaaaaaggaccaggtgcagtggctcatgcaggtaatcctagcactttgggaggccaaggtgggcagatcacaaggtcaggagttcgagaccagcctggccaatatggtgaaaccccgtctctaccaaaaatacaaaaattagccagacacggtggcacgtgcctgtagtcccagctactagggaggctgagtcaggagaatcacttgaaccaggaggcagaggttgcagtgagccaagatcacaccactgcactctagcctgggcaacagagcaagactccatctcaaaaataaaaaataaaaataaaaaaagaaaagaaaagaaaagaaatggggaaaaggacactagcttacaaatactcatcctcacaagcaatcagaaagaagcaaattaaatatcttagctattagattgacaaagacaggctttaaattttcaggccctttgccccagtaatattttcattataaaaatccatcactaacttgaaggtataaaatgaaagtactgaaaccacaacatctacaaagtggtataaaagtttcaagaagcaagcagagcattcatgatgctgtacaaagtaaaaggctcccaaatgcaaaccaacaacgtacctttttaataagatttgaggaaaatagaagcttttccttactgtccacctaatgttataattttggacatagcagaacttaaacaagtcattttaattaataaacaagtcattttaattactttaattactttaataagtcatttaattactttaataattatgttagaatgacttctaaagtttactttttggaaaacctgtacgcattactactacatacactgaggaaacagtttgcccactaacggttttgtaggacctttgtgaactgtactgttcagttaggaattactgagtgtcagctccaacttggagatttcactgtattcttcttcccagttcattctggaatggaaagcaacactcacacttaccctaagcattcaatatatactttctgttgctaatgtggtgatttatctacagttgtacaatgaataaaagacagtactgtgaatataatttaaaagcctccagcatatcacctagacaccttttataagtctaaataaatatgcactagcctctccactgtatcgactgcacaaactctagaatattatttgagtgttttttgttccttgcttcgagtatccccattaccttttcctgcacatggaataccagcttttattagtaatctcacttgttattgccaatactttcatttttcctaggtgaaaataagccatttttctatatcttctctttagaacagcggttctcaaccttgactgtacactgaaatcaattgggaagttttaacactataccccctgagactgatttaattaccttggggtacaacctggataatgagattgtttttaaagctctccaggtgattctaatgtgcagttaagataagaatcgcacttctttttccttaaggaaatcatatcaaaacatttaggtaactgaaacacagtgaacataaaatgatatattacagattttggacaacaattccataatctgatgtttaaatgctcttcaaaccctagaaaatatgccatttgtcccactgatatgtccactatttaattattaggtctttcctaggctaaaaactgaaacagcaatgtcacataactatgcaatccacctcttccttcacaaaggtctcaattaatttgaaataaatataaagtagcacaatcagtcaaaagtggtctacctcactagcaaatgataaagaattttccattcagaattcccagactttataatctggcagtcagctttcctattttgttttgaaagtctttaatgaccttacaaactgtgtttactttgtaaaagtatgaatgaagagagctgtttccattaaaggcaaacaaaacgaaactgaaaagggaaaacacaccattaaaatattttattcacctaataagcagtcattatatatcaaaatcgcagctgatttcatttttgaaggaaagaagcaaatgacaacgtcacttaatctgtctgagttctcattagcacaactcattccaccaaattaagtgctgtggtctcaggataccctgtggaaggttaaaagaatcagctgaagcaacaagcaattttccctgagatactgttttaagtccagtgtgaggttttactttaatacgtggtttccaactcactcccaacagggcaaggtattccctataattaaaagcagcaaatatcacaacccatctcttctgtacttggaccataatgcatcaaagccaaaggagcacaaaaaaatgaatcaccctatctccctaagagtatggcatttttggactatcatcagatctgctggaaaactgcaggccagaaagaaaggcatactatggggcttcaacactgctaacttgtctctggggcttgctagaaacatcaggaaagtgttactttgaattcactagttttacaccaacaggtattaccatttttatggctttctttaggggaataaggtgagtttcagaggtctcaaaacatgtttaggaacactagttcccactttcccacagaaaagtaaaagaccctttcacattgcctttatattatctttactccatcctattcctcactaattctttgaggcatggactgaatctgagacttacatgtacacagcagacaccaaagtagtcagaagatgaaaacaaaataaaacctggaaagtaccactatgtccaaagggagataaaagtggccactttatagtagttacaacattcaaatgagcgagttggaggtatattatttcacccaatactatttccccaaatgttcttctccagatcaattttacctgtttacttccccaccatctgcaatttcacagtattatttacatacatttctcaaacttagaattatcacagaaaattatgcaaagtggtaggagtgattatacaaaatggtttaataaggcacaatttagtgtggttacagtggagacacacactgaaacataaaaatataggtatatgaattatatggaaggttagtaggttctattttaataccctcttatttctagttaaaaaatacataaaaactcaaataatgaaaagagcagtgactagaaacctatggattctaatcaaaactaccagcactttaagccatatacatcttaaatattgttacgaatttagacctgaagtctgtgaactcacatttatgagtaaaggtacttaatctcttctatgttggtcattatgcttatcaggatctctctaactttcaaaccaccaaggaaccctttttttttttttttttactttctcctccgaggtctcaatgtttttcataagtctaacaaattgcctttattaattagtacctgatttgtattattgtttttctagtttcaacactgactctacctttaactgaagatctagaaccatccaaagttaatcatcattgttagcactggggtggtgcaaaggtaatcagggtaaatcagcattagaggctcaagcactatcactactgacatcactttcaatcactgtttattagttcatactcatatcatgtgtgaacccctggatatgttcatttaggaggtgtagcacctggaaaggcactctgtcacagtgtgtagcccatatgcacccccagaattttctgtaaaaccatcagtggtcaatcagagggcttgaatgtcataaactgaccactattattcctcaaaattgaaatagtctagacaaaagcaaagaaattcatgtgttcgttaactgtgtttaatgctactaagctttctcaaatagctcatagacacaacctcttactaactttgtggaccattttagccaagtgaaaaaaataaataaataacactgctgctcagttctggttcatagaaactcaccagctctaatagtgaacgggctttgactaaagagaaacctgactcctggcctcctgggtaaagatcttatctttgtgattaattttcttcataaaatgaggaccctttcagatctcaatttctgggtctctaaattcttgaagttgagagaagtgagtaagcagcaatattcatttcaatgacaacaatttcagctattaaatctttttactggatgcctgactacttgaagatacagaataaaataaacaacggattagtgattttgcaattaccttgttacttcttttagataatctaactgtataatgcaagacttcaagtaagttttggcattacttattagcttgtgcatcaaattcacataaacatagttaaattcccatttcattttgccctaagaggaaaccagactgccaaaagttgctccagctccctttagtaagcagcacattttttaaaaggtgggggagggttgagtaaagtaaatacttaggctatttggcatccatcttaataaaaaataaaagtaattcacaaaagttaacctgtgctcaatgctctaagcatttagaatgtggaaattcctaaggattctattttttttcatagaatatatgttgtattttgctttttttgtagtttgaaattatctttggtaatgcctggataaggttataacaatagtctccccagtagtattgtgaatgcacctgcttgccaattcaaataattttgaacaaatatttaaacagaaggagtcagagaaaaatgcactatttgaacagctaagggagggtccacttcattaacaaaatgcaacaagtattcacagtataaatcaactcatagtaaatttgcaaaagcatcttcaaggataatattccaaggagaaaatagtctcttaattttaccaaacattatttttacactttaatcattaaaaataggcttaaatgcaatatgaatggtaaaactagagactggatgatatgaactcataccacaacatatacaaaaaatagttttaacaatgactattgaagctgacagtcgcttgactagaattgagaagaggccacgggtgactgcctcagaacagactcaattagagcagctgattaggaagtatgggattcatacaggagtggagcagcaggctcataaaaacaccgcggggcattcaaaacttacctgagtaatggtggttttaactgtgccaatttgtttgggattgggaaatgctattatgacctatttctcttctccaacatgaggagtctccctaccattctgtgactgaatacctagggttaggttacctgaaggatctgttattaatctccagctgtaaggaaatattccataaggattcccagagaataaatgattccaaaatagttgctcagtttgtgtgtgttttaaaaagttgggtaagaccacttaaaatttttttctaagaggatagatcttaagcatacaatagtgttaactataggtgtgtacttatccccatgatacttatacacctatgaaaccaccaatagttagggtggagtggtatgcacagctttttacatgtcaattatacctcaaaaaataaaggttatctaaatgggggtaggagaatgtagggagactgaatttactctgaactacagttatagttgaagtcaactcaaaacctctccaaatttctaaaaatgcctcacacactgaagttaatatttcagaaaactaataaatgtctgtgcatgtaggtatgccttgagcagactacaatctctctggatctctaggtcttgtcacaaactgagggaactgttaccgatttctacagaaccttccaggttcagcattctattaaaaagatttcctagagtttgtattgtaaacatttaaccacttaggacaatttgagtcattactcgtgtctggtacagaacatcaggcccctggggtcttgttttgaaactcaagttggccagcctttcacctgaaacaaacttcttaccttttgggggagaataagcattttgttccccaaaaaagcatttggaaagcatttgttatgaagtgatcatgcaccaatcctttatctttcatcagtaatagtatatttcattaatcaggcctgcccagaccagaaattacttacccacaaacactttacaaagctgcatgccttctcggtgtttggatttgatgtcctggttgtatgacaatataggaaacgtattaatttaacttttttattcactgaggaaaatttctacccctcttaagtgaagacttcactctagctaagagaagtactcgggctccacctgtttcgcctagctacaacactcattcagaccctcggcaaacccagctctagcaatatcacgccaggctaggtggacaggaatgcaccagtgctgttggaaattaaagttgatgggagttgcattctaatccggccagagctgcgcctgccgggtgcaaccgcggcgcggccggcgctgtcggtctctgtctcacggatggtgagctgacagctcctgccagcccaggcggggaggaggagaagaggtgtccgctgcagccgcatacccggcgggtgaaagcaccgtcttgtccccaaagattcctctgccctcagagactaacaaaaatacggtgtcctgcgtttcgcagaaggacgggaggcgtcccagagctctcccgggagaaaaacccagggagaagtggtggtaggaggcgcccggtcccgcaactcaccttctgctgcctccgggccatgtcggtgggctgcttggcgttgaaggggtacgcgatgcacctcacgacgaagacgtagagctgcaggcggatcctccgctcctgctcatcgtccagctgccgctggggctcgtctcgcccctcgctgagcacagaggggctcgggctcacagatctggccgcgccgccgccgcccgcgcgccccggcgcgtcccgccgcccttcccgagtcggggctggaggagctcgctgcgagctgccggctgccaccagcacatcgcggctttcctcttccagcccctcgtccgactcctcttcgctggaagacgggtccagcatggtgctcggggatccccgccgctcggcccgcggtccccaagcgcctcacccccggcggctgcgcccgcgggtctgagggagccgcggggctggctgcagcggccgcagaacgaaaggaaaactggccagggctttccggacacgtcgagttagattcaggagtgtttcctaccaccagggcgaaaggggcgggcaggagccgggaggaggattgggaggggggagagggggagccgccgggactgaataggcggagttagcgttgggggtgagcttgggcgcctcaggaattgctccgccagccccgggcgcgccgacccagcggttccccagagcccgccggcagaggcggagccgcccgagcgcccggacgcaggtggggaacctgtggcgcctacaacaagcaacacgtggaattgaat

SEQ ID NO: 599 - DNA, 568336 bp, Homo sapiens; identical to SEQ ID NO: 598

SEQ ID NO: 600 - DNA, 568336 bp, Homo sapiens; identical to SEQ ID NO: 598

SEQ ID NO: 601 - DNA, 1443 bp, Homo sapiens
aacagacaaactgcttgtcagtattaggacctgatttcacatacaggtttaatacacttcctcaaaagtcatgccatcaaggtgaaggatgaacatcttccactactgaatgaggctggatgtcattattctgagaagtagggttctcctccacatggattactttatctgaggttcctgcaggagaaacttcattatttgtctcctcttcactaggtgataaggtttcaggcagttcatttgacattagaacttgcaaaggttctgttccattttcaacaaccacttgaatccccaaaactttaagaatatcacatttgcaaatggggcatgtcccatggggtaaaatccaggggtcaatgcaattcttgtggaaaaaatgtttacaagtcagaatacgaactatgtcattaggcttatagcgttcaaagcaaattacgcagctatccccatttggatttatttcttcatccccctcttttactactcgaagttggagttgtccaaatgtgttctgaagatctgttgttaatcgctgccatctccggttctgaatccttgctaaacaaagtctatgaatgtgataaaagatgaaatatgctaaggtagcagttgtgacaatcacaaaagagaccaaatagtgattcatccagatgatgtgctttctccccacctcaaccacggctgtaatgagaactcccttcttaattaaatggaaaatttccgtgccttttaagttaccaatcataaccacaacgacatcttcaaatgcctgatgaaacatggggaacacctggttgccagtacctggaacgttatagatgatcactccactggctcccttctcagttgccactttaattttctgtgtgaaggtacaacctccccgttcaataagtgcaagccaggtctctgagtactttgatcggctgaaaatggtattgggattacatgcattttggatttttccctctggtggcactataactcctgccactctcttcaaagtggagcttcttccaaagactccagtctctcccaactctgacaacacatgattcccaacatgaaatgatatgttcatataagccatccaaacaacacttgctctgcaacagttctgactaacaagccaaagaacactgaacttcataagccaggaagaggcagtgttgtttctccaagtgccaaccttgagtagatgcatctctctcttctccgagtgacttaagaaccaacctaacagttgcacatctgttgacaattaatttaaaataacgaagagaaaaaaatcttcaggatacaaacaagatccactgtcttccagcatgtttttgtaagaaattcttaaagatggcttatgagtttcagatgtcttactagagagaggtgaaaaactttagattgaaaaataaatcccctactgttaactctagatactgc

SEQ ID NO: 602 - DNA, 1302 bp, Homo sapiens
gctgggcatgataaggagttttatttttaaaacacaaatttcacccttgttcatacttgggtagagaagctgaaattttctctctacataaagtacaataagacaatttatctaatctttgtatttggaaagatctggttacatcttcagaaaattctccagatttcttaagttttcaggatgtcacacttgcacatgggacatgtcctatgggctaaaagccaggggtcaatgcatgccttatggaaaaaatgtttgcaagttaaaatgcgtactacatcttggggtttgtatgtgtcaaagcaaacaacacagttgtcttcatttaggtctaattcctcatccccttctttgagaactcgcagttgaagctggtcaatagctttcttcacatctgtctttatttgacttcgcctcctggtgaaagaattgggcactctaggtgtaagtctccagacgcaatctaagtaaaagtaggcaattgtggcagccaggaaggtaaatagatacatgatgtaatggctcacccactgcatgtgcattctccccacttcaatgatgactgtcacatagactcctttctgaatcgagtgcaaaatttccatgcctttcaggttgcttatcatcaccgcgactatattttccgtcccctggtgagacatgggaaatactttactgcccgtaccttgatagttgtagatgatcaccccatttgctcccttctctgctgccacgttgattttatgtgtaaaagtacagcctccacgttcgatgagggccagccatgagtctgcctgtttgggcctgctgaaattggtcaaaggatgacaggcattctgattccatccttcaggaagtgccaccacaccagacaccctttccagaggagaatgattcccgaacactccactctctcctaattccgatgtgatctcatttccaacctgaaatgttatattcaggtgagctgtccaaatggcttttccgtttgagtcaggaaagctaagtagtagaaagatactaagcctcaaaagtccagatgaaacagaactatgcgtcgaaggggtaattctaaggaagctcatgcctccatttgtctattaagagacaaacatgagaaaacaaaacaacatcagttgtagaagaacataaagaagatagcttgttggcggcagattactaaagcacataaatggaaaaggtctccctggatcaaagctatcttgctccttccagtattttaatatttagtagattatctttctcataatgaaacaaaataacaagacttgtgattggtac

SEQ ID NO: 603 - DNA, 39812 bp, Homo sapiens
gttacgccgctgatgtggagtagggccgagcgcggaacgcgaggggctgctggggtgtttgtcgcagcgggttttcctcggcggtttgcggagctgctaggatggagcaggttgcggagggagcaagggtgaccgcagtccctgtgtcagctgccgacagcactgaggagttggccgaagtcgaagaaggagttggagtagtgggcgaagataatgacgcagccgcgagaggagcggaggcctttggcgacagtgaggaggacggagaggatgtgttcgaggtggagaagatcctggacatgaagaccgagggggtatgtggaggggccccggcgcggggctgggcggggagctccgggcctggcggggaggacgcgagctggaaacagcacgggcagacccaaaacaggagcgggggaggaatgtgagagttcaatgcaagcacgcgaaatcgtgggaaaagcgaagtgacatttccaactgcactcttagggctgagtgtgtgagggaagcttcagcaaattttggaggattgttttggccgaagagacgaagcagtttgggatgtggtgtgtggtgatcacaaggctgcaggcagctggtgaagggagctgctgcgctttggcgtgatatgatagtgaagtaatgcttctcgtcgtagtccactgtccacgccatcgttacagtgttttccaaaaccgtaaccaactccctggtttaaaatcttccggaattttcatttgcccttggagtaaaatctcaatcttacccagagggtggcatttaaaggccttcataacctgatcagcatcatccctctctcccctatgcgttgtatagctcgcagccacacagaaatacttggaattcatcacaccatgccttggtgtttcctgttctcctggcctggacagttctctgccctcttcttctggtgaaatcttactcaaatgcttccaaggcctcggggtgtagctctctgggaaagctttttttgaccctaacctctgcagagtgaggagcttctcatctctgctctttttactttttgtattgacctctatgaaggcatttaagccattatcgttctttgtttgtctctcctgctatatgtggtctcctttaatccaaggggaagcatggacaataagaaaacaatctgtttcagtagatggatgtgaggtaaacaaaggtcccacagtggtcattctgtatgttgtgttttcattgtctgttatttcccattggtcatatgctgccttgtgtcaattttttgcgcattcattcagcattttttatcaactactgtatgccaggtgctgtgttaggtccggacaatatagagattttaattgaagcatacacagttgctaatagtggaaacttttcctatgaggagttaagtaattaagagctgatgtcattaatattgttatttgcaataaagatggaaatgtttttatgtataatttctccaaatatattgtaagcactttgaggtgaaaggatgagccactgttagactattttgtatcacttgcatttaacacaatacctggcacacaggaggtatttgaaaaatattcggctagggccgggcgcagtggcttatacctgtaatctagcactttgggaggccaaggcggacggatcacgaggtcaggggttcgagaccagcctggccaacatggtgaaaccccgtctctactaaaacacaaaaaaatacaaaaattagctgggcgaggtagcgggcgccagtaatcccagctactcgggaggctgaggcaggagaattgcttgaacccgggaggcggaggttgcagtaaaacaagattgcgccactgccctccagcctgggcgacagagggagactccgtctcaaaaaaaataataataatttggctagaaggataaaatctttagaattaagatgattctcattcatacagtgtttaattttgccagcctcaaagaattgtaagcactgtatacctaaagcctcaccagtctaaagagggtgaaactaagaaacttatttgtgtaaggcaattaggctttagtgttgtgagttaaaattcaagttcttgcatttttaggtgctcttgtgaaggagtggtttatatgattaaagatgatatggtttggctgtgtccccacccagaatctcatcttgaattgtattccccataattcccatgtgtcaagggcgcgaccaggtggaggtaggatcgtgggagtggtttcgcccatgctgttctcacgatagtgagtgagtctcaatctggtggttttataagcgtctggcatttcccctgcttgcactcactcgatcctgccaccctgtgaagaaggtgcctgcttctcctttgccttccgccatgattataagtttcctgaggcctccccagccatgctgaactgagtcaattaagcctctttcctttataaattacccagtctcaggtatttcttcatagcagtttgagaacggactaatacaaaaggtgttagcggaacaggactattgcagttttctgttttcactgctgagtgaaccagccggttggttagccacctagccattgacaaacttaagggtactgctagcggtttgttaggcctccttatagtctagtctatagtctataatcagaaacacttacaattgattcactttttactaattaataatatttcttgattctaactatatgtatgaataattaacataagaactgtggaaatacatacatacaccaccattccaaatcattatttataatttatttggggtaatagagtaagcagagaattaaattctaatagtgtatattaatttccttttttttttttgagacagattctctgttgcccaggctggagtgcattggcataatcatggctctctgcagccttgacctcccaggctcaaacaatcctgccacctcagcctctcggagtagatgggactataggtgtgctctaccatgactaatattttaattttttatagagatggggtctccctacgttgcccatgctggccttgaactcctgggctcaagtgattctccacccttggcctcccaaagtgctgggatttacaggtgtgagccactgtgccaggccaattttttaatttttttaacaaaattttaaactgttgctctagtgtatatgatctggtagaataggggtctgccttttagtttggctcactgattaaaggaaactttggctaccaagaaatagactgcttctggaattttgaagtcaaatttataaatcctagggctatcatgcaatttccttatacatggcaaaaccctggacaattttttggatttacatgactccatacaaagacgtggaattcagggatttcatctgtatttgtatactgccatgctcctaaaactcagaaggttcctgaaacatagtgaccacgttcaataactatttgttgaatgagtgaatgaatgaagcacacctgttgaagtaaagggtaacaattatcagtaaattaaatctggagctataattaagatatgttccttaatacttgaaaattgttcttaataccctcctcatcaattaggtcatatttcactgataactagcattagatttataactatgttaatgtaaaaggtaattttctagtctccactgctttttaaaaattatcagaaatgtaagaattagatagactctcatataccttcacccagattctctagttgttaatcatttatttatcttttttctgtttatgtacatttttttctggcccatttgaaagtggtgtttttaagggctatgttgaataacgcatttaccactatttttatgcacacacacaaacaaggatcatttttgttcccatgacccattactgataaaattagctgataaaatccacccgcctcggcctcccaaagtgctgggattacaggcatgagccaccgctcctggctctgatgtttattctaaaaccaaatatattgctttcttttaggcagttctgcatactattgactaagatttcttttcttttcccccattcatgcaagctaagaagctgtcttcttagctgtgctgtctcatctttaatttcttcagttttaattatgcctttacagaagacagaagctcttacaaagttatatacaggccgggcgcggtgggtcacgcctgtaatcccagcactttgagaggccaaggcaggcggatcacgaagtcaagagattgagaccatcctggctaacatggtgaaaccccgtctctactaaaaatacaaaaaattaggtgggcatggtggcaggcgcctgtagtcccagctactcgggaggctgaggcaggagaatggcatgaacccgggaggtggagcttgcagtgagcagagatcgtgccactgcagtccagcctgggcgaaagagtgagactccatctcaaaaaaaaaaaaaagttgtatacaatagttttccttttgtatattattttgcctaaaagaatatgcatatattctcaatggataaaatcaccatcttcccacccatttaatgtagctgaacagtaaaaataaaactgtattgctgaacaataaaactgtattgatgtactcttaactattattttaaaattttaaggcttttcaggcttatctttaaaagttaagattttgaggctgggcacggtggctcacacctgtaatcccagcactttgggaagccgaggcagacggatcacgaggtcaggagatcgagactatcctggccaacatggtgaaaccccgtctctactaaaatacaaaaaattagccaggcgtggtggtgtgcgcctgtagtctcagctactcgggaggctgaggcaggggaatcacttgaacccaggaggcgaaggttgtggtgagccgagatcgtgacactgcactccagcctgacagagcaagactctgtctcaaaaaaaaaaaaagttaagattttgaatttgttctttttctgatatttcttgagttcagattctactcagtgcttgtacttgatctttctacacagataactgaatgattgaagggcagtgtgggtacaattgaagggtaaaatgggtggggagcagttcttggcacttcgcttggaaagtttattgccttggtggtggtgtgaagaaaatcaggcaagtgttaagtgtgtagctagaatggtgctagcggatctcttgaggtcaggagttcaagaccagcctggccaacatggtgaaaccccatctctactaaaaatacaaaaattagccaggcgtggtgctgggcacctgtaatcccagctacttgggagggagaggcaggagaattgcttgaacccaggaggcagaggttgcagtgagctgagattgtgccactgcactccagcctgggcaacagagcgagactccgtctcaaaaaaaaaaaaaaaaatttaccatagggtttttaaaaggcagcttggtatgggagacatgtgggagtggtgctacagggtctgtgtgtctttgtttggatggctattttggctagtcacccatctggaggtctggttggcgctggtggtagcctagttgcttgcgactcctcctgagcaggaggattctacagtgcctggtttgtttgagattagcctctggaatgtcttttttttttttcttttgagatggaatcttgctctgtcacccaggctggagtacaatggtgtgatctcagctcactgcaacctccgcctcctgggttcaagcgattctcctgcctcaggctcctgagtagccagaattacaggcacacgccaccacacccggctaatttttgtatttttagtagagacacggtttcaccatgttggtcagggtggtctcaaacgcctgacctcgtgatccacctgcctcggcctcccaaagtgctgggattacaggtgtgagccaccacacctggcctaccctctggaatttcttaagcaagagcataattagataagcatgcattgctggaagagagtgtctagagaggaaaggaatgcaggggtaagagaggagggaaggaagaaaaagaaggtgattaaaatatattttaaaaactgaggtccccagttacagatgcattgccaaatccaaagtcgtgaaaacttattcctgtgttaagaattttatgggccaggcacagaggctcatgcctgtaatctcagcattttgggaggccgaggcggacagatctcttgagcccaggagtttgaaaccagcctggccaacatgccgaaaccccatctctactaaacaatacaaaactcagctgagcatggtggtgcccacctgtaatctcagctacttgggaggctgagcgatgagaatcacttgaacccgggaggcggaggttgcagtgagccaagatcgcgccactactctgcagcctgggcgaccctgtcttaaaaaaaaaacaaccaaaaagaaaaaaaaagctgtggggtaagacactgggtttgaatttcagctgaactacccattagctgtgtgatctttgactagttactttatctagaagctttagtctcctcatctataaaatgggtaatactacctagttcatggggatgttgtaaatattaatgatgaactaataaatgcaaagatttagacagcgcatggcacattgtaaagcagttgatgaatgtaattcttttgatttccctttaaccatttaaaaatatagaacaattcttagatcacaaggtgagcaaaaacaggaggcaggccctgctgtagtttgctgacccctgatacagagagatggactcttgtatctggtggagtgtaaattggagcattttttctggaaggcatttggcagtgtgttttaatctttaaatggcttgccttttttttttttgagatgggatttcactatgttgcccaggctggcttcgaactcctgagcttaagcgatcctcccacttcagcctgtcaagtatctgggactctaggtgcctactaccacgcctggctgccatcaaccctggaaatggctaggttttttttaccccattgacctcctttctgggaatttattctaacaacttaataagagatacacagggatattacagctttatttataagtacaaaaaaaatggaaaagggagcgtttttgtactattttttgttgtatttgtatgatggaataatcttaagtcactaaagagcgtttgaaaagttataacaaaaagtgcttgatacgtaagtgaaaaagcaatattaaaaattatagtattatcctaatgttttaaaaacattctaaatatgtattaatgtaataggtgaaggaaatagatcaaattgttttcagtatccatttattatttggttcttcctatcttttctatttttcattgcttttcaagaattacgtactgctttatggaatcagaataggacttcagtctttggtttatgaaaaacagatcaataatatactgttttttcttttcatttctctcttttgttttccacaccagggtctggctctgttacccaggctggagtgcaatggcactatcttggctcactgcaacctctgcctcctgggcttaagtaatcctcccacctcagcctcctaagtaacttggaccacagttacatgccactgtgcccagctaatttttttttttttttttttgagatggagtctcgctcttttgcccaggcaggagtgcagtggcacaatctctgctcactgcaacctctgcctcctggatacaagcgattctcctgcctcagcctcccaagtagctgggactacaggcacgtgccaccatctttttttttttttttttttttttttttgagacagagtttcactcttgttgctcaagctggagtgcaatggcgtgtgatcttggctcactgcaacctctgccttctgggttcaagcgattctcctgcctcagcttccgaagtagctgggattacaggcgcccaccaccacacccagctaatttttttgtgttttttagtagagaaaaggtttcaccatgttggccaggctggtcttcaactcctgacctcaggtgatgcgcttgcctcggcctcccaaaatgctgggattacgggcatgagccactgcgcctggcccataatttttgtatttttagtagagacaaggtttcaccatgttggtcaggctgttctcaaactcctgggctcaagcagtctgcccaccttgacctcccaaagtgctgggattataggcatgatcccactgcacctggtcaatactttttttcttaagccacttttctcaggagatgtgtgtactttagaatgtgaaaatttccacttagaagcaattttcaagttctttcatgtcttctcatcagttttttttttttttttggaaatttaatcaagttagcaatctgctttatttgcctccttttattttctataacagggtaaagttctttacaaagttcgctggaaaggctatacatcggatgatgatacctgggagcccgagattcacctggaggactgtaaagaagtgcttcttgaatttaggaagaaaattgcagagaacaaagccaaagcagtcaggaaggatattcaggtactatgttttgtctcatatttgtttttacatacataaatttattgtaaattttaactctcaaagtatgtgtagtaaatgatttacaaataacaaagtgtaccgtattctttagtgtaaattccatgtagccaattctcacagactgctttcagtgatttttgctgggttcttctttctgtacccaacctacagttgcagttgacaaacaagaatagtttggagatgaatattgatattttcctttaagttaagagtaaggtcaaggtggagaaaaaagagacatgccaaactatcatttgttcgtccgtgacatgagcaacttgtttttgtatatttattctgcattattaactatgtcttatgcctgctttttctgctagttaaaacaaattatctggtgaggacctggtttaaaaaaaaaaaaaacaacttagaactatatagtgaagatatctcacattaagagaatgattctcatgattttataggctgaacattgatctttctccctacaatttaagtttcaactatgttttttaaaatacctagtcttttcttaaatgaccaaaacaatattagttttgactgtgtgtagtagttgttaataataatagcaataacagaagtgcctggcatttattgagcatgtgtgtatactacataactaccatacactgggtcagcactggtttagtaagtgaagcaatcacttagtaaaacaggtgtatttataagatgaccactggtctgtcatgagctttgagtgatgttacgtgacactaatggacttctactgaactgttttgtcaacatcgtagtatttttagcttttttttcttttttgagtaaacatggagtgtctcataggggccagacccctaaacagttacagttacggaaagataggtaaaatctattttctgcgcttgatctgtcttcaggttatacgtagatgtatgatttttttcttttcttctcatttatttttaaatacagtcttgcttctgtcacccaggctggagtgcagtggcacagtcatggtccactgcagcctcaacctctgggttcaagtgacaatcctcccacctcagcctcccaagcagctaggactatagatacacgccaccaggcctggctaattttttttcttttttccagagacagggtctctctctattgatcaggctggtaggaactcctggcctcaagtaatcctcgcacctcggcctcccaaagtgttggttgggattacaggtgtgagccactgtgcccgacctgatttttcttttaaagatggtaccatatactaattttgccctttgcccttcctttaaaataatcttttattaatacatattttattcagaaaacaaatatgggtattttttttggcaccagtacattttcagagattcttttattcaacatgttactattggtgctaaaactgttgtacatttagctggaaccccttcataccagcccctgtgtcctggcgctcccactcagggtagcactgctctcttttttggcacagtggcacatcccagcctcaataaatccatgctgacctctgtaactcggcctgtcaccacagtgtcaccacagagacctacgtgttctcccttttcctaccaggagaactctggtcacaacagtattgcatgtcctcatttactaaatcttacaatacagagaaattaacctcagatttgctatgccctttctactgtgaatgacaaacagtatttgttaatctatttgataaagttccacattcatttgtagttctttttgttcttagaatatatgcactgtttaatgttcagaagttacttgaatttttttttctgtgtggttatcaattttataaacaggttcatttgtctgtttgtattcagttttagggttcctccatccttgccgatgcaattttgttgagtatgtaaaatacttaatgtggttcaaaggataaaactagaaattaactaggacctatcttctccctgccctctctctccctctatatctaatttgaaatactgtcctttactcccagttaataactataatcagcaagcataatattcctttaatatgttctcaccacatctccctgttatttcctagatacactgtaccttgttagaacatttagtcacacatactacagtctctcttataaccctcattcagtcttagtcctagaagcaaatacataattaatgctttccaccagtccttatggtgatgtttgtccagtcatttttggttatctgaagttcatgctttagtaccggacgtctcaaagtgtggactccggcaggagcatcagtccccagcagaggtgcatgcaagagtttgcaacccacctctgtggtaggaaggctcttgagaacaatattcactgacttcttttgtttcctaacagtgtgttggcagcctttctatctgaatgccagttgcagattccttagtgcacattttcttttctcaggtgtcttactgtgttaatccattgttatctggcacaaaacattgctcttgatgaccagttgagtttatttgtcttgtaagtgacttggggtctttttgcctgatgctccaaagtttttgtttgttttctcttctgttttatagacatgtctttttggtatgcttttattgcttttaggatagtcaacctggctaattaaaaaaaaatttttttttagatcttttgtttctgtcttctctggcctacttggtttggaatctaatcctagcagtttttcctccttgtggggcttggtcctggaagtcctgaggagagcttcactggtcccttttgcagggcctgggaggggtcagccacctctccccttctccgccttgcccagtgcacagcaggccccaccccacagctgctctctcaggcagcagcagcctgggcttttccagattgttgccttcgcttcccctgagtgaccatccacaccacatgggccttaccactgttttagttttggtaaggcctgtgtggtagggacttgggacttactaaaaccaaaagctgtctgtggggagttttgttttgctgtcctagttgccttgttttttatgaggtgattcagggagattggaaaggttaagccagtgccaccatattcccacttgttaaccttggtggtgtccatttcttaggcagtgcagggaagacatttttaaagtatatctggccaggcgccgtggctcacccctgtaatcctagcactttgggaggccgagaggtcaggggttcgagaccagcctggacaacatgatgaaaccctgtctttactaaaaatacaaaaattagcagggtgtggtggcacgttcctctaatcccagctattcgtgaagctgaggcaggagaatcgcttgaacccaggaggcaggggttgcagtgagtcactgcactccagcctgggtgacagaatgagactctgtctcaaaaaaaaaaaaaaaaagctatcgtttccatcccttctctctacccccaagtcatttaggataaggtggttttgggaaatgggaacagaaaatactttgcatagtgtttttgtgtttatacgagtactttattcttaagtttctttttttcaattttaaaataggaaaatattttttcataagcaatatttcagataacacatgaacttgggaagtaagatttgtgtgcagtcttgcttgttctgtacataactgtcaaacgtaggagcaagtttaaggacattccaggatccagggtcttagaaaacgttttgtatttgcattggtaactactttgttggcagccaagaaagtctgtaaaaattactttcttggtggttttggaaatgttgaaattcaaatcatttatagcccaccatacctgagtcctttcactcccactttgggttgggcgctcagcagcactgagtttctgtgcacccctgccttccagactcacacttgccctcaccgccaagacctgtttgctgagtcagagatagaggtagcatacgatttcagcttaggtaagcagttttaagaagttgagattctgcttggaacaaaaaatattcttaccaaatttcattagtactacttttcaaaacctttaaaatcaatatgttaatgaatattttaatctgttttgtattttatagagactatccttaaataacgacatatttgaggcgaactctgatagcgatcagcaaagtgagacaaaagaagatacttccccaaagaagaaaaagaaaaaattgaggcagagagaagagaaaagcccagatgatctgaaaaagaaaaaagcaaaggccgggaagctaaaagacaagtccaaaccagacctggagagctccttggaaagtttagtttttgatttaaggacaaagaaaagaatttctgaagccaaagaagaactaaaggagtccaaaaagcccaaaaaagatgaagtaaaagaaacaaaagaattaaagaaagttaaaaagggtgaaataagagatttaaagacgaaaacaagagaagatcccaaagaaaatagaaaaacaaaaaaagaaaaatttgtcgaatcccaggtggaatctgaatcaagtgtacttaatgattctccctttccagaggatgacagtgaagggctacattccgacagcagagaagagaaacaaaacactaaaagtgcaagagagagagcagggcaggacatggggctggagcatggctttgagaagcccctagacagtgccatgagtgctgaggaggataccgatgtcagaggcaggaggaaaaagaagaccccgagaaaggctgaggacactagagagaacaggaagctagagaacaagaacgctttcttagagaagaaaactgtgcctaaaaagcagaggaatcaagacagaagcaaaagtgctgcagagttagagaagctgatgcctgtatctgcccaaacgccaaagggccggaggttgagcggggaagagagaggcctctggtccacggactcagccgaggaggtaagggccacgggaggcagcagaaaacccatgttgagtggtcaagacatttcacaagcaaggaaagggaaacagtcaagctataagaaagtgtttatgaccatgggcggtcataaatgaagatcctccagcttttggacaccgcagcttatctcttagtctctggtttgtttctcttagaatgattatgactagaaaattaaaggctaatttgtgaacaaaaatcaggatggtttttagaggtactcagatgatatatggagcattgtatactcaggtttatagcttcatcagcttattttattaacttttcacatcctgcttggtcatttcccctgttgtcttgagtataccactattaaataataggacacaaactacattaaccagtattttaatgctttttaaaatgtatttaatagggaatttgtcccattataaaaattatttttatatggctttgcaaaatggatatattttccaaattatgagagtatttatatatgcaatatttatcaagggctataaaaaacatcatttttttcatccattatttccagttttgggaatgtattttaaggaaatcattttaaagaaggaaaagctgtgcatacatagttatttatggcagtattatcttcattagtgctacagcaaaatagaacaacttagaaaatgcagtggagaagaaaaccctacataaatgtgaacacagtcatgtaaaaatatgtgtgtaatgtaaacaaaaatgaattttaaaaaagattatccatgtaaaagtacgaggaccagaagggggaacatggagaagtacaatagtcatggttggttaagactatgggtggaaaactttcttataattttctttttttttttttaataataaaattcctaaaagagggttggaaaactgatgttgggtttggaatttgatattttgtgaattattatatggttgactgaggaagcaaaattcttttgtgtgaagaggatttaatgatcagttatcatgtaccacagtatacaagggtgattccctgaagccacaaacctgtattttccggttctcaaataaatttacagtgtcaactctttatccattcttgttttggatatcatgtcattttcaggacaaagaaaccaaaagaaatgaatccaaagaaaaatatcagaaaaggcatgattctgacaaggaagaaaaaggcagaaaagagccaaaaggattaaagagtgagtgtaaatattaacgttttgccatttacgttgctatcttttatacaaataaccagttacctaaatttattatataaaaatttatataattttttttccttattttcaccttgtttttcctttttaatatgatgagggatctgattagaattactgagactggaaattagttgtggcagaaaaataaatgtgtttttatagcaagatgctaaattttaaaaaaccttttaatatattcattatatgtaactctgtgtcatttgtgtaaatataatattgaatacgcattttggatcacttcaagatagaccataatagaaaatccattatatatataaatattggaacaaatactttatatttcttgaaaacaaacaaaaaaacaccattacagtgtttgaataaaccctagcagataaatatttagtttctgtagcaaaagtacttggaacacatgttttctggcaaacagtggttctaagagatggatgcttttccttaggttttcttactgaaagctgtatgtaactgaagtaatattaaaagtaagtttttttctaagcctaggctggttttggcagtagaagcaggtgaatgaagtggcaggagcagtggctgtttcagtgggtcacacataaagtggctgtaagactgttgttcaaagcaaaacaaaaatcttaaatgccttctattcttcaaagaatgactagaggttcaaaatactgtaaaactggacctggccttgttaaccttttttcctcctagtatcttgtatgtcagtttcagatacatttttactgtgaacatacagccttaaatggaactactgtttgtcccattcataagggtactcactagagtccagttttcaatattccctgataataaaacctgtctgctgtgtacccagagtttataatagaattcatcctaattctcttctttttggggttatttcttatgtcaggtctagtacctgccagttttcttcccactttcttctttagttaaaagctggtagcgtcaggtacagttttaccaggtacacaggcagtgctctggcaccctgctgtttccctcacttgccaccagaagccattttggtacaagcttcaacatccagctatagacagtctggtgtctttagctgtgggaaaggtgctggtgtgacttggatcactctgagactcactgccttcagtaggcctttgtcacaactgcaggtgagtagttcagaacatctgcttaacagccattcacactggacatcctttctgaatattgagcagccagtagaaagaccagctgaaacgattttgtggctttgacagtaaatcagaccaggctttataagcaaggtagatgttagtaaaaattaagaaaatatcttgttgctttaacactaagttagattttcttttgaatgtaacagaaatttgtgactcatacttaaccatctattttaattttttcgttagcacttaaggaaatcagaaatgcatttgatttatttaaattaactccagaagaaaaaaatgatgtttctgagaataatcggaaaagggaagaaataccactggattttaaaaccatagacgatcacaaaaccaaggaaaacaaacagtcacttaaagaaaggagaaacaccagagacgaaacggatacttgggcatacattgctgcagaaggtgatcaggaggttttagacagcgtgtgccaagcagatgagaattcaggtgagtttggaatcattttgcagaatttttcaaggtagtgcaccatattattttactgtactcttctctgtatttctgatctcaacgatcaaaaaataatggagtcgaagagtttatttggatctcctgaataaataacattttatattgaagacgggtcattctgtgacttctcaatggatcaaacaatttttctgagttcctataatgttctcagcacgtatagaaattaaaagatttctgattttctaccttacctactcttacctggcagccccattttatatcttactatttaatagatttctttcaggaaattatcaaatataaacttatttgtattttacccttttaatgttgtagcaagtaacactaaataagattatattataaatgctgtcctgaggacattggagctggtcaagaagaagaatacagactacagtagtggtggggaggaggagtgctaaaaagtgtacatacatgtttataactaggacctaataaatcagagaggttagtctaataaaactttgtataatttgtgaatcttgagaaacagttgagaattgaaaaattcggaatatatgacagactagatcgcctgggaaacccttatactacaaaaatgactatatcttggataccgagggaaaatgtgcttttggatatattgctgagcttgcaggaaattagggtaatttctggtaccagtgggcaaggaggaagaggtatgtcgcccagagggcagatgccaaatagtaacactgctgttgagataccaggcagtaaaaaacagatacagtaggggaacatcagtaaagccagaagtggattcctggttttctataaaataagcctctgacacagtttgttgagaacaaaagaaacacatgaaaaagaggtacgattacaggttgtgtacagatttaaaagatgaaagaattctatgagcaatttcttaccagttgatttgaaaactagctaggcggccaggcacagtggcctgtagtcccagcactttgggaggttgaggcaggtggattgcctgagctcaggagttggagaccagcctgggcgacacagtgaaaccccatctctactaaaatacaaaaacttagctgggcgtggcagtgtgcacctgtattcccagctactcaggaggctgaggcaggagaattgcttgaacctgggaggcggaggttgcagtgagctgaaatcacaccacagcactccagcttgggtgacacagtgagactccacctccaaaaaaaaaaaaaagaaaactggctaggcatggtggcatgtgcctatagtcacagctactctggaggcgaggcaggaggatcaataagcccaggagtttgaggctatattatgctaagattgtacctgtgaatagccactgtactccatcctggtcaacatagcaagacttcatctctaaaattgaaaaagaggtttgaaaactgaatgacatgggaaaattccttgggaaaaaaataatgagactgatccaaaaaagactgaatagtcacaactgttaaagaacatgagggctgggcacggcggctcacacctgtaatcccagcactttgggaggccgaggcaggcagatcacaaggtcaggagtccgagaccagcctggacaacatgctgaaaccctgtctctactaaaaatacaaaaaaaaattcgctgggcatggtggtgcgtgcctgcagtcccagccacttgggaggctgaggcaggagaatcgcttgaacccaggaggcagaggttgtggtgagccaagatcacgtcactgcaccccagcctgggcaacagtgcgagtctccatctcaaaataaaaaaagaacatgaaatacgggattgctggcaagatggccgaataggaacagctccgttccgcaattctcagcgagattgacacagaaagcaggtgatttctgcatttccaactgaggtacccggttcatctcattgggactggttggacagtgggtgcagcccacggagggtgagccaaagcagggtcgggcgttgcctcacctgggaaatgcagggggtcggggaactccctcccctagccaagggaatctctgagggactgtgccatgaggaacggtgcactctggcccagatactgtgcttttcccatggtcttcgcaactcacagaccaggagattccctctggtggctatgccgccagggccctggatttgaaacacaaaactgggtggctgtttgggccgacactgagctagctgcagaagttttttttccataccccagtggcacctggaacgccagcgagacaaaaccgttcattcctctggaaagggggctgaagccagggagccaagtggtctggcttggcgggtcccacccccacagagttcagcaagctaagatccactggcttgaaattctcgctgccagcacagcagtctgagatcaatctgggccacttgagcttggtgggaggaggggtgtccgccattgctgaggctcgagtaggtcgttttaccctcatagtgtaagcaaagcctccgggatgttcgaactgggaggagcgcaccgtagctcagcaaggctgctgtggccagactgcctctagattcctcctctctgggcagggcatctctggaaaaaaggcggcagccacagtcagggtcttgtagataaaacccccatctccctgggacagagcaactcggggaaggggcggctgtgggcgcagcttcagcagacttaaacgtccctgcctcacggctctgaagagagcagtggatctcccagcacagcatttgagctctgctaagggtcagactgcctcctcaagtgggtccctgacccccatgtctcctgactgggagatacctcccagtaggggccaacagacgcctcatacaggagagctccggctggcatctggcgggtgcccctctgggacgaagcttccagaggaaggaacaggcagcaatctttgctgttctgcagcttccgctggtgatacccaggcaaacagagtctggagtgagcctccagcaaacctgcagcagaggtgcctgttagaaggaaaactaacaaacagaaaggaatagcatcaacattaacaaaaaggatgtccactcacaccccatctgaaagtcaccaacatcaaagaccaaaggtagataactccacaaagatggggagaaaccagtgcaaaaagtctgaaaattgcaaaaaccagaacacctcttctccaaaggatcacaactcctcgccaagggaacaaaactgggcggagaatgagtttgacgaattgacagaagtaggcttcagaaggtgggtaataaactcctctgagctaaaagagcatgttctaacccaatgcaaggaagctaagaaccttgagaaaaggttagaggaattgctgactagaataacaagtttagggaagaacagaaatgacctgatggagctgaaaacacagcacgagaacttcatgaagcatacacaagtatcaataacgaaatcggtaagcagaagaaaggatatcagagattgaagatcaacttaatgaaataaagcaagaagacaagattagaggaaaaagaatgaaaaggaatgaacaaagcctccaagaaatatggaactatgtgcaaagaccaaatctacgtttaattagtgtacgtgaaagtgacgaggaggatggaaccaagttggaaaacactcttcaaagtattatccaggagaacctccccaacctagcaagacaggccaacattcaaattcaggaaatacagagagcagcattaagatactcctcaagaagagcatccccaagacgtaatcatcagattcaccaaggttgaaatgagggaaaaaatgttaagggcagtcagagagaaaagtcgggttacccacaaagggaagcctgtcagactaacatcattctcagcaaactaacacaagaacagaaaactaaacacacactacatgttctcactcataagtggtagttgaacaaggagaacacatggacccagggaggggaacatcacacaccagggcctgtcagggggtaggggctccgggagggatagcattaggagaaacacctgatgtagatgacaggatgaggggtgcagcaaactgccatggcacgtgtatgcctgtgtaacagacctgcatgctctgcacatgtaccccagaacttatagtaataaaaaaaagaacgtggaataataaaaacagcctcataaatttaacgccaagtcagatgggtttctcaaaccaaaggctaccaaacttataaaagtcgctctaaaaatagacaaagaatgctaatgctaacttattctgggagaccatcataacttcagtaccaaaaccagacaaaaactatatataagaaaaggccgggcgcagtggctcatgcctgtattcccagcactttgggaggccgaggcgggtgaatcacctgaggtcgggagttcgagaccagccttaccaacatggaaaaaccctctctctactaaaaatacaaaattagctggatgtggtggcacatgcctgtaatcccagctactcaggaagttgaggcaggagaatcgcttgaacccaggaggcagaggtttcagtgagctgagatgaaaccattgcaatccagtctgggcaacaagaacgacacaccatctcaaaaaaaaaaagaaaaatgacaggccaagctcactaaacgaagtcacacgcaaaatcccccacaaaatattagcaaatttaatctggccctgttttaaaaaaaatctcatgatcacgttgggtttttcctacaaattgtaaaggagaaattgatttaatagcattcttgattaaaaagtaaaaacaaattatgaataaagggagctttctcgattgataaaggacattaaacctttagcaacataagccaggcatggtggctcacacctacaatcttaacactttgggagctgaaatgagaggatcacttgagcccaggagttcaagactagcctgggaaaacaagaccctgtctgtacaaaaaattaaaaaagctgggtgtggtactatttgcctatagcctcagctacttggatggctgagacaggaggaccacttgagcccggaagttcgaggatgcagtgagccatgataacaccactgtactccagcctgggtaacagagtgagactctgtctcaaaaacaccaccaccaccaccaccaccaccaaaaaaccctttagcagcatgagttataatggtgtaacattagaaacattgatttgatttgattttttatagagatgggtttcaccatgtttcccaggctggtcttgaactcctgggttccagtgatccacttgcctcagcctcccagtgtgctgggactacaggcatgagccaccatgactggccagaaacattgattttaaaccaggaataatacaaggatgccttctgtcaacacttttattcaacattatactaaggtctactcagtacagtaagacaaagaaataaaaaagccataggcattggaaaggaacggggaggggaaatagctgtcacccaggcgggatgcctcccacctataatcccagtgctttgagaggccaagcagatcgcttgagctcagaagttttgagaccagcctgggcaacatggtgaaactccacttctacaaaaaatacaaaattaggcgcatgcctgtaatcccagctatttgggaggctgaagcaggataatcgcttaaatccgggaaggtggaggttacagtgagacgagatcgcgccattgtactccagcctgggcaacaagagcaaaactccgtctcaacaacaacgtaataaaataaaataaaataaaccaggcaggatggcacatacctgtagtcccagctactcaggaagctaaggtaggaggaccatttgagcccaggaggcagagattgtagtgagctaaaatcgtgccactgcacttcagcctggacgacagagcaagactgttgtcaaaaaaaaaaaaaaaaaaaaaaactgtcgtcatcagattcatattaaaaacctaaaatctacaaataaattattagaagtattaaaaatgtagcaaggtgactggatataagatcagtgacaaaagccaattttcttttttaaacctatatacatttctacataaataataaatgtattttttaaaagatacagttttcaggccgggcgcggtggctcacacctataatcccagcaccttgggaggccgaggcgggtggctcatttgaggtcaggattttgagaccagcctggccaacatggtgaaaccccgtctctactaaaaatacaaaaattagctaggcgtggtggcacatgtctgtaatcccagctactcgggaggctgaggcaggagaatcgcttcaaccgggaaggcggaggttgcagtgagctgagatcgtgccatcgcactccagcctgggggacaagagtgagactttctttcaaaaataaaaaataaaaacatacagttttcaatagcaacacattaaaagatttaaaagattgcttagaatattgttcataaaagatgggccaggcacggtggctcacgcctgtaatcctgggagactgtggagggtggatcacttgaggtcaggagttcgaggccagcctggccaacatggtgaaaccccgtctctactaaaaatacaaaaattagccagttgtggtggcatacgcctgtggtcccagctactcaggaggctgaggcaggagaattgcttgaacccaggaggtggaggttgcagtgagctgagatagtgccactgcactccagcctgggcaacagcacaaaactctgtctcaaaaaaaaaaaaaaaaaaaaaggcctgtatggagaaaattttaaagatttcttgattgcttgaaagttactaaaatgtatatatgccatttttattagaaaacagttttagggtccaggcacggtggttcacgcctgtaatcctagcagtttgggaggctgaggcaggcagatcatttgaggtcagaagttcgagaccagcctggctaacatggtgaaaccccatctctactacaaaatacaaaaattagccaggcagaattttttttgcatgagcaaaaaaatagcttttttttttttgcgcttgagcaaaacatagctcatgcaatttcagctactcaggaggccaaggcacagaaatcacatgaacctgggaggtggaggttgcagtgagccgagatggcgccactgcactccagcctggggacagagcaagactccgtctcaaaaaaaaaagaaaagaaaatcaagcatatcaggtccagaggcaagacccacacttgtcaggaatgaacatgggttttgaaccagtttgctttgttagagaccacaatctgagctgcagctcagcctttccagtggttctggtctaggcatgctctctgttcttacagcagtcctgtgagtttggtggtattatctcagttcataaagacctcatctgttctgcttccacaatctttccacattgcttcctcagtggtgggatgggtcatggggcatagcaggtgggggcttcatgggggactcagacacctgaataagaagactggctctgccactcactgctgtgtgtctctgagcaaaccctggagcctctcccagcctctctcatctgtaacatgtctccccttacaggttattgtgtatggaggaaataaatccattcatgtaaataagttaacatgtcttatgattgctagtggctttcactattaccattgctgatagacctgggatgctgcaccaggatggacagcccagaggctgtgctgtttctctgctgtcagctctcagagttagcagaagtgttagtttgagttgagggctttggaaaagttcttcatttattgcatatgttttacaaactttttttctgtggccaggccatctgcctaacatcatctatatagtttgaggaactggtttcaggtgaaaatcctttaactctaccatcaagtagttctgtttttcacttgtaaaaaaagcacaaaaccattgtgaattactcccaaatgacctgcactgaagtctgtgtgattgattgcagtggtgataaaggctgaacacatgcgtcctcagtgttcccgtgcctgtaggtcctgtcggggaagactctagcaatacctcacgggggtgggtgtgggccagggcactgggagcaggaggcttccagatgtaggggcctgtgggagtctggaaggatccataagcagtgcctttgactcacatgctgggatagctcacatgctgagaatggctttatctgtacatggttggaagcagtgtatgtccaagaagaatggtgtaagggagaagagtcacattagaattgcatttcctcttaccagatccccgatccctccttcctttgagctacttagtcttaaaattcctcctttgctattttacaatgacagcttacctatttatctttatgccttcagagtaccatggcttctaaatgtggatcgttcatattacttcccaaagaaaattggggattttatcaattaaaagaccccattatacaatgacttgtgttaaaagtgtacataaagctttggttaagacaccacaaatttcataaacaacattgtgggttttttatacttcagacaaatgtatgttaacaaggctattgtgtgttccagatggcaggcagcagattctgagtttgggcatggacctgcagttggaatggatgaagttggaagatttccaaaagcaccttgatgggaaagatgagaattttgctgcaacagatgcaattccaagtagtgagtagttttggaaatattgaaatccctttcacaaatctagatttataaaatctaacttattttttctttcattttagatgtgttaagggatgctgtgaaaaatggggattatattactgtaaaagttgcacttaattcaaatgaagaatataacctggaccaagaggtaatatgtcgttgaaaaatctcatgaaaggaaaatggaaagtaacacttgaaagaattcagtttaacttttcatttattttaattacaaaaggctgggcgtggtggtgcacacctgtaatcccagcactttgggaggccgaggcaggaggattgcttgagcccaggaattcaagaccagcctgggctccatggtgaaaccccaactctacaaaaaatacaaaaattagctggacatggtggtgtacacctttggtcccagttacttgggtggctgaggtgacaggatcacctgagcctgggaggtcaaggctgtggtaagtggagatcacaccactgcaccccagcctgggcaacagagcaagactcccatctcaaaaaaaaaaaaaataatgcacgttcactttgtaaaataaaaaaattgtagaaccctataaatgtacaattatagtccctttaattccaaccccctcccctctaaaagtgatggtttggtttggttatggtctacctgttttgtatgtggtttaccctctgccactcttgagagcgtagagtgagaccattttcctgtggtcatttgtgtttctttgatggttgtcccatttacaacaatggtccatctctcctgttgtagctggggatttttcatactgatatgtatggattttttttttttttttttttttttgagacagtgtctcgctctgttgcccaggctggagtgcagtggtgtgatctcagctcactgcaagctccgcctcccgggttcacgccattctcctgcctcagcctcccgagtagctggactacagttgcctgccacctcgcccggctaattttttgtatttttttttttttagtagagacggggtttcaccatgttagccaggatggtctcgatctcctgaccttgtgatctgcctgcctccgcctcccaaagtgctgggattacaggcgtgagccaccgcgcctggccacgtatggatttttttaatggaagcatattgaccctttctccctagattttaggtttgtgtttgagtcttgtattgcttgaagatttttagttttaggcaatcatatctgttgatcttttacatttatggcttttgggtatcttgtcttgcttagaaaatatttttatattctttagttttttagcttagctgtggattttttaggtttaatcctttgggattacaattcacaaaattattgggcttttgattaaaattgcatgaaataatatagattgagaattgacatttactttttgcatcttctgtctaggaacatggtaattctacattcactcagctcttcatttatatccttaagcaaagttctatgggttttttcattcatatagacgttgcacatttcctatagatgtatgcctatatgttttataatggtcattagagtcttttttcatttacattttgttttctaactggttattgcttgtcgatggtaaagctgtggatgtctttgtacacataagtgtgtgtaactccagtcatttaatgaaattcttatagtttttaagttacttgttttggattttctaggtagaaaatttgatcgtatgccccccaaaaattcactgttcattttgtatggtgcaaacttttcatgtgcctttaggatttaatacacaaaacaaaaagaagatacaaaaatgagagctgggcgtggtggcatgcacctgtaatcccatctacttgaggctgtggcaggaggaatgcttgagcccaggagtttgagaccagcctgggctgacatagcaacaccgtctcaataaaaaagaaagaaagaaaaacaacaccaacaaaaaaaattgaagcattccttggagatattgtgggtttggttccagactgttggaataaagcgagtcacacaaatttgttggtttcctggtgcatataaaatttaggtttacactatactgtagtctaaatgtgaatagcattacatcttttaaaaaacctatatatcttaatttacaacactttattgctaaaaaatgctgacacaacaacacaaaatgagcacatgctgtggggtaatgatgtgaataaacgtgcttgtggcagggttaccacaaaccttccctttgtaaaaaacacagtccctgtgaagtgcagtaaagcaaagctcagtgaaacaaggtaggcctatagaggaaagttgtaaaattttatgcaaacattcatatgtgaaaagatactctaaaagctagtagcttctgatggttgggatattttagtgaaaatcctaagtagatgcctaaatcagtgcctattagtgatttcacattgaaacatctcgagtgagaagacttggttctgaaattgttctgactaaagattaacacgttttttatttaacaaaccaacacaggattccagtggaatgacactggtgatgcttgccgccgccggagggcaggacgacctcctgcgactcctcatcacaaaaggcgcgaaagtgaacggtcggcagaagaacgggaccaccgccctcattcatgctgcagagaaggtttgtggcttcttatgcatcagtttcagagctttcatggtattcctgccgatggactgagaggatctctttggtagtgaaatatagcagtcacatggtcacatcgctttttttttttttttagacggagtctcgctctgtcgccgaggctggagtgcagtggcacgatctcagctcactgcaagctccacctcccgggttcactcctgcctcagcctcctgagtagctgggactacaggcaggtacctgccaccacacccggctaatttctttgtatttttagtagagatggggtttcaccatgttagccaggatggtctcgatctcctgacctcgtgatctgcctgccttggcctcccaaagtgctggtattacaggcgtgagccaccgcgcctggctgtcacacggtcccatagctttttaaaaatttatttttagaaataaggtctcactctgtcacacaggttggagtgcaggtggcaccatcataactcactgtagcttcaaactcctggactcaagcaatcctctcgcctcagcctcccaagtagctgggactaagtgtgtaccaccacacctggctaattttaaaaatttttgtaaagacatggtctcactgtgttgcccagcctgggctcaagtgatcctcctgcctcagttaaagtgctgggattacaggcatgagccaccgcacccagctggagtaactttttaattttgtttcagttgatctgtgacatgtaatgaatggatttatcatcagtagtacattgtaatcacatttcaaaatgtgatttatctcgttggaagtaatttatattaaaatactctgattaaagtactaatattttaatcttagataatttaatttttttgaataaatggtatttgtattccttttggttaataatttaattgaaatgtttccatatattatctttttaaaggatttatatgcagaggttcttaggttggagctagcggttccattcgcagttgctggcagcacagtgagtggccacgtttgggcctctgtggggcggggtgcacccccgtggccccacgggaatgctgcagcccgcaaccacttgtgatagaacctgctgggtatttttcctgatgactaaaaatttcaaaatatctgaaaactgtcttttaaataatttgggaaattaaatttgcctttttttcttttcatagaactttttaacaacagtggctattcttttggaagcaggagcttttgtaaatgtccagcaaagcaatggtgagactgcactgatgaaggtaaatccctcctgcaggtcatccctttcttcactacgttggcaggtgctcgtgttggcatctgccactgccaggcactgtgctggggactgagaacagagtgggtaccaagacagtcctagagtcagccgcttgcaggggagaaggagaagcgggctggcagggtagcagtgagagctcagtatgggcagtggtgtgatcagaacaggcacagagagccatgaggtcacagggaagtgctccgagctgggccctggggaccctgacaatccttagggtggatgaggcaggtgccacactgtgtcctaaatggcagtcaagtcagccgggagggagcactccggccgcagctggagcagcagggaggctgctggcctcgaaagtgcaggcctaggggtgggacggagttcctcgtgcactctgtgtgttcgtcattttatgttggtgaatttgttgcctcgggcttgttcctgtgttctggaacgtggtttgcagacaggttttgagagaaaggtcagcagtttggcatttgtcttagggggccctgccaggtctggttggttcctctgtggcagttgtgggttcctggcccaggatgctgttaggatatagcaggtccagacacccagccagtggtggccggctcagctccctgtggggacctgtcctctttccttcctgggatgcttggctccatgtaagccattgagccaagcgggggcctgcccacagcgcccattccagccgctgtccccagtaagcaaaagagcacagccaggccctgggtctgcagggcacctggcatcaagtctcactgtgaaccctcttctgatggcctggaccacctgtcccttgtcctcctgctgcatgaggcccataaacagtctccttctgtcgcccgggctggagtgcagtggcaccatcatgactcactgatgccttggcttccagagctcaagtgcctccctcagcctcccgagtagctgggactacaggtgcgagccaccacacccagccattttttttcttattagagacaaggtctcactgtgttgcccaggcttgtcttgaactcctggcctcaagcactttccttttggttcatggaaatgttcattttgtttgggagcctgaggtttgtctttgtttcccttcatttgtttctgtggttgtcttgtgtggagcagaggtggcctctgcaagcatcatcttagtgacagatgaccaggtgtaccctgaactgcagccacgcaggtgcatttagagcatgagagaggtgggtgggcacagaagcccccttcatgccaagccttagggagttcgtcctgagggcactggggagccacagcaaggttgaagctgaagaagggtagaatcggattagagggttttcatttgtgtattttaatgctgcttagtacagaaggggcatagattgagaagaagatagtttgcaaacttgtcaggagggtctccagattatgtgaaataacagaagtctgtacctcgggagtggcaggagggatggagtgggtgaggtgcccacttggtaagagcttggtaactggaggtgacgcctgggcatcccatttcctaagttggggcacggctggcagagctgggggagttgggcgttgggtcgtgtagatgtcacctctgtacatttcacaggggcatctaggctcaggagagaggtgtgggctggagattcaggtttgttgctgtccagctctgcaacagtgaccgtagccataggttgagagtggggtcatccatggggaattggaaaggagaaaagggccatagatggaaagagcctgcgtggggagaagcagaggaggaggaggaagtggtccacgggctggcagcacctcccccacacagcaggcagaaggcaggcgggagtgccccaggtcagcacctcagggctgtgtgccttgctgaggtacgtgtgttgagttggggagtggggtgcagaggggagatggctctggaagtgggttggggagggcgtggcgtttcttccctgagcggacatgtagcacttatttattttactgggtctgaattcagtagactgcctttatctgccatgaggtttatttaagtgtttgttcctgaaaagctgtattttaattgctttcaggatttagcatgttgaagtttgagttttagaatgagaagatgtaaacatagtgattttcagaaattaaaaacctttttatctgaggagaaagtgtgtaacattggtccttaccagagtgggcaggtgcagagggactgccctcgcctgtcactgcaggctctgttggtcccagaagggcctctcaccctccccgtggctgtaatgtgggccactcgctctgtcccgagcctgtcctggacggcgtccctaacctctgcactggatgcccagggtaacaaccagaaaggtctcaggcattgcccaggctcccctgatggcagagttccccctgccagaagcactggatgacaccgttgtcggggtagtgtggcggctcctcctagggctgcgggagtgccaccgctcctggaggctgctctgcaaagtgacgctgctgccccagcatctgcctcacagggtagggaggcacaggcacccttatcctcttttcgcaaatggaaacgtgccactcagaagaattaagggacttatctgaagtcacgtggctaataagtgacagagacaaggagacagtctgtcagctgtgccacagctccatcgtacatttgcaggttcagattcggatctgtgcttgggttgtctcctttaaagcggcagctggggacatttcgagggtgttttgtggtcctgagaggtgtttttgagattcctgagacaaagttgtctacagtgaaggccaggcttacgtatctctgcgcctcgctgaggggctggctcacgggggacagcgtggcatggacagagggcagcagcaggggactgcttagcaaggcctggtgtctgttctgtcttgggactgaagcatcctttttgaagttgcccatttcctgaaaactcagtgctaagatattaactgaatgtagcacacagatttttatgttggcccctgagtcaaagatactccccacttgcatttaagcaatgctgtgtgactcctaacgctgtggcctgacgggccccaaaagttctctatccttcttccatggcctgtgccctctcttcacagaaccgctaagcatgtatggagaagggaccagcacccatgccacagtttacagctaagtaattgttactcctttttacctgacgtaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacgtaagtgagaagcgactgtgccatagttaagtcacatatcatacatctgtttatgtagacatattataattggagtggcctgtgtgtaactgctcagaaaaacatccagcacaagtcctgatggttttgtttccagtagatcacagatttaataaatggcatatgaattatttttctgcaagttatttaactctcagaaaatttcaaacttaacactggcctatctgggagtattttccttaaatattaagtatgctcttaatttggttagcaaaggttttcttaaaaacatttaaacttggccgggcgcagtggctcacgcttgtaatcctagtactttgggaggccgaggcgggtggatcacttaaggtcaggagtttgagaccatcctggccaacatgatgaaaccctggctctactaaaaatacaaaaattagccgggcgtggtggtgggtacctgtaaccccagctactcaggatgctgaggcaggagaatcgcttgaacccgggaggcggaggttgcagtgacctgagatcacaccactgcactccagcctgggcgacagagcaacactctgtttccgccccccaccaccaaaaaaagaaagaaactttaaacatttgtctttctttttaatagactttattttttgcaacacttttaagcacagcaaagttgagcggagggtacagatttccaagcctccccaccgccatcctccccgactgtcgagatcccagtcacccacagtgggacatacagctggggaacctacagggacatggcataatcccctggagcgcagcattgacattagggctcactcgtagtgttacccattctatgaatttggacaaatacataatgacatccatccctcatcacagtgtcatacagaatagtttcactgccttaaaaagcctgtgttttccaccttttcatccctccctcccccagcccctgacaaccaccagtaatttaattccttcatattttgccctttccagaacaggtggaatcacacattatttggtctttgcaggttggcctctttcatttagcaataggcattcaagattccttccatgtcttgatagtgcatttctgtttagcactgactaatattctgttgttggttgtcaagatttactagtttattcaagttcattctttttcaaataaattctcaatcatattttattttattgcaggttcatacttataacacaatttagtatttctatcacttaagaactcttggcaacacatatcagaaacttgcatgtatcagacagtagcgaactcaaggcggtgtttatgtagcaggtctcgggtgggcctctgggaccgcgcctgttgaactcagtgctgctgatggctgcagtcccaactcctctggtcacacggggggtttgcatagatccagcaagtagagtgacccactttcctgatttgcccagtactgaggggttcccctttctgattttccactgattcattagacaactatgtattaagcatagactttgtgccaggcactgttctaaaggctggggagatggaaatggcagtggagggaagagacttgccttcttagaacttcaattccactgagatggacaacaagacagacacatgggtgtcaggtgcttggtggaagtagagctggaaagcggaggcaggcagagctgcaggtctttgtttggaaggttggcctgggaagccctcactggtattcgacaggcttgtggttcttttctacattaacgttaacacgtactatttttttttcttagactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggtaagccgatgcctcccttcacacttttctatgtgaagtgtgacactatattaacagatttttagacagaatcctttcttggaacaaaactttaaggaaattccattacgtgtaataattctgcagaccggttaacagtagagccactctggtggaagagacatccagctgacaccccatccctgttttaacacccatatagagcatggaagttaggtcttaataatcacactagttctcaatgagttttattaaaattcagcgtcaagattctaagcctagaatgttttttccctgaattttgttgtttgtaatagtctttgccctttgaaaaagaaaaaaatagtcttgctccatagtaaagctgagtggaaagagatggagaagccactttcctctctagcctctgctcgacagaccctctccaggcagggctgcggctggccctctctacacgtggcgccaggtagacgtggaggcagtgcagtctgccgaggggaggaagccgggctctggctttttttgcttagaaactcctgttccccattttgtaaatggtttgtattcattcctggaaaatgtatttaagaacatatagccctgcccctgaaagagccgtttgtaatatcttagtgttgagagaacttatcaggtggttgctgttgttttgagatggagtctccctgtgtcacccaggctgcagtgcatggcatgatcttggctcactgcaacctctgccttctggcttcaagtgatccgcctgcctcagcctcccaaagtgctgggattacaggcgtgagccaccgtgcgcgttcagtaatttatagttttgattattcgggtggaccatctgcattgccaggtatgagtaccagagaacgatgccctgagctggccctggtgaacctgagcccccactgacacctacaactgctgggcctgcagttttctcagcatgtgtacaatgtctgcatccaccaacttttttttttttttttcaggagtctcacactgttccccaggctggagtgcagtggtgcgatctcggctcactgcaacctccgcctcctgggttcaagcaattctcctgcctcaacctcccgagtagctggaattacaggtgcccaccatgatacccagctaaattttgtgttcttagtagagatgggggtttcaccatattggccaggctgatcttgaactcctggcctcaagtgatctgcctgcctctgcctcccaaagtgctgggattacagacatgagccaccatgcctggccaatttttggttatgtattaatcagaaaaattggaaggggcaaaagggtatgtggaagaaaatggaaaaccactcagacccacacccaaagatgcccaccacaggaatgtccctgggacgtgtgcacattcagcagcagtgtttaaataccagttaaataacttcagtgtagaaaatcatacgtaagtcttttccaggaactgtcagcagagattacttgggcaaaaggtaaaaagagttctgtggttgaaaaatgccaggtgacacgagctttgagagggccagcctcctctgagcctccaggcagagtgggtgatgcctgtctgaccaggcccagctcaggggcctgcttccatctggtgttgagtgttcctctggggactgaaggttgcctttgaagtaattcacacacatctcccattttcaggctctggcatcctgctgtttatcttccatgcaaactttttgggtaaagaagttattgctcggctctgtggaccgtgtagtgtacaagctgtagttctgaatgataaatttcagcttcctgtttttctggtaagatactctgtatttcactactgaaaagtacattcttctaatcaaaagcacagatgacttaattttaaattcctgtgtcttaataaaatataagcattcagaaaacgatccagtaatagtggttgggaatgaggcaatacccataaagtaaaattatcctaagttttgtcagtaggaatttttcctgcttattttttgccttaaattgtgctcaccatactgtcttagggccagcattgttctgaatataaatacttaatgatctcaaagattctttgtacataattactttgccactgttagaattatttccttggactgaattaagcaaaatttgctagatatagacattttaacacttgtactgtatattgctgggggcattctaatccagtttcccagattgattctgtcatttgtatatttttaataaatcaagggaaaaataaatcactttttttttttttttgaagacagggtctcgctctgttgtccaggctggagtgcagtggcgcggattacagctcactggagtcttgacttcccaggcacaagcaatcctcccacctcagcctcctaactacctgggactaaaaatgcacgccaccacatccggctaattttttgtattttttgtagagatggggtttcaccatgttggccaggctggtctcaaacttctgggctcaagcgattgtccgccttggcctcctccacaacatcttgacttatgaaataaaaaataaaacttatttatgattcttttacatcattggtgttttaagggcttctggtgtaagtttgaaaacactgactttttttttctctttccattgtaggacagtcattttgtttactcattcagccctgttgcaggtcccaataaactcttcataaggttgacagaagcaccctctgccaaggtgacagtcctttcttcacatttagtgtcactactcaagttgttgctccagattactttatcaacattagaaaaaaaattccaagaatcctggtgtacctgtcctagagacaggcactccctggggtagtgatgctaggtgcaccctctctcagtttacaatgtgttagacataataatgcggcaggaaaagaactaggttgcagctgagaaagatgcctctctagaggatggagccatctgaatcatgatctaggccttggtatggagttgccaaatgtatgtctttaggccggtccctaacctctcttgtatgaaaggaagctggacaaaatagtctctctaataaaacagtaatataaaattataagcacttggaattatttcttgaattaaaatggcaatgatctaacaatgtaaattgataagcaacttgaaaatattgccaaataatagaagcaaatcttggccatttgtgggttttttcttgtaagaaaggggaaatctggatctgtactgacacctgcgttcttttctttcaacaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaaggaaaaattcagctctaaaacatttgcttacagcaagggagccatgttatattcaagttacccaagcaccaaataaagtgtgggtttgctgcccttgaaagggttgggaggcctgatctttttctagtagacagttgccacacattccccaagcacaaaaggtggagatggcagtcactttgtaaatatgctgtagtcacttatcatcttttcaaagggtaacaagagaatctaagatgtagtaagaatgtaaaccagtacactatgagacctaaaagagagtattaaatgtgaacttttagcagagcgtggtggctcacacctataatcccagcgctttggaggctgaggttggaggattgcttaagtccaggagttcaagaccagcctgggtaacatggggtggaacaagcctgtagtcccagatactcaggaggctgaggtgaaaggattgcttgagccagggaggtcaaggctgcagtgagccgtgaaaggccactgcactccagcctgagtgacagaatgagaccttgtctcaaaaaaaaaaaaaagtttcttggaacctatacggtttttttttgttttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgttggtctgtttccttttata

SEQ ID NO: 604 - DNA, 108268 bp, Homo sapiens
taaagaagttcgaaatgtttaatatttcatgcagttaacatgcttcaaagctttaagtctgaagttttagacttatcccaaatccttgctaagaagtcaagaccactatggaattcacactgctttctatagacttccactgacttgcagctaatggtccttacacagcaaagttgggatttctagacgtctccttccaggttcggaaaagcctcactaggcaagtggcaagactgtgaagacaatgaaggttcagaattcagtcaaatggaaacaagatcaggaaacaagatcaaggactcatctgtccgcctggcaccactttagttttgaaggtgacgccaccacgcatccccgcagcacacactccttcctgtgccgactcccgctatttgcttgcctgagccagttcatgtttcagtaagaacgatttttctcccaacagtgccagttttcttattcccaattttgagagttgacccaaaattgtgggctatgagggatggtttttaaaactcctctaatggttcccaggcacagagcgttgaaaaggagggatttcttggctattctgaatttgtgcattgctgccatactacttcccaacacgaaccagcaagaccaccacaccaaggagtgggtaacatcttgatttaatttacaaataaaaagccaaaaccctcaatgcaaaggaaaactgcagtttacacttattctggagatcatttttaaccacagaaaatgtgcccctgtagcatgtttttaaatggcaagtgctatgattgcccagacatccataaactgcttgtatggagtaagaaattcataaatgaagaaagatttgttttctgtcttgtttctcctaggtcacgaacaggatatttcccacaaaatgttttgacctggaaaagagacagagtcttcactagtaaacaggatctaatctccatagtatatttttctaaagaaacaagagctttcagtcctaaagtaatttgctagactagaatcactgaccagcagacctaaattcaagcttcaatattaagattgttgatggaggaaactgtcatggaaatggcaatttcttaactctttataataaaagcagattcaatgtcacaagaattaaatatttggccttttaataattttactttctttacatgtttctggagtgaacctcggttacttttcactgactttgttagaaagcaaaatctataaaaggagttactttaactgaagtaacagtattcacatattttaaccaaaattttaaaatcctaaagttccaatgacaaatctacctgataagcttatagaatctctctccccttctctctttgaaggccacagaatgccacaggcttgatctatgccacagacagcttatgtacacaattttttttcctttcccatatatttccttacccatatatgagattcgttctttggattttcagatacctacataatacagcaatttaaaagtttaacttcaataaaatctccatagactagaaaattattctctagtttccatcctcaaaatttctgttgcataggctgagggtgtggcttgagaatgtgcattctgaagctcccagatggcgatgctgctggtctaggcctgagaaccaaagcctgagatttaactttctagagctgggtacagtatgcaaaacagctgtcacatttttgtgctgcatgaggtgtcagatactttgaaaaggtataatttctcaaaactacagaatacatcagtgcatctcaaaccaagtgcacacaaatcctagaaagaaacgtcttcattagtacacaggacctaatcttcacagttaaaacggactttttgacttgcaggactctgtgtcctgtgtgggagacacttcatttccaagaagctctcaggcaacactgtcactcctagtccccagaaccacttgtagcagcaagaataagacacaataatgtttagtatcaccagacaaaagctagaaaagacatacacttaatactttctggatctattaggatgacaatgtacccatgggaattttgtcataaagactgcattaatgtttcaataatattttaagagtgacataacaaaagaaccgaaaaattgtgacccctctccgaaaaagtaaaaagcagaggaggaggaatggatccatttttaagattacatattttctggccgggcacagtggctcacgcctctaatcccagcactttgggaggccgaggcgggtggatcacaaagtcaggagatcgagaccatcctggctaacacagtgaaaccccgtctctactaaaaatacaaaaattagccgggcatggtggcaggcgcctgtggtcccagctactcgggaggctgaggcaggagaatggcatgaacccgggaggcagagcttgcagtgagccaagatcgtgccactgcactccagcctgggcgacagagcaagactccgtctcaaaaaaaaaaaaaaaaaagagattacatattttccaaaggaacacaagtttaaaattctaggtttggaggtcattaaaaatcaacaggaaatttttttacaaagaccttttttttctctctcctcactccaagacctctatgtcatttcccctcttagtcatttcccctcttagtccagttttacctgaagacaaattaatatacgcattacaccagtgaggaaagaggagggcaaggcgaagctgagagtcccctctagccttgctgagatatgatgccagggtttcctacgaagacaggccaagctatagaggcttcagcttcacctataaactgttcataaatattctactgactcaaaacactgggaccattacatatcttcattacagtccacagaatcagaatcaggaagaattgactagaaaaaactaggaagaaacgaatactcaaggatctgttagaaaataatgagcagatacggactgacctgaaaggaagtatgattccagtacttctggtcttaactcttctgaattacactgcaagctgaacttcgggtaacttcagccacattttcttttatcaccctagaaatacaatgaaatcagattcagcctttttaagaactgatttcaataaacaatgagaaaaatcagagttaactcatttagtaaattcataacagtaattgaggtttcgataccatgtagtgctgcgtgctgattatttccattcagtaaggattttctttttaattcaaaatactctccatttcctcaaagaacatcaactgaattaaaatcagcttcattttatcttctacagtaaacagtattaagtcctaaataccaaataattttcagatctgctaataatttattaagaatttaattggctaagtccctccttatttccacaggccctcttgtacagattgttgatacctcagcacaacacagcttgaaaccttgtattgcaaaatcccacaaaggatcctcactcccactgtgtctgcaaaaccgtattccacttgtaccaaggcagggaataccaatgtgtgtgtcgtgctccatcagaaaaagactcttaccctagtaagaccttgatcaatgttcttcaaagagcacatacccaaaacatttcaatagaggacaggtttatgtgtacagttatccttatatatgttttataatatgcctgaaatattcatacagtcatacacaattgcattttgggacacataaacatacagctgtgtgctcaattttcaactgttgggggtccatgatccaaaaatattggaaatcattaccctagatcagtgttgttaaaacccatttgggactcaatttgcctgagaattggatgaagcccaaaactgtccccccagaaagtatatgtgaaatatgtatgcagaaactgtagacaagactgcctgcaagtaaaggggatccacagataccctaatgcaccccagtaacccaagaggacccatggggtccctataatcaaatctttggagtttttgtttttgttttgagagagggtctcactttgtcacccaggctagagtgcagtggcgtgaatacagatcactgcagcctcatcttcccaggctcaagcaatcctcctgtctcagtctcccaggtagctgagactacaggtgcgcaccaccacacccagctagttgtattttttgtagagatgtgattttgccatgttgtccaagctcgtatggaactcctgagcgcaggcaatcctccagccttggcttcccaaagtgctaggaatacaggtgtgagccaacatgcctgtcctgtaagtattttttaaaacaaggcatggcataaatgaacaaaaaattattttttatatatttccaccagcaattggcattctatctactcttgtatgcaagctctgaatttatagactctgtatccttatattcaccatggattgaaaatgcagttagaagccaggtgcagtggctcacgcctgtaatcccagcactttgagaggctgaggtgggcagatcactttagtccaggagtttgagaagagcctagacaacatggcaaagtcccgtctctacaaaaaaatacaaaaattagccacacgtggtggtacatgcctgtagtcccaactaattggcaggctgaagcagaaggatcgtttgagcccacgatgtggaggttgaagtgagctgagatcacaccactgtgctccagcctgggctacagagcaagaccctttctcaaaaaaaaaggaagaaaagaaaatgtagttaggccccgagtggttgtgtctatactgaacatgtatagacttttttccttgtcattattccctaaacaatatagctccatagcatttacactgtatgaggtattataagcaacatataatttaaagtatacaggaggatgtacatgggatatgtgaaatactacagcattttatatcaggaacttcaggatctgcagattttgatattcatgggggcagaagcaacctcccaggaaatggaggaacaactgtttatgcctttggtacagtaaaggctgacaataaaaataaacagaaccataaaccaaactggacaacagtgtcacttaatccttctcaataacatcaggattactaaaaactttaagcattctcagcttctcaaatatgtgaatactcaatttataaaccattactaaaacctagaaaagtaatttccagaatttagccaagttttagttgtcaatatttaatttcaatttttaaatttttatgtatttatttattgaggtggagtctcactctgtcacccaggctacaatacagtggggtgttctcgactcactgcaaccttcacctcccaggttcaaatgatcctcctgcctcagctgcccaagtagccgggactacaggcgcacactaccgcgcccagctaatttttgtatttttagtagagatagggtttcaccatgttggccaggctgctctcgaactcctgaccccaggtgatccaccagcctcagcctcccaaagtgctgggattataggtgtgagccaccatgcccggcccaatatttaatttttaaaagggtcattttttcttattacttctattcaatatttgaaaaattactagagttctgtttaaactggtcttacaaaaaaagtgacaaggctgattgtacattgcattgtaatcaaccctaataaaaccatcacaatgagctactacacatctattcaatgatactcataatttggatttcaaaatatgcgaagtcctagaaagctaagacaaagacagcacttaatacttcctcattctgaagaacagcatctccatcaaagtgatactgcctaatatgaaaaaaaaaccaataatcaaattaaaagaaaaggtctcccttaagtgaaatcctaaaagtataactgtaacaactatatgacaccatcttgaacacaggtggtctgtctttaatttcagaataaaattgggtcactaagaactacccacacattaacgggggattttatcctcatgccaaaacatttaaacaaaagcgagtgaaaaaggcccctctaaccaccccctaagattgaatggagacatttttcacatagtcagaaatgtaaacagtcaataccacacatacttttctatgacttaaagaataaaacattaaaatacaaggccgggcacggtggctcatgcctgtaatcccagcactttgggaagctgacacaggaggactgcttgaggtcaagagtttgagaccagcgtgggcaacatagcaagatgactctacaaaaaatgtaaaaattagctgagtgcggtggcacacacaggtcgtcctggctacttgggaggctgagatgggagaatcacttgagcccaggagctcaaggctgcagtgagctatgatcaagccactgcactccagcctgggtgacagagtgacactctatctctaaaaaagaataaaataaaatgtaaagatatttttaaatacagaagccccattcttttgagaatggtaaactatgtgataatggatgtaacattctcccagcctttgagtaaaagaagatactcttttccctgaagacacaagatctactattattcatgtattacatgttatatattatgtaatatataaattatatataatagaagtaagtcctaaggaatgaatgtataaaatacacataatatatgatctaatgagcatggaagctgagctgttcaaattacaacatacgaattgtaaaacttgaagaaacaggattttaacaatggcatatgttgaaagatgcctaaaaggcaaggatttcctgtgaggcagacacctgttgtgctgagccacagggaccagcattcttttaaccagatgttcactgttcaacagcagggtttcctttcggagaaaggtatgctctgaagtctgcagattttggtggggtagggatttccatgttatctaacataaccaccagagaaatcttataccgaggagtgtttacaactgaatatgatcctttgccttcatgacaaaggcacagaccacaacactggctgctacagcaataaagaaactaaatgctattacaagcaattcatagctgtcaaaatatacaggattacctttcaccaaagctgctctattctactgttaactgtaagattctctttaagcaacaaagaatgtattttcaacagacagtataaagaaatagtgaagactcagtgaatgatatagcaaaagaataaggcaaaaaattcaaaagccaacattttccaagaaaacttgagaaaatgactatgaaagcaacaaacatgaaagaacttgacaacagatccacaaggtcaaactaattttgatgtaatataacctcaatagatgaacaaattatttaacatattaaaatataatttcagttaattggacaactagatgatgttttaataaaaaagttgtatctttcagctgatattttgtaagaagcaaaaatctgtaatatgaacattcaattctggattcccaatatcatctggcttttcagaattctaataaagctatctatgtttaaactcatttttacattcacagattatacataggtcaatgagttttaacatcaaatggcaatgaaaccacagaagctagttaaatagcaatatgggtgtacggtgatcaaagaaaaagcaggagtactttacaaagcaggtggctgaatggcaaaaaaaaaaaaaaaaaaaagcagtatataaagggtactcaacatcagaagttatcggaaaatgttcacaacgtcaggctcactaaaaaaagttatgaggaaaagcaaattaaaaccacaatgagatatattcactaaaatggctaaaattaacatgactgacagtatggagtgttgtcaaggatgcggaggaacggaaatcttatacattgttcatgggaaaagaaaacaggacaggcactttagaaaattacttggcagtttctaagaaacatattaatagaacctgccctagactgacagtatggctcacaggtataatcccagcattctggaaggccgaggtgggagaatcacttgagcccaggagttcaagaccaacctgggtaacatagtgagagaccctgtctctcactaaaaaaaaaaaataaattagccagatgcagtggcacatgcctgtattcccagctactcgggaggctgagactggaggatggtttatgcccagaagctcaaggctgcagtgagctatgatcgcactactatactccagcctgggtgacagagtgagatcctgtctcaaaagaaaaaaagaaaaagaaagaaagaaagaaactgccctatactctaagagtttctaagaaacataagctactctatacttagcaatactgatcctaggaattttccccaagaggaatgaatgcataatgacttgtacaagagtgttcatagtagctttattcacaatagccccaaaaataaaaactgccccaagagcatatcaatagaaaactagacagacaaaatgtgacatattcatttaaagatatgtcattgagcagaatgagaaccacgtactgataaatgcagcaacacagatgaatttcaaaaacattatgtgaagtggaagaagccggagagaaaaaagagtacatattgtaccattccatttctatgaaattcaaaaacagatttatcaacggtgatcaatacacaacagtgacgtcctctgacgcaggatggactgactacaaaggagctcataagaccttacgtttatgaaaacagtcaaactgaacaaaatccaaaacgtttgaataactgacagggtaaccctaaattctaaaacgcaaaattttacattttcttaaagaagggaaaattatttgtaagttcatgtagcaactcaacgttgagaaataaatacctaaaataaaaccatgttcagatataggaatcatttataaatattaaaaataacactgaagtttagataaatattaaagaaatattaaacattccagttagaatcttaactttttcaggaaaaaaatatatatgtatatatgccatcttttcctcttaagattatatggtaatgtttcctgtaagttatcaaagaaatgtgaagttcagcaaagactcatagttgaataaagtacaatatgatgactttatcaaacataattaatgacctcaaaggaaaaattaactccatttcaagtgcccagacctgaaaaataccaaattctagagaaaagcttggaatggatcttagaatatctgtctgctttatctgcaaggcaactgtagtgaggcaagcgctcgttaggaagtgagacatgtcactgaaaattttcaaccttaattttgtccccaaatccctacaaaggcatctcgaaaacaaaatccagaattatcttcttgtgatcacatgaatttctcaaacataatagaaaaaacaaaacaaaaacagtcaagaaaaaaactaccattgatcactgcataatcaaggtaagttttttaaaccatgatggactacggtaacaataaattgcattttttagttcaagaaattattatgaacttacctgaacagcctccactattttctttaaaagttcaatatttcaagtaaattactgccacagccaagaatcccactgttacttatttaatgtatcaatcatgttcatatatcatgaaaagccactggaaacaaattgtcaaataatattcaatagtttattttacaccacacacgtaaaaccatttaaaaaatagcaccttactgttacttattttgaagataacatgtaaatcaaattaggaaaaatatttcttgcagaatccattacatattcatgtgcattaaataataccaaaatgttgtactgggggtaattactcaaatatcactgcagtgttatgtgctgatcatctgtttaaatgcagggggaaaacaggtgctaagccgaatcagtgatgaggtctgatgaccaacctcagtcaggatcctttcttctgctgccccatttggcatgaactcctcactggggaacactacttctgaattagaagtgtatccagtaactgtatttacatgaaaatacattaggatcattacatgttttaatggtttgctttaacatagaatgacaacacatcttctaaaaagagactaaagtctaaaaacagaagacaagtttaaaagatatctgtcacattttgtaaatgtacaaaacttcatttattggttgccacaaagtttgagaaatttagactatatagaccaggttaataggtaacagaaaaacaaagtataaggaaagccgtaacatgtagttgtaaatctaccatctcaaacttttcctgcctccacatcatttgtaaatgcagaagcttcccatcagcaaagctgcatggcactgcgccacatcagagcccagcccaacctttggcccttggtaaggcattaacagcatatccgtaagtgccatgtgaacctcagaattcccggcagtccctttgttagaacacatactatttcccactttcagtcataatcagggctcattaaaagcactcccaataattttgcagtgattatttcaggaaaaactatgtggtataaagaaatcctattttgattcggctaataacttgtttatcttagacaaatggcctgttcactaattcaacaaaagcacaggaagcacctctatgagggtattcacaacttaagaaggtctcccttaacatctcagaaggtctgaagattgtgtattaggtaagaataattcagtctgacagaaagagcactgaaattcaactccagatgttcatatgctagtgcacaatcaccactagtgcagcagcaagagtagagcaagcaggcaatgagcagattctccaatcaagaggagactggaataagagggtgaaataaatatggaattttgaccattctagtttccttttgtgatcatctatttatatacccaaatccctaacaaaaaaaacttacaatgacctcaaggttaaaaatcagacttgagtttctcatttcccaaagtttcctttactacagctgtgggttccacagacaacctccctttacatgtcttcagaggcattgtatccagagcttttgtcattaatatacatagacatgctttatttttggccattactgctatatgcatcttattgtctctcctcttacatatttatctgccaacagtgatctttgcagaccaagccaccatcacctctctcaactctcctgactgatctaagtgctttgattctcgctctcctccactcaattctctattaagtagctaacgtaattcctttctaaaaaataagctacatcctatcatgacctaggcaaagtctctccgctgaattcccattttattcagggaaaaaaaattcccaactactgaccacggcattgctccacatcttgcattctcaacagagcaatctccgtcccaagggggagaaaattacctgggggagggagaggacaaaaatcgtactctttctatgtatgcagcacagatttaacagatagacttacaaccatccacagttatccaggttgtcaacatttcagtagcagggggtcaattaggaaaagaaggtctaaaaggccttctgtggaggaagtgatcacaaaaaaaaattgagaaatgcggatgtattaagaatatatacatctatgaatacagaaacttctggaaggatacaccagaaattagtaacagcggctgcccctggatagagaagttggatggctgttagatgatactgagaaatttactatcactctgcatcactttgtatcttgatttctgtgtaccaggtacacattattgttcataaaattcaaaaatatagtttatgtataaatagtatttgaaggctgttgatttttattaggtattctttctaaagtgcaacagtgtaataaagattatttctagatctcaaggaggatctgaatgatggctataatgaagggcctatttaggtaacttttaagtttgaggaataagagaatggggttagtccacttagggtttccgtatttcctcatgttggccactgaccaagtatgaatatagccatctttaggggtgggcgcggtggctcatgcctgtaatccctgcactttgggaggccaaggtgggcggatcatctgaggtcgggagttcgagaccagcctggctaacatggtgaaaccccatctctactaaaaataaaaataaaaaattagctgggcatagtggtgcatgcctgtaatccagctactcaggaaactgagacaggagaatcacttgaatccgggaggcggaggttgtggtgagctgaaatcgcgccactgcactccagcctgggcaacagagtaagactccatctcaaaaaattaaaattaatattaaaaaataaagccatctttagtatatgttcatttctttgggatgtgcatttctgtaactcatcaatgcaactgcagtgttctatggagcttcaatggtttccacgtattccagtacaagactcaaactcaccaagccctgcaggggacacccaaatcactctgtggatgtacagagggtatctcagccccctaacctatatacatttgacactggcaaacttttgtgtctcatattttcatttgtcaattgttgcttactctactgacaattctctagccaagatcttttccccgagcatcaggatttcctgtgctgaacccactttctagatggcacagggccccaacccttccatctgccctttctcctctttttagcagcaccaaaatacctatcatttggttttttaaaacctgtcacccttgccttctttcttccacataaatcccagtcgtgaccatatcataatcactccacgtcttgatttctgcccttcttctccatcccactatcccacatatcaagtgctctcacttcctgcagttaaggccattcaaatgcatcccactgccaatccctaggtatatagtgactgcaatctgactactgtcattctcttgccaaaaatctcctaacgatttttggagattttttcaatgggtctttatcacagaataagattttagatttgttttccagtcttgttttgggttcctaccagctttctacacagtatcaactgtcagcctttgctcacggtgggcccactctgatcgtatctactccccgaaacagatatagctcatttgaagttgatacctaggtatttctacctccccaaatctctggacacactcactaagatagatactacttccccttttgttctgaatggtcgtctaatgctcccacctccaaacaagagcattctatgaaaatccttcccaactattgtatcttatatgcatttctctttgccgaactccctgtaacacacttatgttgggcaacaggtttcatgtgtaatccgtcaaggtaccaaagtatacctagcactactactgaactgtacacatagcaggtgattcttacagataatactagataacctcctgtcacacgatgctcccaaaactgataacaagatgtatgctttattgagaacaagattccaacacttattttgtattgtgtattcttgaatttttccttccgtctgcctctcaattcatgcatatgtaagtaaagtccaagttgactgctgaaaggtgctcctaccattattgatgtttgtcatcctttctttctcccttaagatcttttctgcattgtttcataattaatgtgctgtcttctaacatgtatcagttgtctggagttgctggaagacaggagcacctcatatctaccccacgctggctgcgtttatcttcgatggagcaaatccttgctggacggagcttatattccatgccacccagacctactgtagaatcaattattcctaatctatgactcgagcgtctactaactcagctcaagcaatctaggcccttcacaaatataacaatgacataatctcttgcaattaatttatggaccctatagattgtttagaaaccattcattttgttgaccaaatacagtgttcgcttattagtttatatggcatcaaagacacattcacattaaattagcattttaatacataagttacttttaatggtgtgataaactcttaaaaaaaaaaaaaaaggaaactcattgtagtattcctacactagcacccaggctattttatgtgtcagtgtgtgcactagccaaaggaaaataactattaaaggacaaacagaaaacttatagtcaactgtcgacatgagctgtcaggtgttcaattaatgataatccagccaagagcacatccaacccagagaagcactgaggtctgaagggtacagttctgctccggctgctctagacagcagccagttcagactagagcaggaaaaggcaggcctccagagggaagcctagagtgaagacaaaagcaaaataaaaacaggatgataacgaggatgcaaaattaaggaaatggcaaagacactgaacactgggaaaacacacatgaaaattttatgtaaccaaatacatatttcatactatagattagctatatagaaaaaaatgagttttggcaaactagagttgattccatttatttatgctccaaaagtacttaagactatatatactactataatgtgattattaaccaaaattatatcataatgtcaacttgaacattttaaaaaccctttgcatacgctgaattatacatttaatcccaagttttcatcatctcttgtcaagaagagaagaaaaaaacaatgcttcttgcagaggtcaggtccccagacttggtggcattcccattcttcctaacttgtacttactataaaacagagagcccaggatgctgaaaagaatataactgacatatttcacaaacggagactaaaaccaaaatgcaggaactgagtaatgtctaccatataactaagaaaaatgttaatctggtctattcttagaaaacatttgaaatcaccatttgtaaaagcaatccaaaaaagcaatgtcgattttacaggtaatgttttaaattcctataacccatccaactgaacagtaatatatatgaggtcaaggaccatgataaaagaagcaagcaactgaaaaaaaggatagggcagagggaaactggtaactcttaagaactcctcagagtatctgagtaactatccactcataaacagggactcttaacatgaaagaccaagtctcaaactattaattacatgctttttctcctcccagtatttgtaaaagagtttttcaatctatgtcagtacaatatatccaatgtatcaaaacctgagaggattaggtagtccccttcatcacatataatttttactgaattatttctcctgcaaatcttagccacactgtcatcttaaagttcaattactggaagaattaactggaccatcaatgtctgaagaagtatatatagtgatcacctatagaaactatatatggataatcacatcaacaatgagttctagttgctacattttgctagaagacccttctgagcatttcctgacgagttgctcctagcagtgaacctctcccatttgtgttggttctggttttctcttcaatgtataacaaaggaagaaaaggtgtgagagaaaaacaaatacagaaacttataaaaccagtagccttcatttaaaactcaattagaaaaagcctactttcctggagaaacctcaggtaggcgttttaaacttacttccacgtcctctggtcttcttactgcttggggttccaccaagaccaaacgccattgtatttggtatagccaatcaatacaaagaacatacaccgtgattttagttctaaattttatattgatcgttgaaccaagtcttctcccattccgccaacctcattccactctctggtcccacacagcaggatatcttaactcctatctatccattccaactttcttctctttcctctttagacagggtacatattctaccaacgtctattaagagctggactatttactcgtcctccctgctggctattcttactctgaccctttagtgtaatggagttgtctaagaatttctttatgcactttcttttcccaatttttcttttgccacttactagacttcaaactcaaagaaggtagggacagtgtctattttcttcactattatatgcacagactgagacaaaaatgttcaataaaaatttattgaatgaataaacaatctgcaatactcatccaaacactttaattggtactaaaaactctactcctaaatccataccatgactccatttttcctcctgaaaattttctcagatcagttcaataccaaatgtcaaacactgtgtgaacattgataaagatggggaaaaaaagtaggcattgctgggcacagtggctcacacgtgtgatcccagcactttgggaggccaaggcgggaggatcatttgagacaaggagtttgagaccagcctgggagcctgggcaacacagtgagaccctgtttctataactttttttttaaaaagtagctaggcatggtggcatgcacctgtggtccctactactgaggtgggatgatcacttgggcctaggagtttgaggctgcggtgagctatgatacaccactgcactccagcctgagtgacagagtgagaccttgtctcgaaaaaagacaaagtaggcacaacgagcaaataaatatactgataaaattgacatgaatgaaaagacttgatgggaaactgttctgaaaaaggcacttataagagatttacaaaggccgggcgtggtgagtcattgcctgtaatcctagcactttgggaggccgaggtaggcggatcacttgaggtcaggagttcaagaccagcctggccaacatggtgaaacctcatccctacaaaaacacaaatatcagccggggatggtggcaggtgcctgtagttccagcttctcagaaggctgaggcaggacaatcacttgaacctgggaggtggatgttgcagtgagcagagattgcaccactgtaccctagactgagtgacagagcgagaccccatctcaaaaaagagagacctacaaaaatatctgggagacggaggaaccaccttagagtttagtgagcaagcggggagggatggaggtagatgaggttggaaaggcggaccaaatcagataaagtcctgtggtctaccatgtagttgtgatttaattcagatgggaaactactgtttgaaaagaaaaggaagcagaatctgagtcatgttttgtgtatttatttatttttgagacaaagtctcactctattgcccaggctggagtgcagtggtgtgatctcagctcgctgcaacctccgcctcccaggttcaagcgattctcctgcctcagcctcccgagtagctggaaccacaggtttgcgtcaccatgcccggctactcttttagtagagatggggttttgccatcttgcccaggctagtctcaacttgtgagctcaagtgatccacccaccttgacctcccaaagtgctcagattacagcatgtcactgcgcccacccggccaagtcttgttttagaatgatgcattttgtggagaataagttgcaagagcaaaagtaaaaacaggacgagttaggaatgtatcatagtcatctttggtgacagatggtaggtcctgtgagataatatatttaccaggcggattttccaaagttttaaaaatcccaaccaaccacctaaaagcactcaaaaccaaaacattcaaaaatcaaatggattatgccctcctctccctctagcagctacatcaatcacctcaccatcgaccctgaacacacttacctttggcgtctctgttcatagtatcctcaacccatcattcaaaccagaaacccctaggacactttgcatctccctcctccgccctcccaatacattagaaacagctgaattcactatacctctgaattactcttatctggaatctgaacaatcctgacactaaagatcctttcaaattcaatgtagggaggctggggctggatccctgatctatgtggtctctctgctccagaacattgtttccagtccagtcactcttacatttaacataattattttaagttgtaataatggggcttatccttactcgcagtcacctaaaaggtaaataaaggtctaaactccttaacagtgatcaattataatcttatctcaactttacttctcttctctgctaccaaccagtcttagcgtcctccccttagacggcttagtgcctcaccaggcctgtgaccacatcatgttgccaccccacaatgctccttaccctctcgtgcaaaaagcctacaactatcaagtatctactcaccttcaggacctgctcaaacgctatcatcttagtgaaatcttcccagtctccgcaaagtaaatgaactatttgcgtctgggttttcaaagaactttctatgccctttattacaacaacttggtcagtttccttacaactctacatatacccattaaactacaaaaggaccatattttgttcattttggtatcctcatttgtaaacactgtgtctgttctacagttggtgtcattcattcaccaagcaaatatctaacaaggacttgctaggaaattaagatgaattactaaatgacggatattctagaaggaataaaataaataaataaataaacaagataacctcacacaaatgttttaagagaaatcttgtatgtacgaccaaaccttttcaggacttaaaacatatgcttaaaaatgttatggatagtatcaaggtgatagcaaacacaaaaggaaagtaacaaagtgaaaggggtgtaaaacttgatgtgtacgatttctttcctgagaacttcgtgctccaactccttccctgcaggacagcaaacaccaagtaattaagctcaggaaattaatctcacactgacacttaactatgaatatatacttaaacttggccaggcgcggtggctcacgcctgtaatccaagcactttgggaggccgagatgggcggatcacgaggtcaggagatcgagaccatgctggctaacacggtgaaaccccatctctactaaaaatacaaaaaattagccgggtgtggtggcgggcgcctgtagtcccagctacttgggaggctgaggcaggagaatggcgtgaacccgggaggcggagcctgcagtgagccgagatcgcaccactgcactccagcctgggtgacagagcgagactccatctcaaaaaaaaaaaaaaaaaaaaaaaaaaaaccatatatatatatatacatacacacatacacacacacacacactaaaactttaaatttcaaccttattcattttaaaaggaacaataaattacataattatagcctatgtaatgggattcagagattacaatcattgaaaggaaaaaattaaaatgtgactaaattattcttctaagatcagggccaagaaaaatatttcaaaccacatgtgaaatattaaacttcctagaagccacattaaaggagggaaaaaagcaacaggtgaaattagcttaattatatatattttattgaacccaatgtagtcaaaatattatcacttcggcatatgccacatttaaaagttgagaaattttacattcttttcttcgtaagtctgcaaatctaattcagatgcaaaattttcctcaaaaatacttaactgtatttagattacataaaatcaaagatacaaaagtagattaatataatcaagtcgttccaagtatgcttaatattctatcaataactgaatttaagtcaattacaataaaaactttagttcctcatctcactagtcccattccaaggactcaacagccaaatgccactactactaggatggttcagcttcaggcagaactgtggccgcttacttcagcacaactcaattcaatgagcacaaactaaataaaaatcattttctttcccctttgtctcctaagatagctattttctaggccccttaactaaaagagtagctgtcattttctctactgcctttatcgctacatggtaagatattatttgtcactctattacacaaatgctatcagggcaaaggatgggtccactgtgttcacacttcaaactgcaagaaactacagtctacatagcaaactgtaggaagtcagtatgtaactaagagggtttcaagcactgctaaattatttaacatgtgtatctatgctgtgtttatgacctacagaaaagaaatagaaactggctgtgataggttagtcttctatatcattcaagtaattccaaaataattcaaactatgagatctatattttcagccaacctagggaatatttcatccattcatatgtcaaaaagttcatgacatgaacccctagactttagttgactttaaggcctgtagcacaaacagcagaacataagttaagtacattctattgcaaagcagaatctaagaatgtaaacacacttttctacattgtacttcccagccctaaaacttggagcatgttattttccacaaactgcccatcttccactaattttttaaaaaaatttaatggcttcagataaagggcaatgtagcacaatacacagccaagaaacaaaagaagtagtcttatttttcccaattaatcatcatgcataaatctacatattagcaacagatcaaatataaagttctatggctgcccagtaaggtaatgctagagccgttaaatatgcatgctggtgggggagggaaccacattccaatcagaagacttcagtaatgtataagatgacacaaagtaaaaactcaaggcaggtccctttttaaatttttatcatttttttttctgtattcatgtaccaagaataaaagttaaacactgatttttgtagagatgtaactcattttggtgtcacaggagttaaaaataatcatttcttgactgaagacaattagtaatacataacaggaaaaactgtgaaaaagtctggtatcaacatattttttttagaagagataaaaaaaaaaagtcttactctcattaggctgcctgagaattcctcagttggaaaataggttaataagccaccatggggtagaagcagcctaatgtcgtagacctgggcctccacgaagcgaggaatctgactctgaacagaagaaatgggggaggggtgtggttggtgcaatgttaaaagataacactgattgcaccttctccaaaccaaacccatttatgttcacaaaaatctcaaaatggctgattcatgtggaaaactgagaagataccaaattctattttagggtagtttttgggaagcagagtcagagagtccccaggtgatatccggattacaattaagaaacaaatctctatacttatttcctacatatagatattcttaacatacacacatcaaagtcaatgttatagaatctactttctgggatattaaaggactgaaatcaggtgactgtttctttgcactggtacagtcacaattttttggaacaaacaactgtcaatacagcaaatagatgctctcattatgaaccaatttaattttttattgtgctgcataattttgagtaggcctttatcacacacacacgcacacacacacacacatacgcacacacacacacatatctgacgctacaaagaaaatattttaatatatatacttatggtcttgggaaatacacttatcaaatcttttatcttcaagctagaaaagcaaaacaagcttacaccaaagagaaagtcaggccatcattttaatccaccaaactatcattctattcatattcaccatgagggtaagtaaagacaggacagttttctagcaccttcatccagcagccagaagcatgtccaaacataccgatacaaaaacagttacattatttcatctcatactggtatgctgagaatctgctaagaggaaacttgtttcacaaaatcttcaaagtacacttctccacataccctcttcatttgaattaactaggttttaaaatcctagttcaaaaatgtatgataaatgaatttatgcattaaataacactcaatagctaatatgtttcctagtcagaaataatggacttttgcagtgcttatcaactggcaatagctgtaaatgtctgagggtgttttgattgtcagggatcttatccaatctacagtgtactgggacagtcaactacagcaacaacaaaaatcacaatcagaatagcctcttttgaggcacaatatctgaaaacagatgctcaaaggggttcttaccaacagtagcagcgtcatcacataggaacttactagaaatgaacgttctttggctccacctgaggcctacagaccactctggaataaagtccagagatctgtgttttaatgagcctcccaggtgattctaatgcatgctcaagtgtgagaaccactaacttcagaaggatgtctgtggctgctgtcccttaatttagaggacaagtttttttccactgttgtatcttaagccctagaaaactaaccaatacacagtaggtccccttgatacatgctgttacaatgaattaatggatatagtgaaattctgaatgacatggcacctcataaaatcttatatgactaagaaaagtttttgtagacaattactcccattaccattttcagttatctgaacttctcactccaaagttatcctaatgtgtaaagcattcaagtctgggaacatattttctaatcaactcaaagaattaacatacagtgattaacaactaagcaacttactattattgcctctaacaccaaaaaggtcagaaattactaaaagtcatacagaatgactatgtagaatttagtttactttttctcaatacataaaaacaccaggcaacatatttaaatctaaagaatgtctgaaacttaatactgatttacattatctaataatgtaaaaatatcctgaggaaaagttaaccacgaaaggtacactaagatgttttctcaattttcacgtaataaataatacaaataacttgcaaaaagtaaattatttaaataaccataaagataataatgtaaataacttgtattccaaacatggcaaagtgaacaggcacaggattatatatttacataattcttctaaacagtcacagaagcctggttgattgacaaacatataatgcccttttgcataaaagcagctagaacaggaaagaatgtatcagagatccagtcagagagaaaacataaaacatactgaatgaatgtggctacttaagttatgacactagcttatatacggtaattccttacatgagatgtacaatatataaataaaaatgtgaagctgtcttggtgtaataaagagctagaaaaaattttagataaaaatttagacaatgaaataaaaataaaaattaagataaaatttagattaaggtatctatttcaaagtcttcaacaccatcaacaaaacacttaaacaaagcatttaaaaaatataaggtccacttatattactatcaacacaatgtaggacctcgtatttaatgaataatttgtcttattgactaaatttatattaaaatatgaagaaaatctaaaatgaaatgtgttcaaactaagtacatttccacttgaacctacttaattctaattctattcttaattttgagactgaactacctcatgtgaaatttgagtgatttatattccacaagacagaactgaaattttatttatgtgtacaagcagaataccatctcttttaaagttcatctgattaaatgagaaaggcacatttaaaaagaacaattctgacaaacttcttttaaaaatacaggatctttcgcagaggagggaactgatagtgacaatggtaactgaagccataaaattttcttgaaaaagattttgtttaatgtgtatgtataaactctggctatataacattaagaatttcagtatcttcaatctggaaataacagacttctgttattcaaaaggaaaaaatgtcataaaatagaaaaaacacatacactgttaatttcatcaggtaaaaaaaagtgtaatcaaatagtaagtttcaacaaagaggaacccttagaggtatttatattctaaacggttttacagaaaaaaaggtcaaataaaatcagaaaacaagttttgtggtaagcctttaaacactgtcttacaagcttcaaatttcaatcattaatattgttattccataatcaaggaaacaaaaacaaattcaaaatattctcacaacacatagaagacactacttttgatatttatttttaaaatttttttattttttgtagagacgaggtctcactacaactgcccaggctcatctcagcttttggtatttaaaaaactccagattttaaacattagacactataaatttttttctgcatttttttttcattatttccccagagtaacagtccataaattaactgatggatactcacttaggaaatggcagacatacttcattttacaccaccagaaaaacatgtaaagtgaacagagaaaaatgattttaatttttaaacttcagtaatgaaagctgctggaaacaaaatgatcttgtaaagtataagactactcccaattcattgaattatatgatttgcttagaatgaaatgtttccatgctgggctacataagaggtggactcttcgatttcaagaaatgaatcttcatcagtatgaaattaacctaaaaatgttgtttttggaggcatgtgttgaaatatttaagggacaagtaacatcaagcctgctacttactttaaagtagtttgccatccccccaaaaagtccatgcctaaaaacatctatgaacacaggaaaacatgaataactgttgaattagaagatatgtatatggatatttactgccttattcttgaaaataagaagtctgactttttatatcactgctatcctctgacacctcagaaatatattttaacacattagatgttgtaacaaaactctgaacacctacagaaaacacttaaataataccttactccccaggaacttccttcattttttcaaaatgatgtggcccatttatttttcactaataccatctgacactaaatctcaaccctttttaaagcttttaccataatatgatcacatcctttcacaaaacttacttgatttcaatcatatatgtcctttttctcattcagaatctatgttgtaatgatcaacctaatccccatttactaattaatgactactaatcattcacattgctatttagcaattattagagactctacatataagtagcaagttactgaaatattcaacaagtatgtttctcaacaaactgtaaaggtattatttcaaatagtgtttgaaaaacaagagccaaagtttcagtcactgtccttgtttacaattcctatttttattaaatggcaattccagctaaaacagatattgttcccctaatattattgatatttcagggttaaaaatattcaatctctttcactaagtgctcagcactgatttcacacagaaaaataaaaaaaacctcaagaaagaatagcaaattgaattttgcaaaaacacaagtgaatcagttttttaaaatctgcatctgtcaagaaaaaaaatatgcatttatttacaaaatatacaaaaatgggggaaattccaacaacatagagtactagaataaaactattaggaaaacaggtgttcctttattttatacacactaattacaagtagcacatgaaacattaagtcctgaagactttaaactcagtacttcaaatcatcacacaaactatcataatattgttatatattaaaattgtttcatattactttttataaaaaaaagatagcatatatgacaacttcacacttacttagaaagctaacactactgaatttcctctttatttttgtatctaccacttttaagcagatgatattcaaaaatcttccttggtatactaatccacaagaaaaaaaaattgactgaaccagccacaaagtttaactatacaaaaacactaaaaacacggaataactgggagttcagagatgctccacttgactgtcactcagaagctgactgctcccagcgtaaacttggtaaagccggaacaaggattttcttgatgctgggaaaaagttgtgtagaactctgttcttggtgccagagttgagcctggacactaggatgttcaggagattaagacatctttttgtgcactggccttcgagtgttcttgaatgaatcatacagaatttcacagccttggccaaaggtaccttggtttaacatcaaaggatcaagtttctcccaatcatatttcagctttgaagtgaaatacaatgctaaaaattacctgagaattatatgaataaaatatagatgacgggaaaggtagatttaagtgcaatagatatcactgaaaaactgtaatcaatgttaaaactccccataccccaattaatgtcacaaattaaagcaaatcccactctccatcacctcatacttatgagaaacatgagaatagtctttgactattattttacaatctccaaatcatgttttcaaagaactgtcaaaaacaaaagcctatgaataccacaaattttggaaaatagttccatccacactgtgtatcaaaaaaatagcagaacatgaaagagtacgtatgaaaattttaattagtataaaagaatgcatcaattatgctttacaaccaactgcttttatgcaaaatttaaattgtttctttccaaactacaccttccagcaaaacagacaccactatttacatagtgtttattttaaaatagcatattatctttcagaaaggtgctgaaagcatgatatagcaaaccataatgatgttttatgagaaacagctatgctatgatcagtgtctgatgaattacatttgtggtatgagtcatatatgattccttaaatgtaattttaaataaacatgaccaacatacacatttttaaagagttatgactttgttttgcaataaacattataatgtgataaaatcagtttctccctagtattgaaaatcaaaataggtatttgatagtgaaaggagctaatcagattccaatgactctagccattctcaagtaattatctgctttttaaaatcacctcttgaactgtactccttggatgtctctcagcattatcttgaaaaacacaaacaaacaattaaaaagaaaaccactgccattccttggagacaaatggtcctaacccatcagacacgttttactggagaaatgtccaaattttagggaaatatttacaacactgcagagtcaagccatcttttaatacttctagaaacctacattctcaagaaatgcctaattcaccacaaatcacacagcaaatcctcacttcacagccaacccaacagtattgttttattttaaagaatgtttaacactaactgtacgataataatcgggtaaggtctagatattaaaaccaaataaataatggcagatatgtttaaaactagacattattttttataagcaaaagagatttgccttcaaacagtttttttcaagatgaaaaagatttatttggaaaaatcagcacaggacaaagatatccttaataatctgtctcagaatacctgaatattcagaagctatatgaaatgtagctggaaattccgatttcacagaacatcagtggtttatacaaattaaactcccataccctcccacccccacatatactactctatctaccccttattgacattagctttcattaattaagcttctatctttagtgctacttgcgcaaattaaaaagcaaaatcattttcatttttaatgataggattagttaaagcaaccaaagcattactgttacagcaaagtttagtaagaccgtaagagaataccactaataacagttttaaattatccaaaatgatttctttattgagattaactacatagatttcacagtactatggaatacttatatttagctaaagtcacaaacacatttcaacattcaaaatgatgagcatcattaccattctaatctacaaagctcatgaataaagaaaaatacaaaaacctcaagttttacaaaaaaaaaaaaacttttaagtctacatacattaacaataaaaccatttcttccagataacaggtaaaagtataaaggcataccactgacttttttttttctagatagccaggaatgaacgaatgtttaatatctacgacgcttattagggccttcaaagttgcccccttgacttcctctaccaaagccaccaggaccaccactcacaggacctacaccactcattggtgcttgaggggtttcagaacctgttctactccccataggtgaacccatctgagatggtggtccttgaggaaatctgtcattgtgctatgataccacacaataaggaatagaatatgaagtccatttggaacacgccaaatataagtgacaagaaaaattggcaaaatcccaagtggtggtgtcatgaagttcggcagaaagtccagcagaatcaggatcacacatagaaggaagaaaggagcaatttaattagttactatgttttttttaaaaaaatgcagcatctgaagatttacatattgctaatgctatgccccaatttaaagaacaaagaactgatttcgtgacagaagcaaatgtaatcttaagcctaaacaatattataataaatctctgattccttttttcaaaagtttatattgcatgaaactacgctatgtaagaaaaatacgttcttaaaaaaatcagagaaataaaactggggagcagcatcaattcggttttttaaaagtaaacattctaaaaaaaaatcttcacatcaattccttgaagatagaaagcactaatacaaacatacacaaagaattatgatttcagtatggaaacttctgagagtgttttccttgaaagattatcatgggaaaatagttttaaaaattaatgtaataacatgcactaataagcacatttaaacatctgaattaagtattttgaaaaacttcacaataatcatacatattaatctgaaaggttggatagaactccctgaagtgtagcagtaaaatgtcagtgcaaaacagaccaagggtgatatttaaataaagtttacaatttcagggagacaataaaaaaatgggacagttaatgttacttctatgtttctattgatgattatatgccacacaaaaacttaaccaaagtagtataagtttttactagctttcaaacatatcactataaaataaagcctctactgaaggaaataaatgcaatcactgtgttaagcgccatctgttcatagtagccgtgcactgcctcatctccctgtataaactatcattttaaaaaatccaactgccagcatgtccaatttctccaaattcttgaagcaaataaaataatgataaatgctgcattcaactctaagacatacaatgcattgcttttaacgtctctgatcacggtggatttacaactgatgacaggtctgagtctaacaggcagtgctttctttctttcttagcagcattggcgcctcaagatttcatacagtagtttcaaaactaaactgccttttcaaaatagataaccaaacaatttccctttcaaaatgttatttacaacaagcattaacaaacactaaatgagaaaacggtttgcctaaagtccgatttatatagtgacagactttaatagaaatgataaaaggtatcattcttgctactaatatatttaaatataataaaaattacaactgaaaaaccttgttttcatagtatttaatccacacaaagatatcttcacactctcagatcaagacaaaaaactgtctactttaaatttactaaatataatttaaaattctgtgaaaagaatgccacaatggtggtttggaaatacacaaaaactttaatgttaatttacagccaaattctttgcaataaatcatgacaggtaatatttttatcaaaaatatttactgaaaactgtgtgttcatacatattggacttttgtccccatcaaatataaggagtccacacaggaaaagaacactatcataaaatgcttgaacgttagaatgctggtaaaagatggaaacaaattaaaaagcacagaaaaatatctgtaattaacatatgcatttgctatatactgaggtaccacagcatgccacagacagtaatcctaattcttggactacttaaaaactatctcagctggacgcggtggctcacgcctgtaatcccagcactttgggaggccgaggcgggcggatcacgaggtcaggagtttgagaccagcctggccaacatagtgaaaccctgtctctactaaaaatacaaaaattagcctggcgtggtggcgcacgcctgtagccccaactactcgggaggctgaggcaggagaattgcttgaacctagaaggtggaggttgcagcaagccaagatcgtgccatgcacaccagcctcggcaatagtgcgagactctctgtctcaaaaaaaaaaaaaactatctgtaacacatcaacatatgatgtcacaaaattttcttcttcattggctgccaaaacaaatgataccaaattatattaagtgtgaagttatccttgatgcagaagtgtacattactgaatataatcaaaataatgtttatgatacattaccactgctccattatctggcatcattggagttcccatatttgcggctccttctggtcccatggcaggaccaggacccattggtgggccaggtatagttgctctgttgttcatattcatacccatcattggaggaggaccttggttaccagcaggggctgggctaaacgcatctatgtaaaacaatctatacttagagctgtcctatcttagtttagtaaacattaacaatttaacaatatttatgcaatctatataccaagaccattatcaaaattattttcgctccttaagaatgcgatatgcgttatctactctgtaatagggtattacctacactctagaattagaattttcatccccaagccaaacgtacataaaatcaaggaggaaactatcaatcattttagggcatttgagactaacagtttgcaagctttgagacatcactattattttgtaatagcaggcttttaaaccaaagaatccctaacaatggggactacattttaccagtttaaatgagtaacaaaggattagcacttacaaaaccacttaatttttttcaacccatggctaaaaatattagcagtaaattatgctaagttgtgagagaggaaatcatttcctgcaatatataaataaagatcattataactagcctctcatcttagttttttttttttcctccctgagtttatggaataccttgctaaattacataaggtactctttttttaactttttattttgaaatatggactctaaaccaaaaaattgaaatgacttataagaaaacttatttttaaaagcaaccgcaaccaaatacagataaaatattaatatagctatctggatctttctgacaagcttaaattccataaatggggacaacctgataatatttcaagttttttcattaaaaaaatccacctacctcattaacattaatagtgtttgcactgtaatactacatatatgatgatctcagatacaacacatttttaggcattttctttgaaaaattttttcccttttaagtgttagtacttatcattaaaaattcataacaaagccattctaatttagagttttcttctagtatttcattacataggtcaattttctgataataagaactcaatttctcaaatatacattataatgcagctgaaatctctatatggctgagtccttaccagcccctggcatcatacttctgctctttgaatccaatccccagaaacctagcaaattcataggaaggaattatttccttcatccccaaatgctcttgccgataaacagactttaaccaagaatatttccgctccctcagtatagccctaaatagctatttttaataatttctacaatctagacatgaagagaatataagaacagtatctaagaggcgtcttacctcaacaatcccccagaaaacaaactaagtttctttttcctctctttctctttaatggaatgtaattttacaatggtgggttcggaagttttctttttcctctctttctctttaatagaatgtaatttaacaatggtgggttcagaatataactatacaactatgggtataaaaaatcaaaaataatatttccaactaacagcagttaacttagagccttacttttagtattcacatcttccaccacatagctataaataaatttaaagatataaaaaatgttagcattatctgattactagaaaggtagcattataatgtaggtttcgtttggttatacacactagtgatacaccagaaaatctgctgccactttccatcaatgtaacttgatgagttatgacagttttaacttctcaacaacccaactggatgataatgattaatagctctacaaaaccattatgatgaagtctcacattgaatgaagactgaagagaaaattagataaactgggctttaggagagttaagtgctaaaatgtaagtaagtcctctggtgaataaaatgtcacaaaaattttaagttatcttcaattcctaactaaataaggactctaaaggcatattctgatatttcttctgataaaattgcagagtatctctgcaccatcagaaatggttttaagttttatactattttaaagtttagctctgatgttaatgtcattctaataatgataacagccttttaaactgcctataatctacaataaccttattcctaaaatccttaaaattacatggattatattaaatagcaccccagcatttactcttaaaaaaagacataaatattggaccacttggacatcattatactcaattatgcttcataatttagaacactcttggttcattaattatttcacgtatccactgcagtaatttcacaattaagttctttatgggcgagggccatgtttcttgcttcctgcatatatcagagatattcactaactacttgttggtaaaaagtgaccaagtaaaacagcaatatatgactctacattatctgattagtagtattgaaaaactggcaacagaagtttaagaaaaaaaagctgatcatggaaaatgttcattccacacatgacttaagtttcatttgatagactatatatgctgagaacacacttgattttgtaaatgggtgtgcatgttaagtacattgtttgccatggtagtgtaatctttgaaactatgtacttttaagttatataaagatttttagcttcataacaccttttgtgggacaatttaatgtgggacagcttttgtgggacaattaatttaataaaatttaattccttatccaacttttaaatgtatgacatttcaaatttcaaatttagtaaggcctacgatatgccacacttgcttttccttcaggttatttacttggcattatttcccttgcaacttggctatacgagcaaatccatactaaagttgctaatatgctttcttaaaagcttagtcaactctaaaacatgcattggcgacacacataattcccttgatgagttatagactacaaacactgagtgcacttctgtgcacaacactgtaggttaaaggaaaaaagttcaatattcattaaagtgaaggaaaacagcttcaaagttacacaaaaagctagtttaagatagaaatgtataaaacgctctccacctaaaaacacaactcagaaactatcaatttccaactcggaaactatcaatttccagtgttcaattaggacaggcgaggtggctcatgcctggaatatcagcactttgggaagctgatgggggtaaactgcttgagcccaggagttcgagaccatcctgggcaacaaagcgaaatcctgtctctactaaaaatacaaaaaataagccaggcgtggtggcacatgcctgtagtcccagctacttggtaagatggaaggaccacttgagcccaggaagtcgaggtttcagcaagccaagtttgtgccactgtactccagcctgggcaacagagtgaggtcctgcctcaaaaaaaaaaaaaaaaaaaaagccaaatagaaggcataaaatttgattttaaaactgcaaagacagagctgtattacacaatgcaatgactaaactaccttcaggctgtattgcaacctggtttatatgtttctttcattaagcctatgaatgtataacacatcttttagccttcaaacaaaaacaaaatgagaattttcttcccagacatatatttttaatataattgtattgtattccagtttaatggatgtaagagatttcacctttagaaatgttggttctgtattttagtttcttactgatatgtagataccacaaacagcataaacagtccccccaaaaatgataaattacaaaagccttttgcttcaaatccctacctcccatgtttattgctccacggggacccatatcacccattctcatttcctgttctctctgtaagtaaacatagttgtcacagtcaacctatcgatcttatgactttacatttcccatctaaaatcaaaaagaaaagagtgaattgggacatcatttttcattaaaaattttgaaaagtttccatcatcataaacttaataagaatgctgaaaagaaacttcagtctcccaggcttaatatactacaaatgcttaatgcatccagtttatattgcaagattagattactaatgaatcagattatataaaatatatcacaaattatttttaatgtttttattccaacagatgaaagacacatgcctagattccaagcaaaggaaaatctagtaatgataaccaccagagccaattattttctcctcccaggtcactgaagtcttaaaatagaaatgactgttaccaagttcatgttgaaatgtatttgaacatataacacaaatagctttagggaattatgctaaaaataaggttacaatcttcattgtctaaatattataattcattcatgtatttgtattcatctactcaagcattattccatccagggactatagatagcccacacaagcaattactgaaagctcgacataacattgctttcctttaactgcgcagtaattttatttgaaaacctgaatgaaagtattacacagttaactataaaacagaaatattcagaacatttgaaatttcattacagaaactgcttcctaaaagctgttcatttaccaacaatagtgacatagaattaacttcaatgaaatctctaagtgaaatttctcaagataacataggaaaattgcaattttcactttgacttgatgaccatttccaatcacagaaaactgttaaatgtagcaatcatgaaaaacattccattatgagacaaatgcagcaatgtttaaagaaagcataattactgtacttttgaaaagcaatcttattaaaatctaaatgttcatttaaagttccattttataatacgaaagactgttgaaaagcacctataaagctggaaataaaataaaagcctatgatggaaacgtaattgccattaagccacaagtggctccttaaaaaaactgcctaacttaaatggagatgtccaaaggtaatcctaatgaagctacggtacaatgaatgaagctacggtacaacaaaaacaccatcatgaagagataaaatgctttctcacattatttagaagatttaaataccaatctttctaaaaagcttaatttttttttttttcccagagatcctcgctctgttgccctggctgcagtgcagtggcgtcatgatagctcactgcagcctcgaactcctgggctcaagtgatcctcctgcctcagcttcccgaatagatgggatgacaagcatgcaccatcatgcctggtgaatttttgaatttttttttgtagagatagggtctcgctatgtcaaccaggctggtatctaactcctgggctcaagcaatcctcctgcctcacgctcgcaatgtgctgggattacaaacgtgaaccgcaatgcccagccctaaaagccatgttttaactttcctaaaaatttctcatcataaaatttgtgaccattaatggatactattgctgacctgcaaaaaaagctagactgaggcggggtgcagtggctcacgccagtaatcccaacactttgggaggctgaggcaggcagatcatctgaggtcaggagttcaagaccagcctggcaaacatggtgaaacctgtctctaggttgggcgcggtggctcacgcctgtaatcccagcactttgggaggccgagatgggcggatcatgaggtcaggagattgagaccatcctggctaacacggtgaaaccccgtttctactaaaaatacaaaaaaaattagccaggtgtggtggcaggcgcccgtagtcccaactattcgggaggctgaggcaggagaattgcgggaacccaggaggcagaggttgcagtgagccgagatcgcaccactgtactccagcctgggcaacaaagagagactccgtctcataaaaaaaaaaaaaaaaaaaaaagaaaccccatctctactaataatacaaaaaaattagctgggcagtagtggcacatgcctgtaatcctacctcctcaggaggctgcggtaggagaatcgcttgaacccaggaggcgggggttgcaatgaaccaagattgcactattgcactccagcctgggtaacaagagcaaaactctgtctcaaaaaaaaaaaaagctagactgtaatataaaattgctactcatcaagcattatatttagaaaactattttaaaataaagcttctgttatcactactttcaataaaccaaaccaaattgccatttccttatcactacttagaaactactgataggttcttagaacctactgataaaacttaagaatgcttcaaaacacccaaaatcttctagctataaaaataatatctatagtatctagataagtatctgtaacaagcaaatatagtagacatttcgttgttcagaagctggttacacaccagcaccatcgagtaaaatacatggatttcatagtcatgacttttggggaggacaggatttcaatttatatttttacttttgaatttgtcttcactatgaaaggttaggaattcaatatctaaccactaatatagggtaattgtttacagtctcactgcttgagatttcaattttcaactaccccttatataccctaataccttaactattggcctatgattcactggcaggaaaaaagggcataaacaatcttttttattgtctctttgtattttcagctctatgtatcactttctagaataactttctagaatagtgcaagctttattattcacaaagtaccttcttttattattaaatccattgtcattaagaaaatttcacgggaaatgtatcaatgtaccaaaaatatctatggttttaagttaactattaaacatgaacattccccttctggtggtatattataaattggtacaagttctaaaatacctttctctaaatgagataatcagaatatcttagaatactccatgctaccatagcatattactgtattaaaataccaattcatgaggcacattacagcatttttcactaaatatatatatatatacttgtacttagtaatgttgacaatatcttaaagatgattactgaatactattttacacagctttgctcttaagaaaaaagagtataatttgatggcatcattttgtaactatcttagaaggggcaaaagaaattttcagcttcctagtcatgtcttcaggctgttactttctagaaaaccaccgctacaaacttctagtaaaatgcaaaagaggtagagattaggatgattttgtaaaatgaaatacagcattcttcactaacactaaatctatcaaatattaataagaatcacttgaggaaattcacaactgtgtgcccacccaacaagcaatacacaaaacccttacttccctctatgaatgacttttaataacacttcaaattagaatttaagttagaaccagtgcgtatacgtgatatttttacaaattttaataatgctttattacattacaaaaaattaagagttgttgtttaagccaaaacaacttatttgtaaccaacatctcaaaagactgcagtgcgctaaaataaacctatgatgaaaactcagttttacattattgattcaactctatgaagtaggcctactgttacctcattttagacataatgaaactgaggcacaaagctgttgaataacttagtcaaggtcatatggatagtaagtggctgagctaacctatacgattctactgaaatggagttcacaaaatttttgacgttcacgagatactttcattcttcaaaaattccaacatatctccatgtcccagacagccaaaaaaaaaaaaaaaaaaaagaattccaacagtcgaagcctaacaaaaggcaagattttaacttatctttgcggtatttataagattgtatgcctttccatggaaagaattatacatatgtattcctgaaagcttcgaattcaagtgtacttaaattaacagatgaccaaaaaaggaggcaaagtatgactaattcccagaaccacatgtcaaaagagcattccatcattgcagcggttcttaacgtgtaggtcatggagtacactaagagtccccaaaactcaggaagtgcacagtcacaactatttcatgttttcccagcactaagatacagttagttatagtactatcatcagacttttctctgtatcaacattcactacatttaatggtgcgaaagtaatggctaggaaaagtcccagcactatagcacaagccaagagacttgggcccaatttttactagtaaccactgcatttgtcacatggataaaactgtagtttaaaattttaaactatgaatacctggaggaagcagtcaaagttaattttattaaatctctatccatgggtacatgcttttttcatgttcttcacaataaaacaggatttgtccacaaagtacatctgctgcattctgaagtaggatggttattttaagaaaaagcattcataattgaggtgcatgttgaatgaaatacttttttcacagaacaaggtttttataagagacactataattattggcttgagtatttggcggatattttctatgagatcaatatgaagacatgtaacttctttttaattttgtaaaataaatacattagcattttggataatctgcttaggccaatgcatcagtatttttcttctgattggtacataacactaaaaaatcatgcatgggtaaaaaatccattcaaaattcaaagcagcccagcggatttctttttttttttttttttcctttgtcagtctcactctgttgcccaggctggggtgcaatggcgtgatctcaactcatgcagcctctgactcccagattcaagcaatcctcctgcctcagcctcaagggtagctggaactataggcagataccatcacgcccagataatttttgtgttttttgtagaaatggggttttaccatgttacttgggatggtcttgaactcctgagctcaagtgatccacctgcctcaaccccccaaagtgctgtgattacaggtgtgagccaccatgcccagccaacccaattaatttcgatgtaagagtacttttaagttttacagtagtatcaaaaaaatccacaattatctttaaaggttattaacatactcctcccttatcacttctccgtataaagtcaggtcttctttgatgcgttttaattaaaaagctttctgcaatagatggactgcaaaagcaaacgtgggaagccaaccattttttatagagcaaaacaaatttacaaaacataaaacaacaccattcttcccactacactaaagggaacattaaaagacatttgcaaaaatgtacaagaaagcgactcttaactctgtaacgttttctttaaaacctcgctttggcttataatatggtaaatattgatataatcctttagcaggactttggcaccctcaataatttttaatagtgatatggaaaattaaagaaatatggaagccaaaaggtttgagaagcaatatttttaaaatcgcagtcagttttctttcatgaaaatatagaacaggaagcttgcactaagtaaggtaaattaacctaacaaatattttccaaagtggcatggtaaacatgccactactggcacatggcactttttgtgcagaacatggatatttttcctttaatatttagtacttgggctatcatgaaacaaggttagcataaccatccaaaaccccaagtgctccaaaatccaaaactttttaaacaccaacacgatgcccaaagtggaagattccatacttgacctcatgtgatgggtctaagtcaaaatgtaggcaaaactttcacgcacaaaattacttaaaatattctactgagccaggcatagtggttcatgcctataatcccagcactttgggaggctgagatgccaattgctcgagcccaggaattcaagacaagcctgtgtcacacagtgagacactgtctcttaaaaaaaattttttttggacagacacataatcccagcactttgggaggctgaggcggatggatcacgaggtcaagagatcaagaccatcctagctaacacggtgaaaccccgtctctactaaaaatacaaaaaaattagctgggcatggtggagggcacctgtagtcccagctactcgggaggctgaggcaggagaatggcatgaacccgggaggcggagcttgcagtgagccaagatcacgccactgcactccagactgggcgatacagcaagactccgtctcaaaaaaataaaaaataaaaaataaaaaaattaaattctatgaagttaccttcaggctatgtatataagacatatatgaaacataagtgaatttcatatttggatctgggtcccatccccaagatatctcattacataatacacaaatgtttcaaaattcaaaaaaatccaaattccaatacacttctagtcccaaacattttagataagggatactcaacacgtatattttgtgggtgtatatgtgtgtgtgtattaccaataacctaatttaaaggaatgacttaacacagtactcaggtaaagctaaagtgtagtatgaccacctaaacttggggatacactcactgaactaaataaaaactgctttaactgtgtcaactggaacaccatttaatgatcaatgacgagaggtattcatctaacactttatcaatataactcttgtttgagtgaatgcaatcttaatgggcacaatcaatactcttttttaggtcacagtcaaaattctttattgataaagacctctcatgtttatctcaaaaaaagctttaagaattgtccaggaatcaccacatgctatttaggttctatgtctcaaaaaacgaaaatgctaaaataatgtagaacatttaaatccactaaaaaatatataattctagagaaaaatatagtaagttctgacaacaggattcagcctttttaatcaattaggaatatctaaatattcctaaaaataaattccctaaaaaaaactatatttagcaattgaaaatattttagtgtgagcaaactatattctattaccttttccttcactaaagaaggttacataacagaacaataaggttataaccaattaaactttcatgagaaagattaaataagaactgttggccaggcgcggtggctcactcctgtaacctcagcactttggggggctgaggcaggcagatcacctgaggtcaggggatcgagaccagcctggccatgatggtgaaaccccatctctatgaaaagcttggcgacacagcaagactgcatctcaaaaaaaacaaaaaagaaaatcgttaggagccagaaatattagataacaaattgtagacacaaagaatgaagcaaaaatcacttacatgaaatattcatgggtatttttaaaaacctcaagatattaggcctctttgccaagaaagtattaactcatgaaaaaagtattaagatactgaacaatatacatcagcaaatgaatcttttctaataaaagtaaactgggccggacatggtggctcacacttgtaatcccagcactatgggaggctgaggcaggcagatcacttgaggtcaggagttagggaccagcctggccaacatggtgaaaccccataaatactaaaaatacaaaagaaattaaggccaagcacggtggctcaagcctgtaatccaagcagtttgggaggccgaagcgggcagatcacctgaggtcaggagtttgagaccagcctggtcaacatggtgaaacccatctctattaaaaacacaaaaaatcagccaggtgtggtggtgggcacctgtagtcccagctactcgggaggctgaggcaggaaaatcgcttgaaaccagaaggtggaggctgcaatgagccatgataacaccactgctctctagcctgggcaacagagaaagactctgtctcaaaaaaaaaaaaaaaaaaaaaaagttagccgggcatggtggtgcacccctgtatcccagctacttagaaggctgagacaggagaatcacttgatcaggagacagagtttgcagtgagctgagatcgtgccactgcactccagcgtgggcgacagagggagactccactttaaaaaaaaaaaagtaaataagggtcaggcatggtgtccagtgcctgtaatctcagggttttgggggaccaacgcaggaggatcccttgaggtcaggaattagaggtatggtgacctatgattgcgtcactgcactccagcctgggtgacagaatgagacctcactccaaaaaaatttttaaacgttttaaaatgaaaaggaaaaaaatatacgtttctattgatacaactcaatagcatgtaaactttccaacctaatcaatagtgaatgcttggaaaacttaacatttgaaattcaggcaattaaaaacaacaatttccaatatatgttattcgctgctagttagtgaggggtagtttaaaaaatataagacaatctctttatatatatatacccaagttttctcccctcaatacatgcattcctaaatatcttcacccatgaatatctgggaaaatattcttcagatatatgattgttaaaatgaaactttacatcgtatgccattgatagaattgcaaattacattgacggaactgcaaattaaaatgagacagcactacaaaacctactagaatggtgacaatccgaaacactgacaaaaacaaatgctggccaagatgcgatgcaacaagaacttcaacgtattgctgaagggaatacaaacaggtgtaaccattttgcaagacagtctggcagtttctgataaaattaaacatactcttaccatctgatacagcaatatcactctttgcattttaccccaaggaggtgcaaacttatgtctacacaaaaacctacacatgaatgtttatagcagcttgattcataattgctaaaacctggaagcaactaagatgtcctttagtatatgaatgggtgaactgtggtacaaccaaaatattattcagtgctaaaaagaaatgagctatcaacccatgaaaagacatagaggaaatttaaatgcacattgccaggtgactagaagccaatctgaagaggctgtatactgtatgattccaactatatgacattctggaaaaaactaaactatggagacgatagaaggatcagtggttgccaagggttaggtggaagggatagagaagcagagcacagatttttaaggaggtgaaaatactctgtatgatgctataatcataggttcatgtcatagatttgtcaaaaccctcagaatgtacacccagagcaaatctaaaggtaaacgatagactttggttgataagcacgtgtcaatgtagcttcagcaattgttataagtgtatcattctggtaaaacactttgatagcaggagaagctgtaggcatgtggcacggggtagacgggaaatctctgtaccttccacataatcttgctgtggacctaaagctcttttgaaaaaggctactaaaatattgaaactttaaaatgaatccttttgaataatcaattacattaaaaataataataataaatcaagatgagtctcactatgttgcccaggctggacttatactcactgggctcaacggatcctcctgcctcaggctccctagtagctggaactacagtcatgccaccgcacccagctaattacatcttaatttatactgcaaggtttagtcacgaaacaaaaagtagttgttacttgttaaatactaaatcagaaatggaggcaacgacaaatagaagtagggaaacttactgtgttcattaacttgacatgtgcctcttaaaccaaatacattcaacaatgtattttgaaagcctcggtcaggtaattgagtgaatagattgctctgatattactgtcaaattcaactgaatgtgtagcaaaattaatggctgttttttaatacatagggtggctttctaaccgaagatcaattaaatgtaaacacaatctagcacacatcaagggacagaaggaaataagtattttacataaattaattgttaaagaagcttctatttggctgagattttaagagacgggcctctcactatgttgcccgagctggccttgaattcctgagctcaattgatcctcccacctcagcctcccaagtagctgggactacaaggcacacaacactgctcctaagaattttatttgtaatgcatacacctgagagcattttcaagattaccagtttcaattgtcaggtgtaaactcactctgaagaggtgcttttaaaacctaaaattgattaatagtatttaattattcttcaaatttagttattttacccagaactcctaaaaaaaacaatgagcaaggataccagctgtaagacaaacaatactagcaataaaatcttaccaaagttcacataatactggtgactggtttgcacttcttgatccaaaacctctttcttatccagtgcatttccttaccaaagtaaaaccatcataactggccaggtcaaggtatgaaaggtgaaagaaaagaacaaatataaactgcacaagcagcagttccaaattggtcccgtcaacagaaaaaagcagaaaagaggaaaacaaggcatagatggccaacgtatgagttaagtacacattttatacaggagagtatccatttctgtttgtgatagtcggcattagataaatcatcttaataatttaccagaggccttgaaattgtgatgttagtacatattttcttctaagtaactaactcaaagctacaggtttaaatacatagtcattttttacacatttaagtggtaccaaaataaaaatcaaagttatttaaaatttgccattataaaacaaactactgtaacaatcatatcaattggttaaaatcatatatagaaaaaacaagaataaatcaaatgaagaagttatcttaagaaaactatggtaaaacaaccagaaaagccagggtttgacacatagtgcacaatatagtataagataccattaagaaaagaaacaaacttacccataaactttcagttactttgaattgtaaaagtctttgaaagtttgtaattataattatcaatctaactcaaataagtaaaagcctttgaaagtttataattataataattaccaatctaactcataactgcatctcatcagatgcttacaaaccagagttcctacagcctacatctcactagttgttacttaatactgaacatagacattataattttttagttttagtacaaaattctaacattttagatgatactacagagatactatcctcaatatgaagtatagaagatcttagatactgactagcctaaaatataatttaccgtcactatgtagaacaagcactgtaaggtggctccaaatacattaaacaagtcacaaagcagaagtaacaagttaaatttttatgccttctgaggatcttctgttactaattcaaactaataattaaaattattattagttatattatacactagacaatgcacaagatatgtttacattagttaaccatgtctatttgccggtcttgactctcctcttctccgattgctcaaaaaagagttaacattagctaaaaaatcttaccattctgaaccaaaaattattagaacttaccatttcaaatgaaaagacatgaggtatacctacaacacagcaggaataataaacaaatcacatcattttataaacacagacatatacacacacaaaagtaccaagactatttaatgacactctcagtagagaatttcattttctaaattctcagaacgtttgagctgtttcttttaacattactctgtataagtactcagcacctaaagtcctctaacatcctctgtatcctccacagtgctcagcactatgttttgaatacaggaaacagtgaacaaatttttcttccaaaatggaaacctcccagacgacctgtaagtctaatactctgaagtaaaaagttaggtgtgttgaaaaccaagcaaaaaaaaattgtttctttggctgcttttaaaaatactcttcattacttaatcacgtatgaagtctataaaaatgtatcagcagttgtacctcaatgccacctatgttttccaaagtgccaaatgtgtaatatctgaggcattaatattcaataaatgccaaggtctagtgatccatacagactgaaaaccataactgagctgcattggcatttgaaaaacaagacttcaaacagctacttaattctctcagtttacatctaagtaactataatatgacaaacataaaattcgtgacctcgaaaaattcagagaacacaattagtagacaacaaagtcagaaaaaaattagaatacaacttggtaaatataaagaataaactatattgaacataaaaaggaccaggtgcagtggctcacacctgtaatcccagcactttgggaggcagaggcaggaggattgctttagcccaggagtttgagatcaacctagggaacacagtgagactccaactctacaaaaaaaatgtttttaattaggaggggctggtgtcacacacctgcagtcccaactacatgggaggctgaggcaggaggatcacttaagctgaggagttcaaggtcacagggcgctatgatcgtgccactgaactccagtctgggtgacacagcgagagcctgtcttaaaaaaattttcggccaggtgtagtggctcactcctgtaatcccaacactttgggaggctgaggtaggtggatcacctgaggacaggggttcgagaccagcctggccaacacggtgaaaccccgtctctaccaaaaatacaaaaattagctgggcatggtggcgggtgcctgtcatcccagctactcgggagggtgaagcagaagaatcacttgaacctgggaggcggaggttgccatgagctgagatcgcgccactgtactccagcctggatgacaagagcaaaacaccgcctcaagaaaacaaaaacaaaaacaaaaaaattttctggccaggcacagtgactcatgcctgtaatcccagcactttgggaggccaaggcaggtggatcacttgaggtaaagagttcaagagcagcctggccaacatggtgaaaccccatctctactaaaaaatacaaaaattagccggatgtagtggcgagcacctgtaatctcagctacttggaaggctgaggcacaagaatcacttgaacccaggaggcagaggttgcagtgagtcaagatcacgccactgcactccagcctgggcaacagagcaagactccctccttaaaaccaatttttaattttaaattattttaatgaaaaagatgacagctggggtgaggaatcagaagaaacacatgacctgagtctgaacagatattctccaaaaggaaaaaagaaaacatgataatttttctggattatgaacctctctgaaactctaacagaaggtaagatcaaaaaaatgttaatcaatacaattaagtgtcctctgatgaagtgtgtacacagtatgagattcagtcatcatttccaagtagtcattcaaaaaagatttacaaatatgaatgataaaacacagaaaaccattactaataatcatagcatatgattaggctaactatacctcctggttcacctaagaaagcccattttatgcctattgtaggaagtattttaatagtatgcatgttcatttgtcccagtttgtatgaaaaattctacggtttcccacacatcattagatattattgaaactattaaataatctttggaggagtgatcaaataactcaacacctggttaaaactgacacataccttcaaccaattatcccaaatcagcaaaatcctacaaatcaattctaagaatatgtgtaaacattacaaacttatatatatgtttgtttttatttgatcacaaaagtctaagttaagttacaattatgtaccgtgccaaatattgagaaaaatccttggcttgtaataaattattttaatgaataagtaaaaacattaacaaccgaaactagtcacaactagaacattacatatgagaccattgcaatgtctgttattatccattttgattttcaccaacatgtccaaaccactgggactaggccatcattataccataaataagcctaccagtccagcaggtcacacttaaatctgacatcaaatccttcagcaaataattctttagttatttccataacttaatgaagaggccataaaaatcccttgtaaaatgtgtcttttgtttgaatgcttcagaagtttagacttcaaaaaacaaatcttcttaagcaacataaattcctcattagagctttaaaaactgtagaaaaagagggacagccatgtggaaaccacaaaactgtaacttctgctctggaatcttcacaaaccatttcagaaaataaatttgtatctattcattagtaaataacaacaggatcactcttctctgacagcataaattaatggaatttttttttttaccagatagagtttctgtttttcagttttacacgtgccacatcagggaaagttaggttatgattaaagcaagagatgatagatgaacaaacaaagaaacaacaacaaaaagcccatgcaagaggcaggaaaagaggctgactggttaaagaacaggccagattggacaatactgatcaagaggggttcacatttgaaagaacagtgctttattcctctactgactagaactaaagggattttggccgggtacggtggctcacacctgtaatcccaacactctgggaagccaaggtgggcgggtcacgaggtcaggagttcgagaccagcctgaccaacatggtgaaaccccatctctaccaaaaatacaaaaactttgccgagcgtgggccgggcgtggtggctcatacatgtaatcccaccactttgggaggccgagcgggcggatcacctgaggtcaagagatcgagaccatcctggccaacatggtgaaaccacatctctactaaaaatacaaaaattacccaggcgtggtggcgcacgcctgtagtcccagctatttgggaggctgaggcaggagaatcacttgaacctgggaggcgggggttggagtgggccgaaatcatgtcactgcactccagcctggcgagacagcaagactccgtctcaaaaataaaaataaaaataaaaataaaaaattagccaatcgtggtggcgcgtgcctgtaatcccagatactcggaaggctgaggcaggagaaacacttgcacctgggaggcagaggttgcagtgagccaagatcacgccactgaactccagcctaagcgacagagcaagactccatctcaaaaacgaaaaaaagattttaaaatcccaggtgtcagctgcaatgcagtgactctttaccatttcttcccattaacttttgctctggtttataaccatgactaccaatgaaccttctggatactaatttggattcctcaggaatccttggatctggaatatgaggtactgtgctcagtgagccttctaaaaacactggaaaagaatatataaatgaatagatttgcattattcttcacaagctctacgagtttggtaatatgagccacttttatagattcccttcaactctcggattcagaggtcagcaaacatttcaggtaaagggtcaggtgtaaatattttttaggcttggcaggccatgtagtctcaatacagtctcacatagttgtgtcacaactactcaaatcagtttttgtagggcaaaataaacaaaacaaaacaaaacaaacaaaaaaaagtgttacaaaaataggcagcatgtgaactgagcctggtctgttctagtctgtcaacccctcgactggatgagacaattaaaattattagaactatgcacgcaaaattaatgcatagtttgagataatatgtcctgcacatatagtctgaaagcccaaatcaaggttgccacacccaaattctgcagggtactattcacgtagaatgtcatactgtttgaaccgtgttctaaagatggatatataaccatatgcagtggtaggcaactgtagtcccactattcaggagactgagacaggaggatagcttcaggaggtcaagaccagcctgggtaacacagggagacccaatcaaaagaaagaaaaaaatgaagaaagatgggtacagcagcatgcctactctcccagctacttgggaggctgaggcaggaagattcacttaagcccaggagtttgaggctgtagtgtgctataatcacacttgtcaatagccactgcactccagcctgggcaacacagcaagataccatcaataaataaataaattgcatcctatataaatcttacaccatgttgaaccacatcaagcatgccttccactaacactcccaggatccatgaaaaattcaactattttcatttcagtatgtctcatttcaatacaaggccagtagttttgaatcttcgctaccaaaaagaaataagcaaggtgtagagttttctttaacacgtatatctcctggtaccaacctagacacactgaatcaaaatacttggaggactgaatctcaggcatttttccttaagttccacaaatatattgcaaggttgaaaactactggatttagcaaaaaaatgtgatcaaagatcaatgtattacaatctacctggatcacaaaacaaatcaattattagtagtatgatctaagaacccacattttttaaaagctccttgagtgtttattacgtacattggaaaaacactgttctgctgggcacagtggcatgtgcttgttgtctcagccactcaggaggatgaggaaagaggactgcttgagcccagcctgggcaacatatcaagaccccatctctaaaagaaaaaaaatgttttacattgtccttggaagaagcactacactgctagcctctgccaacattcccttaatcattctggcctcacagtccctcgggtgctacaatggaatgcctctgacaagcaaagaaatacaactgagtcaaactgttgccttagcatacaacatacctttattctcaagtttattatgtgtgttgaataaactgtgttgaaacacctagggctattcccaactactcaaatgggactaataagctttaatagtaagtcaggtatatatttagttcaatgcaggaaacctgaaaagggtatgaagaattattcttttctttattgaaaaggcaaacattaatatgtaccatacaagaaaaagaaacttctcagctgggtgtggtggctcatgcctgtaatcccagcattttgggaagccaaggcgggcagatcacctgaggtcaggagttcgagactatcctggccaacatggtgaaaccccatctctaccaaaaatacaaaaattagctgggcatggtggcaggcacctgtaatcccagctactcgggaggctaaggcaggagagtcgcttgaacccaggaggcagaggttgcagtgagctgagatcatcccattgcactccagcctgaacgacaagagtgaaactctgcctcaataaataaataaaaaaaaaaagaaacttctcaaattttaaaaccaagtaacatacaatttaaacatcaccccaattttcctaacccaaatatttcataactacatgatacaataactaaagctaaaataagatggacgtttggatatttttatgacattaacattttcccaagaagcaatgtttactccaagaaactgcatcaaccaaatgctagaactaaaatctgtcatttagtccaatgcagatttttcccataaagactggtaagtactgaagtgtttaaactacttaatctacagttggtggagtaacctaatatgaaaacaatcacaagacaattataaaaaacaatctcataaaattctcattgcttccagaataatagcttttaatgtgtccaaaaattgtgataagtagaaaatttccacttagtaaatactgcctggaaaaaaattgaatacactctatattatggtaaagacaaacctaaatgcaattaagacatattattaaaatgtatacattcttaaggcagttgaatgttatcctaaatgagtaaaaaatgttgtttaatttatagttacaacagtaattatcaaaaagtttgtcttctaaggaaaaatcaagtattaaataaaactgacaactgatattgatgaagtactggcttacatccttgaaactcttaaaaatatattcccatgtgtcataaaattatgatcaagttgaaggctgacaaacaaaaagatgaccagatatgacaagtgttttcactctttctttgttacatgaaattattatttaaaatgtgaaatatgtaaatcaatatttattttatacttaaaagtcccataactcttagttttgttggaatatttctattaggaaggcaagaagagagaggtggcatcttaaaattaacaaagaaaatcaactttactcattacttggacaagttgaacacttaccatttgattcctccctttaaactgaacagtgaaataaagagaaagcacataagagggcctaatttcaaagcttaaacacacacacacacacacacacacacacacacacacacacacacacagcattaaaattgtttaacaattttctccaaagacagttttcaaagtaaatgaagaacaactgccagaatggcctcaatgcattcttaatacaatgctttcctattaatatactcccattaacacaaaatatttgagataggtagagctttcattcatattgcttttagtgcttaagtttgcagtagtaagaggcactgtgaagcttggaaccaaataaaactgacaccaaaataatgaaaaacttgtgtagattcatatcacttctaatcacaaataaacttatagaacactagtcagtgttacacaattatcatacctcatttacatactatttgaaatacggatatcccaaaaagttaagagcatagtaactttgtggtctatctaccataaatactaattttaaaattttttaaaaaacataaatattccagcccaggtttccacagacactataaaaaggtcagaaaaaaatattttaagttattgcgagtcacaaatcatttctaatattcttctttcttttgcaataaccctttaaaaacagaagcaccatcagtatctctgtggtggagtaataaaaaccaggcagtagtcccaggctagagcttgccaacttacactctagccaaattaattttatcatgatgcttcaagtatgcgatacatactttaagtaactactagaaaagaaggtatattgtcacctaatgcttttctataagcataatcttatgaaacaatagatgatctattttagaaatgtcggctgggcatggtggctgacacctgtaatcccagcacttttggaggctgaggtgggcagatcacttgaggtaaagagttcgacaccagcctggccaatatagtgaaaccccgtctctactaaaaatacaaaaattagccaggtgtggtggtgcgcacctgtaatcccagctacttgggagactgaggcaggagaatcgcttgaacctgggaggcagaggttgcagtgagctgagattgtgccactgcactccagcctggttgacagagcaagattccgtctcaaaaaaaaaaaaaaggttactaaaatattaaagacaggaagagaaaacctatagactaaaagaggctggatataacagtcaattcaaagaaaccaaatgtttaaaaaaaaaaaaattaagacctgtgcaaatctgggctttaattagttaagatgaaagagctgaccatttttaaaatatgataaagatttttttaaaaagtcctcatcttttagagatacatactgaaaataaaattatatgaaatcaggtatttcaaataacataaattgggaaataaagtggttatacttaaagatgtaaaagattggccatatgtttataagtgttcactacaattcttctgtacatgtctgaaatcttccaaaatagagatgtttcaatattagtatgtggtgaaaatcagtcaagtggaaatgatgtatatatcaagatttctaacttaatagcatatgtttttttaaagatcaaccaaaataataggaaaaaatataacatccacttcataaaacatagatatcttcagaaactaattttactttaccacctatgagaggttaagaaaatcactaatttatcaaacatgatgaatttagaaagattagaaaagactactgtataaaccaaaatctaaagcattctaaatatgcatcataaacctgaaaatataaaatcattttagttaactagtagtttacttacattttccatgtagtttggcttaaagccctcttgctgtcgcctcagttcctcctgttctctgtgtcggatcatttcttcctcacgccgccgatgctcctcttcatgtctgaaaatttttcaaataaaaatttcagcatcataacatgtgggctgccattggacattttacttcatgtaaaatgaaatcatttatgcaatcatattatgccaaacctgtaatcacgactgaccacggcatcctaaatttaccttccttctatgtcactccaagcctttaataaatcaaaaaagccaaagaaataaagtaacttagctaaggtaaaccagaaaaacaaagtaaaatcataactaggatagttatttgcgtatattcaagaaattgagagtcaaaaaaagctgaaacatgtactctcttactatagaaaggaaaaaatctcagccagccatggtggctcacacctgtaatcccagcactttgggaggttgaggcgagtacatcacctgaggtcgggaattcaagacctgcctggccaacatggtgaaaccctatctctactaaaaatacaaaaattagccaggtgtgttataatcccagctactcgagaggctgaggcaccagaataggttgaactcaggaggcagaggttgcagtgagcggagatcgcgcccctgcactccagactgggcaacagtgagaccctgtctcagaaaaaaaaaacaaaaaaacaaaaaaaaaaaaaacagaaaaagtctgagatctactgatctatcactggcactgcacagttcttaaagccactcagaacatatccagagataagccacctcaaaaaaccacaatgcctagacaaaaatcctatttccaaaaggaagccttaccaactcctccctccccatattcatcaacccactgaaagaaatcccctgaagcaggtgtcagtccacaatctgcttttagaaattacgtgttatagcataaacatttacattactgtctatggttacttttaagaggaaaaatctatatagtaatattgaagtaacagactcacattatattggcatttaaaccaatgcaaattcaaatatacacaggttgagtttccctaaaccaaaaatctgaaagcattcttgaatctttctaaacctgaaatgctccaaaatctggatttgttgttgttgttgttgttgttgagacagggtcttactctgtcacccatgctggagtgtcccaatctcagctcagctcactgcagccttgacctcccaggctcaagcaatcctccaatcttagcctcccaagtagctgggactacgggcacgtgccactatgtccagataatgttttgtacttttgtagagacagggtcttgccatgttgcccagactggtcttaaactcctgggctcaagtggtctgcctgcctcaatctcccaaagtgctgggattacaggcgtgagccccaacaccccggctggaacttcctgatagccaacatgatgtttaaaaaaatgctcactggggcatttcagatttaggatgctcacctggtaaacacaatgcaaatactgaaaatgtgaaaaaatccaaaatacttattctggtgttaaacatgtcccataatggatactcaaggtgtatgccctccaccaataaaactgcaaaagtaatttatatagtgaaggctatataaagctgatgccccattattaggtctcgttttccagattactcttataacgtacttttcctacatttagaattgcaaatcctcaaatttcaagataccttgttcttgtttgttgcacaacactcccgctaaatctgagtccactaattcaaagatatggtgatttcttctattaccagagaaaaaactcagaacttcatgtcagacaacatgaacaaaaatgttcctaagggatttcacgcaaaatctggactattttaagattgttgtcttactctctatacaactcttagtataatccttaaaaataatctttaagtaaactggttaatccatttcctggatattaacacatttcatatattttactgtgaagaaagtacttcacattcatgggtgtgggtggcgatgggaagatccaataaaggtcaaatgtgttgaaattcagtttttctcatttaaaaaagggtcaatatactcataatataccaatactacttataaaaagagtcaatatactaataatatacttatatgctcagtgggatctggggcagcaccccataatcaaccacattaatatttctgcagtaagataaaacattcacactctggaggtaataaaggtttcacataacaggagttcagatcaacttttgccatcaaatggattcacgtcagattgccacctgaatgaggatacatagaaaaacttttggcagggcgcggtggctcacgcctgtaatcccacactttgggagcctgaggcaggtgaatcacctgaggtcaggagttcaagactagcctgggcaacatggtaaaaccctgtctctactaaaaatacaaaaatttgctggacgcggtggcacgtgcatgtaatcccagctactcgggaggctgacgcaggagaatcgcttgagcccaggaggcggaggttgcagagagctgagactgcgccactgcactccagcttgcacaatacagcgagactccatctcaaaaaaaaaagaaaaagaaaaagaaaaaaaaaacaccaactttttagtctcaaagcttccgaattacaaagacaatacagtagacacagtgaccttgttgggggcccacttctaccacataattttaaatgaacaagcctatttccagtaaacagaaatgtacgcacaaatgtgcagggacatatgtatacacagatatatattgtggcattatttataaaagcaaaagatcaaggacacattaatcagttataaatgggagacaaggttcactgacaccttgggagacaagaaacacatctgttacagaggtggattactatctactggcatgaaagaatgtctgcgatgcaaatgtcaggaaaaagggcaagtaaaagaatggtattgctattactgcttttaaaaaccatttttatggccgaatttggtggctcacacctgtaatcccaggattactgggattactttgggaggtggaggcagaagcgaaggtgggaggatcacttgagtgacagcctctctccacgaaaaatagaaaatattagccacggccatgcacagtgactcatgtctgtaatcctagcactctgggaggccgagacgggcagatcacttgaggtcagcagttcaagaccagcctggtccacatggtaaaaccccatctctactaaaaatacaaaaaaattacccaggtgtgttggcgcacacctgtaatcccagctactcaggaggatgaggcaggagaatcgctggaacctgggaggcggaggttgcagtgagctgagatcatgccactgcactgcagcctgggtgacagagcaaggctccatttcaaaaacaagaaaaaagaaaaaaaaatatatatatatatatattaggcaggtatggtggcacacgcttgtagtccctgctactagggaggctaaggtgggaagatcacttgaaccccataaggtgagactgcggggagccgtgatcacaccactgcactccattctgggtgacagagtgagattctgtctaaaaaataaaataaaaatgatttttaaaaccatagaagagggtatgaaaaagtttatataccacattggaaatgattaggggaacaggagcattgcccttacgattataccacacagaagattctataatctaaatttaatgacagcatacagaaacattcctgttgtccatatatgtttgctttcaattatttctactccacaaatgctttaatgaccacctttataattatacaaattacctcttcaggtcaaggattgctttctaggttatattcacaaatggaactactaaggagaggagaactagtaattatgacaaattttaaaccttcacgttacatttaattgaaaactaataaaatttcaattttacaatttgttttattttgaggcccattaattatttacaggtctcaaatattcttgcaggattctgaaagacgcctactggatgaaacctccttgctgttattgttcagcactatggctccacatccaacacagagcccaagacagaagaagggctttataataattcgctaaatgacttaagaaaggaagtgggggccaggcgcactggctcacgcctgtaatcccagcactttgggaggccaaggccggcagatcacctgaggtcaggagttcgagacgagcctggccaacatggtgaaaccctgtctctactacaactacaaaaactagcctggcgtggtggcaggtgcctgtaatcccagttacttgggaggctaaggcagcagaatctcttgaacccgggaggcagaggttacagtgagtcaagattgcaccactgtactccagcctgggcgaaagagcaagattccttctcaaaaaaaaaataataagaatataaaaattagccgggcgtggtggcgtgcacttttaattccagctactcaggaggccgaggcaggagaatcacttgaacctgggaagtggaggttgccgtgagccgagatcacaccactgcattacagcctgagcgacagagcgagactccgtctcaaaaaatcaaacaaacaaacaaacaaaaaaaacaaagaaaggaaggaagtggggccgggtgcggtggctcatgcttgtaatcccagcgctttgggaggacaaggtgggctgatcatctgaggtcaagggtttgcgaccagcttggccaacatggtaaaaccacgtctcgactaaaaatacaaaaattagccaggcagggtggtgggcgcctataatcccagctactcgggaggctgaggcaggagaatcacttgaaccgaagaggcagaggttgcagcgaccgagatcgcgccaccgcactccagcctgggcgacaagaacgaaactctgtctcaaaaaacaaaccaaagaaacgaagtgggtaggtgagtaaatgggtggaaagagaaggaatgaaggaataagtgaacaaacaaaacaaaggaataactactaagtggtcaagtcacagactgaaccagttcatgtaagcccctcatcctggtcttcctttggtacctgccacaacctctgaagaattaagttacctatgaaaaactaaataatttatttatagcattgaaagtaaaaccagaaacttgtgtactccaaatacatttctcccaaaatgtactgtcctaggccagtttttctatcttccaactaaagtaaagcacaaaggcagaattcagactatttggcttgttaacaaataaagctatcttacttggcagcagcctcagccagataaatctcttcaatttaattgtgacaattttcttcatttgctccatcttgcaaatatatatgagttcccagacataatctttttttctttcctttatacatactgcaaaactactcaaaaaaaaaattttttttttgagacgcagtcccctctgtcacccaggctggagtgcagtggcgccatctctgctcactgcaagctacgcctcctgggttcaagccattctcctgcctcagactctgagtagctgggactacaggcgcccgccaccacgtccggctaattttttgtatttttagtaaagacagggtttcaccgtgttagctaggatggtctcgatctcctgaccttgtgatccgcctgcctcggcctcccaaagtgctgggattacaggcatgagccaccgcgcccggccaaaaactactcaattttaaggcaagttgttcacacttcttaaatcaagattcttacagctaatttcaaaagaaactccccagccaccaggaaaaactaagattgtaacagatttattactgcctgtatttactagaatttggtcaaacataaaggttacccgtcaaattatcaccttatattgagatattttcagttaattgaattttagattaaatctgatgcccctgtatactgagattacataataaaaaaaatcacgcaataaaaaattacatcttcaggccacgcacagtggctcaagcctgtaatcccagcactttgggaggccgaggcgggcggatcacaaggtcagcagatcgagaccatcctggctaacacagtgaaaccccatctctactaaaaatacaaaaaattagccaggtgtggtgacaggcgcctgtaatcctagctactccggaggctgaggcaggagaatggcatgaacctgggaggcagagcttgcagtgagccgagatcgcgccactgcactccagcctgggcgacagagtgagactccgtctcgaaaaaataaataaaataaaataaaaaattacatctgcaacaagtattccacatctcagcctatgattaaatcagcaacgtatcctctatgtgcctcacgagcttcccctaatattaaccccttgtataaccatagtacaaaattatgaaaaccaggaatgaatactggcacaatattataattaactatagacattactaaaatttcaccagtttcctcactaatctttttttaaagagatagggtcttcctatgttttttgtttgtttgcttgcttgtttatttgttttaagagacagggtcttgctatgtttctgaggctggagtgcagtggctattcacaggcgctatcccactactaatcagcacgggagtttttacctactccatttctgacttgggccagttcacccctccttaggtaacctggtagtcccctgctcccagaaggtcaccatattgatgccaaacttaatgcggacatccaatcgacatagtgcattacagcccagaactcctgggttcaagcaatccgcccacctcagcctcctaagtagctgggaccacaggcccactaacacctttcttctgttccaataccttatccagaatcccacattgcatttagtcgttatttctccttagtctccaacagtctgtaacagttcagtctttctatctttcatgaacctgacactattaaagagaactgattattttgtagaatgtccttgaatttgggtttgttttttctcataactggaatgattatgcatatctggtaagaatatcacagaaataatgttatatcccattcagtgaatcatatcaaggggctcctgatgttaactgtcttattacaggtgatatgaaatttagtgtttggttatggtggtgtctactgggtttctccctttaaatttaatattttttccttttgtatacaaatttgagactatgcaaaaaccctgtttctcaagttttgcccaccaactttggtatccatcaaaaaagcttgtctgtagcaattattattaaagatcgaggcaccagttatgttcattgttactgaagcttctagggcctctcagtagaaaaagccataaaatacagcatatggggcaggcatggtggcacatgcctgtaatatcagcgctttcggaggctgaggcaggaaagatcacttgaggccaggagtttgataccagcctaagcaacatagcataatcccatctctataaaaaaataaaaattaaaaaattagctgggtgtggtggtaaacacctatagtcccagctacttgggaggctaaggcaggattgtttgagctcaggagttcgaggttacagtcagctatgattgagacactgcacttcagcctgagtgacagggcaagaccttgtctcttaaataatttttttaaattaaaaataaaatacagtatatgtatacatattaacccatacataaacacacatctatatttctgcatgtatttgtcaatattaaacaccacagagttcatacctctgattcaaatcacactcacacaggattttaagtttagccgttcatctttctctaatgatgagaaatttgagtctcattatccacaatatacagtcataccttggtatgtgcaggggattggttccagaacctcccccagataccagaatccactgatgctcaactccctgacatatggtgtagtattcgcatataacctatgcacatcctcctacacacttaaaagcatctctacttataatacctaatacaatgtaaagactatgtaaacagcactgtttacagagaacgacaagtaacaaaaagtcctcctacacacttaaaagcatctctagattacttataatacctaacacaatataaaggctatgtaaatagttgttatactgcacggtttagagaatgacaagttagccgggtgcagtggctcacgcctgtaatcccagcactttgggaggctgaggcgggaggatcacaaggtcacgagttcgagaccatcctggctaacacggtgaaaccccgtctctactaaaaatacaaaaaaatagccaggcatggtggcacgcgtctatagtcccagctacttgggaggctgaggcaggagaatggcgtgaactcggaggcgaagcttgcagtgagccgagattgcgccactgcactccagcctgggcgacagagcgagactccatctcaaaaaaaaaaaaaaaagagaatgacaagtttaaaaagtctgttaatgttagtatatacacaatttttccccagatattatcaatccacagttggctgaatccatagatgtagaacccacagatacaaaagactgtaggtactaatctgttcatgtaacgtatacacacaaagtggtttcagaactactagcccatatgcctaactagcttacagaatttatgtatggttcttatcattagtattatgatatccagtcaacacactattttccagttatttaggttccttgttttcttccctaccccctttcaatgtgatgatgttattcatttgtaagacaattaggttaatttcttgtatttttgtatcctattttggaatccacccctcatattgtttggttttaatgatttattttttgcttacatgaggggtaggtataatttcaaaaagcctagctgtcatctctaagttttaagaggaaaaagctagattcaggtaagcctttatgttaggggagaggaggtttcgttgtctttgttaaaaatagaaaagatctggccgggcgtggtggctcacacctgtaatcccagcactttgggaggccgaggcaggtagatcacctgaggacgggagttcaagaccagcctggccaacatggtgaagccccatctctactaaaaatacaaaataaggtgggcatggtggcgcaagcctgtaatcccagctaggaagctgaggcaggagaatcactgggacctgggaggcagaggttacagtgagccaagatcgcaccattgcattcaagcctgggcagcaagagcgaaactccgtctccaaaataaaatttaaaaaaaaagtagaagagatttgaacatgtctatataaaaaggaaaaaagaaaagttttaaaaaaggttcctgaggaaggcacattcatgatgttgagagttgtttaaaaaaaaaaaaaaaaaaacagtagttctcaagctttcagatctatctgaatgctggaggattccaggtggctgggcctcaccactattgtttctcattcagtagttctgcagggaggcttgagactacattcctaacagttccctaggtgaaatgttaatgctgtctgtccagggaatatgatttaagaatgaattggggccgggcacggtggctcacgcctgtaatcccagcactttgggaggccgaggcaggcggatcacctgaggtccggagttcgagaccagcctgaccaacatggagaaaccccgtctctactaaaagtacaaaattagccgagcatggtggcacatgcctgtaatcccagctactcgggaggctgaggcaggagaatggcttgaacccgggaggcggaggttgctgtgagccgagatcgcgccattgcactccagcctgggcaacaagagcgaaactccctctcaaaaaaaaaaaagaatgaattgggtagagtaaaatcacatagaaatatttataaattgataaactcaggtacaaagtttgaagaaatacatcaaaatatacagaatatcacctatctgtagaccagagaagcttcaaatttgttcacggtttttcacttttttctttacttttacttccccatgaacaccttattttcttatcacaagcaccttacatttttaaagcaaatactattttcaaaaacagatttctacatttgctttaactatcatagctttgtttataatatttcctaactagtatgatttttgaacctttgaagagtaatgtttataccattatattttgcaattaaacaccacaggcacaaggtgagctatcaatgtgggtttatatatcttgaattaaccactctctcaaacatgcttacttaaacctaaaagatttcaagctgaccatcacgattgtctattatgtactgagattttaagtccccataaccccttttaacacggagtcaacttccagaaatcttttttttttttttgagatggagtctcactgtgtagcccaggctggagtgcagtggcaagatctcagatcactgcaacctccgcctcctggattcaagcgattctcctgcctcaacgccctgagtagctgggattacaggcgcgtgccaccacagccagctaattttttagttttagtagagacagggtttcaccatgttggccaagctggtctcgaactcctgacctcatgtgatctgcccacctcagcctcccaaagtgctggaattacaggcatgagctactgcccccagcctcagaaatcttgtttaaagattatcagaagcacaaagttacataaagatattcatagtagagttttacacataacaaaataaataagagcaacgcaaatatatccatctctggaaaaatggatattcacagcatattcttataataaattacatataataatacctaaaacccttgtttaacttcaaagtttagcattcaaagtgcccttaaccagctaaaaaccagcaaagaattatgctacattatgaagtaattcactgtatgtggttaaaatgggcaatttttctatttttcctgtgatactcaacttatacaacttgtaacaggttgtggggagtttttattaataagacatacaattcatgtttcttaaaatgatcttcttttaccttagttgtatttgcttccgtttttgcaactcttggtttctgagttcttccaagcgtctgagttcttcttgacgcctcattagatctataaaataatgactgcacattaatatttttagtttccctttccatatttttataccaataagcatagaagttctctatcactggcaatatattggtatattactcattttataataatgtaagctgggtaattaaataaatatcctttctgagcacgtttcttcacgtatataaaaaagagtattcaagttcattcttggccaggtgcggtggcccacgcctacaatcccagtaatttgggaggccaaggcaggcgtatcactcgaggccaggagtttgagaccagcctggccaacaaggcaaaaccccaactctaccaaaactacaaaaattagctgggcatggtggcgcgcgcctgtagtcccagctactcagaaggctgaggcaggagaatcacttgaacccgggaggtggaggatgcaatgagttgagattgtgccactgcactccagcctgaatgacagagcaagactccatctcaaaaacaagttcattgttaggggaaaaacacgtaataaactcatcttggctgggcgcggtggctcacgccttataatcccaacactttgggaagcccaggtgggcaacagagtgagatgactcaatctcaaaaaaaaaaaaaaaacaaacaaataaataaataaaaattcatctttacgtcaagaaattaaaataggtaggctggcttgtgcctgtaatcccagcactttgggaggccgaggcaggcggatcacttcggccgaggagttcgagaccagcctgagtaacacagtgaaaccctgtctacaaaaaatacaaaaatcagggccaggtgtggtgcctcacaggtggaatctcaacactttgggaggccaaggcaggcggatcacctgaggttgggagttcgagaccagcatggccaacatggcgcaaccccatctctactaaaaatacaaaaattagctgggtatggaggtgcacgcctgtaattccagctactcgggagattgagacaggagaatcacttgaatatgggaggcggaggttgcagtgagccaaaattgcgccactgcactccagcctgggttgcacagcagaactgtctctaaaataaaataacaaattgtaattgttttcagcagcaaatgcaaagccccaacacatgccttcagagacaccagcagagagcacttaagaaccagaccaaacaggaatcatgacataaaacccaaggaacctccctcgcaacacgattagcatgaaattcctccctaactaagccaatgtcttacgaagaagagtgaggagacaattcttcaaagaagaaagcaaagataaatgctgatataaacaagacttttcaacaacaaaaaagcatttccactatcaccaatccctgccatatcaagaatgggggggttccagagtaagataatgaaaagtacatttgtattgcacatctaagaagtagtgtataaactttccacgttaaaaatctccaaagctaaaaatctttgtgtgtgattttgtataaaattatgtatgtatatatgcatatattttaaaataataaaatgttaaaatactctggatggcacaattgctggttgcttttattttccttttctctttatatctgaaatgtctaaagtgaacaaattacctcaactgaatgtttcttaataaacacctgtactcaagagttgactcatataatactacagctaaagttaatctaaggtaccaataacccaaacttcataacaatagcaagacaggcatcataaccataacaaggtaaatattgttctccccattttacagattaaaaacagacatttataaattatgcaaaaaaaaaggattcagacagattataaagttgctccagctattacatgattcaactgggatgccaggccaaacctctccttattccaaagctctttcaaaaaagtatgccaaacctagttgatcagactcaattggaaaacttaaaaatatgcatttggggatgttgctaagaaaagtctgttttggtatatgagacagggcccaggtagttctcataataggcccatagagaaaacacttgattatctgaaaaatgttaaacatgaccgcaattatttcgaacctttataacataattctcaaccttaaatactcattagaattacttaaatacctgaccagtatttaagtaatggctcacacctgtaatcccagcactttgggaggctgaggcaggcggatcacctgaggtcgggagttggaggccagcctgaccaacatggagaaaccccgtctctactaaaaacacaaaaattagccaggcgtggtggcgcatgcctgtaatcagagctactcaggaggcttaggcaggagaatcacttgaacccgggaggcggaggctgcagtgggctgaggtcacaccattgcactccagcctgggcaacaagagcgaaactccatctcaaaaacaaaaaaattacttaaataccttttttgttttttctctcagagacagggtctcactctggcacccaggctggagtagagtggcatgatggtagctcactacagcctcaaaaacctgggctcaagagatcttcccacctcagtctccccaacagccaggactgacaggcttttaacctctcagatcttatcaccttacttgtaacactggtataattagctcaaaggctccaacaatgaaattatcaaataagcacaattacctaatacttaaaagaactataaacttaaaactaccattttatgttgactaaattatatattttttaaagttcctaatacccaaagttcctgatatttcactaaagcttatacatctgtacactgccatgataatatctttctaggggaaaaaactgtaaaaagtacataactagagatgtctttttttttcttttttttcttttttttgagacagagtctcgctttgttgcccaggctggaatgcaatggcgaggtctcggctcactgcaacctctgcctaccaggttcaagcaattctcctgcctcagcctcccaagtagctgggattataggcgcccacaaccgcgcccagctaatttttgtatttttagtagagatgaggtttcaccatcttggccaggctggtcttgaactcgtaaccttgtgatccacccgccttggccttccaaagtgctgggattaaaggcgtgagccaccgcgcccggcccaactagagatgtctttatcttttgatccaggaaattacactcaggaatttttcttaataaaataaagccatctacagtcatgaaggcatcatctaccgtattacttattacttactaaaccaaataacactttgaaatgctttcctggctgggcacagtggcttaccaaagtgggaggctgcctcggcctccgaaagtaatcccagcactttgggaggctgaggcgggtggatcacttgaggtcaggagtttgagacctgcctggccaacatggcaaaatactgtctctattaaaactacaaaaataagccgggcatggtggcacacgcctgtagtcccagctactcaaggaggatgaggcagaagaatcacttgaacctgggaggcacaggttgcagtgagcagagattatgccaacgcagtccagcctgggtgacacagcaagactgtctcaaattaattaattaattaaaatgctgtcctaacaaatttaatgataaaattacatgaaattatatgctataatttcaatgtatcataaatacaggtacagaaaaaaggaatataaacaaactaaaattttgatttgctagactgtaagacagtgttttctcaatttaaaattgcacaagtcatgaaaactgaatgtataacttctgatctaacaattttattttctaaaaatactagtctctttatttttctttcagtttttattttaccgctgatctgtccagatttatgacactgaattaatttttttttttttttttgagatgggagtctcgctctgtcgccctggctggagtgcagtggcgtgatctcggctcactgcaacctccacctcctgggttcaagcaattctcccgcctcagcctcccaagtagctgggactacaggcgcatgccaccaggcctggctaatttttcgtatttccaatagagatggggtttcaccatgttagccaggatggtctcgatctcctgtcggcattaatgttctttaatcataaacctcacatgtatttaaatcctaatatctcaagtaggttcaggcatgactgttctgttcttcacttatgtgatgtttatcctctgttgatttctttaagaagggctcacagcaacatatttgttttgttttttgtttttttttttttttgagacggagtctcgctctgtcgccaggctggagtgcggtggtgcgatcttggctcactgcaacctccgactccctagttcaagcaattctcctgcctcagctacccgagcagctcacacctataatcctagcactttgggaggctgaggtgggcggatcacgaggtcaggagttcaagatcagcctgaccaacatggtgaaaccccatctctactactaatacaaaaattagccgactgtggtggcatgcacctgtaatccaggctactcaagaggctgaggcaggagaatcacttgaaacacagaggcagaggttgcagcaagccgagattgcgccactgcactccagcctgggcaacagagcgagactccgtctctaaataaataaataaatgttaaaaaaaaataaatgtaatggagccaggcgcagtggctcacgcctgtaatcctgacactttgggaggctgaggcgggcagatcacttgaggccaggagtttgaggccagcctggccaacatggcaaagccctgtctctaccaaaaatacaaaaattagccgggtatggtggctcatgcctgagggaggagaatcacttgaacccgggaaccggaggttgtagtgagctgagattgtgccactgaacaccagcctgggcaacagagtgagactccatctcaaaaaaaaatttttttttaatgtaatgggagttgaatctagaaaggactaaataattatcagtaaagtataaatcaaacaattattattgtaaggtacccatgtgttcaataagaatcaacatttacggctgggtgtggtggctcacgcctgtaaccccaacaccttgggaggctgaggcggatggatcacttgaggtcaggagttcgagaccagcctgaccaacatggagaaaccccatctctactaaaatacaaaattagccaggcgtggtggcgcatgcctgtaatcccagctactcaagaggctgaggcaggagactcgcttgaacccaggaggtggaggttgcagtatgccgagatggcgccatttcactccagcctgggcaacaagagtgaaactccgtctcaaaaaaataaaaaaaaatcaacatttacaaaaattttctgatacatgcatatatattctttgcagcactgcttttaaaaacaaactgaaaagagaaattgttatcgaaagaggatgaactaaactaattgtacccatataaaagaatatcatacaaccattaaaaatataaggcggatatttacatatatattcatgtagaaagtaaaaaaggtacagaaaaggtaaacagcttttttttagagacagagtctcgttctgtcatccaggctggagtacagtggcataattacagctcactacagcctcaagctcccaggctcaagtgatcctcccacctaagccttcccaagtagctgcaactacagacacatgccaccatgcccagctaatttctgtacttttggtagagacggggtctcactgtgttactgaggttagtcttgaactgctggactcaagcaatcctcccacctcagcttcccagtgctagaattacaggcatgagccactacacccagccagtttgttttgttgttacgatttttgggttttttgcttacaaatacacaaaaacatctaatgacatatgcaaattttttttcattaaagaatacaaaagagacttaaaatacaaaaagtgattcctacaaaaaagcagaaggtagtaaatagggggacaatttttctgtattgtttgagatttctccttccatgatatgtcatgatacatgtttctgcggaaccacacaactaagattaattacagtctctcctcaacctgaatacatccttagaaatgctggatgaaatacaaaattgtaggccgggtacagtggcttatgcctgtaatcccagcactgtgggaggtcaaggcaggtagatcacttgaggtcaggagttcgaaaccagcttgaccaacatgatgaaaccccatctctactaaaaatacaaaattagctgggcgtggtggtgtacacctgtaatcctagctacttgggatgctgaggcaggagaatcgcttgaactcagaaggcaagaggtaggtctacaatgagctgaagttgcaccactgcactccagcttgggcgaagagcaagagtctgtctcaaaaaaagaaaaaaaaaaagaaatacaaaattgtagaacaaatgggagaaagttgtaactttttaaatttttaaacaaactacaactgaaatttaccaattgcagactttggatcaaataagtacaagtacttcggcacaagtgaacccagaagcagggagtaggattcaacaagcaatgtgattttctaatattataaactaagatattgttaacagaggctttaaatgaacacacacgataaacaacaaaaaaactcatgggaaataactgcaaaattactctacttcaaacatcaaaataccttcaggcaaagttttctaagagctcaagaaaaaactgaagtctaaggaaatgttctttgccatcaatatatcctcagtacctcagacatgtctcccataactgacattaaagatgtgctaaattagtgaatgttataccactgttcgtagcatcaacacaaatctttagtacagatgcttccacatctaatcaacattgttatctaactagggcacaactgtaggtaggtgggaaacaaaatggcagagaagtgcctagcaggctaagagaaaacaattcatattgaacagaagggctagggtaaccacagagcccaggaaacgaaatttcaaaaatttccaagatgattctaatgggtaataaaatttcaaaaccactggactggacaaactttaagatctcttggctgggcacggtggctcatatctgtaatcccagcactatgggaggccaaggtgggtagatcactcgaggctaggagttcaagaccagcttggccaacatggagaaatcccatctctactaaaaatacaaaaaaactggccaggcacagtggctcatgcctgcaatcccagcactttgggaggccgaggcgggcggatcacctgaggtcaggagttcaagagcagcctggccaacatggtaaaaccccatctctactaaaaatacaaaaaattagccgagtgtagaggcatacacttgtaatcccagccacttaggaggcggaggcaggaggattacttgaacccccgaggtggaggttgcagtgagctaagatcacaccaatgcactccagcctgggcgacaacagtgagactccatctcaaattttaaaaaagcaaaaaaattagctgggcgtggtagcacgcacctgtagtcccagggagggtgtactagggagggtgaggcacgagaattgcctcaacatgggaggcggaagttgcagtgtgccgagatcatgccactgcactccaggctgggcgacagagtgagattctgtctcaaaaaaaaaaaaaaaaatctctcttccagatctaacagctaatgaatgattcagtacctttatctcaaataacaacttgcacattttccacaaaataaaagacagtttatctttttttttttttttgaaatggagtctcgctctgtctgtcgcccaggctggagtgcagtggcgtgatctcggcttaccgcaacctccacctcctgggttcaagtaattccctgcctcccaagtagctgggattacaggcgcccgccaccacatctggctaatgacagtttacctttaaatctactctaagatataaatgaattcaattttgttagaaaagtgaacttatagaactaccaagcttagggtccaaattaaaccaaaacacctaactagtttctatggtttgctgggctcgattttgttttaacgtatgtggcatcagcacagttactcaatgacttcatcataagtgctcaataaacatttactgaatagtgatgtacgaaatactagaacacacataacaaaaaaacctacacttcattctaaagcaagtgagaatttacccaaaaggatttagagaagaatgatcaaaatttcacctgctaagaaaaatactgaatctagtacacagaacggtttaaagaaagccaagattagatggcagaaacgttcagcaggaatgctactgcagaaattcagacaggcagctgtggtaccttgatctctggggacagccaagagaaggtaaatacaaaaaaactagccggacattgtggtgtgtgcctgtaatcccagctactcgggaggctgaggcaggagaattgcttgaacccaggtggtggaggctgcagggagacaatatggcgccactgcactccagcctgggcaacagagcaagactccatctcaaaaaaaacaaaaaacaaacaaacaaaaatatatatatatatatacacttaccaattactaacttttcctaaatccccatatcaatgtgtacaaatgaatctttttcatctctaccagattatccatctgtactctttcaaacatgtaataataatcttaaatagccagcatttgtccaaattcttctcatcaaacaaaaaatcctgtatgtgccatgtctacctaccaaaatttgcctgctatgtttctgtttgccaagagaatcatgtatttgatactggcacaatttaatacccgcaaattacctccaacactactgcttgcataagtaaaactaactttttaattttttttttgagacagttttgctcttgttgcccaggctggagcacaatgatgcgatctcagctcacagcaacctctacctcccgggttcaagcaattctcctgcctcagcctcccaactagctgggattacaggtgcgcaccaccacggctggctaattttgtatttttagtagagatggggtttctccaggttggtcaggcaggtctcgaactcccgacctcaggtgatccatctgccttggccccccaaagtgctgggattacaggcgtgagccaccgcgcccgtcaagtaaaactaacttttagtaagttgtgttcttttttttaagggaagttatctgggaaaagggagattttcacacctaatatgttgagttccaactttacctctaaactcctaaatggcactttacacagtagtacatgaatggtacacacacttaagggaaaaaaaaaatcataccacatgtacatgaaaatccatatttaccttgcctcattagcattaattggtgttcatgcctagctgcttccatttctgcctccagtttctctttggcttctctgatgtttctatcaacctgctcacgctgctgcttttccatttcatcaagagccttccatcgagatgcatactcaaattcaaatgtcccaggttgagcaaaacgtggtggttgttctctttccctaaattaacattaaaacatacagaaatgtatgcttaaaaggtaaaacaacaacaaatgagaacaacaagcacttacaatgtccaagacaccgtgtgagacaccgtgtctacatgaattacctcgtgacaatattgtgattacaggcctgagtttaagaactgcccaagaatgttcaactaataatggaacaataattcaaacttacacaatctgatgccacaacctgcattctcctaattattacctgcaaaatttctgcttttggaggtttcattttctggttttcagtcaacaaaatactttacaggccgggcgcagtggctcatgcctgtaatcccagcgcttcgggaggccgaggcgggcagatcacgaggtcaggatatcaagaccatcctggctaacgttgtgaaatcccgtctctactaaaaatacaaaaaaattagccgggcgtggtggcaggcacctgtagtcccagctactcgggaggctgaggcaggagaatggcatgaacccaggaggcagagcttatagtgagctgagatcctgccactgcactcctgcctgggtgacagagcgagactccgtcccaaaaaaaagaaatattttacaaaggaaagtctggaacacatgaatatgaattaactgtctggatcagatgtttttctagtaaaaccagctagattttactgagcgttatgtgccaattaattgggtaggccccaaaaatcaaggcctaacttactaccattgtagttaattatttattacctctttctcttgatagactttaaactcaattgacgacatcaaatgtggctgttaaatgctgtaccaccacctcaagtacctagagtgcagtatatacatttaatatacatttcttgaataaattaacgaattaccaaataaagggctatgaatatatttgaaagtcttcatttttttcatatatacatatatatgtaaatatttattttagagacatataaaaaatatgactgatctcaaactcctggcctcaagtaatactcattcctcagcctccaaaagtgcaaaattacaggtacaagacaccacacctggtccccagtcaatttttttttcacttttttatttatttatttatttatttttgagacacagtctcacagtattgcccaggctggagtgcaatggtataatctcagctcactgcaaccttcgcctcccgggttcgcaccattctcccgcctcagcttcccgagtagctcggattacaggcgtccgccaccatgcttggcttattttttgtaatttttagtagagacggggtttcactatgttggccaggctggtcttgaactcctgaccctgtgatccacccatctcggtctcccaaagttctgggattacaggcgtgagccaccgtgcccagcctttcttttcacttttaagaatttttgttgttggaggtgttgctttgggtttttctgagatagggtcttgctcagtttcacaggagtgtagtggcacaattaagactcactgccgagactgggcacggtaggtcacacttgtaatcccagccctttgggaggctgagacaggcggatcacaacaccaggagttcaagaccagcctggccaacatggcgaaaccgcccctctctactaaaattacaaaaatcagccaggcgtggtggcgggtgcctgcgatcccagctactcaggaggctaaggcaggagaatcgcttgaactcgggagacggaggttacagtgagccgagattgtgccactgcactccagcctgggcaacaagagcaagactccatctcaaaaaaaaaaaaaaaaaaaaggctcacttgccaaatcaacctcccaggctcaagcagtcctcccacctgaggctacagagcacctagaactacagaggcatgccaccatgaccagctaatttttgtattttttgtagagatgaggtaccactacgtttgttgcccaggctggtctcaaactcctggaagcaatgcttctgcctcccaaagtgctgggattacaggtgggagccaccacacccagccaactttcaagaaatttctgcataaatatcttcaattagtctcgcctataacagcctgtatttaaaagtactcatgggaaaacaattcccactccatgaataaaagcatagataccttgctataaatgtaaattttaacttttattttggggtagggaggtgaggaggggtgggtatgacaaatctaggagagaagaaggctgtcacagagggaaagatgtaataacaagagagggaaagatattcagaagcatgtgaagaaaaatcaaagacagccatgatcctagggactctatatctgaaaaccctacttggatttttttctttttaaagcactgactggaaagtgggaaagattgggagaatctaccaaccactaatttttctaaaagaattgtttactggtcagcagttccaaagtcaaagactgactatatttttaaattatttattttctttcaaaggaaaaaaaaaccactgaaataacatgattttttgaaggtgcaagtgaatttgaattttggcttttttgctttgtgagcattttctttttctttctttcttttttttttcctgaaacagtttcattcttgtagcccaggctggaatgcaatggcgccatcttggctcactgcaacctccgcctcctgggttcaagcgattctcctgcctcagcctcccaaatagctgggattacaggctcctgccaccacacccagctaattttttgtagttttagtagagacggggtttcaccatgttggccaggctggtctccaactcctgatctcaggtgatccacccactttggcctcccaaagtgcagggattacaggtgtgaggcactgcgcccagccttgtgagcattttcttctgtgaataaatctaaatctttagtaataaaagtgggaatataactaactcctttttttttttttttttgagacagtctcgctctgtcacccaggctggagtgcagtggcacaatctccactccacctcccggattcaagcgattctcctgcctcagcctcccgaatagctgggattacaggtgcacgccaccacgtctggctaatttttgtatttttagtagagacagggtttcaccatgttggccaggctggtctcgaactcctgacctcaggtgatccacccacctcggcctcccaaagtgctgggattacaggcgtgagccaccacgcccagccataactagctcttaagttttgctgatatcattaactatataaacaaatattgcctataaagtctattcttgttaacaaccttgtacttctagttctctaactcccaaatccaaacgtatgctttatttcaaatttgtaatggtgacctataacaaggaaaaagttaagtgaagaggaaatcacaggaaccctttaaaaaaaatggcattgtggccaggtgcagtgcctcacacctgtaaacccaacactttgagaggccaatgcaggcagatcgcttgagcccaggagttcgagaccacgctgagcaacatgacaaaactctgtctttacaaaataattaaaaaatgagacgggcatggtggcccacatctgtagtcccagctacttggggggtgctgaggtggaaggatcacttgagaccaggaggtagaggctgcagtgagccatgaccatgccattgcactgcagtctgggcaacagggccagaccctgtctcaaaaaaaaaaagaaaagaaaagaaaagaaagagaaatagcattgcaaaggaaataagaatagatattaattaggctgggcatggtggctcacgcctgtaatcccagcactttgggaggctgacgcaggcagatcacaaggtcgggagttcgagaccaacctggccaacatagtgaaactccatctctactaaaaatacaacaattagctgagcatggttatgtgcgcctgtagtctcagctacttgggaggctgaggcaggagaatcacttgaacctgggaggcggaggttgtggtgagccaagatcgcgccactgcactccagcctaggcaataagagagaaactccatctcaaaaaaaaaaaaaacaatagatatgaattataatcaacgctaatgctaatgcttcctccctgaaatactctcctcccttgcttccaggacacagtctgatggttcttccccctattccaatgaatgaatgctcccttctcagtcgttattgattccttctgatcttcccaatctctacacactgaagaactccaaggttcaaggtttggtcctttgactttaaaatatcatgttcataaatccagccaggacagttgctctaaatcctagttataaatccaactacctgcttgactacactgctagcacctagaacagtggctaacacaaaggcactccaagttttatttatctaataaacaagtgggccgggcgcagtggctcacatctgtaatcccagcaccttgggaggccaaggtgggtggatcacccaaggtcaggagttcgagtccagcctggccattatggtaaaaccccgtctctactaaaaatacaaaaattagctgggtgtggtggtgcacgcctgtaatcccagctactcagggagggtgagggacaagaatcacttgaactcgggaggtggaggttgcagtgagctgagactgcaccactgcactccagcctggatgacaaagtgagactgtctcaaaaaataaataagtaggcctttgagcccctatgctcaggcccactcccagactgtggagtggtactttcattttcaataaaacccttcgctccttccttgctttgagcattttgtccaattctttgttcaagacgccaagaacttggatactctccaccgttaacatattttggtgagccagccaggaggaagagtcaagcaggttcactacggccactcagggagcgagaactcagaagcctggcatgctggcaaaagggtaaagaaaacctttttttttttgagacggagtctcactgtcatccaggctggagtgtggtggcgcgatcttggctcaccacaacctccgcctcctgggttcaagcaattctcccgcctcagcctcctgagtagctagaattacagatgcgtgccaccacacccggctgatttttgtaattttagtagagacgggggtttcaccatgttaggctggtctcaaactcctgacctcgtgatctgcccgcctcggcctcccaaagtgctaggattacacgtgtaagccactgtgcccggccctaagaaagcgttttatggtttgaatcttctggaaacgtcaaagacagtcagtcgccgggcatggtggctcacgcctgtaatcccagcactctgggaggccaaggcaggcggatcacaaggtcaggaaatcgagaccatcctggctaacacggtgaaaccccgtctctactaaaaatacaaaaaaattagccgggcatggtggcacgtgcctacagtcccagctacttgggatgctgaggcaggcgaattgcttgaacctgggaggcgggggttgcagtgagctgagatcgtgccactgcactccagcctgggcaatggagtgagactccgtctcaaaaaaaaaaaaaaaaaagaaagaaagactgtccttgccatccacaccacaacaaagctttgggaccttgaactttgggttcatggtctcacaactgagaagggtccctccacacttttggaactgtgcacccactggaacccttgacagaccatcaagcttcagatgaccatgcaacaaaggctccagccagttccaggcaaagacaccacccctagccatcaagaaactaccctgcctccattagatagagcagggcgagagttccgtgatccccaataggtagagactatgccccaagtcagcatgaagcagttacagaaaaaaagaccatcggtccctctgcctcccataaagatttatgaggatcacatctctaagtggagagatgaggcaggaaaatacagtctggaagcagggaacagaagaccaattcacaattcagctataacaggaaatatcctctccataggacatacaccgagtaaatgacttgtaactttacctcatcctcttcatttacataaggcataccccaagtagagggtatttaaactcacaaaaactctgtaacagggcctttgagcccctatgctcaggcccacactgcagagtgtactttcattttcaataaaacccttcattcctcccctgcaaaaaaataaataagtaagtgactggtttttaaaaatataataagctctgcaaaagtaattggagaggaaagggaggtgggacaggcagagaacagaactggaggcagtccatctagggaatgggactgtgaggccatacttgtgaaacatctggactgctattctaggacttttatttgatgtgttcgttgcacagctgtttgaaatgtttaataaagctttataaacttaaaaaaaaaatgcactcggctgggtgcggtggctcacgcctgtaatcccagcactttgggaggccgaggtgggtggatcacgaggtcaggagatcgagaccatcctggctaacatggtgaaaccccgtctctactaaaatacaaaaaactagccaggcatggtggtgggcgcctgtggtcccagctactcgggaggctgaggcaggagaatggtgtgaacccgggagatggagcttgcagtgagccgagatcgtgccactgcactccagcctgggcaacagagtgagactccgtctcaaaaaaaaaaaagtgcactcatataggcaatttatgtaaatatacttgtattattctaagtgaaaagggaaaataaacatacattttgaaaatgagctattttttgcaacctctaagagtttttccgctgtgccaggttatttaactaggaataccctgctctaccctggcacaccaaaaatctccttttaacctacaatagacttgaagcacaaaataaaacttaagaagtatttccagctgggcgtggtggctcacacctgtaatcctagcactttgggaggcctaggcgggtagatcacctgagatcaggagtttgagaccagcctggccaacatggcgaaaccccatctctactgaaaacacaaaaaaattagtcgggcgtggtggcgcacacctgtaatcccagctactcgggaggctgaggaaggagaattgcttgaacctgggaggtggaggttgcagtgagccgagttcacgccactgcactccagcctgtgctacaggagtaagactccatctcaaaaacaaaaaaaaaaaaagtattttcatgttatctagatttcatcgtttttctggcatgaatattattgacagtgtcctcctagtaccctccctgccccagttataaaagtagacatttctaaaaaaaattagtatgttttacccatataaaaaaagaaaactattagctgggcatggtggtgcgtgcctgtaatcccagctactcaggagtctgaggcacgagaatcacttgaacgtgggaggtagagattacagggagccaagatcacaccactgcactccagcctgggcgacagagcaagatactatctcaaaaaaaacaaaaagaaagaaagaaaagaaaactagcattccatgtagactagaccactctattacccagattatataaataaacagaacacctcataatccaatatttgaaaacaaatgtaatgaacacccttaatagtacagacacaaattatctattaataaaatcttacttatgatattgttgagttttctgcatcagcttctctggcaagccatcttcatcatcaaactgctccatgggttccacaatgactggacgaggggtcctggataggtataaaagcattcataaaaattaacacagtgccaagaattaataccgtcttaaaagaaatgttttataataataaagatatatacttagaaaatgtctcacttgagaaaaatgtctcagaagtatcatttgtactcataaaaatcagtcaacagccgaagcagtggctcacgcctgtaatcccagtactttgggaggccaaggagggcacatcatttgaggtcaggagttcaagaccatccaggccaacatggtgaaattccatctctagtaaaaatacaaaaaattagccgggcattgtggtgtgtgcctgtaatcccagctactgaggacgctgaggcaggagaactgcttgaaccccagaggcagaggttgaagtgagtcaagatcgcatcactgcactccagcctgggcaacacagcaagactccatcacaaaaaaaaaaaaaaatcagtcaataaacatttactgagtcagagagaggtgaatgtcaaaagccacaaaaagatgagtaaataaagcaacaattatgaaccagcataacggttatagttaacatttagaaagtataatgaaaacgaatttgtacctaacccatgttttatatgtgtggtcatcatcacagccactgcttcagctattgattgatttttatgagtacaaatgatacttctgagacatttttctcaagtgagacattttctaaatatatatctttatcatcaacatgtcccaccacctcaacccacccatctgtacccaccacccagtttccctgtatctatcagtattgttcagaaagttcttaaaaatgttggccagcaggaacagtggctcacacctgtaatcccagcactttggaaggccaaggcaggcggactacctcaggtcaagagtttgagaccaacatggccaacgtggtgaaaccccgtttctactaaaactacaaaatttagccaggcgtggtggcacacgcctgtagtcccagctactcaggaggctgaggtatgagaatcgcctgaactcaggaggcagaggttgcagtgagtggcgatcgcaccactgtactccagcctgggcgacagagtgagactctgtcaccaaaaaaaaaaaaaaagttaaagctgaaaatccgacctaaaacatttcggcgaagtggctcaaacctgtaattctagagctttgggaagcagaggcggggaagatggcttgagcccagaaattcaagatcagcctgggaaagatgacgagatcctgtctctataaaaaattttaaaattagccgggcacagtggctcacgcctgtaatcccagcactttggtaggctgaggcgggtggatcacaagatcaggagtttgagaccagcctgaccaacatggtgaaacctcgtctctactaaaaatacaaaaaattagccgggcgtggtggtgcacgcctgtaatcccagctacttaggaggctgaggcaggagaatcgcttgaatccgggagacggaggttgcagtgagccaagatcacgccactgcactccagcccaggcgacagagtgaaactccgtctcaaattaaaaaaaaaaaaaatttaaaattagccaggtagcatacactactcaggaggctgaggtgggaagatcacttgagcccaggaatttgaggctgcagtgagctatgatagagccactgcactctaacctgggcaataaggcaagatgtcatctctaaataaaaataaaaataaaagatgttagccagacaaaaagggaaaaagggaaggcagaagacaccagacattcaaggagaaaagctgggataaggaaatgacaagagtgggtaatgaaagatatgactagaggccctccttctttactgttttcttcagtaaaataggagaaaaggagagttcatggaggggaagaggaataagcagaatggatggcacactgatattaaaatttcctttgagatcggctcttcaccatgcaaggggcattaaaatctatttatactaccttcaaaacagtgatgcttcagagagaaaaaactaagctagagagatgaagggtttttggactccaaaagcttctcttacacataataccagagattaacacagactttagatcctaaatgtaagaaaagatacaaaataacttttcaaaattattactgagttagtgaagacattttaaggaaacagttaaagcaggtatggaatatcatggagtggtggaatgagattatagaaacctcagataaactgaataggaacccaaaggtaaagagacttaagatgtggtacttctaaaagtacccaaaaaggcccagggccaaaatgaagatgatgcattttatggaccattcatccgctggaagctatggcagggccacaaacatagaacagtaacagaatcagataaaaggtgcacctgagcagaggccaacaaagaaacaagcaaacccctccagtaacacaagaccatcccccttcagagaaacttcagaaacagaattaagagggaaaaatgaactaagcagatgatatgtcattcatcagaaatgacaaaagtatatgaagccaagggaaaccgtaatcagaattaagggaaaactctgacatctctgtactctcaaatatgttagagattttaacaaattgtaaacttttcacatgtaagtttggaccactagacaactcttacacagtgcgggagaggagaagtacagatttctaagagggaacttaatcgatacaaacaagtttataaagtctccctctaccactctatatatcatcttgctcctacaattccacttctgaagaaacataaaccagtgagcaaagatcaatcaggctgggcgtggtggctcacgcctgtaaccccagcactttgggaggccgaggtgcgtggatcacgaggtcaggagtttgagaccagtctggccaatatagtgaaatgccatctctactaaaaaaaataacaaaaattagccaggcgtggtggcacacgcctgtagtcccagctactcgggaggctgaggcagtagaatcgctggaacctgggaggcagaggttgcagtgagccgagatcgtgccattgcactccagccaggatgatacaacgagactccgtctcagaaaaaaagatcaatcacaaccacattcatctaattacacaacataaaaagaccaaggaacatgggtacgtattgtgtacaagggaattacttaagggactgtgtcttatttttatttattggaacacatgctaaaatgtgtttctatctatggtttcattgtacatacaccactccctatagaagctccctttgtccattttctgactcatcttgtttatttcactttcatctttaggtataaccaaaatttgttaaactcaacctaaggccgggcacggtggctcacagctgtaatcccagcactttgggaggccaaggcaggtggatcactcaggagtttgagaccagcctgaccaacatggtgaaaccccgtctctactaaatacaaaaaattagctgggtatggtggtacatgcctgtagtcccagctacttgggaggctgaggcaggataatcacttgaacccaggaagcagaggttgcagtgagctgagaccgcggcattgcactctagcctaggcaacaagagcaaaactgtttccaaaaaaaaaaaaactcaacttaaattctgtttaccataggtataataactacatttattcttttttcttgagacagtgtctcactctgttgtctaggctggagtgcagtggggcgatcacagctcactgcagcctcaacctcctgggctcaagatatcctctcgcttcagcctcccaaagtgctgggattataggcatgagtgactacgtctgtccaggttactctttttgcaaatataagtatataataagtacaaaacagatcaaaaagaaacaaatcaaagtgttcaaccataatgttaaatctgaagttactgcttgggtttttgtttttctccccattttaccaccaagtcaatcattagtttggttataaacttgaaggactgagagagagaggcttcgggactgaggccctggggtttacagcaggttatgagctgcatagcctttggctaggaggttcctgcgctagctgaagttttctctgaagttttctcatcggtaaaatgggatatcagtgcatcatagggttgttatgataacgaaagaagaaaggtagggcacttagcacagttcttggtaaagagagttcattaaatcaaagtgaactcggccaggcgtggtggctcacgttggtaatctcaacgccttgggaggccaaggcaagtgtatcacctgaagttaggagtttgagaccagcctggccaacatggtaaaaccccatctctactaatacaaaaaattggccgggcatggtggccgggcagcggctgtggtcccaactactcaggagactgaggaacgagaattgcttgaatccaggaggtggaagttgcagtgagcagagatcacaccactgcactccagcctgggcagcagactgaaaccctgtctcggaaaaaaagaaactgaaggtttttttcagggggtaagagagagaaaaagtatttcagtgttctttcaggcttgaaaatactaaaatttaaagtgttaatttatttacaaaaaaacttgaaaaatgtttcattgtgaaaaaacttaaatagcaagtattgcagaagaaacaaggcccctgaaatcctaacatatggagaggagctctgatcacatttttgtgaaaaccacttaagacttgcctttctgttggatatatgcataagtttacataaaatgaattacctatacatgctttttttcagatatccaatgtactcaatgtaaaatggcaccattttacgcactgcatgcatgcacaataatttttttaaccataccaactggtatacatctggggttttcatgttttctgtaattatatataacatcaactacgtatttgtgactgatctttcctcattgtggctgatcttttcttagaactgtggaaacaaggtaaaatatacagtactaaaaaaaacatggtgacttaagggctgggcaaggtggcttttgcctgtaatcccagcactctggcagactgaagtgggaggatcatttgaggccaggaattccaggttacaatgagctatgatcgtgccactgcactccaacctgggtaagagcagaacttgccttaaaaaaaaaaaaaaaaaaaggtggcttaaaagataatgcaatattttgcacatgtaatttcttttttttgagacagggtcttgttctattgcccaggctgccatgcagtggcatgatcactgctcattgcagcctcgacctacaaggctcaagtgatcctcccacctcagcctcccacgtacctgggactacaagtgtgcaccaccatgcttagctaatttttttatttttcttttgtagagatagggttttgccatgttgcccaagctacacataatttttaaaacgaagaatgtgtaatgatgatgacaatttatttctgcactgaatcacccttatagacatgtaccattttgtgatggtttttcattttagctcagttgcatatttataagcatggttgagaatagttgaatagtaatgataaaataattatcaggatgcagccacgacaaacatggtgaaaccctgtctccagtaaaaattcaaaagttagctgggtgtggtggtgcgcacctgtaatcacagctactcaggaggttgaggcacaggaatcacttgaacccagaaggcagaggttgcagtgagccaagatcatgccatgcactccaccctgggtgacagaatgagagcccatctcaaaaataataataataataataattattattattattattattaccaggatgacgatattaataaaatattttatgatggagaaaaaataaaatcactaggatctgataatgatatcttagatttacaaaatgacacaatagatccatgtggtaattttaagaaaagggatctaatttttttttttttttttttgagagacgggtctcacgacgttgctcaggctagtctcgaactcccgggctcaagcaaacctcagccttcagagtagctgggactacaggtgcctactactacactcagcttgttttaatttttttaatttttctttttgttcttttgaagacctctaagaaataaggaagtatcagtctttacaaataactacaaataacaaataaggaaatatcaatctttacaaaaaaaagaaagcaaaaaactaaaactggatccaattagcactgatagtatatcaagggttaatgttgctttcctaaaaagttaagtagcaatttatacttatcagcaggttttcctagataactcattattttcaacaggcaatggaaatattataatgtttttcttaaagaattttttttgtctaaaagtaatctcatttaatggaaagatatgataaagcaaataaaatgttggaaaaagtaatccctttcaaatataaatataaaataggaaaagtacaaaattatttttgtactcttctgcacaggaaaagtgtgcagaaaagagttttaaaaagcaagcctgcagctgggcgcagtggctcacgcctgtaatcccaggactttgggaggctgaggcaggcggatgacttatggtcaggagttcgagaccagcctggtcaacatagtgaaaccccgtctctactaaaaatacaaaaattagccaggtgtggtggtgaacatctgtaatcccagctattcaggcagctgaggcacatgaatcgcttgaatccaagaggcagaggttgcagtgagccaagaacatgccacagaactgcaccctgagtgacagagtgagaccctgtctcaaatcaatctatcaatcaatcaatcaatcaatcctaccagccaagagcggtggcttgtgtctgtaatcctagcactttgggaggccaaaacgagcagatcacttgagcccaagagttcaaggccagcctgggccacatggcgaaaatacaaaaagtaaaaaaattagccaagtctggtggcacatgcctgtggtcccagctactcggaaggctgaggtgggaggatcatgtgagcctgaggaggctgagggcatagtgacctatgatcgcattcagcctgggtgagagtaagaccttatctccaaaaaaaagctatcaataagaaatcgttagttaactgggtgtggtggtgcatgcctatagtcccagcagcttgggagcctgaggtgggaggatgacttgagcctagcaggttgaggctgcaacgagctgtgataatgccactgcgctccagcctgggaggcacactgagacattgcctcgaggaaaaaaaaagaaaaaaaaaaaggacaagaacaatggctcacacacttgtaatcccagcactctgggaggctgaggccagctgagacaggtggattgcttgagctcaggagttgaagaccagcctggacaaaatgacaaaatccacctctacaaaaaatacaaaaagtaggcctggagtagtggctcatgtctgtaatcccagcactctaggaggctgaggcaggcacatcacctaaggccaagagttcaagaccagcctagccaacatggtgaaaccccagctctattaaaaatacgaaaaaaaataaaaaattaaaaaataaaaataaaatggaaaagcaagatctatgacaatctgaagaaagagcattctctaaggaaagagaataagagcacaatctctgacaagattgtgttgtaaaacagcagatatagcacgaatttcagttttagtatcaatgcttaatagtcgaaagtaagttttaaaatgcttacaaatcagcaactaagttccatagagccaggaaacaaaattttttaaattttagggatcaattccctaaaccctaaattccctaaaccctaaaacatctgaatgatcccaaccaatagctgacagcaccatacaataagcaaatacaaagaacctaaatagccaaaaaaatttttgaaaaaataaaattggatgattatactacctgatttcaaagcttagggtaaatatggtaattaagcaagtacaattttggaactgacaaactggtcaatgaaacaaaaaagtacagattttttttttcctggtaacaaaggggaaatcataaattttttcaattaatggtgctggaacaactggagacctgcacggtaacaaggatttttacgtcacactcaaaatgtataaatgtaaaagctataaaatttctcaagaaaacatgagaaaagctctgcaatcttaagcaaagatcatacaaggacacaaaaagaacaaaccatacaagaaaaaaattgatgaaatttggacttcataaaatataaaaacatctgctctttgagggtcactgttaaagttaaaaaactttacagatgcaatggctcacacctgtaattccagcactttgggaggccaagacaggaggatagtttaagctcaggagttagggaccagcctgggtgacatagcaagacctcatatctactttaaaaaaaaattcaaaaaattagccaggcatggtggcacatgcctgtagtcctagctactcagcaggctgaggaaggagaatcatttgagcccaggaggtcaaggctgcagtgagccgagatcactccactgcactttggcctgagtgacagagcaagaccgtgtccccccccaaaaaaataaataaataaaaataaaagaaaatttaaaaacaagccacagactggcaggaagatttataatacagacttatctagatttcataattcagtaagaagacaatctgcccaattaaaaataacaagcaggggacgggcgtggtggctcacgcctgtaatcccagcactttgggaggctgaggcgggcggatcacaaggtcaggatatcgagaccatcctggctaacatgtgaaaccctgtctctactaaaaatacaaaaaaaattagccggacatggtggctggcgcctgtagtctcagctactcaggaggttgaggcaggagaatggcgtgaacccgggaggcagagcttgcagtgagccgagatcacgccactgcactccaggctgggcaacagagcaagactctgtctcaaataaaagaaaagaaaaaaaaatgaataagggggacatctaaaaaaatggacaaaaaattttagatatttcaggaaagatatataattggccaaaaagcacatgaaaagatgctcatcattagtcatcaggaaaataaaatttaaatcacaatgagattgcgctaaactaactagaatatctaagtctaaaaacaccaagtggcaactgggcacagtggctcacacctgtaatcccagcgcttagggaaaccgaagcaggtggatcacttgaggccaggagttcctgaccagcctagccaacgtggcgaaaccccatctctactgcaaaaaaaaaaaaaaaattagccaggcatagtggtgcatgcctgtagtcccagctactcaggaggctgaggcacaataatcacttgaactcgggaggcagaggttgtagcagccgacatggaaccactgcactccagcctgggtgacacattaagactctgcctcaaaaagcaaattaacaaaaaattaataataggctgggcgcggtggctcacgcctgtaatctcagcactttgggaggccaaactgaggtctggagttagagaccaccctcaccaacacgtagaaaccccgtctaacggccgggcgcagtggctcacgcctgtaatcccagcactttgggaggccgaggcaggtggatcacgaggtcaggagatcaagaccatcctggctaacacagtgaaaccccgtctctactaaaaatacaaaaaattagccgggcgtggcggcatgagcctgtagtcccagctactcgggaggctgaggcaggagaatggtgaacccaggaggcggagcttgaagtgagctgagatcgcgccactgcactccggcctgggggacagagcgagactccgtctcaaaaaaaaaccccgtcttactaaaaacacaaaattagctgggcatggtggcgcatgcctgtaatcccagctatctgggaggctgagccaggagaatcgcttgaacccgggaggcagacgttgcagcgagctgagatcgcgccattgcactccagcctgggcaacaagagcgaaaactccgtctcaaaaaataataataaaataaaataaaaataataaaaataaaaaataaaaacaccaagtgtgggtaaaatgtggagtaactagaagtcactcactcattgctggtaggaatgtaaaatgatacaaccaccacggaaaagaacttggtagtttcttatacaattaaacatacagcaatttacccctaaatatttacctaagccacatgaaagcctaatattcacaagaagccttgtaaacaaatactcatagtagctttattcacaatggccagtagttgtaagcaactcaaatatccatccatatgtcacggacaaaacatagttatgtccataccatggaatatgactcagccataaaaaggaacaaaatactatacacacaaagatatgaatgaaatctcataaacatatgctgagcaagagaagccagacacagaagaatacatactatatgatttcacttaatattagaaaacacaaaacttatttataaataagaaatagctatctaaggcaggtagagtgcagaataactgtaaaagggcacaagggaacttctgtggggtaacggaagtgttctgtatttttattatggcagtgtgttacatgagtacatatgtttgttaaaactcactgagctcagccgggtgaagtggctcacacctgtaatcccagcactttgggaggctcaggcaggtggattacttgaggtcaggagttcgagaccagcctggccaacatggtgaaaccccgtctctacaaaaatacgggccaggcatggtggctcatgcatgtaatcccagcactttgggaggccaaggtgggtggatcacctgaggtcagcagttccagaccagcctgcccaacatggtgaaaccccatctctactaaaaatataaaaattagccggacacagtggttcacgcttgtaatcccaactactcgggaggctgaggcaggagaatcacttgaacccagcaagactccatctcaaaagaaaaaaatacaaaagattagccaggcatggtggtgcacacctgtaatcccagctgctcaagtggctgaggaaggagaattgcttgaacctgggaggcagaggttacagtgagtcaagatcgccactgcactgcagcctgggcgacagagtgagactcgtctccaaaaaaaaaaacaaacaaaaaaaacacctcattgagctctacaacagaatgtcttttattattttattattatttttaattttctttttaaatagagacagggtctcactgcaactttgacctcctgagctcaagtgatcctcccatctcagcctcctgagtagctgggactacagcgcaaatagctgagactactgtgcactccaccacgctgcccccaagatgtttttatgttgttgttgtttttggttttgttttttaggcagagtctcgctctgtcgcccagtctggagtgcagtggcacaatctggactcactgcaacctccgccccccgggttcaaccgattctggtgactcaccctcccaagtagctgggattacaggcacgcagcaccaagcccggctaattcctcatatttttagtagagacagggtttcgccatttgcccaggctggtctcgaactcctgagctcaggcaatccacccgcctgggcctcccagagtgctgggattacaggcataagccaccgcgcctggcccaaggtactattttttttgagacaaggtcactcggtcacctaggctggagtagagtggcatgatctgggatcactgcaacctctgcctccagggttcaagcaattatcatgcctcagcctcctgagtaggtgggattacagggatgtgtcaccacgcccaattaatttttgtatttttagaagagatgaggttttgtttttttttttgagacagagtctgtcacccaggctggagtgcagtggcatgatctcggctcactgcaacctccgactcccggagtcaagtgattcttgagcctcagcctccccagtagctgggactacaggcatgcaccaccacgcccggctaatttttgtatttttagtagagatggggtttcatgccatgttggccaggctggtcatgaactcctgacctgaggtgatccgcgcactgaaagtctggggcttgagccactgcacccctgaggtgctttttattaatgtaaattaggtgtcaataaagctgattacaatttctgaaaggattaccttaagtttatagattttactttgtatatatgttcattaagttaaatgaaataatacaaaacactgcagagatttaaactctgaagtttgaagaaagtacatgactcttgactcctaccagtacacgaaaatttcttatttatattcactgaatatttactcaacacctacttaccatatgctagtatgaactgcaatgaaagacagaattccaaaacagagagaagcccatatgtaactggatagaagaaggacaagatatttaaaacttacgttgttagcaagaatgccccatcaccacatctttccagagcctttcgtgcaggaggttttgctgcaaactctacaaaaccttttcctgtagctctaccgcgatcatccacaaccacaacagctttctctactggaccaaactgagaaaatgcttgctctagcagctcattggaaacaactggagaaaggttcttgacagtcaaggctgctccatgtgtagcgaagcgaatccgtagaggtctgctcttgagaatggtgccgtccagctctgcttttgcaatttcagccagggttctggattcctttttaggaagaaaaaacatttttaaaagatgacagtaacagaaaaaattcaaaacagtgtttggcttctagggagaactaggtatctttagcaaatggctgacagggtcaatttgattttgtatcttttaactttggtatcacatggtttttaactattcaatgatcattttaaacattttaattaaaaggtcccaactccattgttttgttaaaagtaatcatttaaagattagctcttcataaggccagttaccaactattaaatattcaaagcaatatagttttaaaatctcctacatatattaagaacacatattaacaacttgactagaggctgggcacagtggttcacccctgtaatcccagcactttgagaggctgaggcgggcggatcacctgaggtcaggagtttgagaccagcctggccaacagggtgaaatcccacctctactaaaaatacaaaaattagctgggcgtggtggcgggtgccttaatcccaactacctgggaggcttaggcaagagatctcttgaacctaggaggcagaggttgcagtgagctgagatggcgctactgcactccagcctggtgaacagagcaagactctgtctcggaaaaaataaaaataaaaaaacaataataacttgactagaaactatcaacaaaggaataattctccataccctttatgtttttatctcattttttttttttttttttgagacagaatctggcactgtcacccgggctagagtacaatggcgtaatctcggctcactgtaacctctgcctcctgggttcaagagattctcctgccttggcttcccaagtagctgggattacaggtgcccgctaccacgcccagctaattttttgtatttttagtagagacggggtttcaccatgttggcctgaactcctgactccagatttgcccacctcagcttcccaaagtgctgggattacaggcgtgagccaccgcacccggcctgttttttatatcttaacaaaacatcccacctctctacagccagacaaatcaccttttctttttattttcatttctcttcaattttatatgtaaaaactgttagttcttgggtttttttttcaggggagggaggtgtctgagacagggtcttactctggtgcccaggctggagtacagtggcacaatcatagcttactgcagcctcaaactttggggctcaagggatcttcctgcctcccgagtagctgggtttccgggtgcatgccaccaagcatggctaattttttaattttctgtagagatgggggggtctcactatattccccatgctggtctctcgaactcctggcctcaaacagtcctctcgccttagcctcccaaagtgtaagattacaggtgtgagccatcttgccctagccaatgtcttcttaatgacttctcctgaaatactggcatgggttacacatttctcactattacatgaagagaaacaaaggcaacattcacgagctataatagttctcgccattatataaagtgtacatatacacttactataaactaaaaaatatgctcattgctgaaactacaaggtaagagaacttccttctactgggagaattcaaagttggtgtagaatatgggcagcacctaaaacaataaataaggaactggtaaatttaacagaagtatgtctttttcattgtgttatgggaactctccaaggacaactgaagaggctttatatgtatatgtaagaagaatacaaacatactgtcttatgaaaattgtcttaaggtcacaagagctctttattcaatccctaaaatgttcatgacagcttgaaattattgccctttattgcaaaaatctacctatagaattatttttacaaaaacaaatgaagttaccctttttagagatatagtcatccctctgtatccatggattcaaccaaaagtggatcaaaaatatttggggccaggcccaatggctcacacctgtaatcccagcactttgggaggctgaggcaggtagatcacttgaggtcaggagttcaagaccggcctcctggccaacatggcaaaacctagtctctatcaaaaaatacaaaaattagccggggcatggtggtaagcgcctgtagtcccagctacttgggggactgaggtgggagaatctcttgaacccagaaggcagaggttgcagtgagccaagatcacaccactgcactccagcctgggtgtcagggacagactctgtgtccaaaaaaaaaaaaacaaaaaaaaaaaagaaaaagaaaaagaaagaaagaaaagcaaacatttgggaaagaaacaatttaaaattgacaggcagggtaagggggctcacacctgtaatcccagcactttgggaagccaaaacaggaagaatccttgaggccaggagtttaagaccagcctaggcaacatagcaagacctcttctttattcctttaaaataaaaaaataaaatttaaataaaagaaactaaataggctgggcgcagtggctcatgcctgtaatcccagcactttaggaggccgaggcgggcagatcacgaggtcaggagttcgagaccagcctagccagcatagtgaaaccccgtctctactaaaaatacaaaaaaaaacaaaaacaaaaattagccaggcatgtggcacgggcctgtagtcccagctactcaggaggctgaggcaggagaattgcttgaacccgtgaggcagaggttgcagtgggctgagacagtgccactacactcacgcctgggtgacagagcgagactccgtctcaaaaaaataaatagacaaaaaaaaaaaataaaccaaataatacagcataacagctattcatacagcatttacattgtactaggtattacaagtaatctagagatgatttaaagtatacaggaggattgcatgggtaacatggaaaaacaatgccatttttacacagtataaggatttgagcatctacgaattttagtactggaggaggtcctagaatcaatcccccacagatactgagggataattgcattctaaacagtcgttttgtttattgcttttaactcactagtaacagtagtagcagcaagcacttaataaacacctaaaaagagatgggtactttcttacctaatacatcatataatccaacaactcttaagaggtagactttagaaacagttttgaaagtgagaatagggctgggcacagtggctcacgcctgtaatcccaacactttgggaggccgaggcaggagaatcacgaggtcaggagattgagaccatcctggctaacacagtgaaaccccgtctctactaaaagtacaaaaaaattagccggacgtggcagtgtgcgcctgtagtcccagctgctggggaggctgaggcaggagaatggtgtgaacacgggaggcggaacttgcagtgagccgcgatcgcaccactgcactccagcatgggtgacagagcaagactccatctcaaaaaaaaaataaaataaaatgagaataggaagaaatatgaagacatttaatggggtgataatatgtatattttgataggggtttgagttaaacagacatatacatttgtcaaaattcacaaaccagtggctaggcatggtggctcacacttgtcatcctaacactttgggaagctgaggaggagggatcatgtaagcccaggagtttgagacctgcctgggcaacataatgagagagaccttgtctctacaaaaaataaacaaaattagctgggtgtggtggtgtgtgcctgcggtcccagcaacctgaggggctgaggtgtgaggatcacttcagccccggaagtggaggctagagtgagccatgatcatgccactgcactctagtctgggcactctgtctcaagagaaaaaacaaaaatcaccaaccagtacacttaaaatgtgtaccctttactatatgcaaatttttttttttttgagatggagtctcactctgtcacccaggctggagtgcagctgcgcaatctcactgcaagctccgcctcctgggttcacgccattctcctgcctcagcctcccgggtagctgggactacaggtgcctgcaaccacaattggctaattttttgtatttttagtagagacgaggtttcactgtgttagccaggatggtctcgatctcctgacctcatgatacgcctgcctcggcctcccaaagttctgggattacaggcgtgagccaccgcgcccggcctactatatgtaaatttttaaaaccctaaaaaataatatgccgggcatggtggctcatgcctgtaatcccagcactttgggaggccgagacaggtggatcacctgaggtcaggagttcaagaccagcctggccaacatggtgaaaccctatctctactaaaaatacaaaaatcagcctgggctggtgtcatgcctgtaattccagctattcaggaggctgaggagtgagaatcgcttgaacctggggaggcaaggctgcagtgagcccagtgtgccactgcactccagcctgggtgacagcgaggctccatctaaaaaaaaaaaaaaaaaaagaggccaggcacagtggctcacacctgtacacctgtaatcccagcactttgggaggctgaggcgggtggatcacctgaggtcaggagttcgagaccagcctggccaacatggtgaaaccccatctctactaaaaatacaaaaattagccgggcatgaaggcgggcgcctgtaattccagctactccagaggctgaggtaggagaatcgctttagtccaggaggcgggggttgcagtgagccaagatcacaccgctgcactccagcctgggcgacacagcaagacctcagctcaaaaaaaaaaaaaaaaaaaaaagataacttttacataaaaattttcaccaaatggcgagctgtctctgatgtccaaaaaataaataaatgcatttataatgttcaaaatgtaatgattatttaacctgaattttaaggaaatttccatatttcattattattaatagtttgcgaatatttacccttctcttgaagccacttacatgttgaagtgtttgccctaaaaaatacagtctcaccaggcacagtggctcacacctgtaatcccagcactttgggaggccaaggcaggcggatcacaaggtgaggagtttcagaccagcctgaccagcatgatgaaaccccatctctactaaaaatacaaaaattagccaggcctggtggcacacacctgtagtcccagctactcaggaggctgaggcaggagaatcgcttgaaccagggaggcagaggttgcagtgagtcgagatcgcgctactgcactccagcctgggcgacagagtgagactccctctcaaaaaaacagtcccttggctgggcgccgtggctcacccctgaaatccaagaactttgggaggccaaggcgggcggatcacgaggtcaataggtcaagaccatcctggccaacatggtgaaaccccgtctctactaaaaatacaaaaattagctgggcgtggttgcatgcgcctgtagtcccagctactccagaggctgaggcaggagaatcgcttgaacccaggaggtggaggttgcagtgaaccaagatcccgccactgcactccaacgtggtgacagagcaagattccgtctcaaaaaaaaaaaattacactatcttaaaggttttagaagattaattttttaaaaaagaaaaaaattaataaaaataccgtaccatgtaattacaattttctctacatattaagacctctccctctccccctccccctccccctccccctccccctccctctccctctccccacggtctccctctcatgcggagccgaagctggactgtactgctgccatctcggctcactgcaacctccctgcctgattctcctgcctcagtctgccgaatgcctgcaattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcatctccgcccggccgccatcccatctaggaagtgaggagcgcctcttcccagccgccatcacatttaggaagtgaggagcgtctctgcccggccgcccatcgtctgagatgtggggagcgcctctgccccgctgccccatctgggatgtgaggagcgcctctgcccggccgagaccccgtctgggaggtgaggagcgtctctgcccggccgccccgtctgagaagtgaggagaccctctgcctggcaaccgccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggggtcagccccccgcccggccagccgccccatccgggagggacgtggggggtcagcccccccgcccggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtcccggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccaccctgtctgggagggaggtgggggggggtcagccctccgcccagccagccggcccgtctgggaggtgaggggcgcctctgcccggccgcccctactgggaagtgaggagcccctctgcccggccagccgccccatccgggagggaggtgggggggtcggccccccgcccggccagccgccccgtccgggagggaggtgggggtgtcggccccccgcccggccagccgccccgtccgggagggaggtgggggggtcggccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgggagggaggtggggggatcagccccccgcccggccagccgccccgtccgggagggaggtggggggggtcagcccccccgcccggccagccaccccgtccgggaggtgaggggcgcctctgcccggccgcccctactgggaagtgaggagcccctctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggaatcctgttgatctgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaagattttgtatcgtccagacagagaacccaattttgaaaatcaaagttccaggccggacacagtggctcaccctgtaatcccagcactttgggaggccaaggcgggaggatcgtttgagcccaggaattcgaaagcaacctggacaacatggcgaaacaccgcctctacaaaaaatacaaaaattaggcaggcttgggggtgcgtgactgtagtccccgtcccagctactcgggaggctgaggtgggagaacttcttgagcccaggaactgagatcgcgccactgcactctagcctgggtgatagagcgagacccagtctcaaaaaaaaaaaaaaaaaaggcgtaaaccttagcaatttttgttttgttttgagacgggatctcgctctgtcgcccaggctggagtgcagtgacgtgatctcagctcactgcagcctctgcctcagcctcccaagtaactgggactacaggcgcgcaccaccacgcccagctaatttttgtatttttagtagagatggagtttcgccatgttggccaggcttgttcaaattttttttaaatataaaggaatcataatttttgcataaattattggaaaacttttcaaagtttagattaaaagagagtaagctatattactctgatactgggatatgtatcagtaatttatgaagtagtactgtgtatcaactattctcccccctataaaaacgtgaaactctccaggatgtttggtagaaaaacactatattagatacatacaattaaacactgtctcattactgcagattaaacggtgttacttgagtacagagtttgggcacctaagcagtttgaggtaaatagcaggctgcactgaggtgagaaataaagtggcaggccaaggcaggaggatcgctcgtgctcaggagttcgagaccagcctgggcaacatagcgagaccccatttctattaaaataaataaatttaatttaaaaagaaataaagtggtctacccttaaacgcatataggtgtggttgaagccaaggatgggatgttaataattgtttaagaagcaagtctcctggacagaccctcacgaccagtgatacgtctggtccgacttaagcttcctttccaaatgtacatccaattcgttttttatggcacgatttttgccttgaagaattctcaccccaaaacgctgcccgcccctgtccccggaccctttcggtacccggggcaacggggaacccgggagcgctcgctacctggacagggtgcaccatgcccgatccagcgcagggcagcaggcctgcagccaccgcaaagcacgatcggcgcacggcagaaaacggcggccactgtgagcgcaggaaatcccgggaccgtgaactcgaaaccaaaggcgccgagctggggaagcggccaaccccgcacagaggaatcgatgaggccgagcggcgccacggttgccacaggttgagacagcgtcctaggacgaggctggcctcagccccacgaccccgcggccaccccgacagtccttttgttccctcgcgcgggcgcctgacactcaccaagcggatgaagccgaagccacggtcccggttgatgaagacttcgctgggctcgccatagcgttcgaagagcctcttgaagtcctcctccgtgatgtcggtgggcagatttcccacgaagaggcggcagcgctgcgtgtacgtcttctcgcccggcttgaggaaactcttgatgtcgatagtgaaccccatctcctcgtccgggtggtcctctggaggcgcgggcgcgggcggtgccggctccccggcaagagcgagcgccatggctgccgcggccgccggctcgctctcgcccaccgcggactccagggcgcgaaggcgggccgggtttttctcaatgcgcacttgcttcaggtttcctcttaacatcatcttactgagttcgcctcggacaccggatacaggcctagatttatagacagtgtgtctatatatatgtatacgtctctacataaacctatgccaacaaaatatcgacaatcaagagaccgctaggtaggcgagtcggcaacccgtcctcccccaactcacgcccgctgcagctgcacattcaaaatggcgctgccacaaactgcagttagaagaagagacgccggtgcaagtcccacccctccgccaaagccggcgccggaac

SEQ ID NO: 605 - DNA, 108268 bp, Homo sapiens; identical to SEQ ID NO: 604

SEQ ID NO: 606 - DNA, 80151 bp, Homo sapiens
ttaaattatccaaaatgatttctttattgagattaactacatagatttcacagtactatggaatacttatatttagctaaagtcacaaacacatttcaacattcaaaatgatgagcatcattaccattctaatctacaaagctcatgaataaagaaaaatacaaaaacctcaagttttacaaaaaaaaaaaaacttttaagtctacatacattaacaataaaaccatttcttccagataacaggtaaaagtataaaggcataccactgacttttttttttctagatagccaggaatgaacgaatgtttaatatctacgacgcttattagggccttcaaagttgcccccttgacttcctctaccaaagccaccaggaccaccactcacaggacctacaccactcattggtgcttgaggggtttcagaacctgttctactccccataggtgaacccatctgagatggtggtccttgaggaaatctgtcattgtgctatgataccacacaataaggaatagaatatgaagtccatttggaacacgccaaatataagtgacaagaaaaattggcaaaatcccaagtggtggtgtcatgaagttcggcagaaagtccagcagaatcaggatcacacatagaaggaagaaaggagcaatttaattagttactatgttttttttaaaaaaatgcagcatctgaagatttacatattgctaatgctatgccccaatttaaagaacaaagaactgatttcgtgacagaagcaaatgtaatcttaagcctaaacaatattataataaatctctgattccttttttcaaaagtttatattgcatgaaactacgctatgtaagaaaaatacgttcttaaaaaaatcagagaaataaaactggggagcagcatcaattcggttttttaaaagtaaacattctaaaaaaaaatcttcacatcaattccttgaagatagaaagcactaatacaaacatacacaaagaattatgatttcagtatggaaacttctgagagtgttttccttgaaagattatcatgggaaaatagttttaaaaattaatgtaataacatgcactaataagcacatttaaacatctgaattaagtattttgaaaaacttcacaataatcatacatattaatctgaaaggttggatagaactccctgaagtgtagcagtaaaatgtcagtgcaaaacagaccaagggtgatatttaaataaagtttacaatttcagggagacaataaaaaaatgggacagttaatgttacttctatgtttctattgatgattatatgccacacaaaaacttaaccaaagtagtataagtttttactagctttcaaacatatcactataaaataaagcctctactgaaggaaataaatgcaatcactgtgttaagcgccatctgttcatagtagccgtgcactgcctcatctccctgtataaactatcattttaaaaaatccaactgccagcatgtccaatttctccaaattcttgaagcaaataaaataatgataaatgctgcattcaactctaagacatacaatgcattgcttttaacgtctctgatcacggtggatttacaactgatgacaggtctgagtctaacaggcagtgctttctttctttcttagcagcattggcgcctcaagatttcatacagtagtttcaaaactaaactgccttttcaaaatagataaccaaacaatttccctttcaaaatgttatttacaacaagcattaacaaacactaaatgagaaaacggtttgcctaaagtccgatttatatagtgacagactttaatagaaatgataaaaggtatcattcttgctactaatatatttaaatataataaaaattacaactgaaaaaccttgttttcatagtatttaatccacacaaagatatcttcacactctcagatcaagacaaaaaactgtctactttaaatttactaaatataatttaaaattctgtgaaaagaatgccacaatggtggtttggaaatacacaaaaactttaatgttaatttacagccaaattctttgcaataaatcatgacaggtaatatttttatcaaaaatatttactgaaaactgtgtgttcatacatattggacttttgtccccatcaaatataaggagtccacacaggaaaagaacactatcataaaatgcttgaacgttagaatgctggtaaaagatggaaacaaattaaaaagcacagaaaaatatctgtaattaacatatgcatttgctatatactgaggtaccacagcatgccacagacagtaatcctaattcttggactacttaaaaactatctcagctggacgcggtggctcacgcctgtaatcccagcactttgggaggccgaggcgggcggatcacgaggtcaggagtttgagaccagcctggccaacatagtgaaaccctgtctctactaaaaatacaaaaattagcctggcgtggtggcgcacgcctgtagccccaactactcgggaggctgaggcaggagaattgcttgaacctagaaggtggaggttgcagcaagccaagatcgtgccatgcacaccagcctcggcaatagtgcgagactctctgtctcaaaaaaaaaaaaaactatctgtaacacatcaacatatgatgtcacaaaattttcttcttcattggctgccaaaacaaatgataccaaattatattaagtgtgaagttatccttgatgcagaagtgtacattactgaatataatcaaaataatgtttatgatacattaccactgctccattatctggcatcattggagttcccatatttgcggctccttctggtcccatggcaggaccaggacccattggtgggccaggtatagttgctctgttgttcatattcatacccatcattggaggaggaccttggttaccagcaggggctgggctaaacgcatctatgtaaaacaatctatacttagagctgtcctatcttagtttagtaaacattaacaatttaacaatatttatgcaatctatataccaagaccattatcaaaattattttcgctccttaagaatgcgatatgcgttatctactctgtaatagggtattacctacactctagaattagaattttcatccccaagccaaacgtacataaaatcaaggaggaaactatcaatcattttagggcatttgagactaacagtttgcaagctttgagacatcactattattttgtaatagcaggcttttaaaccaaagaatccctaacaatggggactacattttaccagtttaaatgagtaacaaaggattagcacttacaaaaccacttaatttttttcaacccatggctaaaaatattagcagtaaattatgctaagttgtgagagaggaaatcatttcctgcaatatataaataaagatcattataactagcctctcatcttagttttttttttttcctccctgagtttatggaataccttgctaaattacataaggtactctttttttaactttttattttgaaatatggactctaaaccaaaaaattgaaatgacttataagaaaacttatttttaaaagcaaccgcaaccaaatacagataaaatattaatatagctatctggatctttctgacaagcttaaattccataaatggggacaacctgataatatttcaagttttttcattaaaaaaatccacctacctcattaacattaatagtgtttgcactgtaatactacatatatgatgatctcagatacaacacatttttaggcattttctttgaaaaattttttcccttttaagtgttagtacttatcattaaaaattcataacaaagccattctaatttagagttttcttctagtatttcattacataggtcaattttctgataataagaactcaatttctcaaatatacattataatgcagctgaaatctctatatggctgagtccttaccagcccctggcatcatacttctgctctttgaatccaatccccagaaacctagcaaattcataggaaggaattatttccttcatccccaaatgctcttgccgataaacagactttaaccaagaatatttccgctccctcagtatagccctaaatagctatttttaataatttctacaatctagacatgaagagaatataagaacagtatctaagaggcgtcttacctcaacaatcccccagaaaacaaactaagtttctttttcctctctttctctttaatggaatgtaattttacaatggtgggttcggaagttttctttttcctctctttctctttaatagaatgtaatttaacaatggtgggttcagaatataactatacaactatgggtataaaaaatcaaaaataatatttccaactaacagcagttaacttagagccttacttttagtattcacatcttccaccacatagctataaataaatttaaagatataaaaaatgttagcattatctgattactagaaaggtagcattataatgtaggtttcgtttggttatacacactagtgatacaccagaaaatctgctgccactttccatcaatgtaacttgatgagttatgacagttttaacttctcaacaacccaactggatgataatgattaatagctctacaaaaccattatgatgaagtctcacattgaatgaagactgaagagaaaattagataaactgggctttaggagagttaagtgctaaaatgtaagtaagtcctctggtgaataaaatgtcacaaaaattttaagttatcttcaattcctaactaaataaggactctaaaggcatattctgatatttcttctgataaaattgcagagtatctctgcaccatcagaaatggttttaagttttatactattttaaagtttagctctgatgttaatgtcattctaataatgataacagccttttaaactgcctataatctacaataaccttattcctaaaatccttaaaattacatggattatattaaatagcaccccagcatttactcttaaaaaaagacataaatattggaccacttggacatcattatactcaattatgcttcataatttagaacactcttggttcattaattatttcacgtatccactgcagtaatttcacaattaagttctttatgggcgagggccatgtttcttgcttcctgcatatatcagagatattcactaactacttgttggtaaaaagtgaccaagtaaaacagcaatatatgactctacattatctgattagtagtattgaaaaactggcaacagaagtttaagaaaaaaaagctgatcatggaaaatgttcattccacacatgacttaagtttcatttgatagactatatatgctgagaacacacttgattttgtaaatgggtgtgcatgttaagtacattgtttgccatggtagtgtaatctttgaaactatgtacttttaagttatataaagatttttagcttcataacaccttttgtgggacaatttaatgtgggacagcttttgtgggacaattaatttaataaaatttaattccttatccaacttttaaatgtatgacatttcaaatttcaaatttagtaaggcctacgatatgccacacttgcttttccttcaggttatttacttggcattatttcccttgcaacttggctatacgagcaaatccatactaaagttgctaatatgctttcttaaaagcttagtcaactctaaaacatgcattggcgacacacataattcccttgatgagttatagactacaaacactgagtgcacttctgtgcacaacactgtaggttaaaggaaaaaagttcaatattcattaaagtgaaggaaaacagcttcaaagttacacaaaaagctagtttaagatagaaatgtataaaacgctctccacctaaaaacacaactcagaaactatcaatttccaactcggaaactatcaatttccagtgttcaattaggacaggcgaggtggctcatgcctggaatatcagcactttgggaagctgatgggggtaaactgcttgagcccaggagttcgagaccatcctgggcaacaaagcgaaatcctgtctctactaaaaatacaaaaaataagccaggcgtggtggcacatgcctgtagtcccagctacttggtaagatggaaggaccacttgagcccaggaagtcgaggtttcagcaagccaagtttgtgccactgtactccagcctgggcaacagagtgaggtcctgcctcaaaaaaaaaaaaaaaaaaaaagccaaatagaaggcataaaatttgattttaaaactgcaaagacagagctgtattacacaatgcaatgactaaactaccttcaggctgtattgcaacctggtttatatgtttctttcattaagcctatgaatgtataacacatcttttagccttcaaacaaaaacaaaatgagaattttcttcccagacatatatttttaatataattgtattgtattccagtttaatggatgtaagagatttcacctttagaaatgttggttctgtattttagtttcttactgatatgtagataccacaaacagcataaacagtccccccaaaaatgataaattacaaaagccttttgcttcaaatccctacctcccatgtttattgctccacggggacccatatcacccattctcatttcctgttctctctgtaagtaaacatagttgtcacagtcaacctatcgatcttatgactttacatttcccatctaaaatcaaaaagaaaagagtgaattgggacatcatttttcattaaaaattttgaaaagtttccatcatcataaacttaataagaatgctgaaaagaaacttcagtctcccaggcttaatatactacaaatgcttaatgcatccagtttatattgcaagattagattactaatgaatcagattatataaaatatatcacaaattatttttaatgtttttattccaacagatgaaagacacatgcctagattccaagcaaaggaaaatctagtaatgataaccaccagagccaattattttctcctcccaggtcactgaagtcttaaaatagaaatgactgttaccaagttcatgttgaaatgtatttgaacatataacacaaatagctttagggaattatgctaaaaataaggttacaatcttcattgtctaaatattataattcattcatgtatttgtattcatctactcaagcattattccatccagggactatagatagcccacacaagcaattactgaaagctcgacataacattgctttcctttaactgcgcagtaattttatttgaaaacctgaatgaaagtattacacagttaactataaaacagaaatattcagaacatttgaaatttcattacagaaactgcttcctaaaagctgttcatttaccaacaatagtgacatagaattaacttcaatgaaatctctaagtgaaatttctcaagataacataggaaaattgcaattttcactttgacttgatgaccatttccaatcacagaaaactgttaaatgtagcaatcatgaaaaacattccattatgagacaaatgcagcaatgtttaaagaaagcataattactgtacttttgaaaagcaatcttattaaaatctaaatgttcatttaaagttccattttataatacgaaagactgttgaaaagcacctataaagctggaaataaaataaaagcctatgatggaaacgtaattgccattaagccacaagtggctccttaaaaaaactgcctaacttaaatggagatgtccaaaggtaatcctaatgaagctacggtacaatgaatgaagctacggtacaacaaaaacaccatcatgaagagataaaatgctttctcacattatttagaagatttaaataccaatctttctaaaaagcttaatttttttttttttcccagagatcctcgctctgttgccctggctgcagtgcagtggcgtcatgatagctcactgcagcctcgaactcctgggctcaagtgatcctcctgcctcagcttcccgaatagatgggatgacaagcatgcaccatcatgcctggtgaatttttgaatttttttttgtagagatagggtctcgctatgtcaaccaggctggtatctaactcctgggctcaagcaatcctcctgcctcacgctcgcaatgtgctgggattacaaacgtgaaccgcaatgcccagccctaaaagccatgttttaactttcctaaaaatttctcatcataaaatttgtgaccattaatggatactattgctgacctgcaaaaaaagctagactgaggcggggtgcagtggctcacgccagtaatcccaacactttgggaggctgaggcaggcagatcatctgaggtcaggagttcaagaccagcctggcaaacatggtgaaacctgtctctaggttgggcgcggtggctcacgcctgtaatcccagcactttgggaggccgagatgggcggatcatgaggtcaggagattgagaccatcctggctaacacggtgaaaccccgtttctactaaaaatacaaaaaaaattagccaggtgtggtggcaggcgcccgtagtcccaactattcgggaggctgaggcaggagaattgcgggaacccaggaggcagaggttgcagtgagccgagatcgcaccactgtactccagcctgggcaacaaagagagactccgtctcataaaaaaaaaaaaaaaaaaaaaagaaaccccatctctactaataatacaaaaaaattagctgggcagtagtggcacatgcctgtaatcctacctcctcaggaggctgcggtaggagaatcgcttgaacccaggaggcgggggttgcaatgaaccaagattgcactattgcactccagcctgggtaacaagagcaaaactctgtctcaaaaaaaaaaaaagctagactgtaatataaaattgctactcatcaagcattatatttagaaaactattttaaaataaagcttctgttatcactactttcaataaaccaaaccaaattgccatttccttatcactacttagaaactactgataggttcttagaacctactgataaaacttaagaatgcttcaaaacacccaaaatcttctagctataaaaataatatctatagtatctagataagtatctgtaacaagcaaatatagtagacatttcgttgttcagaagctggttacacaccagcaccatcgagtaaaatacatggatttcatagtcatgacttttggggaggacaggatttcaatttatatttttacttttgaatttgtcttcactatgaaaggttaggaattcaatatctaaccactaatatagggtaattgtttacagtctcactgcttgagatttcaattttcaactaccccttatataccctaataccttaactattggcctatgattcactggcaggaaaaaagggcataaacaatcttttttattgtctctttgtattttcagctctatgtatcactttctagaataactttctagaatagtgcaagctttattattcacaaagtaccttcttttattattaaatccattgtcattaagaaaatttcacgggaaatgtatcaatgtaccaaaaatatctatggttttaagttaactattaaacatgaacattccccttctggtggtatattataaattggtacaagttctaaaatacctttctctaaatgagataatcagaatatcttagaatactccatgctaccatagcatattactgtattaaaataccaattcatgaggcacattacagcatttttcactaaatatatatatatatacttgtacttagtaatgttgacaatatcttaaagatgattactgaatactattttacacagctttgctcttaagaaaaaagagtataatttgatggcatcattttgtaactatcttagaaggggcaaaagaaattttcagcttcctagtcatgtcttcaggctgttactttctagaaaaccaccgctacaaacttctagtaaaatgcaaaagaggtagagattaggatgattttgtaaaatgaaatacagcattcttcactaacactaaatctatcaaatattaataagaatcacttgaggaaattcacaactgtgtgcccacccaacaagcaatacacaaaacccttacttccctctatgaatgacttttaataacacttcaaattagaatttaagttagaaccagtgcgtatacgtgatatttttacaaattttaataatgctttattacattacaaaaaattaagagttgttgtttaagccaaaacaacttatttgtaaccaacatctcaaaagactgcagtgcgctaaaataaacctatgatgaaaactcagttttacattattgattcaactctatgaagtaggcctactgttacctcattttagacataatgaaactgaggcacaaagctgttgaataacttagtcaaggtcatatggatagtaagtggctgagctaacctatacgattctactgaaatggagttcacaaaatttttgacgttcacgagatactttcattcttcaaaaattccaacatatctccatgtcccagacagccaaaaaaaaaaaaaaaaaaaagaattccaacagtcgaagcctaacaaaaggcaagattttaacttatctttgcggtatttataagattgtatgcctttccatggaaagaattatacatatgtattcctgaaagcttcgaattcaagtgtacttaaattaacagatgaccaaaaaaggaggcaaagtatgactaattcccagaaccacatgtcaaaagagcattccatcattgcagcggttcttaacgtgtaggtcatggagtacactaagagtccccaaaactcaggaagtgcacagtcacaactatttcatgttttcccagcactaagatacagttagttatagtactatcatcagacttttctctgtatcaacattcactacatttaatggtgcgaaagtaatggctaggaaaagtcccagcactatagcacaagccaagagacttgggcccaatttttactagtaaccactgcatttgtcacatggataaaactgtagtttaaaattttaaactatgaatacctggaggaagcagtcaaagttaattttattaaatctctatccatgggtacatgcttttttcatgttcttcacaataaaacaggatttgtccacaaagtacatctgctgcattctgaagtaggatggttattttaagaaaaagcattcataattgaggtgcatgttgaatgaaatacttttttcacagaacaaggtttttataagagacactataattattggcttgagtatttggcggatattttctatgagatcaatatgaagacatgtaacttctttttaattttgtaaaataaatacattagcattttggataatctgcttaggccaatgcatcagtatttttcttctgattggtacataacactaaaaaatcatgcatgggtaaaaaatccattcaaaattcaaagcagcccagcggatttctttttttttttttttttcctttgtcagtctcactctgttgcccaggctggggtgcaatggcgtgatctcaactcatgcagcctctgactcccagattcaagcaatcctcctgcctcagcctcaagggtagctggaactataggcagataccatcacgcccagataatttttgtgttttttgtagaaatggggttttaccatgttacttgggatggtcttgaactcctgagctcaagtgatccacctgcctcaaccccccaaagtgctgtgattacaggtgtgagccaccatgcccagccaacccaattaatttcgatgtaagagtacttttaagttttacagtagtatcaaaaaaatccacaattatctttaaaggttattaacatactcctcccttatcacttctccgtataaagtcaggtcttctttgatgcgttttaattaaaaagctttctgcaatagatggactgcaaaagcaaacgtgggaagccaaccattttttatagagcaaaacaaatttacaaaacataaaacaacaccattcttcccactacactaaagggaacattaaaagacatttgcaaaaatgtacaagaaagcgactcttaactctgtaacgttttctttaaaacctcgctttggcttataatatggtaaatattgatataatcctttagcaggactttggcaccctcaataatttttaatagtgatatggaaaattaaagaaatatggaagccaaaaggtttgagaagcaatatttttaaaatcgcagtcagttttctttcatgaaaatatagaacaggaagcttgcactaagtaaggtaaattaacctaacaaatattttccaaagtggcatggtaaacatgccactactggcacatggcactttttgtgcagaacatggatatttttcctttaatatttagtacttgggctatcatgaaacaaggttagcataaccatccaaaaccccaagtgctccaaaatccaaaactttttaaacaccaacacgatgcccaaagtggaagattccatacttgacctcatgtgatgggtctaagtcaaaatgtaggcaaaactttcacgcacaaaattacttaaaatattctactgagccaggcatagtggttcatgcctataatcccagcactttgggaggctgagatgccaattgctcgagcccaggaattcaagacaagcctgtgtcacacagtgagacactgtctcttaaaaaaaattttttttggacagacacataatcccagcactttgggaggctgaggcggatggatcacgaggtcaagagatcaagaccatcctagctaacacggtgaaaccccgtctctactaaaaatacaaaaaaattagctgggcatggtggagggcacctgtagtcccagctactcgggaggctgaggcaggagaatggcatgaacccgggaggcggagcttgcagtgagccaagatcacgccactgcactccagactgggcgatacagcaagactccgtctcaaaaaaataaaaaataaaaaataaaaaaattaaattctatgaagttaccttcaggctatgtatataagacatatatgaaacataagtgaatttcatatttggatctgggtcccatccccaagatatctcattacataatacacaaatgtttcaaaattcaaaaaaatccaaattccaatacacttctagtcccaaacattttagataagggatactcaacacgtatattttgtgggtgtatatgtgtgtgtgtattaccaataacctaatttaaaggaatgacttaacacagtactcaggtaaagctaaagtgtagtatgaccacctaaacttggggatacactcactgaactaaataaaaactgctttaactgtgtcaactggaacaccatttaatgatcaatgacgagaggtattcatctaacactttatcaatataactcttgtttgagtgaatgcaatcttaatgggcacaatcaatactcttttttaggtcacagtcaaaattctttattgataaagacctctcatgtttatctcaaaaaaagctttaagaattgtccaggaatcaccacatgctatttaggttctatgtctcaaaaaacgaaaatgctaaaataatgtagaacatttaaatccactaaaaaatatataattctagagaaaaatatagtaagttctgacaacaggattcagcctttttaatcaattaggaatatctaaatattcctaaaaataaattccctaaaaaaaactatatttagcaattgaaaatattttagtgtgagcaaactatattctattaccttttccttcactaaagaaggttacataacagaacaataaggttataaccaattaaactttcatgagaaagattaaataagaactgttggccaggcgcggtggctcactcctgtaacctcagcactttggggggctgaggcaggcagatcacctgaggtcaggggatcgagaccagcctggccatgatggtgaaaccccatctctatgaaaagcttggcgacacagcaagactgcatctcaaaaaaaacaaaaaagaaaatcgttaggagccagaaatattagataacaaattgtagacacaaagaatgaagcaaaaatcacttacatgaaatattcatgggtatttttaaaaacctcaagatattaggcctctttgccaagaaagtattaactcatgaaaaaagtattaagatactgaacaatatacatcagcaaatgaatcttttctaataaaagtaaactgggccggacatggtggctcacacttgtaatcccagcactatgggaggctgaggcaggcagatcacttgaggtcaggagttagggaccagcctggccaacatggtgaaaccccataaatactaaaaatacaaaagaaattaaggccaagcacggtggctcaagcctgtaatccaagcagtttgggaggccgaagcgggcagatcacctgaggtcaggagtttgagaccagcctggtcaacatggtgaaacccatctctattaaaaacacaaaaaatcagccaggtgtggtggtgggcacctgtagtcccagctactcgggaggctgaggcaggaaaatcgcttgaaaccagaaggtggaggctgcaatgagccatgataacaccactgctctctagcctgggcaacagagaaagactctgtctcaaaaaaaaaaaaaaaaaaaaaaagttagccgggcatggtggtgcacccctgtatcccagctacttagaaggctgagacaggagaatcacttgatcaggagacagagtttgcagtgagctgagatcgtgccactgcactccagcgtgggcgacagagggagactccactttaaaaaaaaaaaagtaaataagggtcaggcatggtgtccagtgcctgtaatctcagggttttgggggaccaacgcaggaggatcccttgaggtcaggaattagaggtatggtgacctatgattgcgtcactgcactccagcctgggtgacagaatgagacctcactccaaaaaaatttttaaacgttttaaaatgaaaaggaaaaaaatatacgtttctattgatacaactcaatagcatgtaaactttccaacctaatcaatagtgaatgcttggaaaacttaacatttgaaattcaggcaattaaaaacaacaatttccaatatatgttattcgctgctagttagtgaggggtagtttaaaaaatataagacaatctctttatatatatatacccaagttttctcccctcaatacatgcattcctaaatatcttcacccatgaatatctgggaaaatattcttcagatatatgattgttaaaatgaaactttacatcgtatgccattgatagaattgcaaattacattgacggaactgcaaattaaaatgagacagcactacaaaacctactagaatggtgacaatccgaaacactgacaaaaacaaatgctggccaagatgcgatgcaacaagaacttcaacgtattgctgaagggaatacaaacaggtgtaaccattttgcaagacagtctggcagtttctgataaaattaaacatactcttaccatctgatacagcaatatcactctttgcattttaccccaaggaggtgcaaacttatgtctacacaaaaacctacacatgaatgtttatagcagcttgattcataattgctaaaacctggaagcaactaagatgtcctttagtatatgaatgggtgaactgtggtacaaccaaaatattattcagtgctaaaaagaaatgagctatcaacccatgaaaagacatagaggaaatttaaatgcacattgccaggtgactagaagccaatctgaagaggctgtatactgtatgattccaactatatgacattctggaaaaaactaaactatggagacgatagaaggatcagtggttgccaagggttaggtggaagggatagagaagcagagcacagatttttaaggaggtgaaaatactctgtatgatgctataatcataggttcatgtcatagatttgtcaaaaccctcagaatgtacacccagagcaaatctaaaggtaaacgatagactttggttgataagcacgtgtcaatgtagcttcagcaattgttataagtgtatcattctggtaaaacactttgatagcaggagaagctgtaggcatgtggcacggggtagacgggaaatctctgtaccttccacataatcttgctgtggacctaaagctcttttgaaaaaggctactaaaatattgaaactttaaaatgaatccttttgaataatcaattacattaaaaataataataataaatcaagatgagtctcactatgttgcccaggctggacttatactcactgggctcaacggatcctcctgcctcaggctccctagtagctggaactacagtcatgccaccgcacccagctaattacatcttaatttatactgcaaggtttagtcacgaaacaaaaagtagttgttacttgttaaatactaaatcagaaatggaggcaacgacaaatagaagtagggaaacttactgtgttcattaacttgacatgtgcctcttaaaccaaatacattcaacaatgtattttgaaagcctcggtcaggtaattgagtgaatagattgctctgatattactgtcaaattcaactgaatgtgtagcaaaattaatggctgttttttaatacatagggtggctttctaaccgaagatcaattaaatgtaaacacaatctagcacacatcaagggacagaaggaaataagtattttacataaattaattgttaaagaagcttctatttggctgagattttaagagacgggcctctcactatgttgcccgagctggccttgaattcctgagctcaattgatcctcccacctcagcctcccaagtagctgggactacaaggcacacaacactgctcctaagaattttatttgtaatgcatacacctgagagcattttcaagattaccagtttcaattgtcaggtgtaaactcactctgaagaggtgcttttaaaacctaaaattgattaatagtatttaattattcttcaaatttagttattttacccagaactcctaaaaaaaacaatgagcaaggataccagctgtaagacaaacaatactagcaataaaatcttaccaaagttcacataatactggtgactggtttgcacttcttgatccaaaacctctttcttatccagtgcatttccttaccaaagtaaaaccatcataactggccaggtcaaggtatgaaaggtgaaagaaaagaacaaatataaactgcacaagcagcagttccaaattggtcccgtcaacagaaaaaagcagaaaagaggaaaacaaggcatagatggccaacgtatgagttaagtacacattttatacaggagagtatccatttctgtttgtgatagtcggcattagataaatcatcttaataatttaccagaggccttgaaattgtgatgttagtacatattttcttctaagtaactaactcaaagctacaggtttaaatacatagtcattttttacacatttaagtggtaccaaaataaaaatcaaagttatttaaaatttgccattataaaacaaactactgtaacaatcatatcaattggttaaaatcatatatagaaaaaacaagaataaatcaaatgaagaagttatcttaagaaaactatggtaaaacaaccagaaaagccagggtttgacacatagtgcacaatatagtataagataccattaagaaaagaaacaaacttacccataaactttcagttactttgaattgtaaaagtctttgaaagtttgtaattataattatcaatctaactcaaataagtaaaagcctttgaaagtttataattataataattaccaatctaactcataactgcatctcatcagatgcttacaaaccagagttcctacagcctacatctcactagttgttacttaatactgaacatagacattataattttttagttttagtacaaaattctaacattttagatgatactacagagatactatcctcaatatgaagtatagaagatcttagatactgactagcctaaaatataatttaccgtcactatgtagaacaagcactgtaaggtggctccaaatacattaaacaagtcacaaagcagaagtaacaagttaaatttttatgccttctgaggatcttctgttactaattcaaactaataattaaaattattattagttatattatacactagacaatgcacaagatatgtttacattagttaaccatgtctatttgccggtcttgactctcctcttctccgattgctcaaaaaagagttaacattagctaaaaaatcttaccattctgaaccaaaaattattagaacttaccatttcaaatgaaaagacatgaggtatacctacaacacagcaggaataataaacaaatcacatcattttataaacacagacatatacacacacaaaagtaccaagactatttaatgacactctcagtagagaatttcattttctaaattctcagaacgtttgagctgtttcttttaacattactctgtataagtactcagcacctaaagtcctctaacatcctctgtatcctccacagtgctcagcactatgttttgaatacaggaaacagtgaacaaatttttcttccaaaatggaaacctcccagacgacctgtaagtctaatactctgaagtaaaaagttaggtgtgttgaaaaccaagcaaaaaaaaattgtttctttggctgcttttaaaaatactcttcattacttaatcacgtatgaagtctataaaaatgtatcagcagttgtacctcaatgccacctatgttttccaaagtgccaaatgtgtaatatctgaggcattaatattcaataaatgccaaggtctagtgatccatacagactgaaaaccataactgagctgcattggcatttgaaaaacaagacttcaaacagctacttaattctctcagtttacatctaagtaactataatatgacaaacataaaattcgtgacctcgaaaaattcagagaacacaattagtagacaacaaagtcagaaaaaaattagaatacaacttggtaaatataaagaataaactatattgaacataaaaaggaccaggtgcagtggctcacacctgtaatcccagcactttgggaggcagaggcaggaggattgctttagcccaggagtttgagatcaacctagggaacacagtgagactccaactctacaaaaaaaatgtttttaattaggaggggctggtgtcacacacctgcagtcccaactacatgggaggctgaggcaggaggatcacttaagctgaggagttcaaggtcacagggcgctatgatcgtgccactgaactccagtctgggtgacacagcgagagcctgtcttaaaaaaattttcggccaggtgtagtggctcactcctgtaatcccaacactttgggaggctgaggtaggtggatcacctgaggacaggggttcgagaccagcctggccaacacggtgaaaccccgtctctaccaaaaatacaaaaattagctgggcatggtggcgggtgcctgtcatcccagctactcgggagggtgaagcagaagaatcacttgaacctgggaggcggaggttgccatgagctgagatcgcgccactgtactccagcctggatgacaagagcaaaacaccgcctcaagaaaacaaaaacaaaaacaaaaaaattttctggccaggcacagtgactcatgcctgtaatcccagcactttgggaggccaaggcaggtggatcacttgaggtaaagagttcaagagcagcctggccaacatggtgaaaccccatctctactaaaaaatacaaaaattagccggatgtagtggcgagcacctgtaatctcagctacttggaaggctgaggcacaagaatcacttgaacccaggaggcagaggttgcagtgagtcaagatcacgccactgcactccagcctgggcaacagagcaagactccctccttaaaaccaatttttaattttaaattattttaatgaaaaagatgacagctggggtgaggaatcagaagaaacacatgacctgagtctgaacagatattctccaaaaggaaaaaagaaaacatgataatttttctggattatgaacctctctgaaactctaacagaaggtaagatcaaaaaaatgttaatcaatacaattaagtgtcctctgatgaagtgtgtacacagtatgagattcagtcatcatttccaagtagtcattcaaaaaagatttacaaatatgaatgataaaacacagaaaaccattactaataatcatagcatatgattaggctaactatacctcctggttcacctaagaaagcccattttatgcctattgtaggaagtattttaatagtatgcatgttcatttgtcccagtttgtatgaaaaattctacggtttcccacacatcattagatattattgaaactattaaataatctttggaggagtgatcaaataactcaacacctggttaaaactgacacataccttcaaccaattatcccaaatcagcaaaatcctacaaatcaattctaagaatatgtgtaaacattacaaacttatatatatgtttgtttttatttgatcacaaaagtctaagttaagttacaattatgtaccgtgccaaatattgagaaaaatccttggcttgtaataaattattttaatgaataagtaaaaacattaacaaccgaaactagtcacaactagaacattacatatgagaccattgcaatgtctgttattatccattttgattttcaccaacatgtccaaaccactgggactaggccatcattataccataaataagcctaccagtccagcaggtcacacttaaatctgacatcaaatccttcagcaaataattctttagttatttccataacttaatgaagaggccataaaaatcccttgtaaaatgtgtcttttgtttgaatgcttcagaagtttagacttcaaaaaacaaatcttcttaagcaacataaattcctcattagagctttaaaaactgtagaaaaagagggacagccatgtggaaaccacaaaactgtaacttctgctctggaatcttcacaaaccatttcagaaaataaatttgtatctattcattagtaaataacaacaggatcactcttctctgacagcataaattaatggaatttttttttttaccagatagagtttctgtttttcagttttacacgtgccacatcagggaaagttaggttatgattaaagcaagagatgatagatgaacaaacaaagaaacaacaacaaaaagcccatgcaagaggcaggaaaagaggctgactggttaaagaacaggccagattggacaatactgatcaagaggggttcacatttgaaagaacagtgctttattcctctactgactagaactaaagggattttggccgggtacggtggctcacacctgtaatcccaacactctgggaagccaaggtgggcgggtcacgaggtcaggagttcgagaccagcctgaccaacatggtgaaaccccatctctaccaaaaatacaaaaactttgccgagcgtgggccgggcgtggtggctcatacatgtaatcccaccactttgggaggccgagcgggcggatcacctgaggtcaagagatcgagaccatcctggccaacatggtgaaaccacatctctactaaaaatacaaaaattacccaggcgtggtggcgcacgcctgtagtcccagctatttgggaggctgaggcaggagaatcacttgaacctgggaggcgggggttggagtgggccgaaatcatgtcactgcactccagcctggcgagacagcaagactccgtctcaaaaataaaaataaaaataaaaataaaaaattagccaatcgtggtggcgcgtgcctgtaatcccagatactcggaaggctgaggcaggagaaacacttgcacctgggaggcagaggttgcagtgagccaagatcacgccactgaactccagcctaagcgacagagcaagactccatctcaaaaacgaaaaaaagattttaaaatcccaggtgtcagctgcaatgcagtgactctttaccatttcttcccattaacttttgctctggtttataaccatgactaccaatgaaccttctggatactaatttggattcctcaggaatccttggatctggaatatgaggtactgtgctcagtgagccttctaaaaacactggaaaagaatatataaatgaatagatttgcattattcttcacaagctctacgagtttggtaatatgagccacttttatagattcccttcaactctcggattcagaggtcagcaaacatttcaggtaaagggtcaggtgtaaatattttttaggcttggcaggccatgtagtctcaatacagtctcacatagttgtgtcacaactactcaaatcagtttttgtagggcaaaataaacaaaacaaaacaaaacaaacaaaaaaaagtgttacaaaaataggcagcatgtgaactgagcctggtctgttctagtctgtcaacccctcgactggatgagacaattaaaattattagaactatgcacgcaaaattaatgcatagtttgagataatatgtcctgcacatatagtctgaaagcccaaatcaaggttgccacacccaaattctgcagggtactattcacgtagaatgtcatactgtttgaaccgtgttctaaagatggatatataaccatatgcagtggtaggcaactgtagtcccactattcaggagactgagacaggaggatagcttcaggaggtcaagaccagcctgggtaacacagggagacccaatcaaaagaaagaaaaaaatgaagaaagatgggtacagcagcatgcctactctcccagctacttgggaggctgaggcaggaagattcacttaagcccaggagtttgaggctgtagtgtgctataatcacacttgtcaatagccactgcactccagcctgggcaacacagcaagataccatcaataaataaataaattgcatcctatataaatcttacaccatgttgaaccacatcaagcatgccttccactaacactcccaggatccatgaaaaattcaactattttcatttcagtatgtctcatttcaatacaaggccagtagttttgaatcttcgctaccaaaaagaaataagcaaggtgtagagttttctttaacacgtatatctcctggtaccaacctagacacactgaatcaaaatacttggaggactgaatctcaggcatttttccttaagttccacaaatatattgcaaggttgaaaactactggatttagcaaaaaaatgtgatcaaagatcaatgtattacaatctacctggatcacaaaacaaatcaattattagtagtatgatctaagaacccacattttttaaaagctccttgagtgtttattacgtacattggaaaaacactgttctgctgggcacagtggcatgtgcttgttgtctcagccactcaggaggatgaggaaagaggactgcttgagcccagcctgggcaacatatcaagaccccatctctaaaagaaaaaaaatgttttacattgtccttggaagaagcactacactgctagcctctgccaacattcccttaatcattctggcctcacagtccctcgggtgctacaatggaatgcctctgacaagcaaagaaatacaactgagtcaaactgttgccttagcatacaacatacctttattctcaagtttattatgtgtgttgaataaactgtgttgaaacacctagggctattcccaactactcaaatgggactaataagctttaatagtaagtcaggtatatatttagttcaatgcaggaaacctgaaaagggtatgaagaattattcttttctttattgaaaaggcaaacattaatatgtaccatacaagaaaaagaaacttctcagctgggtgtggtggctcatgcctgtaatcccagcattttgggaagccaaggcgggcagatcacctgaggtcaggagttcgagactatcctggccaacatggtgaaaccccatctctaccaaaaatacaaaaattagctgggcatggtggcaggcacctgtaatcccagctactcgggaggctaaggcaggagagtcgcttgaacccaggaggcagaggttgcagtgagctgagatcatcccattgcactccagcctgaacgacaagagtgaaactctgcctcaataaataaataaaaaaaaaaagaaacttctcaaattttaaaaccaagtaacatacaatttaaacatcaccccaattttcctaacccaaatatttcataactacatgatacaataactaaagctaaaataagatggacgtttggatatttttatgacattaacattttcccaagaagcaatgtttactccaagaaactgcatcaaccaaatgctagaactaaaatctgtcatttagtccaatgcagatttttcccataaagactggtaagtactgaagtgtttaaactacttaatctacagttggtggagtaacctaatatgaaaacaatcacaagacaattataaaaaacaatctcataaaattctcattgcttccagaataatagcttttaatgtgtccaaaaattgtgataagtagaaaatttccacttagtaaatactgcctggaaaaaaattgaatacactctatattatggtaaagacaaacctaaatgcaattaagacatattattaaaatgtatacattcttaaggcagttgaatgttatcctaaatgagtaaaaaatgttgtttaatttatagttacaacagtaattatcaaaaagtttgtcttctaaggaaaaatcaagtattaaataaaactgacaactgatattgatgaagtactggcttacatccttgaaactcttaaaaatatattcccatgtgtcataaaattatgatcaagttgaaggctgacaaacaaaaagatgaccagatatgacaagtgttttcactctttctttgttacatgaaattattatttaaaatgtgaaatatgtaaatcaatatttattttatacttaaaagtcccataactcttagttttgttggaatatttctattaggaaggcaagaagagagaggtggcatcttaaaattaacaaagaaaatcaactttactcattacttggacaagttgaacacttaccatttgattcctccctttaaactgaacagtgaaataaagagaaagcacataagagggcctaatttcaaagcttaaacacacacacacacacacacacacacacacacacacacacacacacagcattaaaattgtttaacaattttctccaaagacagttttcaaagtaaatgaagaacaactgccagaatggcctcaatgcattcttaatacaatgctttcctattaatatactcccattaacacaaaatatttgagataggtagagctttcattcatattgcttttagtgcttaagtttgcagtagtaagaggcactgtgaagcttggaaccaaataaaactgacaccaaaataatgaaaaacttgtgtagattcatatcacttctaatcacaaataaacttatagaacactagtcagtgttacacaattatcatacctcatttacatactatttgaaatacggatatcccaaaaagttaagagcatagtaactttgtggtctatctaccataaatactaattttaaaattttttaaaaaacataaatattccagcccaggtttccacagacactataaaaaggtcagaaaaaaatattttaagttattgcgagtcacaaatcatttctaatattcttctttcttttgcaataaccctttaaaaacagaagcaccatcagtatctctgtggtggagtaataaaaaccaggcagtagtcccaggctagagcttgccaacttacactctagccaaattaattttatcatgatgcttcaagtatgcgatacatactttaagtaactactagaaaagaaggtatattgtcacctaatgcttttctataagcataatcttatgaaacaatagatgatctattttagaaatgtcggctgggcatggtggctgacacctgtaatcccagcacttttggaggctgaggtgggcagatcacttgaggtaaagagttcgacaccagcctggccaatatagtgaaaccccgtctctactaaaaatacaaaaattagccaggtgtggtggtgcgcacctgtaatcccagctacttgggagactgaggcaggagaatcgcttgaacctgggaggcagaggttgcagtgagctgagattgtgccactgcactccagcctggttgacagagcaagattccgtctcaaaaaaaaaaaaaaggttactaaaatattaaagacaggaagagaaaacctatagactaaaagaggctggatataacagtcaattcaaagaaaccaaatgtttaaaaaaaaaaaaattaagacctgtgcaaatctgggctttaattagttaagatgaaagagctgaccatttttaaaatatgataaagatttttttaaaaagtcctcatcttttagagatacatactgaaaataaaattatatgaaatcaggtatttcaaataacataaattgggaaataaagtggttatacttaaagatgtaaaagattggccatatgtttataagtgttcactacaattcttctgtacatgtctgaaatcttccaaaatagagatgtttcaatattagtatgtggtgaaaatcagtcaagtggaaatgatgtatatatcaagatttctaacttaatagcatatgtttttttaaagatcaaccaaaataataggaaaaaatataacatccacttcataaaacatagatatcttcagaaactaattttactttaccacctatgagaggttaagaaaatcactaatttatcaaacatgatgaatttagaaagattagaaaagactactgtataaaccaaaatctaaagcattctaaatatgcatcataaacctgaaaatataaaatcattttagttaactagtagtttacttacattttccatgtagtttggcttaaagccctcttgctgtcgcctcagttcctcctgttctctgtgtcggatcatttcttcctcacgccgccgatgctcctcttcatgtctgaaaatttttcaaataaaaatttcagcatcataacatgtgggctgccattggacattttacttcatgtaaaatgaaatcatttatgcaatcatattatgccaaacctgtaatcacgactgaccacggcatcctaaatttaccttccttctatgtcactccaagcctttaataaatcaaaaaagccaaagaaataaagtaacttagctaaggtaaaccagaaaaacaaagtaaaatcataactaggatagttatttgcgtatattcaagaaattgagagtcaaaaaaagctgaaacatgtactctcttactatagaaaggaaaaaatctcagccagccatggtggctcacacctgtaatcccagcactttgggaggttgaggcgagtacatcacctgaggtcgggaattcaagacctgcctggccaacatggtgaaaccctatctctactaaaaatacaaaaattagccaggtgtgttataatcccagctactcgagaggctgaggcaccagaataggttgaactcaggaggcagaggttgcagtgagcggagatcgcgcccctgcactccagactgggcaacagtgagaccctgtctcagaaaaaaaaaacaaaaaaacaaaaaaaaaaaaaacagaaaaagtctgagatctactgatctatcactggcactgcacagttcttaaagccactcagaacatatccagagataagccacctcaaaaaaccacaatgcctagacaaaaatcctatttccaaaaggaagccttaccaactcctccctccccatattcatcaacccactgaaagaaatcccctgaagcaggtgtcagtccacaatctgcttttagaaattacgtgttatagcataaacatttacattactgtctatggttacttttaagaggaaaaatctatatagtaatattgaagtaacagactcacattatattggcatttaaaccaatgcaaattcaaatatacacaggttgagtttccctaaaccaaaaatctgaaagcattcttgaatctttctaaacctgaaatgctccaaaatctggatttgttgttgttgttgttgttgttgagacagggtcttactctgtcacccatgctggagtgtcccaatctcagctcagctcactgcagccttgacctcccaggctcaagcaatcctccaatcttagcctcccaagtagctgggactacgggcacgtgccactatgtccagataatgttttgtacttttgtagagacagggtcttgccatgttgcccagactggtcttaaactcctgggctcaagtggtctgcctgcctcaatctcccaaagtgctgggattacaggcgtgagccccaacaccccggctggaacttcctgatagccaacatgatgtttaaaaaaatgctcactggggcatttcagatttaggatgctcacctggtaaacacaatgcaaatactgaaaatgtgaaaaaatccaaaatacttattctggtgttaaacatgtcccataatggatactcaaggtgtatgccctccaccaataaaactgcaaaagtaatttatatagtgaaggctatataaagctgatgccccattattaggtctcgttttccagattactcttataacgtacttttcctacatttagaattgcaaatcctcaaatttcaagataccttgttcttgtttgttgcacaacactcccgctaaatctgagtccactaattcaaagatatggtgatttcttctattaccagagaaaaaactcagaacttcatgtcagacaacatgaacaaaaatgttcctaagggatttcacgcaaaatctggactattttaagattgttgtcttactctctatacaactcttagtataatccttaaaaataatctttaagtaaactggttaatccatttcctggatattaacacatttcatatattttactgtgaagaaagtacttcacattcatgggtgtgggtggcgatgggaagatccaataaaggtcaaatgtgttgaaattcagtttttctcatttaaaaaagggtcaatatactcataatataccaatactacttataaaaagagtcaatatactaataatatacttatatgctcagtgggatctggggcagcaccccataatcaaccacattaatatttctgcagtaagataaaacattcacactctggaggtaataaaggtttcacataacaggagttcagatcaacttttgccatcaaatggattcacgtcagattgccacctgaatgaggatacatagaaaaacttttggcagggcgcggtggctcacgcctgtaatcccacactttgggagcctgaggcaggtgaatcacctgaggtcaggagttcaagactagcctgggcaacatggtaaaaccctgtctctactaaaaatacaaaaatttgctggacgcggtggcacgtgcatgtaatcccagctactcgggaggctgacgcaggagaatcgcttgagcccaggaggcggaggttgcagagagctgagactgcgccactgcactccagcttgcacaatacagcgagactccatctcaaaaaaaaaagaaaaagaaaaagaaaaaaaaaacaccaactttttagtctcaaagcttccgaattacaaagacaatacagtagacacagtgaccttgttgggggcccacttctaccacataattttaaatgaacaagcctatttccagtaaacagaaatgtacgcacaaatgtgcagggacatatgtatacacagatatatattgtggcattatttataaaagcaaaagatcaaggacacattaatcagttataaatgggagacaaggttcactgacaccttgggagacaagaaacacatctgttacagaggtggattactatctactggcatgaaagaatgtctgcgatgcaaatgtcaggaaaaagggcaagtaaaagaatggtattgctattactgcttttaaaaaccatttttatggccgaatttggtggctcacacctgtaatcccaggattactgggattactttgggaggtggaggcagaagcgaaggtgggaggatcacttgagtgacagcctctctccacgaaaaatagaaaatattagccacggccatgcacagtgactcatgtctgtaatcctagcactctgggaggccgagacgggcagatcacttgaggtcagcagttcaagaccagcctggtccacatggtaaaaccccatctctactaaaaatacaaaaaaattacccaggtgtgttggcgcacacctgtaatcccagctactcaggaggatgaggcaggagaatcgctggaacctgggaggcggaggttgcagtgagctgagatcatgccactgcactgcagcctgggtgacagagcaaggctccatttcaaaaacaagaaaaaagaaaaaaaaatatatatatatatatattaggcaggtatggtggcacacgcttgtagtccctgctactagggaggctaaggtgggaagatcacttgaaccccataaggtgagactgcggggagccgtgatcacaccactgcactccattctgggtgacagagtgagattctgtctaaaaaataaaataaaaatgatttttaaaaccatagaagagggtatgaaaaagtttatataccacattggaaatgattaggggaacaggagcattgcccttacgattataccacacagaagattctataatctaaatttaatgacagcatacagaaacattcctgttgtccatatatgtttgctttcaattatttctactccacaaatgctttaatgaccacctttataattatacaaattacctcttcaggtcaaggattgctttctaggttatattcacaaatggaactactaaggagaggagaactagtaattatgacaaattttaaaccttcacgttacatttaattgaaaactaataaaatttcaattttacaatttgttttattttgaggcccattaattatttacaggtctcaaatattcttgcaggattctgaaagacgcctactggatgaaacctccttgctgttattgttcagcactatggctccacatccaacacagagcccaagacagaagaagggctttataataattcgctaaatgacttaagaaaggaagtgggggccaggcgcactggctcacgcctgtaatcccagcactttgggaggccaaggccggcagatcacctgaggtcaggagttcgagacgagcctggccaacatggtgaaaccctgtctctactacaactacaaaaactagcctggcgtggtggcaggtgcctgtaatcccagttacttgggaggctaaggcagcagaatctcttgaacccgggaggcagaggttacagtgagtcaagattgcaccactgtactccagcctgggcgaaagagcaagattccttctcaaaaaaaaaataataagaatataaaaattagccgggcgtggtggcgtgcacttttaattccagctactcaggaggccgaggcaggagaatcacttgaacctgggaagtggaggttgccgtgagccgagatcacaccactgcattacagcctgagcgacagagcgagactccgtctcaaaaaatcaaacaaacaaacaaacaaaaaaaacaaagaaaggaaggaagtggggccgggtgcggtggctcatgcttgtaatcccagcgctttgggaggacaaggtgggctgatcatctgaggtcaagggtttgcgaccagcttggccaacatggtaaaaccacgtctcgactaaaaatacaaaaattagccaggcagggtggtgggcgcctataatcccagctactcgggaggctgaggcaggagaatcacttgaaccgaagaggcagaggttgcagcgaccgagatcgcgccaccgcactccagcctgggcgacaagaacgaaactctgtctcaaaaaacaaaccaaagaaacgaagtgggtaggtgagtaaatgggtggaaagagaaggaatgaaggaataagtgaacaaacaaaacaaaggaataactactaagtggtcaagtcacagactgaaccagttcatgtaagcccctcatcctggtcttcctttggtacctgccacaacctctgaagaattaagttacctatgaaaaactaaataatttatttatagcattgaaagtaaaaccagaaacttgtgtactccaaatacatttctcccaaaatgtactgtcctaggccagtttttctatcttccaactaaagtaaagcacaaaggcagaattcagactatttggcttgttaacaaataaagctatcttacttggcagcagcctcagccagataaatctcttcaatttaattgtgacaattttcttcatttgctccatcttgcaaatatatatgagttcccagacataatctttttttctttcctttatacatactgcaaaactactcaaaaaaaaaattttttttttgagacgcagtcccctctgtcacccaggctggagtgcagtggcgccatctctgctcactgcaagctacgcctcctgggttcaagccattctcctgcctcagactctgagtagctgggactacaggcgcccgccaccacgtccggctaattttttgtatttttagtaaagacagggtttcaccgtgttagctaggatggtctcgatctcctgaccttgtgatccgcctgcctcggcctcccaaagtgctgggattacaggcatgagccaccgcgcccggccaaaaactactcaattttaaggcaagttgttcacacttcttaaatcaagattcttacagctaatttcaaaagaaactccccagccaccaggaaaaactaagattgtaacagatttattactgcctgtatttactagaatttggtcaaacataaaggttacccgtcaaattatcaccttatattgagatattttcagttaattgaattttagattaaatctgatgcccctgtatactgagattacataataaaaaaaatcacgcaataaaaaattacatcttcaggccacgcacagtggctcaagcctgtaatcccagcactttgggaggccgaggcgggcggatcacaaggtcagcagatcgagaccatcctggctaacacagtgaaaccccatctctactaaaaatacaaaaaattagccaggtgtggtgacaggcgcctgtaatcctagctactccggaggctgaggcaggagaatggcatgaacctgggaggcagagcttgcagtgagccgagatcgcgccactgcactccagcctgggcgacagagtgagactccgtctcgaaaaaataaataaaataaaataaaaaattacatctgcaacaagtattccacatctcagcctatgattaaatcagcaacgtatcctctatgtgcctcacgagcttcccctaatattaaccccttgtataaccatagtacaaaattatgaaaaccaggaatgaatactggcacaatattataattaactatagacattactaaaatttcaccagtttcctcactaatctttttttaaagagatagggtcttcctatgttttttgtttgtttgcttgcttgtttatttgttttaagagacagggtcttgctatgtttctgaggctggagtgcagtggctattcacaggcgctatcccactactaatcagcacgggagtttttacctactccatttctgacttgggccagttcacccctccttaggtaacctggtagtcccctgctcccagaaggtcaccatattgatgccaaacttaatgcggacatccaatcgacatagtgcattacagcccagaactcctgggttcaagcaatccgcccacctcagcctcctaagtagctgggaccacaggcccactaacacctttcttctgttccaataccttatccagaatcccacattgcatttagtcgttatttctccttagtctccaacagtctgtaacagttcagtctttctatctttcatgaacctgacactattaaagagaactgattattttgtagaatgtccttgaatttgggtttgttttttctcataactggaatgattatgcatatctggtaagaatatcacagaaataatgttatatcccattcagtgaatcatatcaaggggctcctgatgttaactgtcttattacaggtgatatgaaatttagtgtttggttatggtggtgtctactgggtttctccctttaaatttaatattttttccttttgtatacaaatttgagactatgcaaaaaccctgtttctcaagttttgcccaccaactttggtatccatcaaaaaagcttgtctgtagcaattattattaaagatcgaggcaccagttatgttcattgttactgaagcttctagggcctctcagtagaaaaagccataaaatacagcatatggggcaggcatggtggcacatgcctgtaatatcagcgctttcggaggctgaggcaggaaagatcacttgaggccaggagtttgataccagcctaagcaacatagcataatcccatctctataaaaaaataaaaattaaaaaattagctgggtgtggtggtaaacacctatagtcccagctacttgggaggctaaggcaggattgtttgagctcaggagttcgaggttacagtcagctatgattgagacactgcacttcagcctgagtgacagggcaagaccttgtctcttaaataatttttttaaattaaaaataaaatacagtatatgtatacatattaacccatacataaacacacatctatatttctgcatgtatttgtcaatattaaacaccacagagttcatacctctgattcaaatcacactcacacaggattttaagtttagccgttcatctttctctaatgatgagaaatttgagtctcattatccacaatatacagtcataccttggtatgtgcaggggattggttccagaacctcccccagataccagaatccactgatgctcaactccctgacatatggtgtagtattcgcatataacctatgcacatcctcctacacacttaaaagcatctctacttataatacctaatacaatgtaaagactatgtaaacagcactgtttacagagaacgacaagtaacaaaaagtcctcctacacacttaaaagcatctctagattacttataatacctaacacaatataaaggctatgtaaatagttgttatactgcacggtttagagaatgacaagttagccgggtgcagtggctcacgcctgtaatcccagcactttgggaggctgaggcgggaggatcacaaggtcacgagttcgagaccatcctggctaacacggtgaaaccccgtctctactaaaaatacaaaaaaatagccaggcatggtggcacgcgtctatagtcccagctacttgggaggctgaggcaggagaatggcgtgaactcggaggcgaagcttgcagtgagccgagattgcgccactgcactccagcctgggcgacagagcgagactccatctcaaaaaaaaaaaaaaaagagaatgacaagtttaaaaagtctgttaatgttagtatatacacaatttttccccagatattatcaatccacagttggctgaatccatagatgtagaacccacagatacaaaagactgtaggtactaatctgttcatgtaacgtatacacacaaagtggtttcagaactactagcccatatgcctaactagcttacagaatttatgtatggttcttatcattagtattatgatatccagtcaacacactattttccagttatttaggttccttgttttcttccctaccccctttcaatgtgatgatgttattcatttgtaagacaattaggttaatttcttgtatttttgtatcctattttggaatccacccctcatattgtttggttttaatgatttattttttgcttacatgaggggtaggtataatttcaaaaagcctagctgtcatctctaagttttaagaggaaaaagctagattcaggtaagcctttatgttaggggagaggaggtttcgttgtctttgttaaaaatagaaaagatctggccgggcgtggtggctcacacctgtaatcccagcactttgggaggccgaggcaggtagatcacctgaggacgggagttcaagaccagcctggccaacatggtgaagccccatctctactaaaaatacaaaataaggtgggcatggtggcgcaagcctgtaatcccagctaggaagctgaggcaggagaatcactgggacctgggaggcagaggttacagtgagccaagatcgcaccattgcattcaagcctgggcagcaagagcgaaactccgtctccaaaataaaatttaaaaaaaaagtagaagagatttgaacatgtctatataaaaaggaaaaaagaaaagttttaaaaaaggttcctgaggaaggcacattcatgatgttgagagttgtttaaaaaaaaaaaaaaaaaaacagtagttctcaagctttcagatctatctgaatgctggaggattccaggtggctgggcctcaccactattgtttctcattcagtagttctgcagggaggcttgagactacattcctaacagttccctaggtgaaatgttaatgctgtctgtccagggaatatgatttaagaatgaattggggccgggcacggtggctcacgcctgtaatcccagcactttgggaggccgaggcaggcggatcacctgaggtccggagttcgagaccagcctgaccaacatggagaaaccccgtctctactaaaagtacaaaattagccgagcatggtggcacatgcctgtaatcccagctactcgggaggctgaggcaggagaatggcttgaacccgggaggcggaggttgctgtgagccgagatcgcgccattgcactccagcctgggcaacaagagcgaaactccctctcaaaaaaaaaaaagaatgaattgggtagagtaaaatcacatagaaatatttataaattgataaactcaggtacaaagtttgaagaaatacatcaaaatatacagaatatcacctatctgtagaccagagaagcttcaaatttgttcacggtttttcacttttttctttacttttacttccccatgaacaccttattttcttatcacaagcaccttacatttttaaagcaaatactattttcaaaaacagatttctacatttgctttaactatcatagctttgtttataatatttcctaactagtatgatttttgaacctttgaagagtaatgtttataccattatattttgcaattaaacaccacaggcacaaggtgagctatcaatgtgggtttatatatcttgaattaaccactctctcaaacatgcttacttaaacctaaaagatttcaagctgaccatcacgattgtctattatgtactgagattttaagtccccataaccccttttaacacggagtcaacttccagaaatcttttttttttttttgagatggagtctcactgtgtagcccaggctggagtgcagtggcaagatctcagatcactgcaacctccgcctcctggattcaagcgattctcctgcctcaacgccctgagtagctgggattacaggcgcgtgccaccacagccagctaattttttagttttagtagagacagggtttcaccatgttggccaagctggtctcgaactcctgacctcatgtgatctgcccacctcagcctcccaaagtgctggaattacaggcatgagctactgcccccagcctcagaaatcttgtttaaagattatcagaagcacaaagttacataaagatattcatagtagagttttacacataacaaaataaataagagcaacgcaaatatatccatctctggaaaaatggatattcacagcatattcttataataaattacatataataatacctaaaacccttgtttaacttcaaagtttagcattcaaagtgcccttaaccagctaaaaaccagcaaagaattatgctacattatgaagtaattcactgtatgtggttaaaatgggcaatttttctatttttcctgtgatactcaacttatacaacttgtaacaggttgtggggagtttttattaataagacatacaattcatgtttcttaaaatgatcttcttttaccttagttgtatttgcttccgtttttgcaactcttggtttctgagttcttccaagcgtctgagttcttcttgacgcctcattagatctataaaataatgactgcacattaatatttttagtttccctttccatatttttataccaataagcatagaagttctctatcactggcaatatattggtatattactcattttataataatgtaagctgggtaattaaataaatatcctttctgagcacgtttcttcacgtatataaaaaagagtattcaagttcattcttggccaggtgcggtggcccacgcctacaatcccagtaatttgggaggccaaggcaggcgtatcactcgaggccaggagtttgagaccagcctggccaacaaggcaaaaccccaactctaccaaaactacaaaaattagctgggcatggtggcgcgcgcctgtagtcccagctactcagaaggctgaggcaggagaatcacttgaacccgggaggtggaggatgcaatgagttgagattgtgccactgcactccagcctgaatgacagagcaagactccatctcaaaaacaagttcattgttaggggaaaaacacgtaataaactcatcttggctgggcgcggtggctcacgccttataatcccaacactttgggaagcccaggtgggcaacagagtgagatgactcaatctcaaaaaaaaaaaaaaaacaaacaaataaataaataaaaattcatctttacgtcaagaaattaaaataggtaggctggcttgtgcctgtaatcccagcactttgggaggccgaggcaggcggatcacttcggccgaggagttcgagaccagcctgagtaacacagtgaaaccctgtctacaaaaaatacaaaaatcagggccaggtgtggtgcctcacaggtggaatctcaacactttgggaggccaaggcaggcggatcacctgaggttgggagttcgagaccagcatggccaacatggcgcaaccccatctctactaaaaatacaaaaattagctgggtatggaggtgcacgcctgtaattccagctactcgggagattgagacaggagaatcacttgaatatgggaggcggaggttgcagtgagccaaaattgcgccactgcactccagcctgggttgcacagcagaactgtctctaaaataaaataacaaattgtaattgttttcagcagcaaatgcaaagccccaacacatgccttcagagacaccagcagagagcacttaagaaccagaccaaacaggaatcatgacataaaacccaaggaacctccctcgcaacacgattagcatgaaattcctccctaactaagccaatgtcttacgaagaagagtgaggagacaattcttcaaagaagaaagcaaagataaatgctgatataaacaagacttttcaacaacaaaaaagcatttccactatcaccaatccctgccatatcaagaatgggggggttccagagtaagataatgaaaagtacatttgtattgcacatctaagaagtagtgtataaactttccacgttaaaaatctccaaagctaaaaatctttgtgtgtgattttgtataaaattatgtatgtatatatgcatatattttaaaataataaaatgttaaaatactctggatggcacaattgctggttgcttttattttccttttctctttatatctgaaatgtctaaagtgaacaaattacctcaactgaatgtttcttaataaacacctgtactcaagagttgactcatataatactacagctaaagttaatctaaggtaccaataacccaaacttcataacaatagcaagacaggcatcataaccataacaaggtaaatattgttctccccattttacagattaaaaacagacatttataaattatgcaaaaaaaaaggattcagacagattataaagttgctccagctattacatgattcaactgggatgccaggccaaacctctccttattccaaagctctttcaaaaaagtatgccaaacctagttgatcagactcaattggaaaacttaaaaatatgcatttggggatgttgctaagaaaagtctgttttggtatatgagacagggcccaggtagttctcataataggcccatagagaaaacacttgattatctgaaaaatgttaaacatgaccgcaattatttcgaacctttataacataattctcaaccttaaatactcattagaattacttaaatacctgaccagtatttaagtaatggctcacacctgtaatcccagcactttgggaggctgaggcaggcggatcacctgaggtcgggagttggaggccagcctgaccaacatggagaaaccccgtctctactaaaaacacaaaaattagccaggcgtggtggcgcatgcctgtaatcagagctactcaggaggcttaggcaggagaatcacttgaacccgggaggcggaggctgcagtgggctgaggtcacaccattgcactccagcctgggcaacaagagcgaaactccatctcaaaaacaaaaaaattacttaaataccttttttgttttttctctcagagacagggtctcactctggcacccaggctggagtagagtggcatgatggtagctcactacagcctcaaaaacctgggctcaagagatcttcccacctcagtctccccaacagccaggactgacaggcttttaacctctcagatcttatcaccttacttgtaacactggtataattagctcaaaggctccaacaatgaaattatcaaataagcacaattacctaatacttaaaagaactataaacttaaaactaccattttatgttgactaaattatatattttttaaagttcctaatacccaaagttcctgatatttcactaaagcttatacatctgtacactgccatgataatatctttctaggggaaaaaactgtaaaaagtacataactagagatgtctttttttttcttttttttcttttttttgagacagagtctcgctttgttgcccaggctggaatgcaatggcgaggtctcggctcactgcaacctctgcctaccaggttcaagcaattctcctgcctcagcctcccaagtagctgggattataggcgcccacaaccgcgcccagctaatttttgtatttttagtagagatgaggtttcaccatcttggccaggctggtcttgaactcgtaaccttgtgatccacccgccttggccttccaaagtgctgggattaaaggcgtgagccaccgcgcccggcccaactagagatgtctttatcttttgatccaggaaattacactcaggaatttttcttaataaaataaagccatctacagtcatgaaggcatcatctaccgtattacttattacttactaaaccaaataacactttgaaatgctttcctggctgggcacagtggcttaccaaagtgggaggctgcctcggcctccgaaagtaatcccagcactttgggaggctgaggcgggtggatcacttgaggtcaggagtttgagacctgcctggccaacatggcaaaatactgtctctattaaaactacaaaaataagccgggcatggtggcacacgcctgtagtcccagctactcaaggaggatgaggcagaagaatcacttgaacctgggaggcacaggttgcagtgagcagagattatgccaacgcagtccagcctgggtgacacagcaagactgtctcaaattaattaattaattaaaatgctgtcctaacaaatttaatgataaaattacatgaaattatatgctataatttcaatgtatcataaatacaggtacagaaaaaaggaatataaacaaactaaaattttgatttgctagactgtaagacagtgttttctcaatttaaaattgcacaagtcatgaaaactgaatgtataacttctgatctaacaattttattttctaaaaatactagtctctttatttttctttcagtttttattttaccgctgatctgtccagatttatgacactgaattaatttttttttttttttttgagatgggagtctcgctctgtcgccctggctggagtgcagtggcgtgatctcggctcactgcaacctccacctcctgggttcaagcaattctcccgcctcagcctcccaagtagctgggactacaggcgcatgccaccaggcctggctaatttttcgtatttccaatagagatggggtttcaccatgttagccaggatggtctcgatctcctgtcggcattaatgttctttaatcataaacctcacatgtatttaaatcctaatatctcaagtaggttcaggcatgactgttctgttcttcacttatgtgatgtttatcctctgttgatttctttaagaagggctcacagcaacatatttgttttgttttttgtttttttttttttttgagacggagtctcgctctgtcgccaggctggagtgcggtggtgcgatcttggctcactgcaacctccgactccctagttcaagcaattctcctgcctcagctacccgagcagctcacacctataatcctagcactttgggaggctgaggtgggcggatcacgaggtcaggagttcaagatcagcctgaccaacatggtgaaaccccatctctactactaatacaaaaattagccgactgtggtggcatgcacctgtaatccaggctactcaagaggctgaggcaggagaatcacttgaaacacagaggcagaggttgcagcaagccgagattgcgccactgcactccagcctgggcaacagagcgagactccgtctctaaataaataaataaatgttaaaaaaaaataaatgtaatggagccaggcgcagtggctcacgcctgtaatcctgacactttgggaggctgaggcgggcagatcacttgaggccaggagtttgaggccagcctggccaacatggcaaagccctgtctctaccaaaaatacaaaaattagccgggtatggtggctcatgcctgagggaggagaatcacttgaacccgggaaccggaggttgtagtgagctgagattgtgccactgaacaccagcctgggcaacagagtgagactccatctcaaaaaaaaatttttttttaatgtaatgggagttgaatctagaaaggactaaataattatcagtaaagtataaatcaaacaattattattgtaaggtacccatgtgttcaataagaatcaacatttacggctgggtgtggtggctcacgcctgtaaccccaacaccttgggaggctgaggcggatggatcacttgaggtcaggagttcgagaccagcctgaccaacatggagaaaccccatctctactaaaatacaaaattagccaggcgtggtggcgcatgcctgtaatcccagctactcaagaggctgaggcaggagactcgcttgaacccaggaggtggaggttgcagtatgccgagatggcgccatttcactccagcctgggcaacaagagtgaaactccgtctcaaaaaaataaaaaaaaatcaacatttacaaaaattttctgatacatgcatatatattctttgcagcactgcttttaaaaacaaactgaaaagagaaattgttatcgaaagaggatgaactaaactaattgtacccatataaaagaatatcatacaaccattaaaaatataaggcggatatttacatatatattcatgtagaaagtaaaaaaggtacagaaaaggtaaacagcttttttttagagacagagtctcgttctgtcatccaggctggagtacagtggcataattacagctcactacagcctcaagctcccaggctcaagtgatcctcccacctaagccttcccaagtagctgcaactacagacacatgccaccatgcccagctaatttctgtacttttggtagagacggggtctcactgtgttactgaggttagtcttgaactgctggactcaagcaatcctcccacctcagcttcccagtgctagaattacaggcatgagccactacacccagccagtttgttttgttgttacgatttttgggttttttgcttacaaatacacaaaaacatctaatgacatatgcaaattttttttcattaaagaatacaaaagagacttaaaatacaaaaagtgattcctacaaaaaagcagaaggtagtaaatagggggacaatttttctgtattgtttgagatttctccttccatgatatgtcatgatacatgtttctgcggaaccacacaactaagattaattacagtctctcctcaacctgaatacatccttagaaatgctggatgaaatacaaaattgtaggccgggtacagtggcttatgcctgtaatcccagcactgtgggaggtcaaggcaggtagatcacttgaggtcaggagttcgaaaccagcttgaccaacatgatgaaaccccatctctactaaaaatacaaaattagctgggcgtggtggtgtacacctgtaatcctagctacttgggatgctgaggcaggagaatcgcttgaactcagaaggcaagaggtaggtctacaatgagctgaagttgcaccactgcactccagcttgggcgaagagcaagagtctgtctcaaaaaaagaaaaaaaaaaagaaatacaaaattgtagaacaaatgggagaaagttgtaactttttaaatttttaaacaaactacaactgaaatttaccaattgcagactttggatcaaataagtacaagtacttcggcacaagtgaacccagaagcagggagtaggattcaacaagcaatgtgattttctaatattataaactaagatattgttaacagaggctttaaatgaacacacacgataaacaacaaaaaaactcatgggaaataactgcaaaattactctacttcaaacatcaaaataccttcaggcaaagttttctaagagctcaagaaaaaactgaagtctaaggaaatgttctttgccatcaatatatcctcagtacctcagacatgtctcccataactgacattaaagatgtgctaaattagtgaatgttataccactgttcgtagcatcaacacaaatctttagtacagatgcttccacatctaatcaacattgttatctaactagggcacaactgtaggtaggtgggaaacaaaatggcagagaagtgcctagcaggctaagagaaaacaattcatattgaacagaagggctagggtaaccacagagcccaggaaacgaaatttcaaaaatttccaagatgattctaatgggtaataaaatttcaaaaccactggactggacaaactttaagatctcttggctgggcacggtggctcatatctgtaatcccagcactatgggaggccaaggtgggtagatcactcgaggctaggagttcaagaccagcttggccaacatggagaaatcccatctctactaaaaatacaaaaaaactggccaggcacagtggctcatgcctgcaatcccagcactttgggaggccgaggcgggcggatcacctgaggtcaggagttcaagagcagcctggccaacatggtaaaaccccatctctactaaaaatacaaaaaattagccgagtgtagaggcatacacttgtaatcccagccacttaggaggcggaggcaggaggattacttgaacccccgaggtggaggttgcagtgagctaagatcacaccaatgcactccagcctgggcgacaacagtgagactccatctcaaattttaaaaaagcaaaaaaattagctgggcgtggtagcacgcacctgtagtcccagggagggtgtactagggagggtgaggcacgagaattgcctcaacatgggaggcggaagttgcagtgtgccgagatcatgccactgcactccaggctgggcgacagagtgagattctgtctcaaaaaaaaaaaaaaaaatctctcttccagatctaacagctaatgaatgattcagtacctttatctcaaataacaacttgcacattttccacaaaataaaagacagtttatctttttttttttttttgaaatggagtctcgctctgtctgtcgcccaggctggagtgcagtggcgtgatctcggcttaccgcaacctccacctcctgggttcaagtaattccctgcctcccaagtagctgggattacaggcgcccgccaccacatctggctaatgacagtttacctttaaatctactctaagatataaatgaattcaattttgttagaaaagtgaacttatagaactaccaagcttagggtccaaattaaaccaaaacacctaactagtttctatggtttgctgggctcgattttgttttaacgtatgtggcatcagcacagttactcaatgacttcatcataagtgctcaataaacatttactgaatagtgatgtacgaaatactagaacacacataacaaaaaaacctacacttcattctaaagcaagtgagaatttacccaaaaggatttagagaagaatgatcaaaatttcacctgctaagaaaaatactgaatctagtacacagaacggtttaaagaaagccaagattagatggcagaaacgttcagcaggaatgctactgcagaaattcagacaggcagctgtggtaccttgatctctggggacagccaagagaaggtaaatacaaaaaaactagccggacattgtggtgtgtgcctgtaatcccagctactcgggaggctgaggcaggagaattgcttgaacccaggtggtggaggctgcagggagacaatatggcgccactgcactccagcctgggcaacagagcaagactccatctcaaaaaaaacaaaaaacaaacaaacaaaaatatatatatatatatacacttaccaattactaacttttcctaaatccccatatcaatgtgtacaaatgaatctttttcatctctaccagattatccatctgtactctttcaaacatgtaataataatcttaaatagccagcatttgtccaaattcttctcatcaaacaaaaaatcctgtatgtgccatgtctacctaccaaaatttgcctgctatgtttctgtttgccaagagaatcatgtatttgatactggcacaatttaatacccgcaaattacctccaacactactgcttgcataagtaaaactaactttttaattttttttttgagacagttttgctcttgttgcccaggctggagcacaatgatgcgatctcagctcacagcaacctctacctcccgggttcaagcaattctcctgcctcagcctcccaactagctgggattacaggtgcgcaccaccacggctggctaattttgtatttttagtagagatggggtttctccaggttggtcaggcaggtctcgaactcccgacctcaggtgatccatctgccttggccccccaaagtgctgggattacaggcgtgagccaccgcgcccgtcaagtaaaactaacttttagtaagttgtgttcttttttttaagggaagttatctgggaaaagggagattttcacacctaatatgttgagttccaactttacctctaaactcctaaatggcactttacacagtagtacatgaatggtacacacacttaagggaaaaaaaaaatcataccacatgtacatgaaaatccatatttaccttgcctcattagcattaattggtgttcatgcctagctgcttccatttctgcctccagtttctctttggcttctctgatgtttctatcaacctgctcacgctgctgcttttccatttcatcaagagccttccatcgagatgcatactcaaattcaaatgtcccaggttgagcaaaacgtggtggttgttctctttccctaaattaacattaaaacatacagaaatgtatgcttaaaaggtaaaacaacaacaaatgagaacaacaagcacttacaatgtccaagacaccgtgtgagacaccgtgtctacatgaattacctcgtgacaatattgtgattacaggcctgagtttaagaactgcccaagaatgttcaactaataatggaacaataattcaaacttacacaatctgatgccacaacctgcattctcctaattattacctgcaaaatttctgcttttggaggtttcattttctggttttcagtcaacaaaatactttacaggccgggcgcagtggctcatgcctgtaatcccagcgcttcgggaggccgaggcgggcagatcacgaggtcaggatatcaagaccatcctggctaacgttgtgaaatcccgtctctactaaaaatacaaaaaaattagccgggcgtggtggcaggcacctgtagtcccagctactcgggaggctgaggcaggagaatggcatgaacccaggaggcagagcttatagtgagctgagatcctgccactgcactcctgcctgggtgacagagcgagactccgtcccaaaaaaaagaaatattttacaaaggaaagtctggaacacatgaatatgaattaactgtctggatcagatgtttttctagtaaaaccagctagattttactgagcgttatgtgccaattaattgggtaggccccaaaaatcaaggcctaacttactaccattgtagttaattatttattacctctttctcttgatagactttaaactcaattgacgacatcaaatgtggctgttaaatgctgtaccaccacctcaagtacctagagtgcagtatatacatttaatatacatttcttgaataaattaacgaattaccaaataaagggctatgaatatatttgaaagtcttcatttttttcatatatacatatatatgtaaatatttattttagagacatataaaaaatatgactgatctcaaactcctggcctcaagtaatactcattcctcagcctccaaaagtgcaaaattacaggtacaagacaccacacctggtccccagtcaatttttttttcacttttttatttatttatttatttatttttgagacacagtctcacagtattgcccaggctggagtgcaatggtataatctcagctcactgcaaccttcgcctcccgggttcgcaccattctcccgcctcagcttcccgagtagctcggattacaggcgtccgccaccatgcttggcttattttttgtaatttttagtagagacggggtttcactatgttggccaggctggtcttgaactcctgaccctgtgatccacccatctcggtctcccaaagttctgggattacaggcgtgagccaccgtgcccagcctttcttttcacttttaagaatttttgttgttggaggtgttgctttgggtttttctgagatagggtcttgctcagtttcacaggagtgtagtggcacaattaagactcactgccgagactgggcacggtaggtcacacttgtaatcccagccctttgggaggctgagacaggcggatcacaacaccaggagttcaagaccagcctggccaacatggcgaaaccgcccctctctactaaaattacaaaaatcagccaggcgtggtggcgggtgcctgcgatcccagctactcaggaggctaaggcaggagaatcgcttgaactcgggagacggaggttacagtgagccgagattgtgccactgcactccagcctgggcaacaagagcaagactccatctcaaaaaaaaaaaaaaaaaaaaggctcacttgccaaatcaacctcccaggctcaagcagtcctcccacctgaggctacagagcacctagaactacagaggcatgccaccatgaccagctaatttttgtattttttgtagagatgaggtaccactacgtttgttgcccaggctggtctcaaactcctggaagcaatgcttctgcctcccaaagtgctgggattacaggtgggagccaccacacccagccaactttcaagaaatttctgcataaatatcttcaattagtctcgcctataacagcctgtatttaaaagtactcatgggaaaacaattcccactccatgaataaaagcatagataccttgctataaatgtaaattttaacttttattttggggtagggaggtgaggaggggtgggtatgacaaatctaggagagaagaaggctgtcacagagggaaagatgtaataacaagagagggaaagatattcagaagcatgtgaagaaaaatcaaagacagccatgatcctagggactctatatctgaaaaccctacttggatttttttctttttaaagcactgactggaaagtgggaaagattgggagaatctaccaaccactaatttttctaaaagaattgtttactggtcagcagttccaaagtcaaagactgactatatttttaaattatttattttctttcaaaggaaaaaaaaaccactgaaataacatgattttttgaaggtgcaagtgaatttgaattttggcttttttgctttgtgagcattttctttttctttctttcttttttttttcctgaaacagtttcattcttgtagcccaggctggaatgcaatggcgccatcttggctcactgcaacctccgcctcctgggttcaagcgattctcctgcctcagcctcccaaatagctgggattacaggctcctgccaccacacccagctaattttttgtagttttagtagagacggggtttcaccatgttggccaggctggtctccaactcctgatctcaggtgatccacccactttggcctcccaaagtgcagggattacaggtgtgaggcactgcgcccagccttgtgagcattttcttctgtgaataaatctaaatctttagtaataaaagtgggaatataactaactcctttttttttttttttttgagacagtctcgctctgtcacccaggctggagtgcagtggcacaatctccactccacctcccggattcaagcgattctcctgcctcagcctcccgaatagctgggattacaggtgcacgccaccacgtctggctaatttttgtatttttagtagagacagggtttcaccatgttggccaggctggtctcgaactcctgacctcaggtgatccacccacctcggcctcccaaagtgctgggattacaggcgtgagccaccacgcccagccataactagctcttaagttttgctgatatcattaactatataaacaaatattgcctataaagtctattcttgttaacaaccttgtacttctagttctctaactcccaaatccaaacgtatgctttatttcaaatttgtaatggtgacctataacaaggaaaaagttaagtgaagaggaaatcacaggaaccctttaaaaaaaatggcattgtggccaggtgcagtgcctcacacctgtaaacccaacactttgagaggccaatgcaggcagatcgcttgagcccaggagttcgagaccacgctgagcaacatgacaaaactctgtctttacaaaataattaaaaaatgagacgggcatggtggcccacatctgtagtcccagctacttggggggtgctgaggtggaaggatcacttgagaccaggaggtagaggctgcagtgagccatgaccatgccattgcactgcagtctgggcaacagggccagaccctgtctcaaaaaaaaaaagaaaagaaaagaaaagaaagagaaatagcattgcaaaggaaataagaatagatattaattaggctgggcatggtggctcacgcctgtaatcccagcactttgggaggctgacgcaggcagatcacaaggtcgggagttcgagaccaacctggccaacatagtgaaactccatctctactaaaaatacaacaattagctgagcatggttatgtgcgcctgtagtctcagctacttgggaggctgaggcaggagaatcacttgaacctgggaggcggaggttgtggtgagccaagatcgcgccactgcactccagcctaggcaataagagagaaactccatctcaaaaaaaaaaaaaacaatagatatgaattataatcaacgctaatgctaatgcttcctccctgaaatactctcctcccttgcttccaggacacagtctgatggttcttccccctattccaatgaatgaatgctcccttctcagtcgttattgattccttctgatcttcccaatctctacacactgaagaactccaaggttcaaggtttggtcctttgactttaaaatatcatgttcataaatccagccaggacagttgctctaaatcctagttataaatccaactacctgcttgactacactgctagcacctagaacagtggctaacacaaaggcactccaagttttatttatctaataaacaagtgggccgggcgcagtggctcacatctgtaatcccagcaccttgggaggccaaggtgggtggatcacccaaggtcaggagttcgagtccagcctggccattatggtaaaaccccgtctctactaaaaatacaaaaattagctgggtgtggtggtgcacgcctgtaatcccagctactcagggagggtgagggacaagaatcacttgaactcgggaggtggaggttgcagtgagctgagactgcaccactgcactccagcctggatgacaaagtgagactgtctcaaaaaataaataagtaggcctttgagcccctatgctcaggcccactcccagactgtggagtggtactttcattttcaataaaacccttcgctccttccttgctttgagcattttgtccaattctttgttcaagacgccaagaacttggatactctccaccgttaacatattttggtgagccagccaggaggaagagtcaagcaggttcactacggccactcagggagcgagaactcagaagcctggcatgctggcaaaagggtaaagaaaacctttttttttttgagacggagtctcactgtcatccaggctggagtgtggtggcgcgatcttggctcaccacaacctccgcctcctgggttcaagcaattctcccgcctcagcctcctgagtagctagaattacagatgcgtgccaccacacccggctgatttttgtaattttagtagagacgggggtttcaccatgttaggctggtctcaaactcctgacctcgtgatctgcccgcctcggcctcccaaagtgctaggattacacgtgtaagccactgtgcccggccctaagaaagcgttttatggtttgaatcttctggaaacgtcaaagacagtcagtcgccgggcatggtggctcacgcctgtaatcccagcactctgggaggccaaggcaggcggatcacaaggtcaggaaatcgagaccatcctggctaacacggtgaaaccccgtctctactaaaaatacaaaaaaattagccgggcatggtggcacgtgcctacagtcccagctacttgggatgctgaggcaggcgaattgcttgaacctgggaggcgggggttgcagtgagctgagatcgtgccactgcactccagcctgggcaatggagtgagactccgtctcaaaaaaaaaaaaaaaaaagaaagaaagactgtccttgccatccacaccacaacaaagctttgggaccttgaactttgggttcatggtctcacaactgagaagggtccctccacacttttggaactgtgcacccactggaacccttgacagaccatcaagcttcagatgaccatgcaacaaaggctccagccagttccaggcaaagacaccacccctagccatcaagaaactaccctgcctccattagatagagcagggcgagagttccgtgatccccaataggtagagactatgccccaagtcagcatgaagcagttacagaaaaaaagaccatcggtccctctgcctcccataaagatttatgaggatcacatctctaagtggagagatgaggcaggaaaatacagtctggaagcagggaacagaagaccaattcacaattcagctataacaggaaatatcctctccataggacatacaccgagtaaatgacttgtaactttacctcatcctcttcatttacataaggcataccccaagtagagggtatttaaactcacaaaaactctgtaacagggcctttgagcccctatgctcaggcccacactgcagagtgtactttcattttcaataaaacccttcattcctcccctgcaaaaaaataaataagtaagtgactggtttttaaaaatataataagctctgcaaaagtaattggagaggaaagggaggtgggacaggcagagaacagaactggaggcagtccatctagggaatgggactgtgaggccatacttgtgaaacatctggactgctattctaggacttttatttgatgtgttcgttgcacagctgtttgaaatgtttaataaagctttataaacttaaaaaaaaaatgcactcggctgggtgcggtggctcacgcctgtaatcccagcactttgggaggccgaggtgggtggatcacgaggtcaggagatcgagaccatcctggctaacatggtgaaaccccgtctctactaaaatacaaaaaactagccaggcatggtggtgggcgcctgtggtcccagctactcgggaggctgaggcaggagaatggtgtgaacccgggagatggagcttgcagtgagccgagatcgtgccactgcactccagcctgggcaacagagtgagactccgtctcaaaaaaaaaaaagtgcactcatataggcaatttatgtaaatatacttgtattattctaagtgaaaagggaaaataaacatacattttgaaaatgagctattttttgcaacctctaagagtttttccgctgtgccaggttatttaactaggaataccctgctctaccctggcacaccaaaaatctccttttaacctacaatagacttgaagcacaaaataaaacttaagaagtatttccagctgggcgtggtggctcacacctgtaatcctagcactttgggaggcctaggcgggtagatcacctgagatcaggagtttgagaccagcctggccaacatggcgaaaccccatctctactgaaaacacaaaaaaattagtcgggcgtggtggcgcacacctgtaatcccagctactcgggaggctgaggaaggagaattgcttgaacctgggaggtggaggttgcagtgagccgagttcacgccactgcactccagcctgtgctacaggagtaagactccatctcaaaaacaaaaaaaaaaaaagtattttcatgttatctagatttcatcgtttttctggcatgaatattattgacagtgtcctcctagtaccctccctgccccagttataaaagtagacatttctaaaaaaaattagtatgttttacccatataaaaaaagaaaactattagctgggcatggtggtgcgtgcctgtaatcccagctactcaggagtctgaggcacgagaatcacttgaacgtgggaggtagagattacagggagccaagatcacaccactgcactccagcctgggcgacagagcaagatactatctcaaaaaaaacaaaaagaaagaaagaaaagaaaactagcattccatgtagactagaccactctattacccagattatataaataaacagaacacctcataatccaatatttgaaaacaaatgtaatgaacacccttaatagtacagacacaaattatctattaataaaatcttacttatgatattgttgagttttctgcatcagcttctctggcaagccatcttcatcatcaaactgctccatgggttccacaatgactggacgaggggtcctggataggtataaaagcattcataaaaattaacacagtgccaagaattaataccgtcttaaaagaaatgttttataataataaagatatatacttagaaaatgtctcacttgagaaaaatgtctcagaagtatcatttgtactcataaaaatcagtcaacagccgaagcagtggctcacgcctgtaatcccagtactttgggaggccaaggagggcacatcatttgaggtcaggagttcaagaccatccaggccaacatggtgaaattccatctctagtaaaaatacaaaaaattagccgggcattgtggtgtgtgcctgtaatcccagctactgaggacgctgaggcaggagaactgcttgaaccccagaggcagaggttgaagtgagtcaagatcgcatcactgcactccagcctgggcaacacagcaagactccatcacaaaaaaaaaaaaaaatcagtcaataaacatttactgagtcagagagaggtgaatgtcaaaagccacaaaaagatgagtaaataaagcaacaattatgaaccagcataacggttatagttaacatttagaaagtataatgaaaacgaatttgtacctaacccatgttttatatgtgtggtcatcatcacagccactgcttcagctattgattgatttttatgagtacaaatgatacttctgagacatttttctcaagtgagacattttctaaatatatatctttatcatcaacatgtcccaccacctcaacccacccatctgtacccaccacccagtttccctgtatctatcagtattgttcagaaagttcttaaaaatgttggccagcaggaacagtggctcacacctgtaatcccagcactttggaaggccaaggcaggcggactacctcaggtcaagagtttgagaccaacatggccaacgtggtgaaaccccgtttctactaaaactacaaaatttagccaggcgtggtggcacacgcctgtagtcccagctactcaggaggctgaggtatgagaatcgcctgaactcaggaggcagaggttgcagtgagtggcgatcgcaccactgtactccagcctgggcgacagagtgagactctgtcaccaaaaaaaaaaaaaaagttaaagctgaaaatccgacctaaaacatttcggcgaagtggctcaaacctgtaattctagagctttgggaagcagaggcggggaagatggcttgagcccagaaattcaagatcagcctgggaaagatgacgagatcctgtctctataaaaaattttaaaattagccgggcacagtggctcacgcctgtaatcccagcactttggtaggctgaggcgggtggatcacaagatcaggagtttgagaccagcctgaccaacatggtgaaacctcgtctctactaaaaatacaaaaaattagccgggcgtggtggtgcacgcctgtaatcccagctacttaggaggctgaggcaggagaatcgcttgaatccgggagacggaggttgcagtgagccaagatcacgccactgcactccagcccaggcgacagagtgaaactccgtctcaaattaaaaaaaaaaaaaatttaaaattagccaggtagcatacactactcaggaggctgaggtgggaagatcacttgagcccaggaatttgaggctgcagtgagctatgatagagccactgcactctaacctgggcaataaggcaagatgtcatctctaaataaaaataaaaataaaagatgttagccagacaaaaagggaaaaagggaaggcagaagacaccagacattcaaggagaaaagctgggataaggaaatgacaagagtgggtaatgaaagatatgactagaggccctccttctttactgttttcttcagtaaaataggagaaaaggagagttcatggaggggaagaggaataagcagaatggatggcacactgatattaaaatttcctttgagatcggctcttcaccatgcaaggggcattaaaatctatttatactaccttcaaaacagtgatgcttcagagagaaaaaactaagctagagagatgaagggtttttggactccaaaagcttctcttacacataataccagagattaacacagactttagatcctaaatgtaagaaaagatacaaaataacttttcaaaattattactgagttagtgaagacattttaaggaaacagttaaagcaggtatggaatatcatggagtggtggaatgagattatagaaacctcagataaactgaataggaacccaaaggtaaagagacttaagatgtggtacttctaaaagtacccaaaaaggcccagggccaaaatgaagatgatgcattttatggaccattcatccgctggaagctatggcagggccacaaacatagaacagtaacagaatcagataaaaggtgcacctgagcagaggccaacaaagaaacaagcaaacccctccagtaacacaagaccatcccccttcagagaaacttcagaaacagaattaagagggaaaaatgaactaagcagatgatatgtcattcatcagaaatgacaaaagtatatgaagccaagggaaaccgtaatcagaattaagggaaaactctgacatctctgtactctcaaatatgttagagattttaacaaattgtaaacttttcacatgtaagtttggaccactagacaactcttacacagtgcgggagaggagaagtacagatttctaagagggaacttaatcgatacaaacaagtttataaagtctccctctaccactctatatatcatcttgctcctacaattccacttctgaagaaacataaaccagtgagcaaagatcaatcaggctgggcgtggtggctcacgcctgtaaccccagcactttgggaggccgaggtgcgtggatcacgaggtcaggagtttgagaccagtctggccaatatagtgaaatgccatctctactaaaaaaaataacaaaaattagccaggcgtggtggcacacgcctgtagtcccagctactcgggaggctgaggcagtagaatcgctggaacctgggaggcagaggttgcagtgagccgagatcgtgccattgcactccagccaggatgatacaacgagactccgtctcagaaaaaaagatcaatcacaaccacattcatctaattacacaacataaaaagaccaaggaacatgggtacgtattgtgtacaagggaattacttaagggactgtgtcttatttttatttattggaacacatgctaaaatgtgtttctatctatggtttcattgtacatacaccactccctatagaagctccctttgtccattttctgactcatcttgtttatttcactttcatctttaggtataaccaaaatttgttaaactcaacctaaggccgggcacggtggctcacagctgtaatcccagcactttgggaggccaaggcaggtggatcactcaggagtttgagaccagcctgaccaacatggtgaaaccccgtctctactaaatacaaaaaattagctgggtatggtggtacatgcctgtagtcccagctacttgggaggctgaggcaggataatcacttgaacccaggaagcagaggttgcagtgagctgagaccgcggcattgcactctagcctaggcaacaagagcaaaactgtttccaaaaaaaaaaaaactcaacttaaattctgtttaccataggtataataactacatttattcttttttcttgagacagtgtctcactctgttgtctaggctggagtgcagtggggcgatcacagctcactgcagcctcaacctcctgggctcaagatatcctctcgcttcagcctcccaaagtgctgggattataggcatgagtgactacgtctgtccaggttactctttttgcaaatataagtatataataagtacaaaacagatcaaaaagaaacaaatcaaagtgttcaaccataatgttaaatctgaagttactgcttgggtttttgtttttctccccattttaccaccaagtcaatcattagtttggttataaacttgaaggactgagagagagaggcttcgggactgaggccctggggtttacagcaggttatgagctgcatagcctttggctaggaggttcctgcgctagctgaagttttctctgaagttttctcatcggtaaaatgggatatcagtgcatcatagggttgttatgataacgaaagaagaaaggtagggcacttagcacagttcttggtaaagagagttcattaaatcaaagtgaactcggccaggcgtggtggctcacgttggtaatctcaacgccttgggaggccaaggcaagtgtatcacctgaagttaggagtttgagaccagcctggccaacatggtaaaaccccatctctactaatacaaaaaattggccgggcatggtggccgggcagcggctgtggtcccaactactcaggagactgaggaacgagaattgcttgaatccaggaggtggaagttgcagtgagcagagatcacaccactgcactccagcctgggcagcagactgaaaccctgtctcggaaaaaaagaaactgaaggtttttttcagggggtaagagagagaaaaagtatttcagtgttctttcaggcttgaaaatactaaaatttaaagtgttaatttatttacaaaaaaacttgaaaaatgtttcattgtgaaaaaacttaaatagcaagtattgcagaagaaacaaggcccctgaaatcctaacatatggagaggagctctgatcacatttttgtgaaaaccacttaagacttgcctttctgttggatatatgcataagtttacataaaatgaattacctatacatgctttttttcagatatccaatgtactcaatgtaaaatggcaccattttacgcactgcatgcatgcacaataatttttttaaccataccaactggtatacatctggggttttcatgttttctgtaattatatataacatcaactacgtatttgtgactgatctttcctcattgtggctgatcttttcttagaactgtggaaacaaggtaaaatatacagtactaaaaaaaacatggtgacttaagggctgggcaaggtggcttttgcctgtaatcccagcactctggcagactgaagtgggaggatcatttgaggccaggaattccaggttacaatgagctatgatcgtgccactgcactccaacctgggtaagagcagaacttgccttaaaaaaaaaaaaaaaaaaaggtggcttaaaagataatgcaatattttgcacatgtaatttcttttttttgagacagggtcttgttctattgcccaggctgccatgcagtggcatgatcactgctcattgcagcctcgacctacaaggctcaagtgatcctcccacctcagcctcccacgtacctgggactacaagtgtgcaccaccatgcttagctaatttttttatttttcttttgtagagatagggttttgccatgttgcccaagctacacataatttttaaaacgaagaatgtgtaatgatgatgacaatttatttctgcactgaatcacccttatagacatgtaccattttgtgatggtttttcattttagctcagttgcatatttataagcatggttgagaatagttgaatagtaatgataaaataattatcaggatgcagccacgacaaacatggtgaaaccctgtctccagtaaaaattcaaaagttagctgggtgtggtggtgcgcacctgtaatcacagctactcaggaggttgaggcacaggaatcacttgaacccagaaggcagaggttgcagtgagccaagatcatgccatgcactccaccctgggtgacagaatgagagcccatctcaaaaataataataataataataattattattattattattattaccaggatgacgatattaataaaatattttatgatggagaaaaaataaaatcactaggatctgataatgatatcttagatttacaaaatgacacaatagatccatgtggtaattttaagaaaagggatctaatttttttttttttttttttgagagacgggtctcacgacgttgctcaggctagtctcgaactcccgggctcaagcaaacctcagccttcagagtagctgggactacaggtgcctactactacactcagcttgttttaatttttttaatttttctttttgttcttttgaagacctctaagaaataaggaagtatcagtctttacaaataactacaaataacaaataaggaaatatcaatctttacaaaaaaaagaaagcaaaaaactaaaactggatccaattagcactgatagtatatcaagggttaatgttgctttcctaaaaagttaagtagcaatttatacttatcagcaggttttcctagataactcattattttcaacaggcaatggaaatattataatgtttttcttaaagaattttttttgtctaaaagtaatctcatttaatggaaagatatgataaagcaaataaaatgttggaaaaagtaatccctttcaaatataaatataaaataggaaaagtacaaaattatttttgtactcttctgcacaggaaaagtgtgcagaaaagagttttaaaaagcaagcctgcagctgggcgcagtggctcacgcctgtaatcccaggactttgggaggctgaggcaggcggatgacttatggtcaggagttcgagaccagcctggtcaacatagtgaaaccccgtctctactaaaaatacaaaaattagccaggtgtggtggtgaacatctgtaatcccagctattcaggcagctgaggcacatgaatcgcttgaatccaagaggcagaggttgcagtgagccaagaacatgccacagaactgcaccctgagtgacagagtgagaccctgtctcaaatcaatctatcaatcaatcaatcaatcaatcctaccagccaagagcggtggcttgtgtctgtaatcctagcactttgggaggccaaaacgagcagatcacttgagcccaagagttcaaggccagcctgggccacatggcgaaaatacaaaaagtaaaaaaattagccaagtctggtggcacatgcctgtggtcccagctactcggaaggctgaggtgggaggatcatgtgagcctgaggaggctgagggcatagtgacctatgatcgcattcagcctgggtgagagtaagaccttatctccaaaaaaaagctatcaataagaaatcgttagttaactgggtgtggtggtgcatgcctatagtcccagcagcttgggagcctgaggtgggaggatgacttgagcctagcaggttgaggctgcaacgagctgtgataatgccactgcgctccagcctgggaggcacactgagacattgcctcgaggaaaaaaaaagaaaaaaaaaaaggacaagaacaatggctcacacacttgtaatcccagcactctgggaggctgaggccagctgagacaggtggattgcttgagctcaggagttgaagaccagcctggacaaaatgacaaaatccacctctacaaaaaatacaaaaagtaggcctggagtagtggctcatgtctgtaatcccagcactctaggaggctgaggcaggcacatcacctaaggccaagagttcaagaccagcctagccaacatggtgaaaccccagctctattaaaaatacgaaaaaaaataaaaaattaaaaaataaaaataaaatggaaaagcaagatctatgacaatctgaagaaagagcattctctaaggaaagagaataagagcacaatctctgacaagattgtgttgtaaaacagcagatatagcacgaatttcagttttagtatcaatgcttaatagtcgaaagtaagttttaaaatgcttacaaatcagcaactaagttccatagagccaggaaacaaaattttttaaattttagggatcaattccctaaaccctaaattccctaaaccctaaaacatctgaatgatcccaaccaatagctgacagcaccatacaataagcaaatacaaagaacctaaatagccaaaaaaatttttgaaaaaataaaattggatgattatactacctgatttcaaagcttagggtaaatatggtaattaagcaagtacaattttggaactgacaaactggtcaatgaaacaaaaaagtacagattttttttttcctggtaacaaaggggaaatcataaattttttcaattaatggtgctggaacaactggagacctgcacggtaacaaggatttttacgtcacactcaaaatgtataaatgtaaaagctataaaatttctcaagaaaacatgagaaaagctctgcaatcttaagcaaagatcatacaaggacacaaaaagaacaaaccatacaagaaaaaaattgatgaaatttggacttcataaaatataaaaacatctgctctttgagggtcactgttaaagttaaaaaactttacagatgcaatggctcacacctgtaattccagcactttgggaggccaagacaggaggatagtttaagctcaggagttagggaccagcctgggtgacatagcaagacctcatatctactttaaaaaaaaattcaaaaaattagccaggcatggtggcacatgcctgtagtcctagctactcagcaggctgaggaaggagaatcatttgagcccaggaggtcaaggctgcagtgagccgagatcactccactgcactttggcctgagtgacagagcaagaccgtgtccccccccaaaaaaataaataaataaaaataaaagaaaatttaaaaacaagccacagactggcaggaagatttataatacagacttatctagatttcataattcagtaagaagacaatctgcccaattaaaaataacaagcaggggacgggcgtggtggctcacgcctgtaatcccagcactttgggaggctgaggcgggcggatcacaaggtcaggatatcgagaccatcctggctaacatgtgaaaccctgtctctactaaaaatacaaaaaaaattagccggacatggtggctggcgcctgtagtctcagctactcaggaggttgaggcaggagaatggcgtgaacccgggaggcagagcttgcagtgagccgagatcacgccactgcactccaggctgggcaacagagcaagactctgtctcaaataaaagaaaagaaaaaaaaatgaataagggggacatctaaaaaaatggacaaaaaattttagatatttcaggaaagatatataattggccaaaaagcacatgaaaagatgctcatcattagtcatcaggaaaataaaatttaaatcacaatgagattgcgctaaactaactagaatatctaagtctaaaaacaccaagtggcaactgggcacagtggctcacacctgtaatcccagcgcttagggaaaccgaagcaggtggatcacttgaggccaggagttcctgaccagcctagccaacgtggcgaaaccccatctctactgcaaaaaaaaaaaaaaaattagccaggcatagtggtgcatgcctgtagtcccagctactcaggaggctgaggcacaataatcacttgaactcgggaggcagaggttgtagcagccgacatggaaccactgcactccagcctgggtgacacattaagactctgcctcaaaaagcaaattaacaaaaaattaataataggctgggcgcggtggctcacgcctgtaatctcagcactttgggaggccaaactgaggtctggagttagagaccaccctcaccaacacgtagaaaccccgtctaacggccgggcgcagtggctcacgcctgtaatcccagcactttgggaggccgaggcaggtggatcacgaggtcaggagatcaagaccatcctggctaacacagtgaaaccccgtctctactaaaaatacaaaaaattagccgggcgtggcggcatgagcctgtagtcccagctactcgggaggctgaggcaggagaatggtgaacccaggaggcggagcttgaagtgagctgagatcgcgccactgcactccggcctgggggacagagcgagactccgtctcaaaaaaaaaccccgtcttactaaaaacacaaaattagctgggcatggtggcgcatgcctgtaatcccagctatctgggaggctgagccaggagaatcgcttgaacccgggaggcagacgttgcagcgagctgagatcgcgccattgcactccagcctgggcaacaagagcgaaaactccgtctcaaaaaataataataaaataaaataaaaataataaaaataaaaaataaaaacaccaagtgtgggtaaaatgtggagtaactagaagtcactcactcattgctggtaggaatgtaaaatgatacaaccaccacggaaaagaacttggtagtttcttatacaattaaacatacagcaatttacccctaaatatttacctaagccacatgaaagcctaatattcacaagaagccttgtaaacaaatactcatagtagctttattcacaatggccagtagttgtaagcaactcaaatatccatccatatgtcacggacaaaacatagttatgtccataccatggaatatgactcagccataaaaaggaacaaaatactatacacacaaagatatgaatgaaatctcataaacatatgctgagcaagagaagccagacacagaagaatacatactatatgatttcacttaatattagaaaacacaaaacttatttataaataagaaatagctatctaaggcaggtagagtgcagaataactgtaaaagggcacaagggaacttctgtggggtaacggaagtgttctgtatttttattatggcagtgtgttacatgagtacatatgtttgttaaaactcactgagctcagccgggtgaagtggctcacacctgtaatcccagcactttgggaggctcaggcaggtggattacttgaggtcaggagttcgagaccagcctggccaacatggtgaaaccccgtctctacaaaaatacgggccaggcatggtggctcatgcatgtaatcccagcactttgggaggccaaggtgggtggatcacctgaggtcagcagttccagaccagcctgcccaacatggtgaaaccccatctctactaaaaatataaaaattagccggacacagtggttcacgcttgtaatcccaactactcgggaggctgaggcaggagaatcacttgaacccagcaagactccatctcaaaagaaaaaaatacaaaagattagccaggcatggtggtgcacacctgtaatcccagctgctcaagtggctgaggaaggagaattgcttgaacctgggaggcagaggttacagtgagtcaagatcgccactgcactgcagcctgggcgacagagtgagactcgtctccaaaaaaaaaaacaaacaaaaaaaacacctcattgagctctacaacagaatgtcttttattattttattattatttttaattttctttttaaatagagacagggtctcactgcaactttgacctcctgagctcaagtgatcctcccatctcagcctcctgagtagctgggactacagcgcaaatagctgagactactgtgcactccaccacgctgcccccaagatgtttttatgttgttgttgtttttggttttgttttttaggcagagtctcgctctgtcgcccagtctggagtgcagtggcacaatctggactcactgcaacctccgccccccgggttcaaccgattctggtgactcaccctcccaagtagctgggattacaggcacgcagcaccaagcccggctaattcctcatatttttagtagagacagggtttcgccatttgcccaggctggtctcgaactcctgagctcaggcaatccacccgcctgggcctcccagagtgctgggattacaggcataagccaccgcgcctggcccaaggtactattttttttgagacaaggtcactcggtcacctaggctggagtagagtggcatgatctgggatcactgcaacctctgcctccagggttcaagcaattatcatgcctcagcctcctgagtaggtgggattacagggatgtgtcaccacgcccaattaatttttgtatttttagaagagatgaggttttgtttttttttttgagacagagtctgtcacccaggctggagtgcagtggcatgatctcggctcactgcaacctccgactcccggagtcaagtgattcttgagcctcagcctccccagtagctgggactacaggcatgcaccaccacgcccggctaatttttgtatttttagtagagatggggtttcatgccatgttggccaggctggtcatgaactcctgacctgaggtgatccgcgcactgaaagtctggggcttgagccactgcacccctgaggtgctttttattaatgtaaattaggtgtcaataaagctgattacaatttctgaaaggattaccttaagtttatagattttactttgtatatatgttcattaagttaaatgaaataatacaaaacactgcagagatttaaactctgaagtttgaagaaagtacatgactcttgactcctaccagtacacgaaaatttcttatttatattcactgaatatttactcaacacctacttaccatatgctagtatgaactgcaatgaaagacagaattccaaaacagagagaagcccatatgtaactggatagaagaaggacaagatatttaaaacttacgttgttagcaagaatgccccatcaccacatctttccagagcctttcgtgcaggaggttttgctgcaaactctacaaaaccttttcctgtagctctaccgcgatcatccacaaccacaacagctttctctactggaccaaactgagaaaatgcttgctctagcagctcattggaaacaactggagaaaggttcttgacagtcaaggctgctccatgtgtagcgaagcgaatccgtagaggtctgctcttgagaatggtgccgtccagctctgcttttgcaatttcagccagggttctggattcctttttaggaagaaaaaacatttttaaaagatgacagtaacagaaaaaattcaaaacagtgtttggcttctagggagaactaggtatctttagcaaatggctgacagggtcaatttgattttgtatcttttaactttggtatcacatggtttttaactattcaatgatcattttaaacattttaattaaaaggtcccaactccattgttttgttaaaagtaatcatttaaagattagctcttcataaggccagttaccaactattaaatattcaaagcaatatagttttaaaatctcctacatatattaagaacacatattaacaacttgactagaggctgggcacagtggttcacccctgtaatcccagcactttgagaggctgaggcgggcggatcacctgaggtcaggagtttgagaccagcctggccaacagggtgaaatcccacctctactaaaaatacaaaaattagctgggcgtggtggcgggtgccttaatcccaactacctgggaggcttaggcaagagatctcttgaacctaggaggcagaggttgcagtgagctgagatggcgctactgcactccagcctggtgaacagagcaagactctgtctcggaaaaaataaaaataaaaaaacaataataacttgactagaaactatcaacaaaggaataattctccataccctttatgtttttatctcattttttttttttttttttgagacagaatctggcactgtcacccgggctagagtacaatggcgtaatctcggctcactgtaacctctgcctcctgggttcaagagattctcctgccttggcttcccaagtagctgggattacaggtgcccgctaccacgcccagctaattttttgtatttttagtagagacggggtttcaccatgttggcctgaactcctgactccagatttgcccacctcagcttcccaaagtgctgggattacaggcgtgagccaccgcacccggcctgttttttatatcttaacaaaacatcccacctctctacagccagacaaatcaccttttctttttattttcatttctcttcaattttatatgtaaaaactgttagttcttgggtttttttttcaggggagggaggtgtctgagacagggtcttactctggtgcccaggctggagtacagtggcacaatcatagcttactgcagcctcaaactttggggctcaagggatcttcctgcctcccgagtagctgggtttccgggtgcatgccaccaagcatggctaattttttaattttctgtagagatgggggggtctcactatattccccatgctggtctctcgaactcctggcctcaaacagtcctctcgccttagcctcccaaagtgtaagattacaggtgtgagccatcttgccctagccaatgtcttcttaatgacttctcctgaaatactggcatgggttacacatttctcactattacatgaagagaaacaaaggcaacattcacgagctataatagttctcgccattatataaagtgtacatatacacttactataaactaaaaaatatgctcattgctgaaactacaaggtaagagaacttccttctactgggagaattcaaagttggtgtagaatatgggcagcacctaaaacaataaataaggaactggtaaatttaacagaagtatgtctttttcattgtgttatgggaactctccaaggacaactgaagaggctttatatgtatatgtaagaagaatacaaacatactgtcttatgaaaattgtcttaaggtcacaagagctctttattcaatccctaaaatgttcatgacagcttgaaattattgccctttattgcaaaaatctacctatagaattatttttacaaaaacaaatgaagttaccctttttagagatatagtcatccctctgtatccatggattcaaccaaaagtggatcaaaaatatttggggccaggcccaatggctcacacctgtaatcccagcactttgggaggctgaggcaggtagatcacttgaggtcaggagttcaagaccggcctcctggccaacatggcaaaacctagtctctatcaaaaaatacaaaaattagccggggcatggtggtaagcgcctgtagtcccagctacttgggggactgaggtgggagaatctcttgaacccagaaggcagaggttgcagtgagccaagatcacaccactgcactccagcctgggtgtcagggacagactctgtgtccaaaaaaaaaaaaacaaaaaaaaaaaagaaaaagaaaaagaaagaaagaaaagcaaacatttgggaaagaaacaatttaaaattgacaggcagggtaagggggctcacacctgtaatcccagcactttgggaagccaaaacaggaagaatccttgaggccaggagtttaagaccagcctaggcaacatagcaagacctcttctttattcctttaaaataaaaaaataaaatttaaataaaagaaactaaataggctgggcgcagtggctcatgcctgtaatcccagcactttaggaggccgaggcgggcagatcacgaggtcaggagttcgagaccagcctagccagcatagtgaaaccccgtctctactaaaaatacaaaaaaaaacaaaaacaaaaattagccaggcatgtggcacgggcctgtagtcccagctactcaggaggctgaggcaggagaattgcttgaacccgtgaggcagaggttgcagtgggctgagacagtgccactacactcacgcctgggtgacagagcgagactccgtctcaaaaaaataaatagacaaaaaaaaaaaataaaccaaataatacagcataacagctattcatacagcatttacattgtactaggtattacaagtaatctagagatgatttaaagtatacaggaggattgcatgggtaacatggaaaaacaatgccatttttacacagtataaggatttgagcatctacgaattttagtactggaggaggtcctagaatcaatcccccacagatactgagggataattgcattctaaacagtcgttttgtttattgcttttaactcactagtaacagtagtagcagcaagcacttaataaacacctaaaaagagatgggtactttcttacctaatacatcatataatccaacaactcttaagaggtagactttagaaacagttttgaaagtgagaatagggctgggcacagtggctcacgcctgtaatcccaacactttgggaggccgaggcaggagaatcacgaggtcaggagattgagaccatcctggctaacacagtgaaaccccgtctctactaaaagtacaaaaaaattagccggacgtggcagtgtgcgcctgtagtcccagctgctggggaggctgaggcaggagaatggtgtgaacacgggaggcggaacttgcagtgagccgcgatcgcaccactgcactccagcatgggtgacagagcaagactccatctcaaaaaaaaaataaaataaaatgagaataggaagaaatatgaagacatttaatggggtgataatatgtatattttgataggggtttgagttaaacagacatatacatttgtcaaaattcacaaaccagtggctaggcatggtggctcacacttgtcatcctaacactttgggaagctgaggaggagggatcatgtaagcccaggagtttgagacctgcctgggcaacataatgagagagaccttgtctctacaaaaaataaacaaaattagctgggtgtggtggtgtgtgcctgcggtcccagcaacctgaggggctgaggtgtgaggatcacttcagccccggaagtggaggctagagtgagccatgatcatgccactgcactctagtctgggcactctgtctcaagagaaaaaacaaaaatcaccaaccagtacacttaaaatgtgtaccctttactatatgcaaatttttttttttttgagatggagtctcactctgtcacccaggctggagtgcagctgcgcaatctcactgcaagctccgcctcctgggttcacgccattctcctgcctcagcctcccgggtagctgggactacaggtgcctgcaaccacaattggctaattttttgtatttttagtagagacgaggtttcactgtgttagccaggatggtctcgatctcctgacctcatgatacgcctgcctcggcctcccaaagttctgggattacaggcgtgagccaccgcgcccggcctactatatgtaaatttttaaaaccctaaaaaataatatgccgggcatggtggctcatgcctgtaatcccagcactttgggaggccgagacaggtggatcacctgaggtcaggagttcaagaccagcctggccaacatggtgaaaccctatctctactaaaaatacaaaaatcagcctgggctggtgtcatgcctgtaattccagctattcaggaggctgaggagtgagaatcgcttgaacctggggaggcaaggctgcagtgagcccagtgtgccactgcactccagcctgggtgacagcgaggctccatctaaaaaaaaaaaaaaaaaaagaggccaggcacagtggctcacacctgtacacctgtaatcccagcactttgggaggctgaggcgggtggatcacctgaggtcaggagttcgagaccagcctggccaacatggtgaaaccccatctctactaaaaatacaaaaattagccgggcatgaaggcgggcgcctgtaattccagctactccagaggctgaggtaggagaatcgctttagtccaggaggcgggggttgcagtgagccaagatcacaccgctgcactccagcctgggcgacacagcaagacctcagctcaaaaaaaaaaaaaaaaaaaaaagataacttttacataaaaattttcaccaaatggcgagctgtctctgatgtccaaaaaataaataaatgcatttataatgttcaaaatgtaatgattatttaacctgaattttaaggaaatttccatatttcattattattaatagtttgcgaatatttacccttctcttgaagccacttacatgttgaagtgtttgccctaaaaaatacagtctcaccaggcacagtggctcacacctgtaatcccagcactttgggaggccaaggcaggcggatcacaaggtgaggagtttcagaccagcctgaccagcatgatgaaaccccatctctactaaaaatacaaaaattagccaggcctggtggcacacacctgtagtcccagctactcaggaggctgaggcaggagaatcgcttgaaccagggaggcagaggttgcagtgagtcgagatcgcgctactgcactccagcctgggcgacagagtgagactccctctcaaaaaaacagtcccttggctgggcgccgtggctcacccctgaaatccaagaactttgggaggccaaggcgggcggatcacgaggtcaataggtcaagaccatcctggccaacatggtgaaaccccgtctctactaaaaatacaaaaattagctgggcgtggttgcatgcgcctgtagtcccagctactccagaggctgaggcaggagaatcgcttgaacccaggaggtggaggttgcagtgaaccaagatcccgccactgcactccaacgtggtgacagagcaagattccgtctcaaaaaaaaaaaattacactatcttaaaggttttagaagattaattttttaaaaaagaaaaaaattaataaaaataccgtaccatgtaattacaattttctctacatattaagacctctccctctccccctccccctccccctccccctccccctccctctccctctccccacggtctccctctcatgcggagccgaagctggactgtactgctgccatctcggctcactgcaacctccctgcctgattctcctgcctcagtctgccgaatgcctgcaattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcatctccgcccggccgccatcccatctaggaagtgaggagcgcctcttcccagccgccatcacatttaggaagtgaggagcgtctctgcccggccgcccatcgtctgagatgtggggagcgcctctgccccgctgccccatctgggatgtgaggagcgcctctgcccggccgagaccccgtctgggaggtgaggagcgtctctgcccggccgccccgtctgagaagtgaggagaccctctgcctggcaaccgccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggggtcagccccccgcccggccagccgccccatccgggagggacgtggggggtcagcccccccgcccggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtcccggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccaccctgtctgggagggaggtgggggggggtcagccctccgcccagccagccggcccgtctgggaggtgaggggcgcctctgcccggccgcccctactgggaagtgaggagcccctctgcccggccagccgccccatccgggagggaggtgggggggtcggccccccgcccggccagccgccccgtccgggagggaggtgggggtgtcggccccccgcccggccagccgccccgtccgggagggaggtgggggggtcggccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgggagggaggtggggggatcagccccccgcccggccagccgccccgtccgggagggaggtggggggggtcagcccccccgcccggccagccaccccgtccgggaggtgaggggcgcctctgcccggccgcccctactgggaagtgaggagcccctctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggaatcctgttgatctgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaagattttgtatcgtccagacagagaacccaattttgaaaatcaaagttccaggccggacacagtggctcaccctgtaatcccagcactttgggaggccaaggcgggaggatcgtttgagcccaggaattcgaaagcaacctggacaacatggcgaaacaccgcctctacaaaaaatacaaaaattaggcaggcttgggggtgcgtgactgtagtccccgtcccagctactcgggaggctgaggtgggagaacttcttgagcccaggaactgagatcgcgccactgcactctagcctgggtgatagagcgagacccagtctcaaaaaaaaaaaaaaaaaaggcgtaaaccttagcaatttttgttttgttttgagacgggatctcgctctgtcgcccaggctggagtgcagtgacgtgatctcagctcactgcagcctctgcctcagcctcccaagtaactgggactacaggcgcgcaccaccacgcccagctaatttttgtatttttagtagagatggagtttcgccatgttggccaggcttgttcaaattttttttaaatataaaggaatcataatttttgcataaattattggaaaacttttcaaagtttagattaaaagagagtaagctatattactctgatactgggatatgtatcagtaatttatgaagtagtactgtgtatcaactattctcccccctataaaaacgtgaaactctccaggatgtttggtagaaaaacactatattagatacatacaattaaacactgtctcattactgcagattaaacggtgttacttgagtacagagtttgggcacctaagcagtttgaggtaaatagcaggctgcactgaggtgagaaataaagtggcaggccaaggcaggaggatcgctcgtgctcaggagttcgagaccagcctgggcaacatagcgagaccccatttctattaaaataaataaatttaatttaaaaagaaataaagtggtctacccttaaacgcatataggtgtggttgaagccaaggatgggatgttaataattgtttaagaagcaagtctcctggacagaccctcacgaccagtgatacgtctggtccgacttaagcttcctttccaaatgtacatccaattcgttttttatggcacgatttttgccttgaagaattctcaccccaaaacgctgcccgcccctgtccccggaccctttcggtacccggggcaacggggaacccgggagcgctcgctacctggacagggtgcaccatgcccgatccagcgcagggcagcaggcctgcagccaccgcaaagcacgatcggcgcacggcagaaaacggcggccactgtgagcgcaggaaatcccgggaccgtgaactcgaaaccaaaggcgccgagctggggaagcggccaaccccgcacagaggaatcgatgaggccgagcggcgccacggttgccacaggttgagacagcgtcctaggacgaggctggcctcagccccacgaccccgcggccaccccgacagtccttttgttccctcgcgcgggcgcctgacactcaccaagcggatgaagccgaagccacggtcccggttgatgaagacttcgctgggctcgccatagcgttcgaagagcctcttgaagtcctcctccgtgatgtcggtgggcagatttcccacgaagaggcggcagcgctgcgtgtacgtcttctcgcccggcttgaggaaactcttgatgtcgatagtgaaccccatctcctcgtccgggtggtcctctggaggcgcgggcgcgggcggtgccggctccccggcaagagcgagcgccatggctgccgcggccgccggctcgctctcgcccaccgcggactccagggcgcgaaggcgggccgggtttttctcaatgcgcacttgcttcaggtttcctcttaacatcatcttactgagttcgcctcggacaccggatacaggcctagatttatagacagtgtgtctatatatatgtatacgtctctacataaacctatgccaacaaaatatcgacaatcaagagaccgctaggtaggcgagtcggcaacccgtcctcccccaactcacgcccgctgcagctgcacattcaaaatggcgctgccacaaactgcagttagaagaagagacgccggtgcaagtcccacccctccgccaaagccggcgccggaac

SEQ ID NO: 607 - DNA, 282732 bp, Homo sapiens
tcagtatttagtattaagagtttattggcagtatgaaacaaagtcaacattgctgcattaaaaattcatatatgagcagaacagctagtgtttgctgagggtagttattttaattttttttgtctcttgaagattgaaagctttcagaaatgtaaggacatacatggaaatgtccttataaggagcctcgaaaatgggacagattatatcattcctgaaggcatataccttttgttgagagagagattccaggtagatagcatattcaaaaatcccttcttagcaaaagagagacaagtagttaaaactcttgatacttcagagttgctacaaatttgtttttcccttttaaagtaaaatgactcacgatgtggaaatacagtggatagagttctggagcagaagccacctttatgcccaataatagagagtaaatacatatatacccaatgacaatcattgtgctctgtaattgtttgataggagggactataaatacacatttaataggtaatattatcaagacacatttccatataaaatagttactgtttttgatttttgtttttcaaaaacaaagacttctctgttaaaaatccattatcaatcacttgcaactttagcagcaagattctggtaactgagaaaggtaatagcacttcaaaacaggaacagtttaacagctgacagtccattcacaagacagattttgcaaacattaaagcatctaacacataatacgaatgtcttcagcagctcatccagtcatcacctgatgacatttattactgaatattacatacatacattctgtgtggcagatagagtcagtacagacaaaacaaaatctgccttaggctgtgtgataaacctatcatacctccatcatcaaaaaaccttcagaataatttgggggatgcttacaaatgcattcatatacacaaggagctggaaatcttaaatatgttgcccagtcttccacaatccatgccatacatgggcttcagagcttctccttccttccattgcaggaagctccttctagaagccttgggtgggtaatttgattaatcaccccaagagattgatggtctgacaagtcttcaatgactcactggacagtctctgctgaaagtctgctctcatacaggcacagagcatggtgcacaaattcatactgctcactggtttgcaccattccacctctgcaaggaagaaatcataaaataactgattttgctaaaatcttgcaatttcaagtaacacagagatttcatccaagctagggtattatgccaaagacacatagaacagtcgacctagtggttcttttgttatccctcttacctgtgtccaaatgtctcaactatcaaagttaacatggtaatgtatataaagggcttaacacagttcccagcacacactaggcacgtgattaatttttacctgtgtaacattactggggaggtggtacagcctaatgatcaagtacttggatttggcatcagccaaggtgagttcaaatccctcctctgccaattcttagctgtatgcatcttggacaaattcctcgaaaccccttgcactttagtttcttcctctgttaaagcaggatagtaacagtaactactgctgtgaaggttaaataaattcattgtagctggtatatttgtattacttctcaggtgcctcatgattcatctcttgttaaaatggtttatacatttggcttaaaattgattgacggagacaaaccaaacaaaactcatctgcaaaatgttgctttctacaagtaaaatgaagtctaccttggaatggtttatttgaatatgttgtacagaagcaaccttagccttttggtgtacggggtgtctaaacacaatagtgggtgggtccttaaatgagttggaaaaagggaattggctctgctgtgacattttcctcttggttatcaccattatcatcactagctgcccagcaccctccttgtcaatggattcatagaaagcacttgccttcatgagaaataacggtgcttctcattatgtttttatatacataatacctatatcacattttcccccttcataattatgatccttttttaattttagtttttgagaaaacgtctccttaattgcttaggctgttgtgcagtggcatgatcacagctcagtgcagcctcaacttcctgggatcaagcaattctcccacctcagcctctggtgtagctgggaccacaggcaccaccacacctggacaatttttaaattttttttttcttgtagagacaaggcctcactatgttgcccaggctggtctcctggactcaagtgatcctcttgtcttgggctcccaaagtgatggaatcacaggcttgaacgacggtgtccagtcctataattatgattttttagcttgacaaagttaccagacattaatatgttactattcctgctcactgtataaaagcatcactatcggtaactatttaaagtcttgtaaattctctgtaactctgcaatcatgcaactgatcttatcttttagtttaactctatgttttaaccagatttttccaagtggttgttagtatcattcaaaataactttcagattatttaggcacttcaacttaaaaacaagatatcttgtctcactgtaacaagacttctagttaatggtaataataaaaactgggcttctatgtttatttgtcaatctatgtcaatattagagcagtaaaacttccttgttttaaactaaacagtgattccccaggaaaattaacatgatgtcaaaatgatgtaattggcaaaaaataaagaggtaaattcacagtttttggtgacagcaacttattgacagaagtatttaattggtcttcctcccctagagctgtacattttgttgcattgaaggcaaccttctgggctaagtattccttggtcagaagtgaacaacagaaatggccagctgagaatgtggtaatggtttatcttcttagctgtgtgatgacatctgggctcatctaaaatcatagcaggtgttccgaagatgctggcttgaactgtgaagcttgggagacaccaccacagtaaatattagggtagctccagggagctgagaggtgcctcccttcctctggcatttgcacagctcagggcaccattactccctcttgagctgcagacagtatgtggaagcttctatgtgctccacctcttaggctctggtctgtcagcttcctctcaccatttacctcactttgaggcaagattttccccttcttgtatgttctggtcagcactggtatttacatgtccaactggtgaatgaatggagacacagtttagaatttaataactgtttcaccctaagtgggtcagtggtgtaatttaatggttggagtatatttactatgacattctgttcactaaatcaaggttgttttagccagtgaaagtggggaagatggagaagcatactcattaattgtgggctggcaaaattcttgcaggtctgaaggcttcaggaaagtatatgaaaagttctcttacctcccacttaatttggaaaataaaaatgaaaaaaactggcatcagaggaattcttagagatcatccattctagtcactgacaatatagcttttttagaaatcttgcaattttagaggcagccttttccaaggttggcaggaaaacttttaagacatcaacatgaatctgtcctttctaactttcaccgcattggtccaactgaaataacccaaaagacgtcttaaggctcccctgtagtcacacaacagctctccaaaggctggaaaacagccatcaaagtcctataatcttttcttctttagactaaacatcctgtggtcactcaatatttctgtacagcctggtttttctgtcactcaccactctagtctccctcttctacaggctattttatcaaatatgaccttcttagagagttgtgtctccttctgatgagatctatgaagcaggcttattttctcttccagctgcacgttagagaccaatagatctgtgtttgcaggtgcatcaggtggtgaggtcccccagtgcctacatggtgcctggttctcggtagtattttaagatactaactgacggtgtagattaaataaaaagtcaacaagactttttttgaatgtggacattatagctttctcccatcctgtaattatgctactggatttttgaaactaaatgcaaggctttctatttattcttgttaatttcaacttgttagtttcagcacaatgctcttgtttactggatcactatctatcgtcaatatattagtcttccatttctcactcccagcgttgtgtctcccaggtatttaacaaggatcccttacatctttttatctaaggcattattaaaaaatagaaaaagagacaaagtagggtctttaatatgagtaagttgatatcatgatatatactatctaatcccattctataattatttccaactaggttgtaggtcctttaaagacctacaagcataatggcatggtcttcttctacttgtaacaataaaaagcacttacgagtcctaggtaaatacttgtcaaatgaattacccaggtcatgctattttcatgtcatgtgaaaacagataaactctaggctaaaagaaagcaaaaggtattccaggatgcattcactggaggctggttcaaattcaggaactcatcataatcatctctgaaaatattaaataaatgtcctattgcatatattgatatatagaatagtctattggctggatgcagtggctcatgcctataaccccagcactttgggagtgctggatggatcactcgagcccaaagtgggaggatcacttgagcccaggagctcgagaccagcctgggtaacatagttagaccctgtctacaatttaaaagaaaaattagctggacatggtggtatatgcctgtggtcccaactacacaggaggttgaggccagaggatagcatttgctctataacaggtaatccattcttagaaaggtcaacagagtcttctttcttcttatttttgatatggggtcttgctttgttgcccaggctggagtgtagtcatgcaatcacagctcactgcagccttggcctcccaggctcaggtgattctcccacctcagcctcccaagtagctgggatgacaggtgcatgccaccatactgagctaattttttctgtgtgtgtgtgttttttgtgtttgttttgtttgttttgttttttaagagagagagagggttttgccatgttgcccaagctggtcttgaactcctaggctcaggcaatccatccacctcagcctcccaaagtgctgggattacaggcatgagccaccatgcctggcaaatgcagttttttagataggctggtcatagcaaaaaaagaaacacctaagaagctagtacagtgtctgtatacaaaatatatttatggaataaatgtataaagcttggttaactatggaactctcaagagagctctatagttattcatcctcaggagagctctgacttgactccaggaagctcttaggtcagataggtttcatggatttgctaaaatctggatctatattactgatataaagttcccaatacaaagtggttctgggaggtgagaaacaagggtactctttttcttactttttttttctttttctttttggggcagggtctcactgtgtcatcctggctggatcgtggctcactgcagcctcaacctcccaggtcaactgatctccttagcctcccaagtagctgggactacaggtgtgcaccaatatgcatgcaccttaaattgcaaacagaagtgaaacttacctcaggttcatatctgataaatgcttatgttagaactaaaacataaccccagccaatcataagcatccaactcacatattgttatgtcagtaaggactttccaatacagtacctgaaaaaaggcaattatgtaattgcaaaccaaccaaataaattgtttgtttctgtactttcccaataaatacttgcctctggcgttttgtcattggaacactaaacctcttttggtctggtgtttcccaatgtatgactggcttcttactaaataaactctttaaaattttattgtgcgtcagatatttcttttccagtacacgtttgttttcccaggaggtataatacattaagtgaaaatacctactgctaagcaggagttagtttaccaaaaaagagtaaggtcaaataaaaatgtcaagagaaccccagctagctgagagaatggtgccaagttcattaccaggggggaccagagtatgttaagagggaaaaagacagcatacactgttgtcaagacaaattctgtctccaccacttactagatattttacccaactacacaatctctgcagtgctcagttttttcatctgcaaatgatgcgacaataaaaacaatagttcctactttatagcattgttgtgagaaataaatgggactatcacttaacatgtttagcacatagccaagcacatatcaataccataaatgtcaactattattattgttattgttattgttactctttggtaccatctggtcaaataggactggttaggaggctctggagtgaggcccccaaagaccctggagaaccaagagcaaatctggcagaggacattagtttgcccattaagttccaaatatctttctaaatattgaccagcctagaagacaggcacagtggaggcagatgatgaaaatagtaggcttggagtctgacagattcaggtttgaatccttgtttttttaacttacttagctaaatgattttagacaagtcatttagtccttcccaacctggcttttctcacttgtaaaatggcataaatgacaaacgtcatcgggttgtgaggattaaatgaatcagagcatatcaatgtctggctgaaggctattcacagaatccccagaagcccagggttctacaaaggtggctgaggaccctgggcagggcagaggaggaggatgggtcattaggactagatgccaatcccagctttgaccagggaagttgtgttttttattggttttctgtgttggtgttctgtggaagattctgcctgcaaaaagttttccattgttcacaaagaagtttgaaaaccactggcctggctaataaggtatttaggtatttatctaataaggcttcaagttttacaaggtttaaatgagagaatccacaaaactcttggcacagtaactgcccttcagtgagtactaaataaatgctgtgtattatttttcttattcttagttaatacgacacctagggtaaccatgtttggaagagttgtggttcattggtgttgtcctggtgtcattatcaattgggtcacctttcactctcagaagtaccttggtttggatgataaattatttgttcatcctaatgatgccccattccatgctgtggaagaaagtcattccctttattgcaaaagtggtgttagccacgtggcttggatttctttgtgcccacagactatgaaatgctgtgtttggccaggccagagaggattcagatatactaccctcctataaatgtcagataatctcatatcacattagccctgccaaatacaaagatcagtgtcgtctcagtctccgtgcagaacagcacgtagctgtgtcagctgggggtaaactcaggttagaaagggaaaaaaaaatgtagttttttccctttgctactgggagggtgttttgaaaaaaacctctccagatgcccaggagagagatttggcttttaacatgttaaaattttgaccttttgtgactattcactcacacatacagagagcaacagcctttcctgtcgtaccgcccagcccgtatccggtctaatcagtagacagaagaaattctgcagtgatgactcacttctgggctaacaatgaaacttatgctcctttgctttttattattttcaaatctggaattcttttggtaaagtttggtacagtaaatttagaacaaaaggtgtggacgttaatgtgcctcctgggtaaagttccaagagcttgggcatgagtcaagtgaggctactgtctgctgtgcttagccggggtcagctgtaaggtgtgtctggccccttggacagaggatttcccatggctttacacagatgtcatatcaaggagggagaacttaaatgtaaatttggccaattctgaccaggtattttgaacatagacaccttctccaaaatagatgtgttctaaagtatttgtaggtcataaaaatcagcatatatcaaatgataattcaattgatgagtctaacatattttgagttccatttttttttcctctgaaaattagccgttttcctctgaacactcaagttaacacctaattaactccaagctaggaagaaggaaaatgtcctggcagccacttggaagattcagtcagcataatatgttttacaaagtagacctcttgttgtgatctcaggaattataatgtcaagtaaatccacaccaatttctagggctttatctccaagtgtccttaaaataagcaaatcaaaatgttgaattcctgatcttcaaatgagatctttgaagttcattaattagaggaatctttgtgattatttgggaatgcagagaaatatggataaatgtaaggttacagttgataaaccttagaccaacaagcagaaactttagttttgaaattatttcaaccaggttttggaaacaaaaaatatgttggggacatatattagccttggaaattgatggcatatatattcttctgagatggctgtagttaaaaaaaaaaagaaaagaaaatcatcgaactgaagtgactaatcaaaacatttaaacaatgatatgatgcacattggaagcatctttttatcctgtgtgggaagccacaagtgaggcctttggatgtcattccagtttaagccctctaaggtaaggatgtacaggcaactacaaattccatccttgactcttaaaaagaaggatttgacagataatttcctgctactcaggaagaaaaaaaagaggaaaaaaaaggccttggaataagatattattttatatgtttcacttcccaggttctgttttaaaattcttccagtgtccagttgccaatgggattaaaaggaaaacgatgaggaaaaagttatctgaggtcaatctgcaatggaatatgttcctttcctgcctgcttagatgtcttctgatagtcacgaattgatttgtagtcatacttctgtaatatctatatgcatgtgaagcactgtctgatgttaaaatataaacatcatctatagtaataaactgagacactgcatctctcatgctaaatgtgtaaatgaccttctgtcactatctcaaactgtagaaccttgacatacccaagcctaaatgaatcttttttagcaagagctacatgcagcgaagctggttggcttagctttatagcaattggtatttttaactaggtggtatagttgaacaatttagtgatatttgagattagaaggtttaagtattatatggaagggctttctaagtaataaaaaatgattatactgtgttcagtttagtactaatgttatggatctttttttcaactataattttaaaaaattgacctatacatttacggtaatctcctgttaataggaaaatgtgattgagcaaaatatcccttttgcaacaatgctggccaacagaaagttcattgtacttatcatattcagatattaataagtaatctaaactaaaataatcagagataaacaatttttcctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaatttgagcaaaattgaaagttcagttcagagtgttttataaaaacttcaaaattggtcatgtggccttggagatgtccccttttttggttttggattcttcctttagaatgaaaactttgggcaatatattcctgaggctagattttaaaaaaaaacccacccttttcctaggagatgtttggcaaatgttatgactattgcggctatcccattgttctccacataaacaaatcttcaaagactcaaagaaagcaagagctgagagggatctcagaaagccagttggtcactctgcaatcactgaattccagcatggaaaagcatcttgttagaggagtcctgacatccacttaagctttgttgtgagtcacacaatgaatattaacttgcaagcattaaaatacaacaatcaggtggaggtccatgaaatatcttactcttgatagtaagatatttctggtttttataccagaaaaggttggagatcactgttacgccccacatctccttttactatgtagacagagaggcctagagtggacaaatggtcacacagaaaattagggggcagagccacgcaccaagctccttgacatctagtccagagatgtccggcacctcattcttttgctagtcttaccagtgttcagttgcaattgccataccacccacttcatcttttaattaaaagcgaatgcagtgggaatgaagggatgatcccttaatgcccttctaaataaaacattcgtgggtgccttgcactgaatttgaactcctacttggaaaaaaaaaaagaaatcttattttagttcaaaatatgctcaaaagtattagtaaaaggagaatcacagactcatgaatctgcaatgagaactgagcatctattaatagaagttgtcacaaagccaataaaaataatgtcttgccagagaatgaggaatctaccaaatggttttgtcattgttatactggaaatatccattcagcataacacattcgtctctgaaccagaccatttgaatttattactaaaatgcagatttttaacttgagtagaaattgcttgttcttttcatgttaaattacaatgaccaggcattgtaatttttggggtggtggtggtggaaatcaaaattttaatcctatccagtgttcaagctcttgactgatcggtcatgaaatgagccccatttcaagtatccaaatcactgccttgtctttttctttgctgttagccatacctggactcctcagaggaggcagctacaagtggagaggggtagattataagaataagatgcacagtatgcagccttcattgctagtggttggaggttgttaaaaaagagtagaaaaggatagaggaaggcctgtgaagctcgtattctgccgaatacaaaatatcagccttctgatatactggttctgtcttttctctctcttattacacttagctgcttttaattagttggttccaccattcctttcccaccacctttgtttttttgagtctcactctctcgcccagcctggagtgcagtggcgtgaagtcggctcaccacaactctgcctcctgggttccagcaattctcctgcctcagcctcctgagtagctgggactacaggtgtgcaccaccatgcctggctaatttttgtgttattagtagagatggggtttcaccatgttggccaggctggttttgaactcctgacctcaagtgatctgcctgcctcatcctcccaaagtctgggactacaggcctgagacaccgtgccgggcccttttcctctttttaggggtccaggttcaggcttaaattactatcctatctctagtcttctcttcaccacaaagcttcttgaaagaacagcttatctttattattacaacttctttccctctcatttagatggttcttgaggaaattcatctgtggtcaaataaatgtgaaagagtgcttaaataaaattaaaggagtttctacattggaagattttagattttttaatgcattaatgcttattgtgagtctccgagtggggaagacttcgaagaaatatagtgtagggctgggtgccatggctcatgcctgcagtcccagcactttggcagcccgaggcaggtggatcacctgaggtcaggagttcgagaccagcctggccaacatggtgaaatcctgcctctactaaaaatacaaaaattagccgggagtaatcccagcaactcgggaggctgaggcaggataatcgcttgaacccaggaggtggaggttgcagtgggcccagataatgctactgcactccagcctgggtgacaagaaagaaattccatctcaaaaaaacaaacaaaacaaaacaaaatatatatatatatataaacagcttttccccgaacttagtcaagaacctactttgtgcctgaacgccaccaagagggtttggcttaggaggctctcagtaaataattgttaattaaactatgtcctgagaaggacaatctgggaaactgggaaagctggttaagacacccatttttctacacccaggtgcctgattcatgctcagtagcagatgtctagtgatgcctgttgaatggatgaatgtatgcaggattcaggagcaccactctgtgcagaggtctcagatgcctgttccacagaacacaggatgcaggcccatctattaggttggtgcaaaaataattataatagcaaataccccaattactttggcaccaaactaatacaaacactcattccattctaaaaatatcctaagacagagttagcttcaagggatcgtgaccagtgcagtcatatacctctcaccttcttgtgctgagaaggaccctgaacttgggttaatgctttgctgtcactgtcttgaagtatttgatactttttaatcaacagatgccacattttcattttatactgggcctcacaaattatgtagctggtcctgcccacagtgtcccttggagtgctcttcagctctgtcttagtgccgcttgctttcccaagacaagccatgagcttatctaacagtctccttgattgaaggacctcgccatggcgtgtccagcatcggaagccctcttcaatttcccttcaccaaaacccaagttctgaatgtattcctaatgccaggagttacactctctccagctaccacactgaaaagaacagatcacttcgtttagattgaagcgttaatagcatagtagatatgaagtgttatgccatctcccatctccagattcaataaactttagaaaaagataattcttttaaaagaatccatccaagattagctctttactagcagtattttagacattcgctatacattttagcatcctccatagatagatattttaagaagcagcaatgttttgtccctcaaattgtactcttaaggcagttgccgacaacgtcactccaactattcataaaggagctctcatttatactaaaaactgttttaaaaattatggtgtcccgttgtcattgcattttgtttttaagaggtggagttttgctatgttgcccagggtgggtggcctcgaactcctgggctcatttgtttaaaatggcagagtattatcaaagagatatgtttttgtcaagaagttttacaataaacatattccaaaagcctatttacttttctataagattgataaagatcagagaaataattagagatcaggcaaatgtcccagattccaataggtccattttgttacttcccaagctacttgactttggacaagttactcgctatctcgaattctttggttcctcattaaaaaaaaaaaaattaggccaagatgcttcttttccttcacttgggtttattttgggagttaaataagtcatgtgctttgaagaccatggtgaagagtccatgattaaatacattctgtatgtattaaatacatagtgcattctggaatctctggacagattcagagctgaaggtaaggatagccaggaaaatcggaatttggggacaaggtttgaacaagtgatgaagaaagatatgctgcaagtgcataacggtagacatttggattggctgagaccagttttccctttactgccatgagccaaaaacatggttaatggcagcagttagccacacattggaatttttaaaatgaggtatgataggaaaaagctgaaggactggaacaagaggcaagaataatgtgggagaaaaagaagtaagatgaggtgaaacgaaagggataggttttctgttctgcttttcataacaactagaagagtgtacaacagaaggaagagacaagaaaaggaaaacatatgttgatcctgtgaaggaaggaggctggaggaaagacctttcaaaggaaggttcaaggagaggatctgtttcataaacaacagaaacagctgctcagaaagaatgcagaaagggtcttgatgaagaaatcagaatgattttgatgcatatattggcagtcattcaaactcaagggggttgggtgcctataggcttcagatcagcagagaagttggatgtgttttcaagatcctatcagaagtgaaaagacaagacctctgggaagaccttggtggtgacggaaggccaaggctaaggtttctgaccatttgctttaggaaggaaggagcagatagaggaggcattgtgatgtggtttaaaaaaatgcatttgtaattccattcaaaactagaggacaatttgttagacctgaaaggggaatgtgactgggaagtggaacccaaggtggaggtcaggctatgaaagtgggcaggggaggtgggagatgggagggtgagcaggcaagaattaatggtaacataacaagagccaagaaaaagagcaaaccaagcctgtttttcagcacgttcttccaaataggatcagaacaggtgttgctggaggccagcttggtttggagtcactttagatccatgcatgtgtttggcattcatggagttctggcactaaacaagaacacaggactccaaggtatgaactggagtccccgggtgatttggggtctcaggtggcagccttgtctacagaagcacaaatcaggacagatgaaagtcaatgtgggagcagctctggctgactgagtgctgcttctccccctcagagttagggcccctttcctgtgtgaagacaggccctaaaatttgaagtgaagcaactgatcctattccagctgaggtggactacacaggatggaaggcaaaggaatatcaggagattaaggcagcaattataagaggagaagggataattggaactgatcttttttatgtaccaaaagaaaacatttttggaagcagttacatgtggggtgtggtaagagggaagcaggattggggggtaaagagaggataagcaatgtaggctgagtgttctactaaatacatttcaggtttaatgtcatttaaatgtggctgaagtcctgtgagttatacattactatttccagtttacaggcacatgttaggttccttgctacgtatagtgataacaactgtggaaacttgattgaatgcttattacacaccaggcatttcacataggtcatatcatcttttcatccttacaataataataggaaatatatactactattactccaattttccaaatgagaaaactgaggcatggagaagggtagtaacttgcccaaggccatacaaccaaaaaaatggtggaatctgggatgtaaactcaggcaggcaatctgtttccagagcccagaatgttaatcgccatgatgaactgcttctagagtttacatgctaacagaaagagaaaataataaagaaagaaacaaacatagtagaaaacaaacagggaagatacggttagaaagacttagaggctactgtctaaaaaggagacaagaatgttacagatgggaagggaaaaactaatctggatagggaaatttgaatgtttatttttttagaggtaagagaaacttcacagataattttaataataaagatgataataacataacaaacatttattgagggcttactatgtgccagactctattccaagtgttttacatatattatctcatttttcagaataatcttcttgtcttttttattgaaatgccaggacatagcacatagtgctcaaagcatatttgttgaaaaaaaaatctcgaaaggtaattatatggcctggcacggtggctcacacctacaatcccggcactttgggaggccaagatgtgaggattgtttgagtccaggagttcgagactggcctgggcaacatggcaaagccccagctctacaaaaaatacaaaactcagctgagtgtggcacacgcttgtactcccaggaggtcaaggctgcagtgggccatgatcacgccactgcactccagcttgggcaacagagcgagactctgtctccaggaaaaaaagaaaggttagtgtataattttatctttttagaaaactctaggtcatagggctgaagctcaagggaatcaatgcctgtgtccctctttgttttattacttcacagcatttatttctgtctgaaattatcttggtttattttgcttgtttattatctttttctgctagcatataaattctaagagagcagaaaattcttgtttaatgctgtatttgcagcatctagaccaatgcctaggcatatgaggtgattagtaaacatttgttgtttgctgtttgtttttagagacagggtctcactttgttgctcaggctggtcacaaactcctgaactcaagggatcctcctgttttggcctgccaaagtgctgagattacaggcgagagccaccatacctagccaacaaaactcttgttccactgtagtacactgaattactgagcagagacgcctgctgctcatcattttgtgccttctctgaagcagcatctgtccactttctccatcactaactcaatcgtccatttacccaggcaggcttagttgtggagcaaggaagaagagaagtttcttgtttatcttgttttcaaaacaaatggagattataacaaaggtgatcaaaccatatctctataaaaatgactcttccatctcaccctcataaggatggctactatcaaaaaaagcaaagcagaaaataaaatgtcagtgaagttgtggagaaactggaaccctcctgtgttgttggtgggaatgtaaaacagtgcagccactgcagaaaatactatgatggttttctcaaaaaattaaaaatagaattccgtatgatccatcaatcccactttttgggtatatactcaaaagaattgaaaacagggtcttgaacagatatttgcatacgcatgttcatagcagcagtattcacaatagtcaaaatatggaagcaactgaagtcttcatcaattgatgaatggataaacaaaatatgtgtcctaaaatggaatattattcagccttaaaaagcaaggaaattctgacacatgctacaacatagatgaaccttgaggatattatgctaagtgaaataagccagccacaaacagacaaatactgtatgactccacttacgtaaaaggtgcctagagcatttaaactgacagagacagaaaatagaatggcagttaccagttgggctgagagaggaatggggagttttttaatggatactgagtttttcaacatgaacagaattccagagattggttgtacaacaatgtgaatgtacttaaccctaataaattgtccacttacaaatggttaggatgataaattttgtcatgtgcattttgtcacaatttaataaaaggattaaaaaataactttgggagccagatgcagtgcctttcacctgtaatcccagcactttgggaggccaagaaaggaggatccctcgagcccaggcattctagaccaacctgggcaacatagtaagaccctgtctctacaaaaaaaaaaattacaaaaattagccatgtgtagtggtgctcgcctatagtcccagctacttggggggatgaggtaggaggaccacatgagcccaggaagtctaggctgtagtgagccataatcacaccactgcactccagcttgggtgacaaagtgagaccctgtctcaaaaaaataataaataaataaataacttcaggccaggcatggtggctcatgcctgtaatctcagcgctttgggaagcccaagtgggagattcacttgtggtcaggagttgaagaacaacctgagtaatgtaacaagaccccatctctacaaaaaactaaaaaaattagccaggcatggcgcacacctgtagtcctagctacgtgcgggggctgaggtgtgaggattgcttgagcccaggagtttgaggctgctgggagctgagattgcaccactgcactccagcctggatgacagagcaagaccttgtctcaaaaaagagagaaaaaaaggctttttaatataatgcatatacttaagcattttacaagcatctctacagagatttaggaccttggagcctgagatgtttatgcatgaagtcaggctgatgagatcaggctgtgaatgaaaacagtgctctgaaggcaagcctctgtgacactcacctatccatacgaagctggcagacaatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattataagtagtaggatgagaggggtggggggaagtggtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggagagaaagaagaatggtgatgccctgaggccaagtgcatgctggaatagggtgaatttgaaggaggcagggaaggggagttttgccttggacatactgatgttcagaagtctagtgaataattgagcaattgaagattggattcattttaggagagggtgcagctagaggcacatatttccaagagatttgtatagacatgataattgaacagaaatgatgtctgtcctggtgggtttatacattcaactgccttagacgatatgtccataaaatcaacctcacaagcacacgtgctctctctgtctctgtctgcagttttaaccactaacagtctctatgtaaaagattctttcaaatctacatctagactccctaaatttcctaaactctagattgtcattccatctcctccttactattttggacttgcttcagttcaatgtatctaaattcaatgtatctaaaacagaattaattatcttttccctcaatggcattaccagtctgccacaagttttccagcctagaagtcttggaaccatcttttacatctctccctttctcacctcccacatccaatctgttaccacttcttctattttccatctctgctgagcctgtgggattcatgctttcctttctatagactgtaatcacgttttcaacatctccttttttcatgattagcagtgatctcattatagtttccaagtctcaagtcttttccttgacaaattcgcacagctgctaagttcatctttctgaaatagggacttaattatatcattccctactcaaaacctatagatggctccattaactatagcataatgtctaacctccctaccatggtattcatgaccttgcaaaatctgaatgtgactaactttcaagccttatgtattttgctgtcttccctcccgtgtgccatgattttcacttacgtcaattgtttgggcttttggttttccaatttttctgtgttaacaatgttttcttggtcagaaatgccctccctccttttaaaaccacaacattgattatttcaaaaggctcagttcagcattattccaatttttagaggttttcttcagctcccatggttggaaataattgctcccctcttggcactcaaatagcacctatttctcacatttggcacttgttttctgttgaatgtgagtgcagaggaattcagaggagtggctctcttttagctgaagtgtccacagaaagttcatttcattgaagaaataggattggaactgtgccccatgaatggcaggtattttggctgttataactgagagagaatattctaggtacgacaatgatatacaatgaaagaagaaaagaattaatgagaaacagcaaatatgatttgcaacaataagtagaacagcttgtcttgaagagaaagttattttagtggaactatgggaaataaagatagagaggtaccctgggatcttatatggaaggctaagtggtttgaaatacatccttttttttttttttaagtaagaatttgatgaagactataagcttccactcttcagaaaaattcacataagtttacatactcaaatgtgtccaaataatttcaaggagttcactgacctctgcggtttatggataggttcaacgttagggacttttgctctagttttttttttttttttttttttttttttttttataagacagagtctttctctgtcgcacaggctgctgaaatacagtggcgggatcttgactcactgcaacctctgcctcctcggttcaagcgattctcctgcctccgcctcccaagtagctaggagtacaggcacattccaccacgcctggctaatttttgtatttttagtagagagggcgtttcatcatattggccaggctggacttgaactcctgacctcaagtgatctgcctgcctcggcctcccaaagtgctaggattgcaggtgtgagctaccgcacctggcccattgacaagctttgagcagagactccatgtaaggtgagacggagaaagggcacaggtaggccatggtggcggtgagagcatgggggaatgcggtatgtgtgtgcattttaccagctacttctaaaatacatggatgaggtcagaagggcctgaactatggtggctggacaggaaatggtgattatgggagaagctttgaagggaaagccaatctagtgactgattagatactgatgttggagttaaaaggaggaccagagataactgtcaacatgggatcctgagtgactggaaaaaagatagtctcattctcagaaatagtaatcagaaggggagctggttttataggggaagtgactagttcattttagatatcctgagtgtttaatgactttgggtgggggacagttccagccctaacgcatagtcagttaggctgtttttttgtttttgtttttttggctccaagttaagtttaggataaagccagtattatctacctttggataaatagacacatagtaaactttactcttaattaaaccacacaatctcaaaaaaggaggctaaaattatactctaaaataatatatttattaaatatatcatcaaaagctgacttaagagacctatgcggttaaacaaagcaacccaaattattttgagaaagcatgaagaataaatggctggctgggcatggtagctcacacttgtaatcccagcactttgggaggccaagacaggtggatcacgtttgaagtcaggagtttgagaccagcctggccaacatggtgaaacccccgcctctactaaaaatataaaaattagccaggcgtggtggtgcatgcctgtaattccagctactttggaggctgaggcaggggaatcacttgagccaaggaggcggaggttgcagtgagccgagatagcgccactgcactccagcctgggtgatagagtgagactctgtctcataataaataaataaataaataaataaataaataaatagttgttcatataaattactttaaaaatgctgccttcagtttggttacattaaaaggaaaattaggggaaggaggtatcagttttaggaagagagctttgaactagaaattagggacaggaaccagcacagaccctgctgctgttgttggcttggcctctagtgctccatgttctggtaacagcactttgttttcctttggtgacttgctcacttctcatttcataaatttgtttcaacctgtttttctggagataactcttaaaataattgactggttttcaccaaacttgaaatagtaatgttaccaagatacaagccaagcagagttcacatgtcatgttgaaacaacaaaaaagccactgataatttcaaaaagtgcatctttattcctggtgtgtacaagactgatgagactaaatcaatcaatataagtttcaaagcagataactgctgaataggtctcctgttcactgagccatttattacgaacttgtatttcgccgactgtgtaattgttgtttgtgaaaaatgacctaaaagcatgacttcacttctgtcagcataatcttgattcagactcaaatattacagacttaaccaatttcaataaatatttaatttgccaacaaagtcacatccaggaagcaaaacccacttgcacctgctctgtgactttacaaagaatgggccattgcttagacagaaaggaccatacacgtcttacctgcagtggacaaccacaggccctcggccctgggaagcaagtctgtcttcttctacatccagcatgagctgtaggaggggctgggcactgtctggagtcttgtgatcaggccatgaggtgtaccagtaatgcttcacatgttgggtgtggcttccttgctgaaaatagcaacagccaccaaatgcctcattcacttgtagaactaaaagtcatccaaaccacaatactgaatgccttttatcacccccatcttgctggcaatttatttctaggtgggaaaaaaatttagaagatttttgaagagtgcccttttactttgagaagactttactgtcagtaacctgtttgcaaagtgagaaagtcatacctttgttgagatttacatctctacctatagttataatatagatcatataagtaacatatgctaaatatatatttataatttattataataaacaagatggtaggtgaaaatgtagccaagaaagaatgagatatattttgtttcctgctctatgagcattcctgacaagttattataaacatgttaatcaatagaacacttaatttcatatcagtcatgctaatacttctacactcatccaaaactccagtatttaataggagtgaggaatcacagcaataaagaagctacatgagatccctctattggaaacacttgggtgagggcccacacacctcatctccaaacccagcacgggtgagggtgtggcatgaacctcgcactccagaacatgtgttgaaaaataagttttggtaaatgccttcctattccaaacttccccggcactccagaacatgtgttgaaaaacaggttttggtaaacgccttcctattccaaacttcccaacaaaagccatcactgtagctctgcccctgttttcttcctctttgtgatgattctatcccagcagtgaggctgcagataagatcgaaatttttgggtgattattctccagaagcaaaaataataccatggtaacatttctcagcatctgctgcccatgagttaaataagatagttttcctatgacataatctcgtctggggaaagtccctataaattactgtaactccacgcttctgaagatctcatcaacacttcaggcttgccttgcttcccactgccacccacaaatgcagattttctctttcacagcttccaggccttacgcaaagctgcttagatcaaaatgacattaaaaaaaatcatggtaaagtctccagcacagcctttagttaaaagctttcaaaaggttaaatcagagatattttattaacgcaaattagaggatcacaacatcctacataatgaattttcttaatgtctacttacattcatttaattatactgcatattaatagtagttgacaacaaaaaatacatgagggaatgattatagtttctctttgatcttaacattatttaatttgcttaaattgcatttgtagtacttaaataatttcaaagtagaaatgtaatcctctaacatcatctactttgtagatggctatagctacataatcttacctttaagacaaggtttcgaatggtgtagttatcacattcatttacactgataaccagaacctcaacttttccatatatccctctcttttccggccagtatagcacacatttctggaggaagggaaagagaatacagcaaatattaatggcttttattagccatggagtacttttcattcaagcatctcaagagttttatatcattagttttaaaatatcaaatatcaatttttatagttttgtaaatatactaaaaccattgaattgtaaatcttaagcagctagattttatggtatataaattatatctcaacagttttttttaaagtatcagtttcatatgtgcctattaaacactgtcactgctggctccatacaaaaaaaaaaggcagaattacccaaaactcctcagagaaattaagaactaattaagaagttaagaaatttaagagttaagaaattgagatccaaatattagaatttatcatgtgctgactagaaataaaagaatgttttcccacaataattgaggaaagttacattttcctgcttcaacaaacttatgtctaatgagaatatctaatatgttaggtggcatacaaccaagtttcctttatatgtaaggcagatataatgatcattaatacaactatggtattatattttcccggaccaacagtttttttcacttatggaactaatttacaaaaattacgttaaaaatatttttataatggatcctcctgaggagctttaaaagagtgacaataattatactgcaagcaaggcaacatagcatggtggttaaggcgcaggctttgaactcggaacctgagtccaaattttggttctaccattcattacctgtgaatccacgaacaagatacttaaaccctttggttatagtttctttattattggctatctggaaagtacttaggataaagccaggcatagagtaagcacttacaacatgttattattgctgttgttattttaaaactactgggtgataggtttttggcccaaagtgattagatcttcatgcattaaatattattttggtattattatagtcagttatcattattaaataaaaattgcaaaatgagattcaagcatacatataatctcattttgctttttaaacaactgtaaaataactattttttaccacaaattttgatgataaagaatgtaaaatgacaaatgtttatgttttattttgagtgctcttggaagcaatgttaattttagaaatgtttaaatagcacttattttctcccaaccatacatacatttacatagaaattctttcatttgttgccttcaatcagaaccttttaatacccaggacacttgtttcttcacatctttgtcaaaggcatatgaatacacttgataaaaatttaaatacttatagatttaaaagagcagcaaaagactcacaaaattatagaactgaaggaaaagtgacacaaagtatcagaaacacacctccagggctctattatgctaagtaccactactctacaagctagcacagcgaaggaagtcacttcacctagcagaatcagtttctttcatccattacaataaaaacacatttacatcctctacattttgaccctttttctaaatgaagtaaattgtttcagctttatttacatgccacctgagactctcaggctatcagaccaaaagacttactctggctgacttaatgttaacattaagagaagaaacctttttaaagtagagcaactcatttctctcgaaatctatgagttgccaaatgtctaaaattttcccactttgttaaaggtaatcatacaaaccaatttgcctggtttctttcaatgaagcatcaattatttcgctgtaagacccgagctactgtgtatcttaaaacccatgcctcccgatgagtccaagaagaatgacaaagaatcttggaaaaggtattgaacaaagaaagaggcattcattcagtagtccagcagtctggcgtacgtgccccattgtccacgatcagacctgagcagcagggccctctttaggaaggtggctctcaaaaccagtaagaaaagctgcaaagcaggagcttgccgcctgcaccctgactcttaatacttgcacaggcttctgcacctacttgataaatggaaatgctgctcgcttctctcccaagcttgccgggggccctcttgaatgttttttttgactcgttaccaaaaaagcaattggcagtcagctcccagtagacaatgcaatgtgacttgttcattcaaacaacccttaattagcatcccatctcctttctgagatacaatagcttatttttacacactgaatacatttttccctcatttagatgacagaaaaagagaccagataagtgtgggtacttttgaatatgaggtgggggacagctgcaaatgcagttgtttctaagagtacaagttcatgttcaaattattttcctgtacagctttttagggtttctttattgtggtgctaacaatgagataaaagaggcagaaaaggcagggaagaaaaatgctgccttacagataatactgtgaaaccacactaattgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgtgcaaacaagttattatcaaactctgactgaaaagattctggacattaaccagtgctttgtaactggtggtttacagcaaaagtaggatgtaacacaaagcaatgcaaattctttttttttttttttttttttttttttttttttttgtgatggagtctcattctatcactcaggttggagtgcagtggcacaatgtcagcttactgcaacctccacctcccgggttcaagcgattctcccgcctcagcctcccaagtagctgagattacaggtgtgcaccatcacgcccagctaatttttgtatttttagtagagacggggtttcaccatgttggccagactggtcttgaactcctgacctcaggtgatctgcccaccttggcctcccaaagtcctgggattataggcgtgagccactgcgcccggccgccagctcatatttttgtgatcttttttcttcccttgattctccttctggcccccaccaagttagggctatgtgaggaggcggtctagctagttgtttagttgcctgaaaaaaaaaaacctatttttaagttattttctttttagtttctatatatttaaatatcagagatattgctctataagctaaagatctgtatcatcacatagaatgtggctctaagtaaataaaatcttcatacttagcttcatttgggttatattaatacatgagagggatagaatgggtcaggttgtctaaaattattattactatagctacttttattcctggtgctccgatggaatattactgacataggctcagagatttaagtaccttcaccaacatcatatcatttagccccttccacaatcctttgaagtaggtagggtgggtagcaggtattattattatttaaattatttttcagatgaggacatgaaggctcaggtgttttggtaggggaaaattgccttggggggctagaattttccaagaaaatatcactttatgaatgaaactttccatctttgatttccacactgactcttaaccaatgctacttaaccacagcattgaccaatgacctgttccctctgtcaaatatgttgaggcacatgcaaccttgcatagtcttggttcactctcctactgagctcagtacttctgttaccatcttttgatctctgtgttcctcaagttgtttttataccaaaacacctttatggcaggtgtacttattattgaagtccagtaatttaattacatattacagaaatcaataaaatatgaggtttaaaagagaaaagagctttatgagataattgaataagttgcgtaagtttttcactggtgaaaaaagtaaaccagtaaagaaaactacagtcaaatcagggacaggtgagacaatgacagaaatttgtctctaagttaaaaaatctaaatagaaaactgcatttatattgtttcataggcttttctattttctctttcattttaaataaactaaaatggaaaattttgataatatataaacaatgtgattgacataaactatatgatctagaactccatcttcagaccaacactcataagactgaaccccataataaacaaacacatttgaatatgaacaaatgtacatgttttaaaataaaatactttttttatgattctcacattgaccatttttgattaactgtgtgtttttctgttttttttttttttttttttttttttttttttttttttgagacggagtctcgctctgtcactcaggctggagtgcagtggcacgatcttggctcactgcaagctccgcctcccaggttcaccccattctcctgcctcagcctcccgagtagctgggactacaggcgcccgccaccatgcctggctaattttttgtattttttagtagagacggagtttcaccgtgttagccaggatagtctcgatctcctgacgtcgtgatcctcctgccttggcctcccaaagtgctaggattgcaggcatgagccaccgtgcctggctgattaactgtgttaaacaagagggcttctaactatagttggaagtaaagcaggctaatgcagtttaaacataacactgtggattaaacattaaggtgcaaagttagatttggaatatatgcatgcctggaaggacaggagagtaattttgtttgggcgcagtcagcatctgaatttctagccacccttaattgcttggtcagcatacccatcaaccccctggttacccatgaaatgaaattaggctgcctgtcactgctggacagtggtggccaggttgcctctccaccaacatgatggccctaagtcagaggctaggtggccttggtcatgcttgtggtggctttggtctctttgcttcctgttgaatctatcttgaatggattcgtgtttcataagcaaagtcctgcatgagatcctaatttatcttgtgactccaatttatgctcatgaatccagttgaccagcgacagcattcataatatctaattctgatcctccaaaggaaagctgaataccagaaagggactctcttctgcttgcttgctaggttggactcccacaataataccttctctgaccttgtttggatagaccctctggttgtgggacttggtttgctcgtttcttttcattcattttcaaagcatgaatcctttagtctactccacagtgatctgcaaattgaggacgacttctccctcataatcctagtccacactttcaaaattgtccactagtttgaataaacagattcaacgttttttttaaaacctgatcaaaatgtcttgtctatctcctcttccaaaagagaatggttatagatttctaaccttgaatgtaagcaatcatacataccactttctggatgcaatcacttcttgcactgtagactatcctttcccaccataagtggattccaggcagcagcatagtgtaatggtgaggaggaggaagagaaggaagaggaggagaggaggataaggaagaggaggaggaggataaggatgaagaagaggaggaagaggaggaggaggaggagcagcagcagcttgggagtcagctgtttggctttgggcaagttgccttcctgtgcctcagtgttctcatttgtaatggggtttacaaatatgtttactataaagattaattttcaagcacactgttagtgctccataaacagttgttcttcagaagatccaacagtccaatttctgagctttccatgtatatttgttgaaccttctagattaccttttactctactttttaagctaattataaatgatagagaagatatattttcattttatgcatttagaatttaacatggcacacttaacattttcttattagtatcttaccagaataatttattttctcctcaaacatatagtttaataaagtccactttattttaaagtaaaatttacatatctattgagtagccaatctttctatctgaatgaatgcacatctgattttataatgaaatttaaggcaatgtactccattaatgtatacttactacatacccacaaaattaaaaataaaaatttaaataaagaaactcttttgtaaaggcaaacatgggctgtgctcagttgcttagtcaatatttatatttccaaaaaaactttcttggaatgtatttaattaatcaaagacatatatggtagctgcaatttgacttaatgaggtcttaaggtttttgtggacaataaattggaaacaatttaagtacctatcaataaggaaatgattacattttagcacatccacacaatgaaattctagtaatttaacattttgatgaattattaatgacatggagaatactcataatgttaaaagcagaatatacatcataatacaataccctcttttattgtctttacaccaatgctgtaccttctcatgacatctgatctctctcacctgtgcatttctccagagtacccttatttctaactgcttaatagacttaaaagactttaccagccagaagtctccaacatttatcaaacttaacaggttaaagatgaaactgatatcacatccactcaacctcccaaaccagaagtcctgaagtcaagctctcacttactcccattcgatgagaaactaagcactgtggtttctactgctggaacacttaaatatatcttccaaagctattttatatatatatgctatttatatatatatatatacacacaagctatgtgtgtgtgtgtatatatatacgagctatatatatatataagctatatatatacacacaagccatatatatatatgttatacacacacacacacacacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccacaagtgatcctttcaccttggttttctgaagtgctgggattacaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccgtttgcaaagtactgaataagtcaatgggcaaaatggggcttagagtacttaagtcaagtagtttaactcagatgaaagatgcatgtaaatgtagagaaagagtacagctgtgttaaactgagagcagtgtgttaggccaaattatccagtaattccttcacttcatgaaagataggttcagggtcttattgctctttgggaccaaaagtgggttgcttgccttctaatgtcttaattctttatttggctccttataatgttggggcaatgattaagtgcctgggctttggaattaaacaagcctggattgaaatttggactccatcaactcactaactttgaggctctcattctctctgagctttggttttctcatttataatataggaatagtaaaacctactttgtagagttagaggaaaataaactgaatttatgtgtgttcaaattgtgcttagcacatatgatcaataaatggtagtggctagaaaacatcttccactgtgtatgtaatatggtcaacatgtatacctacttcccttcttttctgaaaggggagagaaatgcagtaagtaacttccagaagtagtatgggggctttgtttcgctggaagtgtgcaaaaactacttgccattttggattgctcttgcagttccagctttataggtttaagccactatgtcttctctagcagtggaatttgaacactgtcatttcaatgtttccttctctgaagaggaattccctttctcttgagatttatctaaatgaaggaactcaaacttaccagcaataaaatctctttaattgcaacttaactgttttttcagctatgtatattttcatttttaatttattttcattttataaacattgaggtcatgagaatattggagttattaaataagagatggcaattattcatttatttatttgctagaaagtagaaagttgcatgaaactataaagcctgggaatttctaaagataactccatctccatatgttttttggaggaaatgatttttgtcttttccaaacaatgacgcttaacacaattgaaagttggcacatttttggtaaacagaattttcctggtagtgtgaagtctactgtgtatttcttttgtgccagacttctcagtatcattttgatctgtaaaacatcagcgtttcctgtattgtattatatttacgtctttggagagtctagacagaaatttttattttaaagagtaatgaataataaaaaataacaaaatttttattgtaatatttgggattatgactggctgtagggaaaaaaagcacaaagcagattacacataaaagacatataacataaatgtttgactttgatatccccagaaggtatatctcagacattaaaaaagacaggaggctaaaaattgtaacacgcaaacaaaaatcatttctccaatttctgaattatgtggtcaaagaaaaaaattaaaacttcaaccacccattggtgtaggaattgttaaaaaaaattctagctttccacagatccatttggctctcctgtaaagactgaaatctgagaatggtaacaacaggttatctctgaggacaattactgcacttgagaaagaaagaacaagatacgctttattcccttgcagatactgaatggagagctctgagcatcataggtaaaccaactctgtgtcactctgaaatacatatttgaggctgctgcatgcagttccccggctagctgcagtcattggtgccagtgctcaggcacctgctgtccttgacctctggccccacaagcactaacccagcgcaggaggaccagccaccgccgccaggctctgatgctggtctctggtagaagaaggttgctcacagctctgctgcaggctcagaagtggccctttcaaccctccagagacatgagactagtccagttccaggcaccccacctggtggggcctcacttgggcccagagatggagaatggtggaagggttatcaacctcaatgcctttgactctatgctccccaaaatgatgacacagttcctagagcagggagaggccatcctctcagtggcaagaagagccttgggtgcccagttgccagtcctaccatggttggaagtgacctccctggctccagccacatggccagataaggtggtgtgtgtgggcatgaattatgtggaccactgcaaagaacagaatgtgcccgtgcccacggaaccgatcaacttcagcaagtttgccaactccattgtggagccctatgatgagatggtcctcccatcagagagccaggaggtagactgggaagtggagcagctgtggtcattggaaagaaaggcaagcacatcaaggccacagatgccatggcccatgtggctggcttcactgcggctcataacgtgagtgctcatgactggcaaatgagacatgatgggaaacagtggctgctgggaaaaaccttcaacaccttctaccctctgggccttgccttggtgaccaaggacagtgtagcagatgcacacatcttaaagacctgctgccaagtgaatggggaagtggtccagagcaacaacaccaaccagatggtggtcaagacagaggagcggatagcgtgggtctcccagtttgtcaccttttacccaggggatgtcatcctgactgggacctccccaggtgttggtgtattcaggaaaccttctgtctttctcaagaagggagatgaagtccagtgtgaaattgaagaactaggtgtcatcatcagcaaggtggtgtgatggctcctgcacaggccctggtcataggatgggggcatctgctcccactcagcttagcccagggaaatgtcgaatgccaggtgtgggcaggtgccagccctgtaagcctcctcttctaggtagaagggagaaggatagagctctcttcaataaatacgtcgggccaaagcaaaaaaaaaaaaaaaaaagaaagaaagaaagaaatatatatttgacttatacagcagttctggtacaatgacatccttggtcttggagaaggaggatgagagcaaccgtctgctggggctttggcatattaataattgctcacatcatccctattggatttctttaaaatatgtcacatattacacaccctctaggaaatgtcttctgcctaaccagcaatcttagtttctgtcctgctaaaaccctgattcaagaatgaggtaaagcactaaaggcacattcctgactttttctataagagtgaacacagataaacatacattacaagattcaaagattgaaatgctcaaaagaacaaacaccgtaatgtatcttacacagttattacaatgtattctgtaatccttgtgagatattgtttcacatatcatttgccaagtgttaatccttagtacatatgcaacactaaattgcatgtaataagtaagtaatttttctggggaaaatattatttgttttaaaacatttacatacttatatttacaaatagtttcataaattatggtgctatgttgattttataagattttatttgtaatagaagaagaaatagaaataataagaaatatttaagggcatgaatgcactttgaaataatatttattttatgacaatttactcagaaaattcaaaccaaagtgggcaggggtaaggcattttgctcagatctacgaaatggtgctaaatattgcatgaagttgttcatagtgtcctcttttatttaaatctctgctttaattatagtcatttttaatggttttttttgcatttcctttaattctgctagttttgcctattttattagacttcaaaaaattgacttttgtttacatcaatcctttttaaaaattttttttaaggcagggtctcattttgttggccaggctgaagtgcagagtagcccaatcataactcaccacaacctcaatcttctgggctccagggatccttttgcctcagccttctgagtagctaagacaacaggtgcgcaccaccacccctggctaatttttaaattttttgttgagatataagtctcattacattgtctaggctggtctcaaactcctggcctcaagcaatcttcctgactcagcctcccaaagtgctgggattacagaaatgagccaccatgcctggcctcatcaatccttttatctttgttttatgtttaacatttattcttcattattccttccttttttctctcctgttcattttatagttcttttactaacttaagtctgttgcttagatcacaaattcttttataatatcatattcatgcctataaacttccttctatgagcatttttagcagcatctcacaagatttgatgtgtagtatttgcatcatccctgaattgcaggtaatttacagttatattataaattcattttcatccatgaattgtgtgtgtgttaaaactttttttaagcatcaaagtgtattttttaatcttatctttctgctttttatttctaacttaatgcactgtaatcgaagcatatatgtacagttattcctggaaatttgccaagacttgctatatagtcgtagttggtcacttttcacaaaatctcatgctttgaaaatttatattatgagattattgattggaaggttctatatatctttcttaaactaagcttgctaatttgaataaaggttatgtataaactttttctatatttttattttttgtctgcttaataaatactaatatctgatttttattgggttttctcccagtgtgatggtgatttatcaattccttctttaattctgcccattaatgcttcagatatttggggggaggttatgtatattatgcatttatatatttagaatcttacttgtgaatttcacattttagtgttatagattgacattccttatctctagtaagctctctgataatgattgttttgatttgaaattcattttcatctgacattctttatctctggtaacctctctagtaattattcttttgagaatattcttttgagaattattcttttgagagtcagttttatctaacttgacttttgattagtattagtttggtgtatttttttccatcctttccattttaacatttctgtgtcctcttgtaggcagcatttaactgaatttatttattttatcagtttggtaatctctgatatttaatttgcaagttatttgtttatatttagtatgatttggatttttttctatctcccaattaggtaaaagtttatcctgatttttctatattaccttttgttttcccttttattttggtttattttcgaaattctgtcttttctctcttctaccagattggaaattatacattctaattccatccttttagtggctaatcttaaaatttgaacatgcatatttacctaaaagtctaaccttggcttatatttctcttttcgtgaataacacagaaatattttaactttcctcatcttctcaaattttaaatactatcattatccagtattttagtttcaccttcatattttactttctttgctcactattatttcttgtatttgagtactttttttctggattgaattcttcttcattctgttttatcctcccttgtagttgttttggtaagattttttttggtggtgaattcttaccatttttgttagtttgaaaatgtctttcacacctggccctgtaggatagatttgttgggtataaagttctgggtagtcaagtattttctttcagttctttgtaggtaatattctactgatttttggcttctagttttgctatagaaaagcctttttttttttggttagttactctggtgggagtaattactttctttggtgctttttcagttccagagatgtgtctagctgtgatttacatttacctattcagcctaggatttattgtgctttttagatttttgaactcaagtcttccatcagttttggaaaatccctatctattatttcttcaaatattacttcttttctcatatcctcttctttctccttctaaaacacctgttatggtatattggatatcaaatactatcctctatgtctcttagacactcttttttatttttttgtcattttgatcttctaggtattttccttagctttatatttgaatccattagttattcatttagctgtgtcttgtttgatgctaaacctatctaataagatttttttaaactttaatgtctttataatgtttatttctagtatttgttgttttaaatcttcatagcctttttggatagtaacttgttcctgtgtcaaattttttatgctttttgtgcttaattatttaaaagagtagcctacatttattatttcagttattttaatttatgtgaatctatttaattgttgctgcttctgattttttctcatggtttttattggttgcttgtatgcctcataattttgattgtaggcttatgtttgctgagagttttttaattttattttaattgacacagaattgtacatattcatattaatgtgatacttcagtgcatgtatatatgggttaatgatcaaataaaggcaatcagtatatccatcactgcaaacatttattatttgttgtttgtagtgagaatattcaaaatcctttcttatttctgggctctatgttccatattccattccattggtctatgtatttgttttttttgccaatatcatgttgctttcgatactgtaactttggggtatattttgaagtcaggtagtatgatgcctccagcttttttttttttttgtctcaagaatgatttggctagtcaagatcttttgtcgcttcatacaaattttaggattaaaaatttttttccatgaagaatgttattggtattttgatagggaatgcattgaatctattgattgtttagcgtagtatggacattttaacaatattaattattccactccatgaacacaggatatatttctgtttatttgtgttctctacaatttccttcatcaatgatttatagttttcagtataaaagatatttcacctctttggttagatttatttttaggtatctctatttattggtagcaattgtaaatggaattgttttcttgattttgtttttagctagctcaccattagcatatacaaatgctactgatttttgaatgttaaatctgtatccttgaactttactaaatttgtctattagttctaacaagttttggtgcagtctttagggttttccatatatatgatcatatgatctgcaagcagggatagtttgacgccttcctttccgattttgccttttatttctttctcttgcctgattactctggctaggacccccagtactatgttgaatagaagtggtgaaagtggatatccttatcccagatcttaggagaaaagctttcaacttttccacattcaatatgatgtttgttgtgggcttgtcatatatggactttttagtgttgaggtacatactttctgtatctaatttgttgacagttcttatcatgaagggatgaattttgtcaaattatttttcttcgtctattgaaatgatgatatggattttatccttcattctgttaacgtgatgtatcatatttattagtttgtgtaaactgaaccattcttgcatccctgggatgaattcccttgatcatagcggatgatgtttttaatgtgctattgatttttactaatggtttactaatattttatgagcatttttgcatgtatatcagagtgacctgtagtttcttttttggttgagtccttgtctggtttgggtgctagggtaatgctggccttgtagaatgagtttggatatgttctctcctctttaattttcttgaatagtttgaggagaattggtattctttaaatgtttggtagaattcattggtgaagccatcaggtcctgggttttgtcttcaatgggatacttttttttttgagatggagttgcactctgtcacccaggctggagtacagtggcatgatcttggctcactgcaacctcccagtcccgggttcaagtgattctcctgcctcagcttcccaggtagctgggattataggcacgcaccaccaagcccagctaatttttgtatttttagtagagacagggtttcaccatgttggctgggctggtgtggaactcccaacctcaggtgatctggctgcctcggcctgccaaagtgctggggttacaggcgtgagccacagcacccggccaggataggttctgttactgatttaatttcctcactcattagcgttttcagattttctatttcttcattgttcaatcttggaaggttgcatgtgtccaggaatttattcatttttttttagattatccaatttgttcgtgtagtattgttcaccatagtcttttataattctttgcatttctgtggcatctaaagttttgtcagttttatgttttcaaacatgatcttttctttttattgatgttttgtatttttctgtctgtatttcatttatttctgctttgatctttcttatttacttccttctactaattttgggtttaatttgttcttgtccttttttattttttgagatggagtctctctctctgtctcccaactgcccaagatggagtgcagtggcatgatctcagctcactgcaacctctgtctccttagttcaattgattcttttgcctcagcctcccgagtacctgagattacaggtgtgtaccaccaggcccagttaatttttgtatttttagtagagacagggtttcaccatgttggccaggctggtctcgaactcctgacctcaagtgatctgcctgcctcggcctcccaaagtgctgggattacaagcgtaagccacgctgcccagcctgttcttgtttttctagttccttgaggtgtgtcattaagttatcatctttcacttacatttcaacaaatgtaagcatttattgatataaacttctcttttagaacagctttttctgtattccaaagactttgatatgctgtctttctatttgtctcaaggaatttttaagtgtcccttttaatgtcttcattgatccattggttgtttaggagcatattgtttaattttcattaaacaatatttgtaaagtttctgaatttcttcctgttgttgatttctagttttataacattgtggtcagaaaacatatttaaaatgattttgatcttttaaaatttgttaaggcttgtcttgtgctgttaagaaaaacgtgtattctgcagttgttgggtgaaatattctgtaaatatctgttaggtccaattggtctattgtgtggtttaaatccaatgtttgtttattttctgtctggatgatctgtccattgctgagagtggggtgttgaagttgaagttcatgattattactatatagcagtctatttctttctttaatctaataaataattgctctttatatttgggtactctagtgttaggtgcatacatatttacaatttttttttgttgaattaacccatgtatcattatataatgatcttctttgtgcttttttgtgatttttgatttgaagtctattttatctggtataagtgaagctactcctggtctcttttagtttccatttgcaagtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgacaggtaagaacttactcctgccattttgttaactgttttctagatactttgtttctttcttctacttttattgtttccctttgtgacttggtggttttccatagtgataagctttgattcatttctctttttgatttgtgtatctgctgtaatttttttctttgtggttattctggggcttatgtaaaaagaacttagaatattttaagctgataacaacttaactttggtcacatacaaatattctagactttcccttcccccatccacaattcataatttccttcaggtcattattttaaattccttttcaggcaatttataaatttccatttctttaggggtcagttactggaggattcttctgcttctttgatggtgtcatgtttctttgctttttcatgtatcttgtatccctgtattgatatttgtgcatctgatggaatggtcaactcttttaattttatggagtgacttttgaagggaatgactttcaccagcagatgtgtctgagggtattggttgggtagggtacattggcttttgctctatgtgtgtgcagtagtgtagtctctgcaggtttttaagctgtagtcaactttattgataacctctgaaggccttggtgtggctagtttgctggctcaggacaggtcacccctggaaacagcacacttggctggtgagcacaagaacaaatccactggttaaggtggggacccgctgtgagatgcatacatggctggtgagcatgcagcagccagtctgccagcttgggttagggattctctgggggcagtgtacttggctggcaagcatggggcttggcttgccaactcagagcagaagtcccctgaaaatgacatgcccagctggtgagcttactggtggtatatgcggacaggtctgccagctcaggttggggcatccttagaagtagtgcacccaactgttgagtgcaccagggacatgcaggggctggtccactggtttgggtgggactcgctttggaatggtgcattcgctggtgagcatgctgactgctcatgaggccagtttggacttggtttctctgctgatcaagattgtctgttcctttgagggcaaggtgctatatgggcttcatggatggggcactggatctaggctctgagagacagggttcagggtgctgcagtcactaggatgtgaaaggtggaacacctcctaggagcttgttcccagggggtagggagctgtagcaactcagcaagggaatggtgtactactgtgtgtgaaggtagtgtaatggcagtgtagccttaggaatgaaaagagatggtggctactggcccctggaacaggatgtactctagttgtggctctggtttcaaaatggcatcatatagctgcagcttgaatcacagggatgaggggatacaatgtgggctccttctctggggcattgcagccatgtggctgtcaggcagctccctaaactggactcagggtctgtagaaactgcaggattctcagcaacaaagagtgcagatgtctgtgacattaatgggggctgctggggcctcttgcttgcctagtccccactggggatgcatctccttgttctgagctaatactggctggggagatggcggtgtggcagaggcagagtgcttcattctcttctctatgtgaccctcactaaaggtctccttgtctcacaggatttctgtctctctcctactgtattccagtgtgctccctcaaacactccagttcaaacatactttcttatttgttgttttggctcttttttttggtgggaagtatgagcattcggcttctctagtcggctctcttgctttgccctggctgggcttttctatggaaatctgtgaggtatatgctgagagtatgtgcatcagaaagtttttgccttcgtttctgtaaagtatcatagggcgttaccaacctagtattactttttatgttaatgacttcacttggtgtttcttgatttttgaattctgtgatttctcagctttaaatactcaagagagccttttcgtttataccataagaaggccagacttaggcgaatttcttagcatcatcctatattagtaggcagatttatttttgttgttcactttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgttgttcacttttttactggaggtgttacctttgaaggtgctcactttatgtaaggtctcagttccaacacctggctcctgcaagatcaggctttgtctccagttcttgtattaccattacaatatgtttaattttctggttttatgccttttagtctctttttattaagcactgggatttcctttactttttttcaaagctcttctttgcatgctgtttcatattctgcacagtgtaactggttttgtagtgagaggtttttcaggttatctagtctgctgtattacataagttctatgtaggaatgcacaaatgtacacatacagagaatacacctcttaaacttgaaaaatcttttctatcataaaaatgtcatgcatattaaacaactgtgaaggaattgtcagtggcttaatatgttgatagattgacactgtgtgggaaacagctgagaatattaggggttatttttataatgccacctcaggctttaatatcagattcatagaagtgtgtttagttagtaagccatgtagtgaattgagtatataaccttatctactggccaaaaatatgctatttttccagaatatagtgtgtttagttagtaagccatgtagtgaattgagtatataaccttatctactggccaaaaatatgctatttttccagaatatagttcaggaaaaaaagttttatctattgtagcaaaaatataagaaaatcacaaactttaaaacacatataaattgctgttttgtgagcctagatgatgtccattagcagcaggattatgctgtactcaaggattataatcaccaaaggcttataaaggaatgcttagttttcttaaattcttactgtcatggtgaagctctggtacaatatttttgacaagaaaacaaacactgaaatgctgattaaaattagactgtaaataatcccagtaagttgtcctaaaatgaaagcggtacctcggatatcagccctcaggaatattacaattgtatttttataatgcaaaatacagaataagtattctgcaagctaaatccttagaaaagactactagtatggaaatgaaatcaaattctgtctttcttggatttcttattatgaagatattgagaaagttgattggtttctgtaactgtcctcaaatctcgttttcttaatgaggctcaccttgcccaccctctttgcattattaaatgtaatctgcaattccccatcaccccctccttactgcctggtatacccattccacttagcctgctctactttctttcctatagcatttaatctcttctcatatattacactatttataagtttattatgtgtagtgttgtttgtctgtcttctcccactagaaagttaaaatctaccaagggcagggatcttggtgtgttttgtttactattgtatccccaatgactacagtagtacctgtcacatagtaggtgttcaaaaatgacttgggtgtgaatgaataaggttttatttatctgcttataaattagggtgataattcatggccccttatttcttttgtgggtacaaattagatatgtatatgccaagtatattgacttgtctgaaagaaagttgacattcataggataatagcacttattatatttgggatgtattaagtgacttagcctttaaatgtctcagagtttccatcttaaatctaagtccatggcaattttactaacacagtatctcttctatagcaacagaacacatataacattcagaacttgattaaagatcatacctcatttttttctttgagttttgtgatcataacaatcacagggctgtcttcctgccaaaccatctgccagaaatcatccacggtgttgatcatggggccctgcgtggcaatgaaggctttctccttgccactgtagccctagatggagtaaagaaacaaaaatattggtttttaagttcatgccttgcagtgaaagtgtaggtgaaagatcttcaacgaaatagctgggctagtacaaaagcaacacaggttacggcttcactgactctagtacaacaatttccatgggtattttggcagcaagttaaggatagcacatggtactgagggttgtaatgcccagtccccagcagagtacccatatagagcactgttgccagagactcacagtgaaaggaaagtcatcataaaagacccattaacaatgttgattatgactaagataaaaaaccaaacaaaatgaaatcttgctggtaatcaagttaaaccaagcttaatctactctaggaaaaagaaaataaaaccaacaattccaaataggaagtcaccagaaagaaatttgtacttatttacttaccctaatataattagcattaatgtaggtgctcaatgaatcggttacattttttggtcttaaacacactctgctgaggggatctaatgaagaaaacaaaaaagaatatattaaacagatttaccctttttaaagttccttagaatgccaataaccagtaagtagaaacctgttatgtattgattatctggtgcatgtcaatgtttgtctttggtgtccattgcttgatccatatgtttattgagggacatttgggcctgtcttcactcctgacataaagctcatccataagcctaagctgatgagtttatatttcaggccatttctcatctgttccggttctcgacctcatttctcatttttgcgcccactcttatacttttgatctggaatttgtaccaggtctcctcactcccatctctctcctttccctatggaggtaaatcaggctatactctaccaattatttatattttactatctcatctcatttagaccctcaggtctgaacctcaccttgtctgaccattatgtcctggccagatctcctgatcttccgagatggatgagattaataatctattacgtgctatctgtgtgaggataggcaagccaggggaagagggaggttgcaaagataaagataaacatgattcatttcgaggctgggcacagtggcttacactgtaatctcagcactttgggaggctgaggcaggaggatcccttgagcctggggcttcaagcctaggcaacatagtgagacttcatctcaaaaaaaaaaaaaaaaaaaaaaaaaaattagccaggcatggtggcttatgtctgtggttccagctacttgggaggctgaggcatgagaattgcttgaacccgaaaggccaaggttgcagtgagctgagattgtgccactgcactccagcctggacaacagagggagagcctgtctcaaaaacaaaaacgaaacaaaacaaaacaaaacaaaaaactatgattcatttcagtgagttttcagtctgctcataaaataacaaacaacatacatttattgtttattagatgtcagagtctgttctcattgctttacagatattatatcatttaattttcttgtaactttaataaaagtacctaagataatgggtaagactccttccccatttttcagataggaaactaagataggttaaataatttgcccaaaggtacacagccaagaagtaggtaatggagtcaggctttgaatccacacgaacactagggtaccattagccactacgctgtgctgcagctctcatgcgaagatagctatgtaagctgacgattaaaatacaaaatgttatatcctagtggttgcttagttactttcttaaaaaacagcaaattcaatgcttttcagcttcctttctcagtggagtgtggtgtaaaaacaggggtgcagcaaagaaaaacttctcccattcccatatttttttagtaacacactatcattgaacatcttctgggtaaacacaatctcttacgttccccacgaaaactgagacaaagaggaggtgaggtaggaagtactagacgaagaaagtttcatagaatatatttaaatgggagctaaaaataattaaaaatttaacaggacttggcaagccaacatttgttttaaatttcactttatatataactggggttaaagataataaaggccataattagtttcagaaaaaggctaaccagcccatgaggacggtgatggtttaaaaatgtagtcatccaattatctgacactccttctaaaagaatgtagtagagactaattcctctcatcttgaatgtgggcagaaattaaatagaatatggcagtagggatggtgtgtgacttggtcataaaaggtattacagtttcctccttgcgctctttcttgagttgcttgctctggaggaagctaatggccatattttgagggcactcaagcagcccaatgaagagagaaatagtggggaactgaggcctccagctgatagcatatgaatgagccctcttagaagcagatccctcagtgccagccaagtgttcagctgaccaaaggcttggccaacaactcaattgaaatctcatgaaagaccttgagccagacactcaactaagccactccccaattcccggcacacagaaattgtgagatataaatgtgtattgttttaagccactaaattttggggtaatttgttccatagcaataaataggtaatatagggaccaataaggagtcagtcacaaaactctggagtgatatcatgatcactgttattgtcattgcactcattgttgactcctatatgtgtcaggtagagcaggtaacagcattttattcattaggtcacttaattattacaattctataacgtacatactgttaacagtctctttatttagattaggaaattgcagcacagagaggttaagtaactcacccaaggtcacacagtaagaaatgaagcagagagttgaaaccagattaccaaacttagaatttaacaaggccattatcaaagatgatgttgaaaatatatagtaaaattttgctaatttgtcactaggatatttgaaataaagatattttatatatatgttatatatataaataaaacaagtaataggagcttctatccaaggatggataaagtagatttgagctataagggatctggctttggcaggagaaagtcccattctgcttaaagctttagattgacttgtgaagaccaagatgcttatctgatcttataggccacaggtaaaatagctcctgatcatgccatatggaagcaatgtctagaagatgttaataaattctggaaatcagtgggaagacccttaggtggcatccaagaatcctgttgatcgaggcaggctttcattcagtttgaaccaaaacactttgcaaaagatcctagcatgtccttttgggtgacctaaaggaagtagggtgactacagagaaacttacagtggaacaggtaaggactgttcgaatcaggatataacctaactgtgaacaaggaattgtggtcctatgctcatcagcatggaaatctcttgagacatgggctttgaacttatcaaaattcctcctcaagagatatgttggggctactggtactgaagcaaactaccctctttaaagcattctggaaataagtccaatctcagtcttgtccttcagagctttcaaaatgtagaccctatggagatggaagctagcaccaaactttcaaaagcacttcattttcccccaaatctcatacagtcttaacagatctatctctacatttcctacaattgttggtcaggggcagactgaccctcacttgcatgagccattttcaataagaaccttgtatcttattttgtattcataatgttgtattcattttttaagagtgtcttccagggcaaagttccatgacattgatgtgggcaaaaatttcttggatatgaccctgaaagcacaatgaaagcaaaaatagacacaggggattgcatcaaactaaaaagcttctgcacagcaaatccacagattgggagaaaatatttataaatcataccttaagaaggggctaatatccaaaatatatcagaaactcaaactactcaataacaagaaaataatcgtattagaaaagggataaagatttgaatagacatttctaaaaacaagacatgcaaatgtccaacagatctacgaaaaaatgttccacatctcaaatcatcagagaaatgcaaattaaaaccacagtatcacttcatacctgttagaagggctattatcaaaaagataaaagataaatgttggcaaggttgtgaagaaaagggagctctggtaggctgttggtgagaatgtaaattagcatagccattttggaaaacagtatggagattcctcaaaaactatgaatgaactaccatatgatccagcaattccacttctgagtatatatccaaaggaactgaagtcagtatgttgaaggcatttctgcactcctatgttcttgcagcactatttacaatagccaaggtttgaaaacaactggagtgtccatcaacagatgaatggattttaaaagtatggtctatatacataatggagttctatctggcctttaaaaagcaggaaattctgtcatttgtgacaacatagatagacttcacagatattatgctaaatgaaataagccaggcacagagagacatgatcttctttatgtgtggaatctaaaaaagttgaactcatagaaatagagagtagaatggtggttaccaaaggctaggtgggtgggtgaatggggaaaggggagatggtggtcaaaggatacaaaatttcagttaggagaaataggttctggcgatctattatagaccatggtgactattgtttaataataatattatatatttcaaaatagctgaaataatgggattttaaatgttctcaccacaaaaaataaataaatatttgaggtaatggatacattaatattagcatgatatgatcattccacaatgtatacatgtatcaaaacatcacattttaccccataaatatatacaactgttattttcaattaaaaataaaataaaacctaaagagtaatctccaaataatataagctttagctcccctcccttccaaaaaactaaatctacccttgttggtaaaacctctcagtctgcataaaatctattacaccctttgtaatgtagaaagacttctgctagactgctttttgttaccttatctttttcctccaaggggtcttgaacacctgtggagctgaattttaacattgagagtgaaattattccattgtttatacgtatcttccgtcaatcctattgatcaaaactcttggcagatcacaaaataacaaacaaggaggagaagccacagtggagcaaacaacatttattgcacactctccaccaagaatctcatggaggaggttccctgctgggagcctttggctatacagcgccctaaaagcttcttgccaagcatgctccgtgctgtctggcatttttgctgtcaatagctggagcacacaatagtacgcatatccaaatatgtactttaagagctagtcgtctcctagtagtcaccatccctgtctttctttagcaataagatcccaattctggctgagaacttggtaggatgcacagcttaagacttcccttcttaccaccccttgcattagttgcggccatgtgactaagttttcacttatagcaggtgagaggaagtgatgcgcgtgacttttagatcatgaaattaaagtgaggagtgatgttcttcttctaccacttctgattccatcttgctgcctgggatgtggtcatggtgatcaggatcttagaccatgcaaaggtaataccctagggatggcgaggtaaccagagagattagtctggaggtataacatggcaaagctgccatatcaaccctggcaggtatacttgagagggaaaaacacttttaaattatttaaaccactgttatttgggttgtggttaatagtatatataagttttctggcaaaaatatttcagaaaagaatagtattatcacaaaatcagttctgcctagggaggcattaatagaataggtacatcccaaacatctggggtttgtatatattcagaagtcaaattcagggtttcttagagttggagttcgcatgtccaataattatcacgatctataaaaaataacgttttagcaacataacaaaaggtaatcatcattttagtctaaaactaagccctcaggccccataacattgccattagaatgcacgcagtgattagttcagtctggatagccctaaattgcttattgcactgatttcctttcttctgacctacaacaaacacatggcctggacagaagtctttttcactatttggaagaagctgtctttagttagcatatgtagcggtttgttcactgacagcacaagtatctgatattggttagattcgtttagtgctagcaacattgtcttaaattctaaaatcactttccatcaagagttgaaagactctttgtggactaaagtgttacggaaaatgtggaaattatttttaccatcatttgcatacattaatattactaattcgtctctttatgatttctttgacctggtacactctgagctttttgaaggcagggatggggatttttcaccatctttataagatctaatgtcttgcatagcagaccttcagtgaatgtctactgcactgatttaaagatctcttctattttttaaaaaaaggtcagttctatatatccttctctagcaattattctattgcttttcttttttagacaggcaaacttctgaaagagtttattatacacacacttcctccatgctcatctgcaactcaatcctcctcatgtacactgtgatctatcctaaccctagcactgtgcagagactgcccttgctaaggtcaccactgaccctcttgttgttaagcccagtgatcccattgtggtatttttgttcatgtcctctctgaagcattcaaaaactgttgactgtatatccttttttcgagttttctcttcccttagattctgggacacaacgttctggttttcctgctcccttttcggtggcctctttccaatctcctgctcatttaatctgccccttttcatgttgctaattctaggattcaacttgaccctcttttatcctcacttgatactgccttgttgagtgactcattcattcctgtgactttattacgcacatcctgagggctctcaaatacatacttcagaccagcccggtctcctcatttatagtccagctttttctatttattatttccttctgaatggaccacaggtttgtgaaactcctcatgcccttcatgtgttcctgacagctttctgctattgtttaggttaggtgtgctgccacagctctacagtccgtgtagagtttctgtgcatttgaatgttagcatattctgcctgttctgtctcctaaaatacgctggggtctgtcttgcctctctgtttgcatggctgtcttcttggactaggactcaagtatctcctggtctccctgccttcaatcttgcttttttccaatccatcctcctcatagctgtcaaggtgctctgtaaaacaaaatctgatcacatgattccattgtctaaatgtcatccatacttcccaattgcccatagcagtatttcccaaaatatttattacctgtaaatcattacctctataacatatagaattatactatatgacttataaattaagtcatcttttacaaaaagaggttagtacccaaataaatatgggaaacattgggttaaacaaatctgaaccatattctttttactgcaggacttctcagggtcttcagtatgttaatggaccctgtgaatttccaagaaggtattgtatataatcctatttgtccgttggactcaattttattatacctactgtatttacatacttaactattatatttatatacttattgataattcagtttagagcagccctgatcaatagaattttctgaggtgatgaaaatattatctatctgtgctgtccaaaaaatgtagcctctagctttcaagcacttgaaatgtggctagtaaaaactgagaaactaaagttttaattttatttaattttaattcatttaagtgtaaactgacctagccataagtgggttctggttgctctacttgacagtgcaggcctagaagatgaatgccaagaggggtacttagcaagatagagcagatccttaatgatcatcccaaggcctcaccaacagctgctttcccacgtgtatcatataatctagccccatggacctagggcaatctcccaaatgttctatgtttttgcagattttatgcttttgcacatattgtttcctttgccttctctgcatggtaaagtcttcctcattactcagggctcaattcagaaaatactgtctttctgaagttctccctgaccttcccaggcagaattaggcattctcttctttgcttgggtcccctgagttttattttagtatttatcatcttgtattttaagtgcttaaatttctgcctgccctcaatggagtgtggtgagcccctagagggcaaaggctgtatttaattcacttttgtatcctttgtgatttctatttgggatgtggctcacagagggtttaatgtcagaattaatttctatgagaaagagttaaagccctgtttttgactttctagatatttttttcttttcttagcaaagaggacaagaaatctttcatgcctttcagtatccactgattgttagaagtttccataaacatcctacaccattcaggcttgaaaagaggcctgcttccttcagtttttataatgcctatgatgtatatgatttactggtaaagctaaaaactgcttagaaacagtttccctgtaaagctaaattatgttggtaattagtaacttacagtattttccaagtatttagaagtttccaaatcctttttattaaaaattcagagaggggagtctcactttgttgcccaggctgaattgcagtggctactcccagatgtgatcacagctcactgcgacctcaacctcccgggctcaagtgatcctcctgcctcagcctcccaagtagctgggaccacacatgtgcaccaccatgcctggctacattttgtattttttggtagagatgaggttttgccatgttgcccaggctagtaattaaactttttttgtgtgtgtggaaatggggtcttattatattgcccaggctggtctcaaactccaggacatgagccactgtgtgtggctccaactacttccttttacaaatgcaagaatacaacatataactgagtatggggaaatgtaggtttccaagaaaaactcttgtaatatatagcttgtactaaaaaaaaaagccaagaattaaacaaaaaatgtataatcatcatcgttttcatcactactgttataaatgaatgaaaatggggctcttgagtactttgcttttaaaactgtaaacttctctatacatagatggtacccctatttcctggaattggttctgaggttagaaatggattcatcttcagttagatagggagggaaagagaaactaacattagctgagggcttactattagttggaactttgacagacattttacacatactatcatttaattttctcggtagccttgtaggagagtattgttatcactacttttgggaataaaggatggcatagggagattaaatatcctgccaaaaattataaatgtttttgttggggtaggaaatcaaatctaattccagtatcttgctttagctacataacttgttgctttaatgagtggttcacttatttgcatatctactctgtgctaggtactttatataataaaaaaggaaacataatttaagtaggaaacattattagatgttaaaattttaaatataaaatgatgacctgagtaaatggcattctttaagtgtatctatattatcttatatttgtatcaacacactgcataaaagaaatatgcatacaatttattattatagtgcagcactattcacaataacaaagacatggaaacaacctagatgcccatcaacagtggattggataaagaaaatgtggtacacatacaccatggaacaccatgaagtcataaaaaagaacaaaatcatgtcctttgcagcaacatggatgcagctggaggccattattctaagcaaattaacacaggaacagaaaaccaaatattgcatgttctcacttataagtgagagctaaattctggatacacatagacataaagatgaaaacaatagtaactgggactccaaaaaaagggagggagggaaagggagaagggctgaaaatcttcctattgggtactatgttcactctctgggtgtcatgccgtcagaagaagcccaaacggcagcatcacacaatatacccttgtaacaaacctgcacaggtaccccctgaatctaaagtaaaaataaaaaatttaaacttattattacagtattttattgtgtgctaataattttctattgatgtatgattattattacagtattatattttattgtctgctaataattttctattgatgtatgattgttttttcctactacttttgtgatttaggatgtagacatatttttatcactaatatttgtttacactgcaaaataatttgatataaacttgactttagcattttaatctcagccaagataacactgtcattagagaaatgactataatttaatttataattataaattgatttattcataattgattcttgcctatccatatatctgttgcaaggcattctcagaattgtataatgttgctattatgtacaagctgtcaagcttttagaactaagaagagtttagtgtaggttaaaactaaaaacaatcataatgtttaaattcttgatcatttaataatcatcattttatgtaatatttcaagtttatctcatattacagtctaaaaccataaagaacatctttgtgtattcattccaggctttttggatgctttcacccaatagtgtggcttttctaagctatatttcctaaattatattttgtgcaacagagggtggtgggtggggcattcagcctgcagacattttcaacagaaaatccatcatttgcaacatcagctgtcagcacaggtgccctgaatccagcggtccacccagttctgtgaacggaaaaactgacacaggactatgaagcagttgtctgatatcatctgggcaggaaatggagaaggctgaactttgaactaatgctaataatttccaaatccttctaaaattagatgatggtttgggtatatataattgtgatggaggtatattcccttattacttatgtttggtatattttagataaaaatttaacagagagagagagagggagagagaaaacacaaattctaacacgcagcactttcatcccctttggccaagtatagtcataaaataaccttcaatggtgactctaccttaggtaaataaatttaactatatagagcagttaaaaatatgttatagtttaacaatgtatttccaattccaccagaaggggaaggccaaagatagtattaacagtaattgtttaattactttattacatcaccattactatgaatataaagaatttggtgtcttatgaatgaattaatgaactaaattatgaagattgctatttcaatgtcaaaagttaaaaagactttgtggctccatctttcctgagctttgtcgtgagatgtttactgattttgccaaaactccaactatatctgtttgtttagtcatagaaaatattacttcctctccatttttttttttttgcctaatttctctggacagaattaattactcagtcctctctgaactcctacactgcttgggcagtatctttattctggcctatgcactgagcataattaccatttatatgactctcgtttctagtctgtgacctccttgattttatagactgtttcttatttcttactggtccctggcattcaggtcattgcttgacgttaataaattccatgaagctcaatctagtttcacatatagtagtggttctcaaagtggatcctggtttcatctggattggaatcacctaggtgtttgctaaaagtagttttctgtgctcaacagcagatctacttaaacaaaatccctggggttgggcacaggactaacaaggactccaggtcattgtcatgcacagcaacatttttttggtaatagttttattgagaaataattcacattccatacaatccccccatttcatgtgccatcacagcatttttttttaaattttcacagagctgtgcaacaatcactgtaaatcaattttataacattcaattagccccaaaataaatacaggtcctttagcagtcattctccatatcccctaatgctaagcaaccactaagatattttctgtctgtatagatttagctatctggacatttcatataaatggactacaaaatatgaggtcttttgtgcctggcttctttcacttagcatgatgttttcaaggttcattcaaggttcatcagtgccttgttcctttttattgattctattgtgtgactatactacattttatctatccatttctcagctgatggttgccactctttggctattatgaataatgctgttataaatatttttgtatcatttttgtgtgaacacatttcatttcttttaggtaatatttacctagaagtagagtgtccaggtcatatagcaactcagttttatcttttaaggaactgccaaactgttttcctaagtagctgtagctgtacttaaaactgtagtgttaagtttccaattctctacatccttgccagcattttttattgtctatttttaaaattatagttatcctcatggatataaagtactatcttgctgtagttttgatttcactgatggctagtgatgttaaacatcttttaatatgcttgttggtcatttgtacatcttctagggagaaatatccattgaaatcttttgtccattttttgggttgtttgtgtttctattattgagttgtaagatttgcgtattgtagctacatgtcccttattagatacatgatttgcaaatatttattttcttccattctatgagttgtcttttcacttccttgaaggtatcctttgaagcacaaaatttttagtattaatgaagttcaatttttttttgctgctgtttgtgcttttgttggcttatctaagaaaccactgactaattcaaggtcataaagatttacagctgttttcgtttatgagttttgtagttctagctcttatgtgtaggtctctggtccattttgagtcaatttttgtcttcaacttcatttttttgcatgtggatatctggttgtttctgctccatttgttgaaaagactctctttttcccattgaattgtttgacccttgacaaaaatcaggtagccataatgtgtggcacaacaaaattttagaatatgtgtctattggaattgtgacctggacattataataagagtaaaaaggtaaaatcattaacttcagatagttttaatgattattagtcttgacatgtgtttgtaattccaaatttgatatgaagtgggtgttgtaagaattggaaatgctgaggtaagggttaatgggaagacttgtcttgtgctttacaatgtaaattattattattatttatactttaagttctgggatacatgtgcagaatgtgcaggtttgttacataggtatacatgtgccattgtggtttgcttttgctgcatccatcaacccatcatctacattaggtatttctcctaatggctatccctccccttgccccccatacaatgcaaattataaaatcaagaagcttacttggtaaaatggtcttatagcgatttttagttccatgacgcggaatatcaatttctttgggatccacaaagttcattggtatttcctgcaaaaataaataatatcaaattagtgtatctaatactgccacaaagaaaatcttcacaggggggcatctgatccagagttctattggacttcaaagccacttaaaaacaacagatctagcacctctggtggaccaacacccttcctttcctaaacatatcagctgcatccggacaagctgacttctaagaaacagctctgtgtgttagaaaatattgcttaatatgtagtcagtaaggagacatataacactggttagattttaagaatcctgctgtgacataattgctagaaagattagacagatgctaaaaagtgaatttttttaaaaaacaatgtattcaaatatattccagtttttacataactttagtaccaaaaattttactataatagattatcttttcacactaatagtgactcttttaggattattaaaacctctttcccaaaatggtaaatataaagggcttttttgttaattcaagtgatgacatgacttttttttgaattaagaaatggtttataactggactgttccattttaagttataaatgcactgtttttagtgaagggcattcaaacactgtttctcccacttaagaacattactattcttattttatcagagtatacattatatgcctcaagtgattggacagggaacaataggaaaagagtggctgtatgtaagtgcattagatctaaaaaggtgtgtatctgtagctaaccaggacaaataaagcaacaagccaaagttttcaaaagggtccaaacaaacatttgtttaaagatttgattatacaaaatagtatgttctctaactttgataagattaacatgaacaaaataacttttatgttatttaatgactgataaacattaaatatttgatcaaataagatatttttactacttaaactttctccagtagaaaatttaacttaacagtctaatattgattgaaatagaagaaatcatctttaaattcattcaaattatcctagttttcagtcattctgaaaatttgagaaaagctggactatactatgaatttgaggcttgttctacagagagaaacagctattcgtttattaattaatttatttttagagatgggatctcactctgtcacctaggtcagtgtgcagtggcacaatcatagctcactgtaacctcaaactcctgggctcaaggcatcctcccatctcagcttcctgagtagctgggattacaagcatgagccacaacacctggccccaagttacttatttttaaaataatttttcctttacctgcattatgctagctatccatgatatttatccctattctctgctccaactaaatgttttaacctgtttgttccaagttataaaaataagcaaaattgttgaatattcaatggaaaacacatgttcatgtttggtaatttcaagcacgtcagtgtctttgggcaaagccacaaaggtaatatctttattcctccccttcttccttctcaccttctgttttctgacacacactgacagtctgtcatcttccagcattctctttctcctgtgtactccttctggccttcaatttcctttcaggaaagtgggctatggtaaggtcttatttcataaacaaagagctgtctgcagttctagaaaaaaaaagctctaggtgtgcctttggctagctgtgtgaccactgacttgttctttcattcctacaggtctcattttcttcacatgtaaaatatgatacaccacagagtctgattttcatgtttgtattttactttggacacttaataatagttgatggggctaatagtagatccaacccattgctgaatctgtcaccattaggatggctgcaaatgcctgaactaataatcaatttattgtactcaaccaatacggcttaagatgcaagaggtgatcaacaaagtcaatattctccttgggcaacaattagacctaagaaggtttaatcttacttcatgttctctgagttgatgtatgttatcatgctttaagctttcactagcaacactggtatgtctaaaactgaattcatcattctttttagcccacacttggtcttcctcctgtgttccttatttcgttaaagggcaccatatgcaccctgttggccaaaccaaaaacacgaatatcaatccctgacttttccattacttttggctgcctcattcaattaatcccacttcttgtagattcctacagattctttccattttcccttctactatattagtttaggccaccaacgcagttccacaggattaacactagagcctctaaactgctcccttttagtgcctactccactgcaaatagaatgatctatccaaaacataagataaagtccaagctcctaaacatatattaaggctagggtttcttttatacttctgaggctcaacttttgccacttcccaccttgatttcaatgttccagttaaactgaacagtttaattccccagacagtgacagcaaggctattctttgtcctggaatgccccttctctgcccagctccctataccacttatttgcctcaccaattcttgcatattctgccttaatttagctctacattccaattttaatacttatcaatagtggatgagactgagtgaatctaaaaccatttcactttgccatttgtttactgtagactgcttaagtataggacagtatcatttccatacgtctctagtgccccatgtatcaaaataccgactgaagagtgaacaataaatagaaggctcaccatgaattcactttggagtaaatgtgaacttgccacgacgtccctcagctgagaccttgtgagaattcggctggctgactgcagatactccattgctaccttctcccgtggtgttggtatagacacaaagggttcaatgttccccaagctactcatgtccaatgtaagagatacgttggaccctcttctacattggagaagaatgttatgtttaaacaccacatacttattttgattgcaaaaacttgtctttctgtacatgcacacaattcagtgagaacttttacagaaataacaaccaactatattttctcttttagtatcatggttggccatagcaactacccatagttccttcacaggaaaataacaattttgttgttggaaagaactctaaattgagaaaatatgctataatttatgaatgcatatacttattacagaaatcataggttggctaataatattaagtgaaaaattaagtaaaaaaaaattaggaaaagctatatctatatctatatcttctgagtgaatccctaaaaaatggcttctggggccagatgaggtagttcatgactgcaatcccagcactttgggaggctgaggtgggtggattgcctgagttcaggagttcaagaccaacctgggcaacatggtaaaaccctgtctctacaaaacatacaaaaagtagctggatgtggtgacccacacttgtagtctcagctactagggaggctgaggtgagagaatcatttgagcccggggggttgaggctgcagtgagccgtgatggtgccactgtactccagcctgggcagcagagagagaccttggctctaaaataaataaataaaacaatagataaaaataaaaaaagatggcttctgtatcctctatttatgtgtatatgtatgcacgcatatgtgaattgacacacgaattcatttaattttgtggtaaacttataaggggccatagaaatcacagacccttaaaatgagttacaatttatcttcctctcataattccccttttcccgctggggggcaaggggatgctcttacaacttacacagaccctgagtcctgagtaggaagtgaggatgccttttacaagtaatattagctgtgtggaccaaggggtaactatgaaatagcatgtgagagactgaggattgaagtcagagatggtgtttacaaaaactgttacatttaaaggggccgtaggtgtgtgtcagatcaaatatagtgccaagcagttggcggctcaaggaagtagagagcagggaaaaacaggccaaaatatgtgagagtaaagacagtaagagtagatgctaggcccagcaaattattccctctggtattttaatacttactctggaatgcgacattaagaaatattacagtggcttgagcttaatttcaaacagtggaaaattattggaatatacaacaacaacaacaaaatccattaacgaaaatctatcagttttcttctctgatgaatctgcctctggttgcatttttgttgtcattctataatttgatatgtaatgtcatttttgttaatttctaaatggtttgtaattgagattttaatttctactttaatttgatggatatctgtaagtttagacatttattttccttataatttctagttatagttgtggaaattagagaatggctggccttttaatggttgaaactacttgattttttttcgagataaacactacatcattttctaaatatttcacagatgttttgctggcatctagtttgattatctgtatatgttcataagtatctatctgcacatatatacatatatatcaccttatttattataccattattttattgaagatattactttattccaacctattctttccttcctttttttttttctactggatttgtcaaagcctgagatatgtatgtgagtcttccacaataattatgcttgttatttttccttctaacagtttttaccttgtacattgcagccattgtgttatttgaagggatttagtcatatcttcactataaatgttaccaatattactttctttcctgttaattttatatttgccctcacatctggctttaaaaaatgaatattgatatgcctatatgttttggggggtatgtttctgaaaactttttctcatcctattattcttcttaactcttttggatcactgggttagggattagggaatagcatttattctagatgctcataaaatcctgcctacctaatagagggatatttttcccactccactttttcttatttggtttttggtggtggttgatagggttcctgtgcttctgagtaggaggcaaatagttgaagaagagcaaagaatggttctactcatggaccaagaatttaatctatttttagtgggaaagtagtttttaaagtttttcagttcagttctggacttcaaattgatagaaaatccttacggattctgataatagtttgccgattggtcttaatatttagggcatttgtgagaattcagcttttgcaagctttatagatattttagtatgaaggtgagagaggccgcttaagggatggctagtcctatgccctttaaaatcaccatgccattcagtcaaattttcagcctcaagagacaaaattgtctgccctctgtcaatggagtgatgcttgtgctatagatggtgagatctcttccatctggagtggtcagagcagattcatgaggtagaagtcatttaagttgggctttgaaagcaaacgtttaataggtgagtttttggtctagagttaaagaatctggtaggaaaaaaagtgtaggagaataaattaatacaactttgaagaacagcatagaagcagtttgagctagagttctcttgtataaaaatgtattttgaaattggggagcaggcttatgtaagagagatgagagagaagcaacagtcatagacactataagactataaaaagcccaaaaatagtccagggatgttggctgacatctgtaatcccagcactttgggagactgaggcaggaggatcacttgaggccaggagtttgagactggcttgggcaacatagcaagaccctgtctctacaaaaaataaaatagctaagtgttgtggtgcttgcctgtagtctcagctattcgggaggatgaggccggaagattgcttgagcccaggagttcgaggctgcagtgaggtaagattgcaccactgtcgtactccaggttgggtgacagagtgagaccccatgtcaaaaataaataaataaataaatacataaataacgaaaaaaaaagccagataaaagaggatccagaacatcatcagggtgtattaatttctgttttgacttcccacagtatacgctgcctaaacctgggagattagaagcctttgacatcccgtgtctaaggtctatttgatttaatgagttaattttctaaggattctgtggtaagcagagagctgtggaagcattttcatgctaactgacttaaataataaccatttatatattacagtcagaaagacatttcaaaaacaagataaacatataaacttatgggaaaattctaattaagacgtataaaaaaattgacagaatttagaaaaaaaatcaacataaataataggagaactatacctttaataaaaaaggaatgtggaaagcaagaaaacgaactctactgaaagctttacttttattttgtcttggaactgtgggcaaactgtttagcctttttaatgcctcatgattgctgttggacaaaagggaacataataaaaagctttatcaagctcctgctgcagcaccaattattatttatgccaaaaaataaataagagggaggaaattcaaaagataccaatgcaaacaattgaaggaaaaagcaaattcttagggaaaggtaaaaggaatgcaataaacagcatgctaattataattaactaaaaaggaaaatatgtataaatattatgggccagggcgacacatccatttcagcaagagaatataaacaactttgggtcaaaattgttcaattctaatgacatcagtttctaatgacttagaggtgggaagaaaacgtagctaaaaatacagtaacattacaactgagtgttggaataactcagaaaccaggcatttattttcccggtagttggggaccataatgctagattttagaagctgaatttaggaagaaagggctaaaatttctagtatcatgtctacgggctctaattctcagacatgctactttttttgcagtactttggtcactgagaacagtgagacttcaagcagtatacctcatttagcaaccaataaagaatggaaatggaagaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtgaaaagtatatataatttgtctggagttgtcttcattagtgtacacgtcaaatcttatgtggtgagaagcaagaactttaatgttgatgttgtcttcagaactgaaaatgtgatcttgaatcctttagtccaactattcatccttgtgtgttacagtggccatgaatctgacaatcttggcttgatcataaaaggtgaccttaaaccctctcacccacaacttatttaattttgcacatacaatttttctacatagttttctagaataactctacttaaacagaatgaaaaaggaaaaaaaaaacaagtttttgctcatttgaataacaaaggagacaaaagtggagaaatggagagatggaattcttttactttgtgtggactgagtggcataggcagtttttgcaactcccaattctatgacttttaagttccgaggttaatggcatttaataatgttatgctgtttccatctctttatcttccagtaaattatacatagtaccaaccctctttctggatcacttgaaagatgataggataaaacagaaataaacacggaccactaggaaagttaaattgtgacataaatggagtgttaccaatttcgagaactgaaataaatgagtaggtattgtgaccattcataataaaatttcccaaaggaaatcctgaagggaagaaataataataaatataaaagatgccaggcatgaacccaggaagatgatatatgaatttcaccctaaagtaaaaagaaaatcttttaacatagagaacatttttagtgtaggaaatgatccattttcctacctgaaaggacctacacctcactaggtagaatgttgctatgccttttgattgaatctataaaagttttgaattcataaaaagatgtctgaccttttatatgtgtataggacaaggcaaaatttactacacccttattttacaaaaaaaattcaaaacaatcatttaaaagaaccagatacattgaacttgtcacattactcttgaaatattgaccttggaaaatgcgttcaatcattgttctgcatttcgcttaagcaacttggaccttagactgcataatctgcaaatgggaataataataaaactcacaaaattgactcacaccataaaagataaataagcaagaatatgtgaatacttccaccctaatgtctgggatataataaacatatatgaattattatcataattaataataacatggtgatttttgcttcactctctatttacacagctatgtgggagctacatgagtacacactgatgaacatttgagggaggtaaagttgagaaaattggttagtgattaagagttagcagcagtatcacacatgcaaaatcaatggtcgtctaagttgggactatttttcatacttcaagtccttaacatttatacctaatgtctttaaagttaacaatgttttcatgattcaaaaataatgcatgttaactaaagctaaaaatagagattttacaaatttcataatacccatatttagagtaactgctaagaacattttttgtgtatgtccttcaagtccttatatgtatgacaaaaatctagatttttattcaatatattcttttatgatttacttttaaaaaaaggaagtaggcacagaaccattgcatatgatttactttttaaaaaaactatatcatgaatgtcttttcatgtcctcaaatttttttaaacactgttttcaaacatttgatagtatcccattattgagatgtgtcatagttatttaaccaatactttatttttggacattgagtcattttcaattttttcaccattataaacaaaactgtaatgaacatccttgtacttcaatgtttgtgcatttccctaattacttttcagtcaagaagtcttaaaaactaactcaaaatctcttgagtttggagaagtcagtgggcactcgcagtgtggaagaggcatgaagacagactcttggagctcgctgatattgatgtagctcaaactctcttcctctttggttcagacctttgcagttgttccttagcaaggcttcctaactctaaaatctcctagttcagtagattttttccagatttcactggaatatctgagcactgaaaatatgataaaacctgcaagtagctacccttttgacgtaagatgcttcctaatctatctactgtgtatttctccatcctcatctcctgtcacattctcatccggacctgtgtcccaggcagacaatctacctgcagttctgttctctatgcctcaaatgtgcttgccccaacactttcaggttcaatcctccaaatgccaggggctctttcctctgagacttcctagcaattttcccaatatgtatccaatatatatcatattcactagaaatgatttgcagtaaagtgtgaacacattgaggccaaagactttgacttgagttctcctgttgtacccagtcatgaacagatggagagcaacacttttggcatctgcgtggatgaatagttgcaaatgaattggttagggggatgctatatgtaattactgtgctttgacggtttttccagtcctctgaaaatacaggaattggggggactatattaaacaggagtctgaaaatttggagtgtagaagccaagcttacataggtaaatgttacagttgtgattcagtttgaatcttgtttaagcatcaataaagtctgagcattaacatcctaaagttacatcctatgttaattttattcagaaaaaggaagaaaatgtactgctttgttttgtaaccaaggatgattaatttttactccttttttttttgtcatttggtattgttttgactgtcattcatggtgaggaggctgtttccctttcaacaaaataacaaaatgatagtagttctatttttagttcctaagttaatttttcctagtttatataattatttaagaaaaagatgctaaaaaaattaataaatctcaatgactaagccattccttgtgaaatgagaagtcttctttgaatttcagctgatttaaatataaatacaaatacaaacacacacacacacacacacacacacacacggcattttctaagtagcacaatacaatgaataacctcctgtctctttatgcaatcaactaccaaagaacccttttaatcctgatcattacaaataaattaaatatattcatttatttgtaaggccagaaatgacacctattgtcctgataccaaaacctggcagagattcaataaaaaaagaaaacttctggccagtatccttgatgaacattgatacactaatcctcaataaaatactggcaaacgaaatccagcagcacatcaaaaagcttacccactgtgatcaagtaggctttatcctgggatgcaaggttggttcaacatatacaaatcaataaatgtaattcatcacataagcagaactaaagacaaaatcacatgaccatctcaatagatacagaaaagaataaaattcaacatccattcatgttaaaaactcttaataaactaggtactaaaggagcatacctcaaaatactaagagccatatatgacaaacccacagtcaacatcatacttgaatgggcaaaagccggaagcattccccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagcgaataaacaacttcagcaaagtttcaggatacaaaatcaatgtgcaatgtgcaaaaatcactagcattcttgtacaccaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactacccaaaatgatttatagattcaatgatggcacttaatattaattaagccaagtttgtaagaaatggcttacctgaattatctcatttaactgttacaacaatttttgagaaagactattcacagaactagaaaaactattttaaaattcatatggaaccaaaaaggagcccaaatagccaagacaatcctgagcaaaaagaacaaagctggaggcatcatgctacctgacttcaaactatactacagggctacagtaaccaaaacagcatagtactgggacaaaaacagacacggagaccaatggaacagaatagagatgccagaaataaggctgcacgtctacaactatttgatcttcaacaaatctgacaaaaacaagcaatgggaaagtattccctattcagtaaatggtgctgggagaactgactagccatatgcagaaaattaaaactggactccttccttatatcatatacaaaaattaactcaagatggcttaaacgcttaaatgtaaaaacccaaactataaaaatcctttaagaaaatccagacaataccattcaagccataggcaaggacataggcatttcatgatgaagatgtcaaaaatgatttcaacaaaaggaaaaattgacaaatgggatttaattaaaccaaagagcttctgcacagcaaaagaaactatcaacagagtataacagacaacctacagaatgggggaaaatttttgccaactctgcatcagacaaaggtctaatatccagcatctataaggaaccttaacaaatttacaagaaaaaaaatctcattaaaaggtgatcaaaggacaggaacagacacttcccaaaagaagatataggtgcagtcaacaatcatatgaaaaaaatctcaacatcactgataattagagaaacgcaaatcaaaaccataatgagataccctctcacaccagttagaatggctactattaaaaagtcaaaaaatgacatatgctggcaaggttgtggagaaaaaggaatgcttatacactgttggtgggagtgtaaattaattcaaccattgtgaaagacacggtggcaattccttaaagacctatagacagaaatatcattcgacccagcaatcccatatacccaaaggaatataaattgctctattataaagacacattcacacatatgttcattgcagcgctattcacaacagcaaagacacggaatcaacataaatgcccagtaatgatggactggataaagaaaatgtgctacatatacaccatgtaatactatgcagccataaaaaaagaacgagattatgtcctttgcagggacatggatgggtctggaggccattagccttagcaaactaacacaggaacagaaaatcaaacactgtatattctcccttataagtgggtgctaaatgatgagaacacatggatatgtagaggggaaaaacacacactggagcctattggagggtagagagtgggaggaggaagaggatcaggaaaaataactaaggggtagtaggattatttagtatatttatatttagtatatttatttatatttaggggtagtaggataactaaggggtagtaggtattaacctgggtgatgaaataatgtatacaacaaacccccatgacacaagtttatctacgtaacaaacctgcacatgtacccctgaacttaacatagaagtcaaaaaagagccctttattttaattccaaatccttaaatttgtttttagtcattggaaagaaacatttataaagttaagtattcacaaagaaaatttttacatttatgccaaggattatgtatttttaaaagtaccctttaatatctatctgaaagattctagattccatctcagtcatttgatataaaaagcagatatcttaagtcattaagcagggtacatcaaggtctgcctttacctaaaatgaactctcaatcaaaattatgaaaatctactctctccagagtttctccaaatgtttacccaagaacagtaagttatttaaatatacatctctgtgtttgttcagtgttcatttaaaagtgtaccacccgccatgtaatcgtgggctttggtcagttaggtgctttgcaaataaaccaggatgacctttgctccctacaagtcactggcctttcaccttggaatttcagagtagggagtggcttctttttggccagtggagagtcaatgactttgctgggttactctgtggccacagattatatttaaagtatcatcagtcttcaggtggaaggaaggaaggcgccaattacctggaagggctgtgttagaattaaatgaagagaatgcacttgatttgatcaccgtgatcagattcttgccagtataaatacacaatcatgttatcggtgatgcctagtacatggatgaatgcctaaatataaattatttaacacagttgccaatagttaaaataaacctctccccataagtaactgggatttgttgatttgatgccattcataataattcatttttttctgggtccttcctcatccagtgtcagataaaataattgcaagataaccctgaaaatcaaatagccattcactcaagtgcagatattaggcataccagatgaagtaaagagtttttatttttgatactgtgttttattatctatattatgtccaaggagcagatagactggtaaaaaataagtatttctggaatgcaaaatatacacattttagagtgaactgaaatttgtcacgtaaaggacgtttttatgcttgctataagaaatatatccctttgcttttccagaaataaaaatgttctaaattagcatgctttaaccaaatcaaacaaaatgaaaaaatgcccagaagcaattcccaaccaattttatataatattaatgagtaatatttatgatagaaaactaaagttatatatactccctcctcttttttattgagatcaacttatgtacaataaaattcacatttccaaagtgtaaaattcaatggtttttattatagtcacttagttgtataagcatcactacaataaattttaaagcattttcctcactccccccaaaaaaattctccctgctcactggcagttactctgtatttctctctctctccaggctctagaaaccactaatatacatgctgtgtctgtagatttacctgctttggacatttcgtataaatggaatcatacaacgtatggcctcttgtgtcttgtctgacttcttttacgtagcataaatgttttcacggttcatccatgttgtagcatctatcagtactacattccttttcatggcacaatatagtccattgtatggatacacccacattttgtgtattcattcatcagttgatagacatttgggttgtttctacttttggctagtatgaattattttgctacgaacatttgtgtttaagttttgcatgaacatatgttttcatttcttttgggtatacacctaggaatggaatttctgggttatatggtaactacatttaactttttgagaaactaccaaattcttttccaaagtggctgtaccattttatgtttccatctgcaatgtctgagatttccaatttctccacattcttgctaatacttgctgctgcctttttttttttttaataatagccatcctagtaggtgtgaagtgtatctcattgtggctttggttacatttccctaatgactgacaatgttgagcatgttttctttggcttactggacatttatatatattctgtggataaatgcctaatgaaatccttggcccatttttaatttgggttgtctttttattttgcgttgtaaaattatgtatatattctggacactagacccttattacatatatgccttcccattctatgaattgtcttttcactttctgatagtatttgtgatgattaattttatatgtcaagttgagtgggccatggtttgcctgggtatttggtcaaaccttattgtgggtgtttctctgagcgtgttttggatgagagcaacatttacattggaagacggagtgaagcagagcaaccctcctaatgtagtaggtcttatcccatcagttatggagacacagcatagattaaaagtgaagttttggcactaagttattctgaagtagatacctgaaggtatctctgtggtcttcatgactgtgtctgcctacattattattcaaataatgtggttactgttctagtctcacttcattttatattgaatagacatatctatgatataaatatctattaattcaaagaaaacaatatcttgttttaattattaaaatgttaatttaattataaaattaatacatacttatactaaagttttcaaataatgcagaaggaagcaaatgaaaaagaaagccctcttcccctagttcttcccgcctcctgattttctggctctgcttctcacagctcaccacaatttgggttatgtacccttctttcaattgcccacgcacttacaaagacaaatataaattggatcataaaatttcatatagttttgcaactttttccctactttacattatatattggaaaatttgtcttattagaacaacaatgtggatttcataattaaatgcacaattatatatatatgttaatagatatttatttccaattctttttgctattaccaacaatgttgccatggaaagtcttctactgtatatttgtttattcatgcaaatgtatctgtacgaacataatataagtttctcctatagaccaggtgcagtggctctcacctttactcccagcactttgggaggctgaggcgggcagattgcatgagcccaggagtttgagaccagccaagggaacatggcaaaagcccatctctacaaaaaatacaaaaattcgctgggcatggtggtgtgttcctgtagttccagccacctgggaggctgagtgggaagatcgctggagcctagggaggttgaggctacagtgagccgtgatcacgctactgcactccagccttggtgacagagtgagaccctgtctccaaaaaaagtttcttctatatattgagtatgccaaaataattttttttttgttatttaagacattacgatatcagggaacctgccccgatagtcatgtaggttcttttctattttccctaagcatcggctggtttgagaaataaagggacagagtacaaaagagagaaattttaaagctgggcgtccgggggagatatcacatgtcagtaggttctgtgatgccccacaagccgtaaaaccagcaagtttttattagggagtttcaaaaggggagggagtatacgaacagggtatgggtcacagacatcaagtacttcacaaggtaatagaatatcacaaggcaaatggaggcagggtgaaatcacgagaccacaggactacaggaccggggcaaagttaaaattgctaatgaagtttccggcaccattgtcattgataacatcttatcaggagacagggttttgagagcaaccggtctgaccaaaatttattaggtgggaatttcttcttcccaataagcctgggagcgctatgcaagactggggtctatttcacccctacagtctacagaccataacagatggccacgcccaggggggccagttcagagacccacccccaggcgcgtattctctttcccagggatgttccttgctgagaaaaagaattcagcgatatttctcccatttgcttttgaaagaagagaaatatggctctgctccgcccggctcactggtggtcagagtttaaggttctctgtcttgttccctgaacattgctgttttcctgttctttcttcaaggtgcccagatttcatattgttcaaacacaggtactctacaatttgtgcagttaatgcaattatcatagggtcctgaggcgacatacatccttctcagctgacaggattaagagattaaagtaaagacaggcataggaaatcacaagggtattgattggggaagtgataagtgtccatgaaatctttacaatttatgtttagagattgcagtaaagacaggcataagaaattataaaagtattaatttgggggactaataaatgtccatgaaatcttcacaatccaggttcttctgccaaggcttcagccggtccctccgtttggggtccctgacttcccgcaaccttacataaagcagcctctttacctcttttatctatcagcttctaagtgtttataacaggataaaatcattaaaatactggaattctagacatgctagaaaacactcagattgggtccactatatatgtactctaactttatctcccatttttgggtagaattgttaataattttcaatttttttctattgtctgtcttctaagtaaaaaaaaaaaaaaagtttgcctctaatgaaatttatgtatttgtaaattatatacatgtactattatacttatgtattatgcaaattatgaaatatttacaaaatttgaagtaggaaagggcaagataaatgtactttttttgtaatatatatgttttacaccctaatggatcattttacacatttcttgggatgcacatgccccactttgagaccactctctcaattatctagacttacataggtaatggtaacttttttcagccactttggatatacaagacagtaagcacctaggacctatggtatctaccatatcagctacaagtactattcatcaaagattatttaaaatagcattttgctgggcgtggtggctcatggctgtaataccagctacttggaaggctgaggcaggaaggatcacttgagcccaggagttcaaggctgcagtgagctataattgtgccactgcactctagcctggggacagaacaagtccctgtcccataaaataaaatcattttgtgtatcacagaagacacttcagtcttccctatagatatgcaactggtaatcattaagttctcactgcaagaatatatcatccaaatcactactataaccataaagacaaaattaaaatgttctaaacttactatattcaacatttctctcaggcagatggcagtgaagaatatgtaaaaacagacttttaaacaacggctacaagaatattctttgtttctctaacatactattcttcctcaggtattgttttatgagttaattcattatttcttttcatcagagatcttttaatataaaaatcataatatttatctggacaactcttaatttctgatactcaataatgacatttttattatatctccaatatatgtttctgtgaatgacataataatgaacacagaaaatctttaaaaacattgagcactaacattcttttcaaataaagagagagtgttaggtgagaataacttctgataccagctaactctgtcatcttagcatattaagctgtcctaagctataccagtgacatttcattctgaaaatgatcatttctgatgaaaatgaactcaagaaatacacaaatgagtctaagtactgaaagactctaacaaaggattacaagggatagggtcaccaaattgagcaaacacaagcacaagactcgccccagttagattttgaaaaatagctctatcacatttttgtaatttaatgaaaaaatgcttagtacaggacatgcagcacatcctgacaaagtcaatacaagacacaggacaaaattgttaaatacagaacatgtcccatatctacagaatgcctggctaacctaacaagatggaacacaattgacctaattttaatttcttccatgcatccgggcatttcctgtgtgcatggcagggatttgtaggtgtgaaaaggaaaataagaatgaaatacaaaggagtttccaaactgactagaaatgaattatttcttctgtttatcataatgttttgcattgattccaaaggaaaaaaaatagtatttgcttttattacatattaaacaattatcatataaaacctgataattggtcagtaattttcctgtaataatgcttattgatttctggcatgaataggcatctatgctaagaaaagaaaaatacaatcttctttttaaaaatactatacagccatggtatttgaaaagtctctcaaatactaactgtctgaatcaggataaaatgacttttagaaaacccattactttgatttaaatgttatattttttatagaattggaattgcttcttgtctgccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcctcagcctcccgagtagctgggattacaggcgtgtgccaccatgctcagctaattttttgtatttttagtagagacggggtttcaccatgatggctgggctggtctcaaactcctgacctcgtgatccgcctgcctagcctcccaaaatgctgggattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttacaaaacaaggattcaattataatggggaaatactagaagaatacataaatttacagattgaaacatatttataccattttgcacatgcttgaaatattgtgtaaaacaatttgaagataagtcctttggacttttttgctttcgtatgtctgaattatcaatacgcacattttccaccaataattctccatgtcagatgaggacattcggagaagtgtgaatgagataaaaacgaggtgcttaagacattctgttcaaacggatagagttcatttactgaatactcctgaccggttcctggagttcagatccacacctaacaaattcccaaagttcttcagacctcagcaagtcaaaatacgctacggaaatcatttttgacaagaactctcgggctaagctttaagtaatcagtatctggttaggacaggaatcacccagtatcctgtggaggaaaacagccgacatgaaggccatttcagctttccctcttctaatcatgctttctaacctactgccaattcgctcctaggctgtcctcgataaggcatgccgtaggattacgggaacccaaagttcacgaatgcaaacttcacgaggctgcccggccccatcctttccagaagatcatatctacagcaaaacggtgctttatcctagaaatcccttttcaatccaaatcctaatggaactccttgacaaccccttgactaaattacattagtaatatagttcctaacaatttcctttgttaggaaggggagcaaaagggcaaaaaaaaaaatcatttttttaaaaaaataatgaaaattgcaaaggcttaaatactgaaagaattgcttgcctctacaacaaatctgtatcattactaacaagcgataaaaggccttccgatggataccaaatgagaaccttccagagggccacgggcgcccagctggaaacccctgctaagagcatctgcagtctgaacccacagtgactgcgcgtcttctctggatgccattaacagacctctgcgaagggaggcttcggctgctccacgtcagctttaggattggtacgtggccctttctttgtttatctgatttgcctttaaatcttacaatggcaacaagtgtctcaagtaggattgttgaggacagagaaacaatgctcaaatgtcctttgaacaaaaccaagagcccaccctgccgacgaccctgaaacctctcctgtctgtaagtggcgcacaagcgccacctggagggtgcaaggcgcaaccatcgctcttctcaaagtggaattggtctgtgttaggctgaagagattattttattttaaaatgcttccattcctccactgaaaaaatttaatatagtctaattatgaatatggagaaggtggaaaaagaaaaatcctcgggtgccttagtcattaggggaagcaggaaatagaaacaagcgtgagatctgggggcacattacctgggctcgaatcctatctctgcagtaatgtactctgcgaccatggaaatgtgcttgaatgcctgtgtctccgtttccttatcattaaatttgagatgatataatttacccacctgaggtggatatgaggaggaaatgattttatatatctgtgatgcatcttgtacagtacctggcatatagcaactgctccacaaatgttaggtataggcatagacttaccaagtcttttccagttttttcctctctatgtagaggtattgctctgttaccctggtaattttttttttttttttttttgagacagggtcttgctctgtcgcccaggctggagtgcagttgcatgacctcagctcactgcaacctccaactcccgggttcaagcgattctcctgcctcagtctccagagtagctggctaatttttgtatttttagtagagacagggtttctccatgttgcccaggctggtcttgaactggtctcaagtgatcccccaggcttggcctcccaaattgctaggacttacaggcgtgagccaccacacctggctcaggtacatttttcttattggtactaccactaggccctaggatattatcctatatttgaatatgcttgatacataatcttatttcaccccactccctcatcttcgactccaataactttttctatttggtttcagattaaagctcagatttggttcttcactgaatagggtttgcctatatagaggtgctccttaacagcactgctttctagtataagcatgtcaacacaggtttagttatttaaaatgcatatcttatataaaccagataatccacaaaaacactcgtgccatattcccctaaaagaaatgtgttgcaggcatatacccattgttacttctcttgcttggaagtcctgcaaaagctcttacttacacatggtactgccaaatatcctaaagttctccagttagaaataggttagaaatataccgaggagttagaaatatactgaggagaaccaagagaacagttttgattagagtctgagtcagtcaacattgcacatatataaaacttctgtctaagaataggtaatttatctatcctggcagagcatttcatgaggggcaccgctattgtgaataacaatggacagccacctcccttgggcacaaccctttcctcggctgatggaacagcaggtggaaagaagagcaggcacacggtggatagctcctgtccaaatagattatcacacaaatcaaaaggtggactattgtgggggaggaattataaaatatatttcaacacattttaggtatttggcaggattctgtttgggttcaccatcagctttcttatagggccttggcaaatgcagtttccctgactgcttagaaatatttatgatcttgggcttttttctactaggcaaaactggaattatgaattctgcacagtataggattcataacaccgcaaacttttctagcccgtttaatctttatttcacaggcctagcttttctatggaagataccgtagtgaacaaataaacaaagtggattgaaattcgccctgctaatatatccaggaaaggaatcgttgggaggatagttggatgattattggaactggcaggtcagtgagggcagcagactctcaaagagcatgaacatgctgaccaattcattagagactctacagcccaaattgaccccaatttaaaatgtatccaaattttggcatgggaagtattgtattaagaaataagaacaaactagcagagtttgttttcaaaatgagggaggcatagatgaaaaatggctaaaggcttttttaccctttgaaaaatctgtcccggctatgcgccccccgtggacgcttcctttcccacccactcctttcctgctttcttactaccagaacccagggtccttttaggtcttgtgcctaggacttgcaaatgcctcgggtgaataagaatgcttttcctgtgtaagagcacaagacattttaggaacaggaaaagcctatccggtccaacatacctgccctttttaggtttatctaaatcccaccttcctgcattgttaccttccttcatcttcctatatagagataacatttcttgtatgtttctcatgatctctcctgtcactagacctgataaaattagacctatattttagtaccactctcgttaaaacaaatgatttctgaaaagagttcgcaaggctagtaaacagtttgtaatttttcttttttaagagtcataaaccatgagtttgaaagaggagactccaaagaagcttgacttggagggacgcggaggtcatccggcttgactttgtgcttagcttttatttatgagttatcttatttgccagaatctgggtaccaacattttctctcagagtgttcagtgacgagggatatgtttatttgggataagactcattatgaagaaaatatgcaggtggctaaagattaattacaagcagcagaggcctgttaaaaagcttaacattctctgagcccttccttgccccctgtttcacagttcatatctggaatttacaatagagtgaggtaagccacccgccgtcataaagaaggtgagatatttattgaacagatgtttcattactcaagaaaattcacattttcaagtaaaaagccaaaagatgggccttccacccaagtccctgaaaaagattcttggcagcatttatatttagtgcctacaagttttacgcactgagtttttactgtttagatgtgcgggtcaacaaatcactgagaagacaccaaaactgtctgccagatgtcgaccactgattaatttgtcttaagttcagccaaaagggaagaaaatatgatgggtggagcatgaacagcaagcacaatcaacatctgaccaaccagggtttcctgtcaccttgggaacaaaattgattggcactggtttcctgtgtacaagttaaaaaccagtagcaactgcagtaacaagaataaactacagataagagacttggaaattaaatcaaggcacatcaccaaaatttcagcttgcaaccctaagcagaaaagttccaagagaactttttgagggcttttttttttccccttttaagctattttgtatgtaaacttaatttttctaattttgccacttctggcaatctgaaatcattaaaaaggacacaattcaaatttatgttagaggtcataaattttgcccaggactcaatattttctcatttttccaaagataaaatcttatttatgcattatagcgacttggttttcactttatcttgaattatagcttttaagaggcagaaagaatcctttttataaggacagtctcaagtgtacacacagattaaatattacaaatataggttgcaaataaaactttcaaaatgtgggattataggaagcaaaagagaaccaaccaaagcatcaacaaatttacctttttgttttttttaaagatttttcttatttccttagctgcttttgcattagcattaaataacattcttattggagtggtatgtgcatggcccaactcaattttatttgcttttagtgtgaatctgaagttttattttttattgctttattcatttatttacagaaacttgttaagcacctaaatatgtagaggcatgtctataaattaaggagcatggcaatttgctctttatttttaaaaattcacagtgagagactccccaaaattagacaaacacacaaaaaaagatacagatttttgaggaagaatgaaataggagagcaaaatgtttgcaaaatatgctttctttgatagtctaagttggaagttgtaaaaaatgaccattttggttataagaggttttttaagttacttcatatcctttcattctattcttccaatttcagaatcacttccaaaatgtattcattcattttataagtgtatataaattgcaaaatactcctcatactgaattttagaattcatgctacttctgctgtcactaccagtatagtggttaagagtggattatggagccagactgccgggggttcaaattcaggttctaccctttaagactgtgtcaccttgggcaacttaacctgtatgtgcccagttttctcatctgtaaaatggggatacaacttgtgcacgtgcttcactggaattctatgaggcttaattgagataatatgtgtgaaacacaacagggcttgataacgtaataaatgcaacagtgtaactcttaactggtattattaatgttttttattactactgcactgctattgctgctgtttctgctaccaagacaccttcagtgctactgctacccttgttgcagcttcctctgtgtttctggccattgtagtgatatattctcaggttgttgctattactgacccctattggtagttaccactgctactgctactgttacaagtagtgttggtgcgtgctcctgctgcaattgctatcattgctgttactattattagcagttactagaggtgtagtgtgtgtatatatatgtatgtgtatgtaagtctggatatatatatatacacacacacacacatatatatatttatataatgttaatggtggctattttggtggtgcaactggctaggaaataatctttatttttgtttttgcttaaatatgctttcaaaatttctataagatgtgttatttgcacagttcatttaaaattaaaaatattaataagggctggagaaatattgaaatctcatattcgtcaatattttgtactgcctcatggcctattccaccttcctgagaaagaaagggtgttgagtgcaccctgccccggtatgagaagggcatcttatattatatcctcctattataaaataagcatgaagagacagggctgggagacatgatttatttgccatctagctatgtactaagagcatacgagacattcagtcactgactgattttgttatttttatctcatgtcaaaattttcctcacttatctttatgtttaagaagaaatatttttgataagaggagagatttttgtatgttttagccaaactattctcaggagaatgcccttgggttggcccatagctcaattgtgaacaattaccctgacattatcctgaaaacaatcccacaagttctactaagaataaataaagcacaatagaataaaattatccaccaaatctaggaaaagcagctatattttagccaggaaatagaagtccccccacctccccaatgtattaagttcttgtacttctgtcagcaaagaatttagcacatggaaaaattcagattctccagttattgatttggggactgattattagggggaaaaagtaccgagagccaacttaggtgagttgttgtaccctgacaattgtccttgtggtacaaatggttttaatagaacagagaaaatgggggaaaagaattaaaaaaaattagaattggttatttctttagagtaatggtaaaacatcccttagtctatttattttttacctttaccaagtgttacaaaattttaaacgtcaaagagttaaatatctggctctctgagacatacaggccaatatttctagactctgtcaaattctaggatgaatgcacagccctggttgaaggtaaattcaatgatgtgtctctcttcgctaaggagggacattactgcgcctgttgaaccctaaatagtaaaatcattgtcaatactattgcttataatgtacacatcatagatagatgatgatcacaagtgatatttttcaacatcttctttgtatgacattacccagaagatccaagctaaaacccagtaaagaatgatgctttttttttttgcagtctgctttatgtttttgcaaaacattttacattacacttgtaaaatatatacatatgtatatattttagtcaacttaattcaagaaaattatacaaaaaatctaatttaatgcaacaaaaacctatcatatgcccagtttttagggcaaaatcaggcttaaaatttgggtagaaatttaaggccctagaaatgtatgtacagtggttgacaatttggggtctggagccaggccacctgtattctatatttattgcacacctctcatggccaattggatgcccttgagcaagtgacataacctcctgcagccatggttttcctttctgtaaaatggggaaaataatgatagggtagttttgactcttatgagttatacatgtaaagtatttataacagtgcctggaatgtagtaagtgcttgataaatgttatctgttatcagtatcatcatgggatagtctgcatttaatttttttttttttttttgagacagagtctcactctgtcacctaggctggagtgcagtggcgtgatcatagctcactgcaacctccacctcctgagttcaaacgattcttacatctcagcctcccaagtagctgggattacaggtgtatgccattatgccaggcttatttttgtatttttagtagagatgagattacaccatgtctctgctaaaaggtcttgaacacctggcctcaagtgattcaccagcctcgacctcccagagtgctgggattacaggcatgagccaccacgcctggctgcatttacaaaatgcatttcttcctacttattcccatttttttctctccaatatttctaagatttgtatatttacgcaggggatggctaggggagagaagggggaaagtggaataagcttttggaatttggaagaaagaacatgtatgttaaaattcctatctagtattaaacataagtcacatattcattattgtgtatttgatcatgtacagcatatattgtcagacttcggtatcgtggaagaagaaatcttgaaattgtctcacaaattttaagggttttgtgctgtcatggaaggatcctaattggatggaactaagttttggttcctagtcccgatttttttttttctctctcagcaaaataaaacactcaggcacttattaattcaaatgtcctcatggacagaggtttttgctaaacaactattgctttctctgggaaactatagtagtttccagaaaagggattgattgaagaccttaattataaagataaggtaaaacacagcctttaaaatgggttataagaattaaaaaaaccagaattaacttctaagcataaatgtacataacttatgagttaatttgttaaaaaattatcaaagaaaaattcataaaagaagctatcagatacttttgtattgtgatcaggttttccaagtggccagtaaaaagtgtgtctgagagtattttctagaaagaattgaaaattttatattagttatgaacagccctgggaaactctaaagatgtcttggatacattgaggggaatgataggtggcagagaatactgcctagctacatcactgcaccaatagaggactcagacccagagtctcatagaaaaatgcatccaaacggcacagaatggccaaaacgtgagaaagacacatgtacttgaacatcacatgatctacttcaccctcaggtctttgatttcacttgaacatgtttagcccgagcagactgtctgagtaaacaactgtatcagtggtaatcaaactcttttcaaagctgggggctcttggttaagaaagaaaataagatcatacctgtaagtctaataatcaaaacaagtgcatgcagagctcagctcattgaggcatcagagaagggcccaggccccactagcctacctcttccctaaggccccatagagcataattgaaaagtactgatttatcaaaatgtgaaataatccatagctagccatgaatccagctacagttctattgttgaataacccaatacaggttgagtatccctgtatcccttatccgaaatgcttgggaccagaagtgtttcagattttggattttttttttttcagattttggaatatttgccatacatatatacagagctcagctcattgaggcatcagagaagggcccaggccccttctctgatctctctctctctctctgtctctagatatatatatatggcaaatattccaaaatctgaaaaaaaaacaaaaaatccaaaatctgaaacacttctggtcccaagcatttcggataagggatacagggatactcaacctgtactgggttattcaattatatatatatacatatatgtgtatatatatatatatatatatgtatgtatgtatatggcaaatattccaaaatctgaatatatatatatatatatatatatatatatatatatgccagttgaggatccctaatccaaagattcaaaatctgaaattctacagtgatcctttcctttgagcatcatgtcaatgttcaataagttttgaattttggagcactttggattttggatttttggattagggatattcaacctgtactgacagatggcttccttcaattctcaaagttctttgtaaactaattagttaacttctttatctccattccttgtccacacaacactaaagaggatgccttctggcaccaacagcctgtgatcctaacaattttagtaatgaatatggctataggaacccagtataatagagtaggtaagagctgttggaatactacggggccaaaaatgaaactgattttagaaaattattagaaaagcttccaggtttgcaatccatgagttgtttcagttctagaactctgcttccaataagggttatggccactgctttcacatcagaggctctgcaacagctgtagagttatgggaacatccttgcgacctggaccagggagactgagattacagttcccaaataggaataatttaaatacagattatagaaatatatactaatataaatatattcaaatacaccatagacatttaaatatatgcatttaaacttaaatgtatttaaacacatgcatttaatgaatatatttaaatatgttatacatgtttgcatatatgtgtgtatatatagatctttatacagattacatgtagagatgatctatttgtatctatctgtctatctatctatctatctatctatctatctatctatctgagtatcatctttccccaaccctggaccagagctgttgaagctgaatttggattggactctagaatattttccatctggaaagtctgtttagataggaatatctagaaatattacaaagtttccctagaggactatgttaaatgagttttggggaccactactctaaggtttctcccaactgtaaaatgctatatttttggccttttgagaggcccccagctctaaaatattaacacttacttctagattataactatgcccaccataaccacttttaccaacagtgagtgggaatgaaggacgaaattaagcatttattaaggtctaatgtacaccaggcaccttaataggcaatacaaatacatggacatggcaataaaaaagagacatccttacctccaagcagcttacaatttagtttactgaattacacagtttactttcttatgaagaatcataatgatttaagaaaaaaaaaacctgaggagtccaataaccatgttcaagccatgttttaattattttacttgttatttctattttgaggattttgacgttctaatgtcatttgatatttttcataatgtcatttgatatttttatcctcttggggggatacaactagtggatgacaaaaaaacaatgaaaaaataataattccaagcaaactattattgacattgtgttaaagattttgtgagacaccctgcccacactagatttcactagtatcaccctagaggatgtaagttctaatgagaatttctgtcacacccaagcctcgatttttacttttacagtatagtgctgtttcactctgccacctgcaggtcatatatggaagaacatatttaaattagaaggcctggcttggtggctcactcctgtaatcccaacactttgggaggccaaggcaggtggatcacctcaggtcaggagttcaagacctgcctggccaacatggtgaaaccccgtctctactaaaaatacaaaaattagccgggcatggtgacgggcacctgtaaccccagctacttgggagactgaggcaggagaatagcttggaccctggaggaggaggttgcagtgagctgagatcatgccactgtgctccagcctgggtgacagagcaagaccccgtctcaaaagaataaatgaattaaaaaaaaaaggtagaaatcagaggccaggcacagtggctcatgcgtgtaattctagcactttgggaggctgagacaagaggatcacttgagaccaggagttggagatcagctagtgagacccccatctctgcaaaaaataaaagaattaactggacatggtggcatgtgcttatagtcctatttacttaggaggctggggcgagtggactacttgagcccaggagtttgaagttacagtgagctaggatcatgccacgccactccagcttgggggagagagagagagagacagagagaggaaggagagagaatgagagagagcagaaggaaggaggaaggagatagagaaagagagaggagggaggaaggagagagagagacagagaatgaaggagagagagagacagaaggaaggaaagagagaggaaagagagaggaagtgaggaggaaggagagaggaaggaaggaggaaggagagatagaggaaggagagagagaggaaggagagagaggaaggagacagagaggaaggaaggaggaaggcaagagagaggaaggaaggaggaaggagagagaggaaggaaggaggaaggagagagagaggaaggaaggaggaaggaaaagaaagaaaatatactttaaagtgaaataaacaactctcttctatgaaactgtgatggaaagttaaaccattggtcaagattataatgattacctggatcaaaaatttggatggaagaaaaatccctccccagaaatgaaaaaaaaatgttggagtttaaacatgtacaaataggaaagcaatggtaaggacagtcacccctctacacaatgttcaaagatgaggaagtattgcctcacctggagaaacttgcaatcgccttgtctgagacctctctctagatttctagaccattctttcactaatatggaaccactcaattgtaggatattttcttaagtgtcttgatgcatatttacgctgtattaacaggttcaggatagagtctcttaaagtttacaaagtttattcattaaacaggagcagaggggccacgaccacagaccttaaaaaccaattggccacatagggtggttggataatttaagcacccgtgaaggaggtggcaagtgagaatttctccctttctctgggctttctagaatcaactggatgttttagagctgaaatagacgaatatgtctaactcccatgagtaaggctaactctgtatcattcagtcaatttttagagaacctctattatgtgtgtggtattaggaagtaggaaaacaaaaacgaataagctctcaggagatcctactgtgtgcacgtgtgcctacacacacatgtgtgagttcttgatggggtcagggaacaagagaggtaatttaggatggtttattcctagattctgtatttttctatgtatcggatgggagaagagaatttaaggacagcaacactgattttaaaaagctgccttgggcaatgaaaaaaagagctgcctggaaaaacggacaggtgtttgagtagggctgaccatcctctggagactgacaagatgaaggatccacatctgaggtatattccttcaggcaaagtgggcctctgccatactttgaatgtattcattctcatagatcctttagtacttcatcatttttactcttatttttgattaaggtgggtttaaaattccaacttttttttcttagaaaccttaagtagactaaggattctgtcaggaaaaaatattcctctgaatagggatttggtaacaacatgctaagttaggagccaacgtaacaagagtaaaacaaatgattcagaagatcatattcacagcagggaccgtgagggttttaggagctcccctcagagccccaggtgcagcgtgacattgccaaggacatgcagggagcacagctccaaggggctccctctcgatgtctaatgaggccaggcaacctgccagcaccacaggcttctgtggggcaagggcgaggtggtggtgagcatccattttttttttgtttgttttcctccgaggcagagtcttgctctgttgcccaggctagagtgcagtggcatgatctcagctcattgcgacctccgcatcctgggttcaagcaattatactgcctcagcctcccaagtagctgggattacaggcgcacgtcaccacgcctggctaatttttgtatttttagtagagatggggtttcaccatgttggccaagctggtctcaaactcctgactttgtgatctgaccacctcagcctcccaaagtgctaggattacaggcatgagccactatgcccggcgcatcatctatttttatttttttaaaacatatttcttcctataaaattaacttgatgtccaagaacttgttccttttttcatattgagatttaacaaatatttatggaacacgtacaaggtggtaggcattgtgctacagacaccgccttgagggaaatcaaagccgagagggaaaacgcaggaaatgaaaagtaaggcaggtgggatggggagggcctggaaaaggggagaatccttgagggctgtgttttaatccatgatttggaaaaaaaggtttccttaaataaacaaatgtatacactataagacattattagggaacaataatttcatttgatacactgttgttaaaattacttaaaataatgagaaatgaaaatgattggatgccaagcattgttagaaagtatatcatatttaaaagtgttcacaagaatttgtcaattctcaagttaaagctgtttcatcactacactgagacctgttttctaaggtatataccaaaaaaagattatgccttacccgccagagaggacgctgtcataaaaaaaatacaaacaaacaacaacaaaaaaaaaaaaaaaaaagaaagaaaaaaagaaaaattatggcaaaaaaaaaaagaaaaaaaaagaaaaaaaaagatttcacctttcttttccttccatgagacaaggggctaacaactgtgtcaacatgaagttctccactagagggaactaattccacgtcctccaatcgtgagcttcatcaggatgtgtctgagaacagtgctctctccatgtttagattgtacccagataatcatgctgcattgctaaatgggaacgacactttaaagtggtttttataagatttccagaaaaagatagttttatatttatataaataaattgaagtgtatattttatgttacagaaaaaacccacatcagttgaaaaataattgtgttcaagtcgcctgccatgagtaacttgtgattcttcactgttctgctctagaggtcatgtgctaatatctgggtgaatttgatgagaggagagtggtgcctcacttcccaggaaaacaatgtttgggcagttcataaaatgcacatagtgggaccctgaactacatagctttatgacacatttccaaaaactcctaaggcaaaagtctctggctgcaaggaaaaacctcctgacacagtatctaagattcagaactggtcgctcttaaaataggaagcaaagcttatgctgggaattatctgtgcctgccctgattaaaacgcttcttcagaacaggccatttcacctaattctgtcaacctatacatcaagatttggaacatggtcccctagcaaaaataaaaaaaaatctcattttaaaaagcactgcatttagtaccctccaaagtgaaactctaattaatcacatgtagaggaatcagagaatttgaatctcaaaaaattgtaccacgaccacctcttctttagggtcaagacaaaaagaactttatagaaatgcacaccctactgaattgccaaaagagttcccagggtagttagattttgtcccccatggtatgagtgcaaatggagagtaccctgtaaagctggaagcagtgtcctggatggggttgcaggctaatggatgttgaaggattgttgggggtcagggtggaagggctgagaagtcctttctgcttgaacctcagggtgaagcagcctgtatgaggggtggtctgggggcagatacagcagttagaggactcagtgggacttattcctgctgctctgccagggaccacaagtagagaaagggaaggcaaggaaaggaaaggagcaattactgtgattcctcttagagccactgccaggtctacactttcaggactcattagactacaatggcttaaacatttcagggtctgcttggagagaaattatgccaggcctgtgctttccaatgagtagtggccaatttttacctttttaggcaaagctcctctacttttaattcttaaataatatatgttggctcctgttttactcaccctgggttgtatccactgtcatttctttcacttaacaagattacatttttgtctcatgacgtaccattaattttcaggcaggtttcaaaacttttgcctcctttttcttcattcctgtggggtcttttatttttttagaataaaaaaccctatgaaaattttgttcataaccctccagaattccaacctacctatataaaatctgacaaataaagagaacagcttgatgctcactgttcatgaagggcttgtgcatgtttccagtgcctccctcagctctggacatccccatacaagtataagaatatgaaaatattttataaaaatgttagaaggtgattagtccgttctcacactgctaataaagacatacctgagattgagttaatctataaggaaaaagaggtttaatggactcacagttccacatggctggggaggccccacaatcatggcagaaggtgaaggaggagcaaaggcatgtcttacatggcagcaggcaagagagtgtgtgcaagggacctgccctttataaaaccatcagatctcgtgagacttattcactatcatgagaacagcatgggaaaaacctgcccccatgattcagttacctcccactgggtccctcccatgacatgtggggattatgggagctacggttcaagatgagatttgggtggggacatagccaaaccatatcagaagattaaaattttgtcatctgtatcacctagaaaaaggtaagacatggtagttacgtgcagattttgtaagcaggttgtcaagattgtatctttggctagatttttatttctttgtgacattgagcatattacttatctctctaagtctctctgttagcataactgcaagatgggcatagaaatactgcctgcctccaggatgttgtgaaggttgtctgagatcatacataagcacagtggttggcaggtggcaggttagtgtccaacccatcagctgtgactctgcatccttctattacagcagcacgggcagcagcttagtgcaggcatgaccatgtgcttctctgctgttcctgccacctccactgacaatcacacacacaatgaagtgggcgagttattatgcaggatgtttgaacaatatggagaccactccatccttttctgacttgagtattctgaattattgccttatagccccctcactttggcttctttgctctattcgtgttcaccttcctcttggtcatttatgtcagattaccaccaggcctccagaatggcaaaaatcagattaaggaaaaaactgagacagacaatgtgcttctagaatggcagtgaaatggttatctgtcatgagtgttttgagtccacctcatgaaattgcactttgcttgatttaaaatctgaaaaatattctgaaagccaagcataaaatttgctaagaggaaaaacagtgtgacgctccataatatacctacttgctaaatatactgatttgtagtttattttaaaattgatttcccacagattataggtgtgtacgcctcctcccaacccccaaagcatgccaatttattattaattaggagtacagcctctggagcaatactgcttgggttcgcattctatttgtcaccctcacaatcctactgacttactattaagttattagggccataacttatactctctgagcatgagtttccactctaaggaggggataaaaagtcccttgggttggtgaaatgagataatgcatgtgaagggtcaacagggcatactgagttgttatttttattgatgttatttggagttaaactggaatttacttctacgtgtttgctatattttatgtttataagccctcatgttgtcaggctgagcaactgagtcatggttgatagactgtgttcaatggggctgggtcataggttccaatagaatgaatggtgtttatttgaaggaggccgtgtggtacgtgtataatggcctgggaaaatcaaaggaacctggagtgtaaacttagctctgctgcgacctttggcaagtacagtaatgctgttggtgccccacccaggtcgcctttctccagctggtgccccatcctctcctgccccactgctgggagggtagcctgttagtggtgcccagctgccacttcgctggagcagccccctcagctgatgggtgttgctgagccagaggtgcctaggaagttatgcctccaccatccctgggtggcctggagtcagtggttggctggcatgagggtgcagaggctcagccccctcacctcaaggtgagacaactgtccatgaggggccactcatgctcagagatccctgtgcaatcaggctgagggtagatggctgctaccaccacctctttgcttgtcctcttctctgttctgcttgccctgctttcctaataagcttcccctgagagcatcttctcaacacatcatttggacaagagcccttgtctcaggctgtgcttttacagaacctcaccaaagacctaagagaaagattctgggccccatttttatttgacagaaaatgagagagttggatccattttcgattatgggtctatttaatgaatatctatctatctatctatctatctatctatctatctatctatctatctttcgagacaaagtctcgctgttttgcccaggctggagtacagtggtgtgacacagctcactgcaaccttgagctcccaggttcaggatatcctcctgcctcagcctcctaagtagctgggagtacaggtaaacaccaccatgcctggctaatttgttaaaaaatttttgtagagacggggtctcactatgttgcccaggttggtctcaaactcctggcttcaagtgattctcctgccttaacctcccaaaatgctgggattacaggcgtgagccaccatttgcagccatgaatacagattttaacttccagggtattttttacactttatgctctgatatgcagtcatattaattctattcccttctctttactcatatgtcccaaaaagagatcagtggaggaatgattaaagattctccaagttaaaatctttaagcatcgaaatgtacctctactagggaaagcgaggcagatacatcaggacattctgccttgccaggaggaaattgtaatacacaaaatcttttgagtttgaatgtagaatggtcaacattttcatggcatgtactgtcttttcattgcttccaccattgcagacaaatttctagttctgataaaaatctcccaagctcagcaacccctaaggaaacctttagactcacaatcctgggtgttatatcattttcacagtatttattgtaaatcataacatgtataccctattatggtacagctgaagaaaagttagtgaatgtttgttcgttggatatcagcaacccttgggggcctactgagacctccgttttgatagaaaaaaacacccattaatatcatagtcctgatggcccaccaactgattactgagaaatgaagtcaggatggagagtgctatattacagtgtgccactcttccttcctggacagttttctacctctccttgcacagtgtttacttgtaatagaaaatcaagtgagaaaaatgaggaaataatgtgaacatatccaatttgcctgttgatttcctttccataaaattggccattagccgtacagtagcccaaagggaaaatgtgcagaatctttcagattcataagttctagaaaatgtactttctagagtttgaatgtgattcctcatttaatgggaatttggaactcagcatgtatacaatttcccttagagtgatcagtggagcattttgggagggcaaggatgggacaaaagacaagagggaacatgaactaactgtggcctcacactgtgccagccatgtgacatttgtcatgtagcttaactgtcccaagagctgtgcaaggcacatgctatgctcctcaatacaggtgaataaacaggttccaacttatatatgtggtagttacagagcaagtgtttgaatttgtacctggactcgccatgagaaatgaatgcatttgttagaccagaattgattaaattgatactgttatttattagataacatttactggccaatttataagtatgtacttataaattacatgtaactgtatatttacaaataggatgaacaaaactatgttaattgacagttaaaaatataatgttatatgacaggctcaactgtagcaattcagtagaaaattagcttcaactcctgagttcaaaagtataactgacctagtgtaggcttgtgaaatggaatcagagaacaaaaacaaaaagaatattagatttccttttccttctcaaagacaccatgccattttgtattgattgttaattttgtagtatcctttgaaggtggagcagatattattttatagattgggaaaactatactacagaggacttaattaatccgttgagccacttatttaataagtgtcagaggtagtattagctgagactcaggtctatagtttatcattaagctattggttcttatggaagattctttagaaacagacgagatcttcagatgtgaagcaacattaattaactccataatatttttgagtgtttactatgtaccagggtttacaggaaccacaggagacacagagtatcttgagccatagtacctgttcttaaaattcttgtcatctgctgaaaacacaagacaaaccacttaaaaaccagttcaagtccctttctgaatgattgttcaattaaagtcattgccagaggagtggtatatctgagaatttataggtgttatacatcactgtgggcacaaataggttacatggccagtggtagggggtaagttttgtgttgggctctggagactagagatcggtaggctgagggaagaggaaggaccaggcaaacagaaatgcaaatgtggacaggagcgcagcactcagagggggatggggatggaaacagagagcatggaatagaaggtttattttaggatgtagttgcaaatggatttggagcaaatgatcagggccagatggtataggacatctgaggcccaacaagatggtctatgccttattctgtaagaaaatggagccaaatggggatttttgcacagcaaagtatgataatgaaagattgttatagcaagataaacctgaagactattgaagggggaaagagaattagatgcagacagataagatgaaataaaataatatatatgaaacatattacatatattagtcctaatatcatttgtacaattatatgacacaacaatttaatcatgaagtaatgagagctgggtccaaggtgatgattacagaaagagataatcaataatgagaaagttggaggagcaagaatcaatatgatttggcgattagtttgaaaaagggagaaaagaagactgaattgctatgtttctcttttttttttttctttttgagacagggtctcactctgtcacccaggctggaatgcagtggcacaatctcagttcactgcaacctctgcttcccaggctcaagtgatcctcccacctcagcctcctgagtagctgggactacaggcatgcaccaccatgcctggctaatatgttcttctttttataagattctttaatcttcataatttcagagtgtattctttatactcagttaagcaatccatttagtctctagatcttatttgacttatcttttaattttaaaattatattttatgattaatgatatcaaagtgatagattctcccaatcagggatgagaaatttatatgacatgatccaaaagattgggacaagtgacttataatgcagtctttatggtctcctggtgattttaatgaagccatacttttatgcaataagtagaagattattacctcactccaggatcaaaagatggagagctattaaacatgagcctattttaaaggcaccattagaacacacatatatatatataaattaaattttaaggcttaaaactgccagaaaagctttctgcatggaacactgtacattcttcaaatttggtcactcttaaaactcttcattatgccatcttggcagggaattgtggtagaaaaatgggagtgagaatagaacaggaagggatggtggaataagcaaagtgtttcccagtaactgctgggagttaacctgaggttagtcataaaaaagaatcattaattggttaattcactcattcaggcatttatctccaggagctcctggtttccagaaattatgttctatatgtaacagataaggagacaattcaatcatatatgtgtcctcaagaagcttagagtctattggctacaacagattagtaaaccagaacttaaagacaacaaagaagtgctataaatactgtatgcacactgggttatggaactaaagcagcggggagcctccatacagaagagaggtagctgaatcagtagtgggctggaggaaggaggaggaggcagagggagcctcaaattggcttccaagaggaagtgatgcttgaatgcccctccctgtattcctactccctctttcacctttggacctttgctgtattcgggctgccagggttttttggtgttttattgcatttgaagaaatctgagagcagaaagcagggaaatttgagtcctgtcatgggctttgtgttctaaaggccaggactttggtggaaggtggcgtctcggggtgtggatgtcagataaggtagaatatgaaataagccagagtagggttttctattcccaaagcctaagaaaacgcccatgggctcaggggagggtgaagtgttagaacggctgctttgtgggtgcaggtgagacccctggatccttcaccgctgagccctgggaagtgggggaccctcaataggaggactgtgatccttggtagagccatgagaaatggctggaaagtgtttctgggggatcatgccttagatatgcccaggttttcctatgcctccatttggggtagaatagtgagatgattcttgggcatctaacagtggtttggatacaactgaaaaagaggaagagagagagaaaaggagaaagcaactgctggaaatgaaggggctgcatgaatagcaacagggaacaacatggtggtaactgtcctgggaatacttatgagaaccaaagagataatggacattttagcagatgacaatgtgcacagatgacatcaaggcagataggggccttactcttcatgttgagaaagtctccttaaaacgtagaggaaaccctaggaaaccagaagtaggttagatgaatcagaaaagggctgagattgagtttctaccatttaggtgaaatgacatctagcaaaaaagcttaggttgagttacagaaaaataaaattgcatttcttgtttttttgatttgtagacccagattcatgcccactatattggtggtaattttcaagggcaaggagtagggaaaaggacaggttctaggcaagtattaattcttaggcttaaaagagaatggcatggtacctggaaaaatgtccaagtagcaggatgagtccaagggggtgtttagcaggaaataggggtcaacataggctgccaaaggccagatcagaaagggcttcatatttcataagtagaagttatcagtttcttcctgaaggcagtgtggaaacactgaggaattttataaagagaaaaacactcaaatataatttagaaaaccagtttaagaggtctagagagtggactggaaaaaaacagaattcgaggtggggaccaggaggagactggctagaattagggagatcctgagttctcagtgggattggggttggacgggggaaacagttgggagaaggtgccaggtcttcataatgttcggctatatggggaggggaaaaacaacacggagaagctgaggatattactggtttcagagactcacaatttaaaaagaagagaaaggatttgatgaggaaggtcttgagttccatttctgaatgttgtaagttggtagtgtttaagaaaggtcagagtagtgacacagagttcagagctgaaatatgggtctggatttcaacagaaaggtagattgagctaaaggtactttttcaggaatcactaaaaggtggtaagataagaagtggccatggttgggtgattcaggaaggagagaagaggacacagaatgaaactctgaggttaacaagagaagggaatctggaggagaccgaaggtagccatgcaagaaacagaaaaatgatatatatgaggccaaaggaggagagaagtttaagaaggagatagttactagtgctagatgggaaatgaaacatgtgctttggatttggtagtgagaccattgataattaacttgataatcgaggatgtgagagaagcaatgagaatgaaaggtgggagaagaacaatgaggcagcaagtacactctgttcttttaagacatgtatttgagaaaggaaggaaaaacaataccagaggaggcactggattaagggagtttctttaatacaagaaagaacctatttgtatgctgagggaacagcattagaaaagagggtacagctgaaggtagaggaggaaaactgatgaagttactagggttgaggtgaatgacctggagcccttgtggagagaatagtcttttcctgctctgaggtggaacaaagtaggaggtgaagtgtgggatgcagtgaagttgtagataaggggacagaggatctatttaacactgattacacacttgctctgctagaatcccccacgtggaccaaagagatgggtatgattccgtccttgtattcgcccttctcaaagattcactttaatgaaatgaataagtgaatatttaaccttatactcctttaaactgtagaccaacatgtccagcagtggtctacagagggcaggatgctgggaatggctactttcctagacaattttattctgaccttgcttagaattggtagtgcatgatgataataaaaatttgtcttttaatcagtttcattatgacccttcattgttatctactatagataacatggcctcctattgcctgcagaccctttcttgccaccggcccttcgttcatcactgatgcccaggtctgtgcttcaaagttcctctttgaagcaaacataaaagcacaaaaataatgtggatgaccagagtaaaagaaccagaaagaagctaaaaaatcaagttaaacctctttatcttttagaagaaaatgaggtccagatgagtgaatgactcaggtgaggccaccaaacccaggaacggcagggctgggtctggaatccagttctcctgactcccagttagccttagggagaaagttccattttctctacctttccacactgaatcacaaaaagcaatttagtgatatctacgtaagtgaatgtcacatggagacctacattgcccatcaagaaaccacaggtattttaggggaggaggtggaaagaatgacttgatcaatctctgttttcttcctgttgtggagtcaaagggttcagtgtttaaggacttttagagataaacacattcctttatttttatgtcatccattgttccttggcaatactttcaaataattatgaaggatcaattttgtattctgcagttcttaaaatcccaagctatattttctgaagggtgtgtttgtgtgtgtaaaccataactatttgcatagggcattgtgatgtatcatgggaaatatattcaaaatttatatatgtgatttaaaaacctcaggcaacaaaatatatggggttagaaaatggagacatggaaaataagaggagaatgaacctgggatattactttgagaacttactctcccactaccctggtgttcaaagttggatacactacaagtcatgttttaaatataaaattaaagcttcttattttaagaaacgccatgggaaagctttacttaatatttttgagaggcaaagaattagtctctcatttatgtattttgcaaatccaagttttcttacattggatttgcgtttaatggaaatgtattggtataaagtgaatcacatgtataatacatcacaaaaaaggtaaggcaacaaaaataatgtcatggattttttttttctttagatagagtttcactctgttgccaaggctggagtgcagtgatgctatctcggctcactgcaacgtctgcctcccaggttcaagcaattctcacatcccagcctcccaagtagctgggattacaggcatgcgccacctcacctggctattggccaggctggtcttgaactcctggcctcaagtgatccacccacctcagcctcccaaagtacttggattataggcgtgagccactgcgcccgtccagtgtcatggatcttgatactgaatgtttgttgtggttaaaaaatgcagagctaaaactttaaaaaaaattaatctgtggcatcaactcctgcctaactccagacaacgtgggcttttgcaggaaacactctgagttcattctcagtcttctacctaccagagtttcatgacaattaaacaagatagcatcttgtgaggtcagtgaacctcaataagctagaaattgtcttgtagttgaagatgaactttgcttggatctataccatcttgaatctagacaagcttagcagaatcagacatacctaacagattttatctaacacagttggattcctttgggagacaagaaacactacttcatctgactgtccatttagtggtgaacaattctacccaattatgtcaatcattactagttctttcttttttagttgatgaatactctttttataaaaagccacacgtagggtatacagaacaagctcttacctctcttgaagtcctatgggcttcattttgaaaggagaagggcaaacagaggtagcggtggtagctttgatctcaggagcacctcggccttgagggtccacgacaacattcagtacctttggggcctgctcaggttggaccatgctgtggactgtctttgcctcggacagtgctggctgtaatgtgatgggcgataggtggatctcctggtttttctctttgtcttgtcttaaggaaagctgaaatctttcttttaatctgtaaagaatctatagaaggagatataaaaaactcctgtcacattttctcacactaaacaagagtatgatctcctccaccccaccctggccgacaaaccaaaataaaggcttaacgataaagtaaacaaagccctctgagagatgatttctcagtttcatggtattgagatttttctcaagacagtacacttggtatttccagttatgctgcacatatgtatcaaataattgtgcacatgaatctgttccacaaagatatattcaaaagtaaatttaaccaattttatgaaaaatgccagatgttagtttggtcacatggggaaatggtaggcttacagaaggaataaccgtaaaacacacgtctatgacatttatagaaatggagatatacatccaacatggcttagtagaaaaaagtagtcttgcaagtattaataaaataatagttatgccataaaccacagtttcttatgttggtaaatctctgcattagtcatatatcaacttgagtatctggtaaatacttgacaaattaaatttagggtatctatgaaagaataatttggacaaccagaatttttattcttaccactttgccctcttaaattttaatatttattttattttatttcgatacaggatctggctctgttgcccaagcgaaagtgcagtgctgtgatcatagctcactgtaacctcgagctctccttaagggaaaagactatgcacctacgagatagaactagaaatgcatattaaacattgaactcctaagaaaagaaagacattttattgttttttatgtcagtccacctccttgtaatctggaaacttttatactggtgatattcattgactctggtagggtaaagttaaagcttaaattttgaaaaaagggtggatttggaatattcacatgataaatatttatcacatgaatgagaaagaaaagatgtctgatattaagtaaaaggtcttcttacctttataataactactttcaagcaagtgtaatgtgtttttttaagctataggatggaaaagactgaagatgaatgcctttatcatgtgcatagtgtctaaggtttttaactcactgcttctcttcagtttccatgaccttcacggtgtaaaaacaaaacctgcactagaacagtatcaatcagatgatacatatattttaggcttattgtgttcagctaaacatttaattactaaacgatgaggcaacagaatttaaaatattgttttagttgcaagaaagttattttcccaaatgaagaaacaaatatatctgtacctttacaaaaatacacttagaagataaggcatatattatatattttaagctcttcacatctaaatataatatgcatatgagaacatttgcttgcctgtttacacttggattttggagaaatatgaatcaacaacgaaaatgggaaagccaaggaaatcttgaccttctcaattgttcttgacaggtcaattttatgatttatattagtgtaaaacaaagtctagtccaaagtccttccttaccattcatgagcttatgtttttgatgagaaacctttgtaacatattttccaatcagtcatctgtttacttcatgtctggttacaggtcaactttgcaacctgtctctgtgtggtacgtgtacaaactgatttctacatctttaattagggaaaagtagaacctggagaatgtatgatgtatataagatagtgtttaaaaatactcaagagattgggctgtctgaaaaaatatggaaaaaatggaagagattgctacttggcaatagggtagttgtcatgaaattaagctataaggcagtgattctcaactggcagggattttgccctcaggaaacgtttggcagtgtctggaggtatttttggttgtcatattttcagggtgtgggggaaggagaagggaaagggtgctactggcatctggtaggcagaggctaactacctttacaatgcattggaaaggctcaccacacacccccgccaacagaaatagtaactccgaaatgtcagtagtgttgtttgtaaaaccctgacgtaagggatcataaaatttttgtggtgtaatctcctcatttcacatttaagtcctgagctattggatgagttatggaggtttggaaagaaaacctagaatccaagttttgtgacttccaggtatgtgatcattcaactctattgtttcctccaaagtctcatgtccttctttgaaacctctttccgaaagcatctggaaaagtgtgtcagagatttttctctgcacagattgagatctggaatatagcatattcatatttctctatgggaattcactttgttgaaaaactcaacctaaaagcttaccgtagcaatggcaagtcaacattttgccttcatctccaagagcttgtttgactcttggactggaataaagtcatgtaataatttaaaaaaggaaaagagaacagattattgaatgagaggagctgtaaaactcaaactatagcaagagaaagaaaataatagtgggaataaaaaaaccagaggaacacagaaatgggaggaagctaaaaaaattcgatgaagcttttctgcagcttaaaattttcgttcaaaaatctcatgagtaacacaaaacattctgtcaaatgtgttcagatttcaaaacgatgccaccaaccactagtctttaacatttgttctttacagtgttttacaattagttctgaaagagttcattcactcttttaatttaataatcctgagtcaatccctactacattccataaacaagatattgtagatgcaaaagtaacacagaactctgtcttctgggaattcataggcttccagaaaagataaatgtgtaaaaattatgttcagtacaaagtactaagtgcaaaaatagaggtgtgcccacagcacagaggtataatgtggcacacatttaccagttccatctgggtagaatggctctgataaatacagccattcgcatctgctactactggagttatttgtggccagaaatatatgttcacaagacagagtgataagactaaaaacaacaacaacaacaacaaacaacaacaaccacagtttgactcctttatgaaaacaaatggaattatggtaaagaatgctgactttcaatttagatagacttgggtttgaatttttaccactttctactctgccacccccatatccacccattgcatgttcttggtcaagtcatttattttttctgaatcttagttttctcataagtaaaattaggaaactaaaacatgttaggcatttagcactacagtaaatttagtaccagtttagtaccaataagtgtgcaataaatggaagaaactaatttttaatgttattactattaagacaattgtattcttcttaatacagaaaaaaaattgaaaattaatttgagatatatgcctacctaaccaatcattccagttaggaatctggtcctagttcccttcatcccgagggattatatttaacaaatgagaaaattatgtccacctttgacatgtatttattacatgatgttaaggctatagcaggtggttcaatgtaggatttcttgctgcggctaccagactacaactagagaaactctttccctcccatatggatgactctcctatgggtctaacatgccagtgtttttattgatccaaacaactattttcatgtgatttctaaaactgctttccagaagcaatctggcctgtagacatctctagctatatttcataaatgtctttgtacttgttaataaacctgtaaggacatttggatgtctaatttagatgataaatggtgttctttctattatttgttcaagtttaagaactaattcttcttagtaagtttctttcatctaaaacagactgaatggattggaagttgcccacacattttttcttggaaaactgtatttttctatttgtcgctccacccactgcacattcacatttgtgaggtgctaaataagtcagcatatttgaaaatgtcatgcctgtctaattttatgcctggcaacattttttttttgtattttaaggaaagtaaacaatatgccacttttcaaaaattctgccaagtcttatgttgttgttacatagcacatacaaccttccattacagcaatttacctatataattttataataaaacccatgcttttcatttctacggcatgtaggaatgccaatgcaaatggaggcacttgatttgttataaatataatcaatgccagggggaaaattctgagttatatctttcctttgtcatggaatcaacaaaactatgggaaacagagttggaatacatgtgtttcagaatcacgaaagtgatagtacaagtatcactgagaaatgcacgtgaaacacttactttaaatcaagcttattatcaaaataatttgaacacttagaaagatgagcttattttagataatcgctttgacatgtccctaaacatgaactcttgactcctctgtggtaagttccatcagataaacttggctttgtgctaatcctattaggtagtacttcttttcttgtgaatatgaacttcccgtctgtgtgctgcgggttcctctgttacttttcagaatttgtttttatttatatatttttcagaggcagagaatctgaagcccaggctggagtaaagtggcatgatcatagctcactgtagcctcaaacccctgggctcaagtgctcctccccgtcagtctcctcagtagctgggactacaggcatgtgccatcagcctggatgattttttaaacccttttttttttttttgtaaagacagggtctcactgtgttgcttaggctagttttagacccctgggcttatgcaattcccctgcctctgcctcccaagtgcagggattacaggcgtgagccactgcacttggtccccctgttacttttaaaagtgactccttcaaattaaaatttaagacagtgtttgaaatccatctaattatttctttcatttctttaagaaccatctgaacacgctcatcctcattctgaacgtgtccctctcccaggaaatgagaacatttccacacagtcagggaagccaaataacctaggagtcatccttaattttacccctgttgctgaggattgggacacagcaagttttgtcggttctactttcaaatagatctcaatccttcacttctctccttccccaccacccacccctgttctatgccaccagcatcttcttcactgggatattgcagaagcctccagaaagatcctcctccttccacaactctccccatcctctgtccaccaccactttctaccagaagaaaatgtgatttttaaacacacacagcagatcatatcaaggctctgcctaaaacattcttcccctagagcctgaacaggctaagcttattctaactgcacccacagtaccctctgcctaggggtcctttactcacatattcacccataggtctcaaacatctcaggttgctctgctccactcactcattattatggtttcttcttcatagcacttatcaacatttgattttttaaattaatatactattttttagagtagttttaggtttacagaaaaactgagcagaaaataccaagttctcacatacccttcttccctatctcttcattttcccgttattaacatcttgcattggtgtgattcatttgttgcaactgatgaaccaatattgatgtattattattaaagtccatagtgtagatagtgtagattagagctcattcttcataccttgtacaggttttgacaaattcataatgtcatgtattcatcattacagaaaatagaatagtttcactgccctaaaatctgctgtcccctacctaatcgttccctttctctgaaatctctggcaaccactgatattttctataggcttgacttttcctgaatgtcatatagttggactcacatagcatgttcaccatttgattttttaaaattaacttaattattttctatgtctccctctagagtaaagacttcaagaaaatagggatcttatctgtcttgttttctcctttgcccacagcaccagcaacaaatagacccgcagagaatattctgcaggaatctgttgattgaatgaatagatgaatccacctgctaacccaatagagagcaatcacctatacttctgaaatgctcctttcttgatttgttctaataacgttagagtcgacttccctaagtttctgacctttacattgatgttttgcaaatattgggaaaagaagagtcatcctctggccccaagtggttgagggtgtgactactataggtccttttgccacaagaccaacataggcatttatctagttacattcagtacatgagcacgccctgagttagaaatgcagaatctgaaacacattctatatgttaatagcaagctctgctctgtttctgctgccctttagtactcaaaggctgggcatgactctgctttcccacttcccttcttctatccttgcctttgctcttctgaatcacatccattgatcccctgaatattttccacttttatcactttcaattcctttctattctcccccttctcttatcctttctcatctgcaaagcagaaaaataccctaattgtgactgacaagagagggaacagcacttgagatttcccatataaaggaagaatcacgtatattaaaatgcaattaaccataacaaggaactatgtcctttaaaacagagatgcccagaagacgctgccataatttcccaaaacctcccactttctctcattaaaattctttcctcttaatctctgccatgtgaaatataaaaatcagtttttactcaattctaaattattcttttgtttattgagtcacaattcttagaaattttttttttcttaatgcttgacccataggagctacctctgaattcattatggtggaagatttagggtactcttgttacttcacagattttaaactctagaaaacatgcttatcttcaccctgtttaagactgtgcttgttttatatcctctaagtttagcccatgcagcctgtctttccagagggagccccaatctttctaacagtaaccccttcccagtaggggaagcagaaataaacaaaatccaataaaacacttagcaacattgttgattgtggagagaaataagtaacataatgacttttggggggcacttaaaaactaaggaagaagtatttatttaaatgtacaaaattaaaaagaacatagctcacagggaaaaaggacattaaaacctatttgtaaactctaattattatattacatcttgaaattttcaaatgagtagaaacatcttattctaccctaaagataccgttagttcattcaatgccaaatagtactgcttaatttagtgggttaagtttgttttgggttctatttttaaaattagaaacatgcttttaaaggctacacattattacttacagagctattccagcatatacatttatacttttgtactatttatccaccttaaaaatgaattagtagtctacctaacttagcctttgagggtataatcatctccttttcatagaatgctttcaagtccttttaaaaataaggaaatcaaccattccttagggagtaatcttgtctcaaagacatatctctttttaaattttttcctgagttccataaagatgatataaaaggagaaataaagtaaacccaaagtgtgcccgtgagactttactgactttgagggcttcagtgacctcagtaaatcactgtctaaagcttcattctcagagttgatcaagttactaaaaactgcattgcaattacagccttattattcaggtcagcatccttaattccataagctctcctttagcaatcgctctgatgtcagatatgaaatattcctaatctagcaggatcatagtcttccttctgctcggaagcattttaacattcatttgaatggcaatgtacccactaatatcaagcagtgggctgagcaaaggataaaatatacaaagaagcaaacttaccatcaaacacgttactataataacaaagatgctgagaaaaatgacaacagcataaaatccttctttgctccagattttgtccgcttcatgctgcccttgtaaaacatttttctttaaaagcaaaacagaaagtccgacgttaaatgagagcttgagaaaactggcgttcttatcagacactaaacatatttttagccttattccattcagtgtagtgcaacacacctacaccccccgctgccagagctgcttctcaaactgatctaagacaacagactgccatccttatatatcgagattatttagtctcctatgcaggagcaagcgtgcctgacatggcatctgcaggtcccaggctttctaaacatccctcagcgtctctcttggaaactacctggttcataggtaagagagttctgttcttttctgtgtggaggaaattgtttctgatttccttactctgttttaagtcccctcccacaacatcagcaccctggattacgtgctgtactacctctttacttttaaacaaaagtgaaacaagtgcaaacaaaagcttgtggtgcattaataaatacagcaacaatgccagcattatttccttctttcttttaatcacatcttttttttttttcaaatagagtctctgctgtcaaaacctgactaaaatatcatctcaagaatacatattgttagaatatcacatatttttctaaagtaatacggaacattaaaaagttcagaattatttgtcaataaaaggtagaatacacaggtttatctttatttgtatcatttttgttccactttgggggtggaagagcagagaagaagcatgaataaagtgtgcatgactctattaattttattttattaatttttttaaagaagcacattgactaaaatccattcttagattaaaattcagttgtataatttagtgacagtatagatttatagttaacgaaactaacttgaaaccaaatagtccatgattgggaaaaacatataaaggctaaatcaagtcaaatgctttaactcatctaaaatttcattttgttgaagggtgcctttttattccctttagtgagagtacatgtctgtccttggttattgtttccagtgattaagaaggcctggagtaaaacacgtcttgtaggtgtctgaactttgaaatcattgctaatttatttttaaggcttttaaaaaataaaatatacccaacatttataaatcagacaaaaaatttaccttgaaaaatattttatgagaactttcattctggaatgcaagtgtgttttggtgggaagataagcaaggctgaacagaaaagatttttgagttcaattgtgattacaaaaattatttggagaaagcctttattaaatgctaacgtaatcaggattctattttctttacttgtaaaacagcgatgtgctcactaattatagtagaatagtatctggcctactttctaagacatagatagatgcatagatacaagaaatgatttagatatgtattttaaagatatataaatgataaatcgatggagaatctgaaaacacttgattgataaatgattagaaaccaagtaccctgctgcaaaacaactttgggttcaagcgacaaattttctttcacctctttgacgtcagccatatcgtttttttaaattccaatgtctctataagcatagctggaaactaatagaaaactcttgcagaaatcaggtataaatatggaaatgaattttttacaggcaacaaaatagcatccattgtttgctataaaagcaaactagttaagccttcaagtaggcagcataaatttgtcaaatttaagtataaggagttgagcttaagcccatgtaaaatttggataaaaaggggtggttaggtgggtggaaagagattttgtgttcctaacccgatttggttcatttttttttcttgctgtagttctacaactcctagaatatcaacatgttcctttctgcttaagacaaacctgttttgttttcttttttaactgaagcagtaatgatgaaagaattaactcccaccctcccatcccccactcccagttagaaagacacgttttaaactcctagaacttagtcactgcactttcttggtaaatagatttctttctgagtcatgctactcctgctgaacactactatatttgtacagagatctaaaaaacttgataagggcagggtaataaatggacaagtttgtagttaagagctcacaaatcaaaagactataattcacaagaatcttcaatctaacctttgcatagggttaaccccatgctttttatattttgtcaggtggccgagagttgaataattcagaggctctgttgttgggtcaagccaatgccactatatcatctttatgttttattatttcatagctacatttctttgccctttaacttagttgcagtgaaagaagctgatgggttttgttctattatttaaaatttggtcagttttctgtatagttaacaatggcttctctatatcctgtttaataatttgatgcactatagctcattcttctttcttttgtcctttctttttaaatattttaatcaattctgatctcagatgcagaaggagatcccaaatgctaggagagacgattcagagatacagaggatctaggagatacacctctttaagagagaggaagtacacagaataagaatgaagtgcaaatgttacaaagtatctggttaatttgattgacttggcagataaatgagatgtatcctataacaatatggctttgttggataaatgccaagcttccactgtactgtgcacaatgtgagcaattgttctgaatggtcgaatacaggttaatattgattgtatgtctcctcagcactgtatggctaggtctacactaatttagacaagactacctgctagtgttcctagtttgaaggaataatcattaaactcacacattattgtttacatttgtatgtaatggctttttttctttgtaaatatttcatgaaggtatcagttagcacattggacttttatttaaagaaggtcactttctcctttgaaatataagatttggaaactggagtaatttgcaattgaacaacaacaaaattcctgaatcatttttaaaaatgtcaacacagaacttaccgttttaataggtatttaattcattttgtaaaaacatttaattttattttcctgggattttacttattaggcaagaggaggtctagttttatctatatgagtgcctataatgttctagatatcatatacaaatatataaaggaaataatgtcttttcctttaagaaacagattacaaatgaaaacaaatgactaaacaagaacagttttctagttgggtttttttgtttctgaagagtcattttcaatttaaaaaatcaagcatatgaaaaaacaataaaaaaccatatccttccatgaaagtaattaacgtaagtttaggaatagatgctttgagacatcattcacgatgttctataattcatgcaaaggatgaaaagccaaaataccagtgatcctttttttctgttaatgaatatgttgccataacatgttataattttaagattaaaatgtgaaaaaatgggttgaggtataagttgttataaaagattaaccacagaaaaaatgaataaagttgtaagaaaactcacagaatagcatttaccagttttaagcaactatcaatcaatatttttgcagggcttctttaggttgtatctgtaccaagcacctccccactggggtgcctgctcactacagacagcttttccctgtttctgcatttagagattctggtcaaaggtcaaagggtaatgcctggccccttctaggagtactcaaacaaaaggttcaaataatccctctgtccttcatgatatgctccttatatctgattcaaatacttcctcatcttctgtaatgcatattttctaaattctagatttctagattccaacaattttatgagaatctatcacatttatcatcaaaacactttccttattcaaatgtagtctattgtgagctagtagctctgtgagaggccattaagctaagtacctcaccttcactggactggggtatattggaggatgcccaggtacttgctttaaagccagctctttttgtatagggagcttcttttggtttgcaaatctgagtgactcagtaagttgctctattcttaaagccttcagaatggcttttaaactgagaataaagcaacagggaaggccgtttacatgattctctaaaagcttatgggaagcaggatacatttatccaacggtctttctaaaatttaaagaattgtcctaggcaagatgtgtaccagtcagtccgtgtagggccttgactgtgggaatggggtttggctttgtgcacaagcggaactgcttcagattcagacgtgggcaaggctgggaggggcctggtggttcacctcctcctgaccctctcctctggcctctctaaagcataaggggtctcttctccaaggcacccatggcacagtgtagtaactttattcatagaactatattcttattatctctttgtgtcgtatttgccctattagtgcataaattcattgagaacaaacatcatttattgtttgttttcttgtttatttatttttctggctttagatattagctagcacagtacttggctatttgctcttgttgttgttgttgttgttgtctgtttgttttgggactccacccaggctggagtgcagtggcctcatcatagctcattacaaccgtaaattcctgggctcaggtgatcctcctgcctcagcctcccaagtagctgggaccacagttacacaccaccatgcccagctaatttttaactttttttgtaaagtcagagtcttgctatgttgctcaggttggtctcaaactcctggcctcaaccaatcctcttctcttgacctcccaaagtgctgggattacaggcttgagccaacgcgcccagcatgactatttgttgactcagttttgttgtgtgcccattgcatgccaggcactaaatgaaggcaatgaagacacagatcaaatgacatgtcacaagctctcaaaaaacccacagtgtagagatgagcctaaagactaatatggaataaggagtttttgttttaagcttgacgggaacacagggtaaggagcatcttcgtctgtggaggtacaagggatactttgctacacagtagactgatcttaagaaatgaaaggtatgcatggtgaaatcccatctctactaaaaatacaaaaaattagctgggcgtggtggcaggcgcctgtagtcccagctactcagaaggttgaggcaggagaatggcatgaactcgggaggcagagcttgcagtgagccgagatgcaccactgcactccagcctgggagacagagcaagactccgtcttaaaaaaaaaaaaaaaaaaaaaaaaaaacaaacgaaaggtatgtagatgaaacaacacatacaaaagcatgaaggaaggagagaatatggtgtatcatagatctatcgagtttagaattgctgaaatgtaaactaggaaagtgttgttcaacaattataaagcccagcatacaaaggaccatataccatattaagaaatctagacttcattccgtagtattttgaaagccagagaagaatcacgaaattaggagggcatggccaaatttatgttgagaaagattactttggtggcaggaaagaaaacacattgggtatgtttggaaacagaacagagagaggcgcaaaaccaaatgcaggaagaccagttgggggtggttgtgacagtgatggttcaatgatgacatatattctcattgtgccaagtcatcctgcattcaaattacatttgtctgctacctaggctgtgtgagaatttctgcatatactttaaaaattcaatccatatttcaagtttataagtgctatacccattttggatttgaagaaactaaggctcagggaggttgataccatgcaaaggcagacaacctcacagagattaaatggcctgcccatggtcacacacattttacgtgtggctttgggatacaaactccatctgggtgcaagtgatcctgctgcctcagcctccccagtagttaggattacaaacataagccaccatgcccacccagagctttttataccacacctgtgatactaaaatgagaggcagtgtgatttactgtaaaggtgaatagaccagggatcaggacatctagattttggacagggaagatggctcactcacatctgtaatcccagcacttttggaggccaaggtgggagaattgcttgaggccaggcattcaagaccagcctgggcaacatagtaaaaccctgcctctataagagagaaaaaaaagacacctagatcttaggtggtgctttacgcctctcttgttctgtcaccttgagggagtcacttaatttctatgggccatactttctgtatctacaaggtgttacacatattccctccagtttaatttcatgattccatgaattgaattacacgtatttaggatgatgatcctttcagtaggtttgttagagcgggatggagtaatagaattggaaaggaaattaaatccattcaggagtgagatggtggaggtggtagaggaaattttttaaaagcgacaaatttggaaaatactatgaagaaacatctatagttcttaagacttaagttctttaaaaaactatagtttcttcagaaaaagaaaaatcacatttcaaattaatttcaaagttatgggaaaaggcgaatatctggtgaccattttgacaatgacgacaatgaggggaggggtgcacctgtagagaaagaaaggtttaaatgtatttttgtttatttgacatatcagtttcaagcgatcaattgacaaaatacatctaaatcttctttcttctagaaaatttactggataagtcaaaataagttataaggccacaaaggtttgaagaagaaaaatgccaaaaagtgaaaaccttaatgtgaaagtgcatttccttaagaagtaaacatatacaatgtaaagatcagagaattctgacactcagggaaatttttattatcaaataacatacaataaacaacttccatctcaaagcctcttggggttgaattaccatagcatgctaactgttcacatttttaaatgaattgtttcgtgcaacaacatacctcaggagagacttctgtaattccaaactgggataaactttgatgcaaaacattgatattaagtgaacgaagaacttcctcagagggcagagcatcagaaattcctgtttttcggtttatgggagacacaaacagttcaatactgttcttctttccctaataaaagcagaatatttgtatttgttatagacattttaaacaactttggataatatttttacctgtcctttagaaacattaaaggaagtcagaattctagaatcctaaaaggctttgtggagattatatttattagttattctctgatagacttaatgttaccagtccaaagtctaaaatcttcaaatagctttcttgccattagttgccaccccccaagatttgtaattttatatttcagtgcatgcttgcatgctgattcatttaccattccatattgtaattttttgatgtagattgttcagatgttccctgagtaattatgtttaaagaagcattttaaaatcaaatgaattaaagtccaaagtaatagtaaaattacaaaattacatattagacatcaccactctctctattatttttataacttgtgttaatgtgaaggcttggctagctaaagaagatggtgccagatgatctttgaagtccttttcctgatactgttcttcacgtcaaatatgtcacacatttaaaattggtcatttggtggaaatgcatatcttatgtagtgatgtcatgagacttttcctattagtattacctcattagctgaaatggagtcagagaatttcttaccataaatgtctgatatcctacacacacatacacacacacacacacacagagagcagacaaaaccatggcgattgataatattatctttcacaacttacacaacacactaatagaaggaaattattcttagctttctttctgacacatggagagctctcatgctagaaagttttcttttaatgtgctttatcagaattttagctggtataaaatgaagtatcagtttactactagcaagccagtaaaagttttttcatgtttgcagagaacaacagacaataactaaatactgatgtgaaacatgtttataacaatttaaatagtttgtgacccaataacaactactgtaggtacagagcacttgtgttgtgcctaacatgctatttaccttaaatcttttatctcatttattgctcaaaacaccgctaagcgataggtattatggttatctctattttacaaataaaacgtaagaggcttgcccacattcacatacatggaatatggccacactggaaatgaagtatggttttgtctgtctccaaaacacatgatgctaatcaacatgctttgctatgtcaggtattgtaactctagctattataataactactttgaaccatgctactaacattctctgaggatatgataagcatattccttcctcagtctggcaaatccctccttcacccttgcaaacagctattatgctcattaaacctaatatgtataaaagtatatctaagatatctatatcatctctctatatatcttagcaaaatatatatgcacaggttgatgcatatatatttttatatgtatatattgtatatatataaaaaatctagatctagatccaagactttttttctttttttttgagatggagtttcgctcttgttgtccaggctggagtgccatggagtgatctctgctcactgcaacttccacctcctgggttcaagtgattctcctgcctcagcctcctgagtagctgggattacagatgcctgccaccatgcccggccaattttttgtattttaagtagtagagatggggttttaccatgttggccaggctggtctcaaactcctgacctccagttatccaccctcctggcctcccaaagttctgggattacaggcgtgagccaccgggtaaccttcactcattcaggggaatgttgtatttcttcttctgtggtatgagttaaaactttttaacagcttgtttacttctagaacattgttgattcacagaatacaaatttttatgaagaaatgaaacaactcactctctacacacagaaaaaataaaaagaaacataaaccccaaaccaaaacaaaaagcaaattccctccatagtgaatgcagatgggtgcaatagaaagctgagctccatgcagcagaagcacagcaatttaaggctgggggaacatggagtccttgcttagactcccattgcagtggacattaagagcaatttaaaacctgtacagtgatcccaaagttccttttcacataaaactgaggtgactagctttttacagaaagacagtcatctgatctgaatttactttttttttggcctttgctcacgcccactttccagtgcagatgggaacatgtagttgcatgaaatccaggttcccaaacaccgaggaaagagaggaaataatggatgtgggtgattgacatataggcctagactgggccctatacaacagatcctttgggtttactttttttttttttttttttactttacccactcagatgcccattcaagttttctcttggttttcctggactaccaattcctgcattccacctgggctgcagtcctcagggtcagttctttattctttatttaaaatgccctgccttgtgcactcaatgtccattgttctactgatatacttgaaagtatatcaataatgtctggaaactgcctcacctgatatacttgaaagtatatcaataatgtctggaaactgccttacctgatatagaagctttcactctaatggagaatattttcggagtagtgtcaggttggtaaggcaagtgttttgggctctttcatatttaccacaggacctagacttgaactatgacagagttaacaaacttcctctataaagggccagatgataaacagtttaggcttcatgagccaatcttttgcaactactgaactctgccactgtaatacaaaaggcatcatgggcaatgggtagatgagcagatatagcttgtttcataaaattttatttgcaaaaacatgacgtgccggatttggctcattagccatacaactatagcatgagccctttagtgattaaaaaaaccacacacacggcttgaattttggaaatgcgaaatgtgggtatcttacaatgaggcgattgatgtgcacttgctggggtaagagtcctaaagctgcagccactccttggcggaagatccgaagcaaggttatgttcagcttgtttacatccatttgcagtgtctagaaaataaggacaaaaataaatccaaattatagtattaatttgtatagatgtatagaatacatccaaataagtattaataagttcacgacattcagttcttgactcatgactgaccacagtttctgtgactctgctaagtttacactaataatgctttattgcatttttgatagaaataaaattataggaacattgcatgtgaaattttaaatggtattagttaaaaagatgtattataggggtggagccaagatggccaaataggaacagctccagtctacagctcccagtgtgagtgatgcagaagatgggtgatttctgcatttccatctgaggtaccaggttcatctcactagggagtgccagacagtgggcgcaggacagtgggtgcagtgcaccgtgcacgagccgaagcagggtgaggcattgcctcactcgggaagtgcaagggctcagggagttccctttcctattcaaagaaaggggtgacagacggcacctggaaaatcgggtcactcccaccccaatactgcgcttttccgacgggcttaaaaaatggcacaccaggagattatatccctcacctggcttggagggtcctatgcccatggagtcttgctgattgctagcacagcagtctgagatcaaactgcaaggcagcagtgaggctgggggaggggtgcccgccattgcccaggctcacttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgagagctttgaagagagcagtggttctcccagcatgcagctggagatctgagaacgggtagactgcctcctcaagtgggtccctgacccctgacccctgagcaggctaactgggaggcacccccccagaaggggcagactgacacctcacacagccgggtactcctctgagacaaaacttcaagaggaacgatcagacagcagcattcgcagttcacaaacatctggtgttctgcagccaccgctgctattacccaagaaaacagggtctggagtagacctctagaaaactccaacagacctgcagctgagggtcctgtctgttagaaggaaaactaacaaacagaaaggacatccacaccaaaaacccatgtgcacatcaccatcatcaaagaccaaaagtagataaaaccacaaagatggggaaaaaacagagcagaaaaactggaaactctaaaaagcagagcgcctctcctcctccaaaggaacacagctcctcaccagcaacggaacaaagctggacagagaatgactttgacgagttgagagaagaaggcttcagacaatgaaactactccgagctacaggaggaaattcaaaccaaaggcaaagaagttgaaaactttgaaaaaaatttagacaaatgtataactagaataaccaatacagagaagtgcttaaaggagctgatggagctgaaagccaaggcttgagaactacgtgaagaatgcagaagcctcaggagctgatgcaatcaactggaagaaagggtatcagtgatggaagatgaaatgaatgaaattaagcgagaagggaagtttagagaaaaaagaataaaaagaagtgaacaaagcctccaagaaatatgggactatgtgaaaagaccaaatctacgtctgattggtgtacttgaacgtgacggggagaatggaaccaagttggaaaacactctgcaggatattatccaggagaacttccccaatctagcaaggcaggccagcattcagattcaggaaatacagagaatgccacaaagatactcctcgagaagagcaactccaagacacataattgtcagattcaccaaagttgaaaagaaggaaaaaatgttaagggcagccagagagaaaggtcgggttacccacaacgggaagcccatcagactaacagcggatctctcaacagaaactctacaagccagaagagagtgggggccaatattcaacattcttaaagaaaagaattttcaacccggaattttatatccagccaagctaagcttcataagtgaaggagaaataaaatactttacagacaagcaaatgctgagagattttgtcaccaccaggcctgccctaaaagaacttctgaaggaagcgctaaacatggaaaggaacaaccggtaccagccactgcaaaatcacgccaaaatgtaaagaccatcgagactaggaagaaactacatcaactaatgagcaaaataatcagctaacatcataatgacaggatcaaattcacacataacaatattaactttaaatgtaaatggactaaatgctccagttaaaagacacagactggcaaattggataaagagtcaagacccatcagtgtgctgtattcaggaaacccatctcatgtgcagagacacacataggctcaaaataaagggatggaggaagatctaccaagaaaatggaaaacaaaaaattacaggggttgcaatcctagtctctgataaaacagactttaaaccaacaaagatcaaaagagacaaaggcggccattacataatggtaaagggatcaattcaacaagaagagctaactatcctaaatatatatgcacccaatacaggagcacccagattcataaagccagtcctgagtgacctacaaagagacttagactcctacacaataataatgggagacgttaacaccccactgtcaacattagacagatcaacgagatagaaagttaacaaggatacccaggaattgaattcagctctgcaccaagcagacctaatagacatctacagaattctccatcccaaatcaacagaatatacatttttttcagcaccacaccacacctgttccaaaattgaccacatacttggaagtaaagctctcctcagcaaatgtaaaagaacagaaattgtaacaattgtctctcagaccacagtgcaatcaaagtagaactcaggattaagaaactcactcaaaaccactcaactacatggaaaatgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaactgacaccctaacatcacaattaaaagaactagaaaagcaacagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagcaagagaagaatcaaatagacgcaataaaaaatgataaaggggatatcaccatcgatcccacagaaatacaaactaccatcagagaatactacaaacacctctacgcaaataaactagaaaatctagaagaaatggataaattccttgacacatgcactttcccaagactaaaccaggaagaagttgaatctctgaatagaccaaaaataggatctgaaattgtggcaataatcaataacttaccaaccaaaaagagtccaggaccagatggattcatagctgaattctaacagaggtacaaggaggaactggtaccattccttctgaaactattccaatcaatagaaaaagagggaatcctccctaactcattttatgaggccagcatcatcctgataccaaagccgggcagagatacaacaaaaaaagagaattttagaccaatatccttgatgaacattgatgcaaaaatcctcaataaaatacgggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaacagatgcagaaaaagcctttgacaaaattcaacaacccttcatgctaaaaactctcaatgaattaggtattgatgggacatatctcaaaataataagaggtatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacgtgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagaatataaaatacttaggaatccaacttacaagggacgtgaaggacttcttcaaggagaactacaaaccactgctcaatgaaataaaagaggatacaaacaaatggaagaacattccatgctcatgggtaggaagaatcaatatcatgaaaatggccaactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctcacttcaaactatactacaaggctacagtaaacaaaacagcatggtactggtaccaaaacagagatatagatcaatggaacagaacagagacctcagaaataacgccgcatatctacaactatctgatctttgacaaacctgacaaaaacaagcaatggggaaagattccctatttaataaatggtgctgggaaaactggctagccatatgtagaaagctgaaactggatcccttccttacaccttatacaaaaattaattcaagatggaataaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaagaaatttacaagaaaaaaacaaacaaccccatcaaaaagtgggcaaaggatatgaacagacacttctcgaaagaagacatttatgcagccaaaagacacatgaaaaaatgctcaccatcactggccatcagagaaatgcaaatcataaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtgattcctcagggatctagaactagaaataccatttgacccagccatcccattactgggtatatacccaaaggactataaatcatgctgctataaagacacatgcacacataggtttattgcggcacaattcacaatagcaaagacttggaaccacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaactcatgaacacaggaaggggaacatcacactctggggactgttgtggggtggggggaggggggaggtatagttttaggagatatacctaatgctaaatgacgagtcaacgggtgcagcacaccagcatggcacatgtatacatatgtaactaacctgcacattgtgcacatgtaccctaaaacttaaagtataataataataaattaaaaaaaaataaaaataaaaagatgtattatatacaccatggaacattatgcagccataaaaaatgaaattatgttctttgcagcacatggttgcagccagaccattatcccaagcaaagtaatgcaggaacaggaaaccatatactgcatgttctcacttataagtgggagctgaacattgagtacccatggacataaagatgagagcaatggacactggagactgctagaggagagagggagggaagggggtgagggactgcttaatgtgtgctgtgctcactgcctgggtgatgggatcatctgcactctaaatctcagtgttatgatccagtgttcccatgtcgcaaacctgcacatgtaccccctgaatctaaaataaaagttgattttttaaaaagatggtatattatataataaagcaatttgtctagttataataaaaagcacaaattaatggtcaattcataaagaatttcattgaaatgtgccttgaataattttgctttagtttagttccagatgacagaatggaatctgtggccaagtgtatttcagttatccatcttcaatttgtgttcatacaagtcacagagagaaagatgctgtgtaagttccataaggcctgtcttggcagtttctatacatagtgatttgctgccagtgcaaggcaaaagaatgaggtgcaagaatacattttcaaactctggtaaaaatgccagtggtactgatgatttggtctaagataaacaattcttattcagttgtttgggcaaacactcagctttcaggtttgcttaggaaaaaatctaaatattaaagaattcctaaaataaaatcaaattatgataatatcataattatcatagtagtaataataaccctcattgaagccccagcatgattactacactgaaaccatgaagtagtttactgtatgtattttcaaaaatgcatcattaatcatttgagagatactcaaggtagggaaaccaaatctttatgcatttcttttattcttataatacttaattcactaatttgaacatagtaggctatcaataactattgaatggctgcaacatcacctgttctgtaaagctaggcatacttctgagtacacacttctctaataacgagattggtttacatgtgcaatctcctatagagtaggaactctttaggggaacttccctcagcttgctttaaaaagagattaatactgtttcaaggatttatagtctcaaaaggaaataccataatatatcctctattttttacctgcaagtatattctctattttgtacctgcaagtaggtaataaataagtgattggaaactggattaaatgctcaatgctataggaatcagagagaatttggaaagtcaaaagaggtatagggttcccagtcaagatgatgggcccagctaaagctccagcctgcatttccaccttagggtctctcaatgcttgcatggaggtaggggccctaagatttggttaatttaggttaactggactccttgtgaaaaattaagatccagaaaagggcagaatcattgaaaaaaactacctaagagagcccagtaataggcaacaatttgcttctggggaggagaaataagaatgatgttggagtatatagaaagctatatcaaacacaatcagtaacactttaaaatttcttaaaatttatcttactttatttttttttaagcttaaaacaacagaaatttcttgtcttgtcatactagaggctggaagtctgaatcaaagtgtcagtggggccatgttccctcttaaatttgtaggggagaatccttccttgcttcttctagcttctggtgtttgccagcaatccttgggattccttggattacagatatattactctaatctttgcatctgtcatcacttggctttctcctccctgtgtcttcacgtcttccctctgagtgtctgtgtccaaattttccctttttataagggcctccttatattggattaggagcccaccctactccaataagacctcttgttaacttttgttacacctacaacaaccttattttcaaataaggtcacattcttaggtactggaaggctagaacttcaacatatgaattctggggtggtggtgaggtgggatgtaattccacctttaacgaggagaaagtcagaattctgaggaaagaagctgctaacttgtagccagagaattgaccaagaaccttagtaattttgcacattttcttctgttttcttttaggctctgagtcaatacaagtaggaagttcaactggttccctgggtgttcattcctggttggagagctgtttgggaggctgggaaggtccattagaagcataattctattccagaggtggcttggcagatggagcatatcatgggtaaaggcagtggtaaagtcttggtgaggcaaaaataaaagaggtacatgaatccagacacaatttgaaatagatctttctgttccaggttaatttctcagcatgtcacagaaagcaattcctactagacctgaagaaagtggcttctctcttaacagaatgttatcttcttctagagagtaatatgtttttattaaataaaaagcatctaatagtacacaagtgtttgctacattattttctgtatttttaatagcctaaatatgcatccattatataacagaatgttttaatgcagaaagtaagacttgaagccaaccttaaaggacaagtaggatttggaaatgcagtgatcaggaaagtagcattatactgttaagcacaatatacgcatctacctggcatacctgggagactagaaaaactcagtacacctggtcatcctgagaaacagaggcttcctttcatccgtggcctgttttcatctctgccagactacagaagctgccattaaagatgagacactgtattggagactctgtctactacccttcccttgcaaggccaaagatggattccttagttttctcaaatggtgaatgagtaacctctgtctcaccagcagtgtttgtcaggcagggtgagctggcacacagtgtgcctgaatccccagaggcaggatttggagccaattgtctatgctgggaacccacaagccccctcaagggggttgtgtacacactgcagaactcaattcccagaggcatgattaacttgaggcttgtaactgtggaaacagtattacagtttcagactgaaatggtaaatgggaagtgaaatgggaactaaagatttaaaaatcactgaaaaaggcaactttgcaaaaatatgaaagctgtacaaaagctgtacatttgaaacagaaatttagactacccaactatagtgaagaagtgagttgaagtaattagttgaaattgaaatcatctggttcattgcatcaaaacatttgaatgattttcctcagttctctgcttgtctgagaaaagctggattttgtagagcatgcacagatttctgactcttccccataaaaatagtgatgctaaaatatagtacaaacagatatctatgtatttgaaggcctaatatatgccaggcattatatatgagtgcaatttgagaaaaagaaaggattctagataaaaatgggaattttatttcagacaaaataaaaaatatatgactttatatagttagaagatatatgctacctccttctgtctggatagatgctagaaatgcacagcctctcctcatcctattatgtgaaaccataacaagtatgacaggatataaattttcacagcagtaacaaggcaacagctttcaagttgctgtacaacattctgcgatatatttttgtttggatgctaaacccatttggtcatttttaacatttaacatacaaatgatttaacattttaatttcaaagagattaaaatgttctttccaaatgcaaatggtaagccactttacaacagtacataatttcatagagttactacataagaacaattgagtatttttattgttattacaaatatataaacatacagaaaaaacatacaaaattcaaagtcttccaattctacctatatttaaatataccaggcctctgtcttgttagattcctttgtcagttccccactactgttcccctccacaaaggaaataatattttatgacaagactttctttctttggttcccagactgtccaccaaagtagttaaagcctatgggccttaggtacaagttgaggtgataggattgatgaaatgtagcactttcaggtaccagcattatgtttgaattataagtatgtgattagcttttagctatttattttgtaaaggataattgaattatttttgcctagcagggaggcagttagtcccctcctgaagttattaggcagcctggactttcatttggtcatacccagtaagagtcaggaccacacccagtggtccagttagtgggcaaaggacaaatgtccatctttcttcctaagagatgcctcaaggctccttagagaagtgctgtctcaattcccaacagccacaaaaggaccaaagcttccttttggaccaaaagcttgctagaagaaatccatccacttctaactcaaatgtgccccccaacccttttttttttaacctggaatctttaactccattcttggccaaggagttggaatggcaagagatttccaggaataaaagcaaaaggttctctgtttatgcctttgaactgagtagagaacgctgacctgttagagacattttatgctttcaccccttcccttctcacaattctctgcacttgtcctctgctattagttacagattaattatttttatttctatattacacatttccacctttctcatggtcttacacctgcttccctcttcctgaatgtcccacttacacttcaaactcaacattacccaaactgaacttacctttctccttcttcctatccacaatcaaatttgcttctctttctacattcacataatggaatgagctatcatatttgggtatcatcccgactcttctttctttattctttacaccaccaccacgacatccagtgaatagtcaagttctgtctattctacctgctaaatagtccttgaatgttgaacccatattttctttatctatatttccatcattttagttcagatcatcaccatgactaactggactatttggctagaatcctaatgggttgccagttttctgtggtctctaattaattccccatatggacatcatagttatctgtgtaaaatgctatcccaatcaagctactattctgttcaaaatactctgaaaaaatctcattttctaatgaatgatcttaactcctccattcaccaaatttgccctgtccttccagtcttaacctcttacacctttccaccacacatgtcatactccaggcatccctaaggtttattaaacatgccatgtccttttcacattgttagcgcacaccgggatcagtgctaggggctctttcttctccttggagactcagcctttttgctacctggaatctttaactccaggtagaagagttaaagattccaattcaagatccatggttggcaaagaccattctgccagccttccctgacttctcccccttcttttgttgttcctttcagttctccagtagtactgtgttggactttaggattttttgtttacatttttataaaaatgtcatgcttattacaacaaaatttaaggtacagatggatatatggtaaaaagtgaaaatatgcttccccttcctagcccttcatcctaatccgcagaaataatcctgctaaccatatcttgtgtatacttccaaatattttctatgtgtacatggtataaaacaatatgtatatatcatacataatatatattactattaaatacaaataggattgaactatacattttgttccacaacttgcttttttcactaatatatctgagatagagttctatatttataatatataccatcatcaaatatcatgctttgattcttataatttcttatttttaacagattagtttattccattcacttctgttatttcaacagatttagatgtgttttattgctttgctattttatgtttttttgtttttattcttccttggttttctgtcttttgctatattgtctgtttttagttgttattctacattttttcttcccatgtctatattataacataaaataaggcatgaaaatatatttaagccattatttcttgatttataaaatttaggaagtatttattaacttctgctatgaaagatgagaaaatatgccactcttcccaccaattctcataacctcccagtttttgtaattatattattatttctatattgttatatctaatgctattgacattatattctgtgtattagagactacccagaattctccatgatcaagataagtaaaagtaaagtgataccttcagtcttacgcagttaacaatgaggatgccttctccaccctctctttcttccttctgtctgcaagctggatgggtccagggtcaccctaaaactgcattaaaaatggtggagctacacaaaggaagacatctgagcccccagatcactgcgtggagaagagggtcccactcagaaacccacattaaatagtgacatgagttaaaaacaaatttttattgtgttaagccactaagatatgggtatgtgttaacactgtttatgccaatgaatatatgctgaaaccataatttctacagttctatagtgatagttatatattcaaatggattcaatgctcatgaccagtcttttatttttagaaggatgtcaccattcttgaattctatattttgatttatctgtttttcagttgggtttcatttcaaatcgcttctttcaagtgaggctcatgagtgctctatttcctgaggcattatatgtttgtgaatatatttgtggtgcttttaacaataaataacagcttggctggatattaaacccctgattcaatctttatttctatttttttttctctttgaactctgctgctattttccaatgccttctggcattgagagttgctgtgaaaaatactgtggcctgaggctagtctgtcttgcctttcccacccctcatctcatagaagtctttatctttaaagttagaaaacttcaccaggatatttctttgggttgatagtgcctgtaatgtggtatgccgttatagtctacagattccagagcctatttcagtaatattttctcctattatgcatttgaatgatttttcatctaaacattttggtctcatcttcaaagacactaattatgcaactatatattcttcatctttctatctcagcacattattttatgtgcttattttctctaatcacttgtatgtttttattcagctaaaattctctgaggtctgcactctgtccttatgttttttcagcagaatcttttctatttcttttgttttaaatgtgatttcaatttctctaatgtttttttttactgccatcatttcacttctgaattctgtcaatttattctttgtgattgttgtagacaagacatggactgtcttgattgcatcagacaggagatgacacaaaacttgtgtttatagtttcttggtcttttgcattcatttttgtttttgtttgttttttagacagagttttcactcttgttgcctaggctggagtgcagtggcacgatctcagctcactgcaacctccacctcccaggttcaagtgattctcccgcctcagcctcccaagtagctgggattacaggcatgcaccaccacacccagctaatttttttgtatttttagtagagacagggtttcaaccacgttggccacttggtcttgaactcctgacctcaggtgatccgcccacctcagcctcccaaagtgctgggtttacaggcgtgagccaccctgcccaaccctccattcatttttaaatctttttttttttttttctttcaggagttcagcttctgtttctctcttaaaatcctgcaacaactttctatcctgtttagagttaaattccatcatgtgggctctcaaggccctgctttatctggctcctattaactgtgagcttcatctcatagacctttttcaaggcactctgtcctttttccagttcctcaagccagctatgctcatttttaccttatgggcttggcatgcacctgcctgctgcctggggaagtgttcaagattattgggtggtgcctccttctggttgttcagctcggtcttaacatcacttcctcagagaggccttcccagcctgaccactctctatcagatcaccctgctttcttttcctcatagcatttatcactatctgacagtttcttgtttacttgtttattgtatattctcactttacaaaatgtgggctccattggtgcgggtccatgtcagtctggttctctgctgtctcctcaagacccaaaacagtgcctggcacatagtaggtatttaataaattcttgtaaaatgaaggaacacatgagtcatgataaccaacactgtagttaccaagtgaaagcatctgagttatatgataggcttggaaagggtaacaaacccaggcctcgtgcttgaggaaggtatgttcaatttagtttacctgtaatacctaatcattaaaaaacacacagaattgatttagcataatttgtattctatttagaattaacatgtctctgacactttgactactataacatttaagagggagcaaaatcaaaagttagtctcatcaactttttgaaactcactttttttttttttaagacagagtctcgctctgttgccaggctgaagtgcagtggtgcaatcttggctcactgcaacctccgcctactgggtttaagtgattctcctgcctcagcctcccgagtagatgggactgcaggtgcccgccaccatgcccagctagttttcgtatttttagtagagacggggtttcaccatgttggccaggatggtcttgatctcttgaccttgtgatccacctgccttggcctcccaaagcgctgggattacaggcgtgagccactgcacctggctgaaactcacttttagtaggcaatatcaatatatattttatgctatattggttgtaaattaaattcaaatgtatccagtgttagtgcccatttcttggtaatttgagagttttaaaatttacctttctaattatatagttaatgcatatgatagaaaatttataaaatataatgattagaaaaaagaaataaggattatttattttgggataatcatgtatcccatcacgctgggataaggttgtggtatttttagtgttagtttttttcctgatacataggttatatatatcatataatgtacatatgcatatatgaatatatatgcatatacctacacatatcatacaaatatttatccattttcatgtgatgctataactaccacatttctatggctttcccctttacatgatattgggaggaaatgctttattccccagccctgatgttttattctgtgtggtagcagttttaatataataatattcctggattcttcctcttgtcagtctccctagaagaggaaaagtgacttgtgtaactggtgcatttggaataagatagtggggcatgtgcaggtctgtgctttcctttaggattctgcctacctgtaaagaccatataatctggtctgttctttgcaagtggtaaagtaagcccaaaggcattgtccctgcaggagagtgctgtggtttaccattgctgcctgtgactggtgagaaaatttgcttgaaggaggtgcagtcataaaagaatatcactttcgtgatttgaagtcacaaatgcagcagctctatcagcaatataattgacattttgatctctgtaggcccagttcctacgtctttttcaggcaggagagacagctgctatgtcttggtccactaaaacaccaacatatggcaccaaaaagtcagacaaaaaaatgggctgacaactttacaacttttcttgttaggtagccttatttcagcacagatatctatgcttgtagacaggtcagagaaacatcatggtaaatggtgttatggaagaagtcaggagtagagaggttccaaaagaggtttctcaacagagccagatactgctggaggttaagaaaaatgtgaacagaaaaaggctgtttgatgtgttaatgagtagataattggaagccttcaagtcctgattctcaaaatgtggttcaaggtgcattgggagggcatgtgatcctcactgcaactcacatgaaaagtgcaagttccctgtgcagccatataggtgcattctgtacaactgcagacttttttatgccaaagcgttattgagtaagtttttaagggttggtacaatttggtcttagtaaactaaaattagtatgttgtcagtatattgacccttttaagaggtgaaagagtgaggtataatgaagaaataggcagaacacgaagaccaattttgatcagaacaaaaggataaagacaggatggtaaacagagagaattcattttttccccatagttttaaataactatgacctttatactacagcaatagtgtcttagatgacttactcttccttcttaagctccctgcattactgatgagctactccttttaacacatgaaataacaatactaacagtattggtaagaatatgttgagacatttcataaacagttgcaataccaacttcatgagtttttcatatccttgctcagttgttgttatgatcaattgataagctaattaaaacaattaacaaagagctaaatgggtattgatagtgagtgagaaaagatacccaaatttcttgtttaaaaagggtaagatcttgtagacaaggacaatattcaggagcttcttgaattttgtgttcacacatttaaaagtgcttgcctgttttctcagttgctagggagcctgagcacagcttaacaaaataaatgtgtttgtgtgttcagatgttgcaggtaggtgagcgaataccaatcaaaaactgccacattcgattcctcaaggatctagaactagaaataccatttgacccagccatcccattactgggtatatacccaaaggattaaatatcatgctgctataaagacacatgcacacgtatgtttattgtggcactattcacaatagcaaagacttggaaccaagccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctcactcatagtgggaattgaacaatgagaacacttggacacaggaagggaaacatcacacaccggggccgttgtggggtggggggagtggggagggatagcattaggagacacacctaatgtaaatgacgagttaataggtgcagcacaccaacatggcacatgtatacatatgtaacaaagctgtacgttgtgaacatgtaccctagaacttaaagtataataaaaaaataaacaaataaaaaactaccacattatcaaataatagttaagataggggttagtaaggcagacttgggttcaaacctgggttgagtggccttggtcaaatttcttctcagttgaagaaaatgaggctcagtttcttcacctggcacatgggaatggtaactgcatccctttcatagtctttaatgtgggccctacatgagctattgataagggatcattggggtccgattttccggccagaaacctctgtggctggtggcacctttgcctgagttcttgtcctgcattcaggaagaatgaggtatgcagacaagtgaagggtgaacaagacaaagatgagctttattaagtgttagaacagctcagaggagacccactgttgatagctcttctctgtaggctggtcatctgtggagtgttcagctctcagcagagaggaggctctggagagggtagctcctctctgctactggttgtgcagacatctactgctctcagcagagaggaggccctggagaagattgttcctctctgtagctggtagtcccatcttcccaggtctctgaaactctcagcagagagggtagctcctctctgtagctgatcattctgtcctcctactttcagcagagaggatagctcctgtctgcagctggttgttgcctctccctcttcatctcttcaccctctgtctgctctggctgaggcctttatgggcctcagagggtggggaagtgcatgctgactggttcatgggcagccatgggtgggcccaagaaaaagcaccatgagctcctgctctgggtctgcaggactggcggccccggaccccaggctttactggagacctgcccttttctgcccaggagcctgtctgcctcccatggctatccatggtgcccaggctgctggcaccaagagacacctgcagttcagcacccagctgcccttagtccccttttagcttcccttctttttggcacccaaagtctggagggtctaaggctgtgtgggggggacggggggggggggcggggggcgggggttggcacgtcagcactgccctgagcctgtgcacacagctggggctgtgacagaacctgggctcagccccaaccctgctcccagattagagcgggtgcccggagtagggagaagcccggcaacagagacaggcactccaagcttgcaaaggtaagaatgcagggatgcctgggtctgcggtttgggtggctgcagctgagggcagagggagcagggttcctgcttgctcggtggagcgggaggcctagatccgcagccctgacttgggcagctgcagcctggcccaggagggcggggcttctgcctactcctgtctccggagagcacaggggtacccaggttgcagtggtggcctggacaccttgcagttgcacctggggagctcccacctgccaacttggaaggggcagggctcccgcttatcccagttccgcaggctccatggagcaaggcacctggccatgccccctggcagcctggggtgggggctccagatccttgctgggcctgggctagtagcggggttgggtcgatgctgccgagagctctccctgtctctccggagctccccctgtggcccgggagctcaggggctagccagagctcccccttgtccggagcacaacctagccccgctccaatgggcggtgcccagggcagcaggctgctgttgggggttctgtctgcctcctcccagtaccctccctgcagcggccggcatgatggcagcagccgcaccagatggccgccgctgccatcactattagctataaaacagctagaagtggcagataaaaagtaacagtaaactaggcttaaagatacgtgtttactgcacatcaatgttgaaaatgaatagtttagtgacttgcttctttggatattcagtacaaggggaagtggagtaacagctttgttgatgaaatgaaggtcttgaacatagtaaccaggatagtaataatatcaacattaaaaagtggcctgattggatttgcagtgtttacagttactgattattacacttgtcaaggagctttcaccaaaagtcaatcaaaaactctaggccccaggaaaaagcaatggtcaaaacaatttggttttgctgaaatgctatcatttgtttctggagagaatatatatattcgaggttgaaggtcaaaacggcacattttaagaacagtttttgaattcaaaatctctgcttccattcactctccatcctgtcccttcacattatggcttctgtgaacatgcaactcaaatcctaaatcatgtagaagactctttaaggacatctaattaaattcatattcatctttcttttcttcatttttaccactaccaattaaatattaatattgaaacaaagccaaatttaatgatttagaatagaatctcttatcctactcatttgaaatgctttttataacctagtttttccttcattagtctctgccctctattttaatattacctcttaattagtgtcccctttcacatcccctaataacattcttgtgataaaaacttttctttcatgtgcagagacctaaaatttagaaattacatgaagaacttttgtatattgttctggaaactttaaattctatacaattttgagtaagcccctatccttataagctgtttttaaaaattatgaaatggtgaaggtctccactcttccaagtacaaattcactggaggagataaagcttccataaaatataaaataatactctatatactttttatgatagtatcatttctatgctttgtgacttcatgtccatttatgcttgtaaaaatatttttataaaagttacagacaggtctatggatgaaatagaagaaaacagatttaacgcaaagttcctcagagacaggagaaaaatcacgatttaaccacaaatagatattatcctgggtacagtaaacaaacataatagcaagttacttgtttttaacagagttttcaattctcattattatatgtttgagtcaacagaactttccaccttccactcccctgattatgttttctatcttttattgggatgttatttttcccagttattcttgttccttgttctctttcagcctcccctccccttccttcagtatttctcatgctgatggcagaacccagcagccaaagcttgagttgaaaatgactggaatcagggtcaggcagaaaccctgtgtggccaaaagctcaacactcaggcaaatgtctgaaaaacgaggtcagacaaattcaggtttctacatccagccctatcaaaataacaaaactctaatcatcacagccctgacctcttcattcatggagcttttctgaaaggacagagacttctcactacagtgttcagtaagaattgagaccatgattacttcgaagaggcttttagggatgcttagaagtagatatccatgggcaaaataataatccttcagcccccaacgactttgcattctagtcataaactgatactttcctgagccattgaatatataaatactactcttttttaaaaaaattaagaaattaaaagtccttacaggtcattggagctttatttcagatgtgggtgaaataaggagatgggtaccttttatgtgcttatattcaatcaataggaatagactcttttgggactttcaactgatcacatgcaaaagcttaagctctgaaggggcacagagaccacacaagctctgaaacatcagtctgatcacaagagtagtttgaagtctaatgctccgtggaagtgtgttatacatttcctttcatttttattccctccatgaagtagtttatgtttcacttcaatggctgtaatgggattctgtgttttcacttttctggtgaactatacaattctccaagaaacacggtaaaatgaaatgaggtttattggcatgtggttttaacatgcaaataaaaactctatgatttaatgtctttcaacttttttcttagtaatcctgattttttctgtcatgggggaattaataattttctgcatggttaaaatgaataaaggcagagtgtggaataagttttagctagtgtttttgtggttctttcaactgaagaaggatatggaaaaataacaataagcatataattttccacaatgtgttattttagtgattagcaccttgagaactgtctcatttctagaaaagaaagattctgagtgatgttgtctgcagcataactttgatgcacaacatgactctgcctatttcatcctgttattacttctcaattaccacaataagagtcttctttttcttttaggaagattgaggtcctggtatttattaggactgcactatgtctgatctaattattaactgttagaagtatatatattgatcagaaaaacaagggaaactatttatagcttattcctttttgtgacagccaaatatagacatggctaatttgatacaacacaatccagcatcaattatcaactgagtaattcgcaatagcaatttttaaaattaacttgaagagtatgaatgctgtagggcaaggtattttagtgtacaaggctaagaagccacatcttctttaaagcttaatttcttttaaatgaaagatttaaacaggttagtcctcctcatattaaaagctatataagcaataaacattacaagaaaatcactaaaaaaactttcctttccctttagtctaaaatcttgctgctgagccctaaatcctgctggaaattcttgccaagccatcatttggcattattacctgctcatgtctcacaccagagttgcacttaaaaaaataacatcaaatctggcagccctatattttgtgggaaacagagcttgacttcttgaatcaaataatttatttgggccatcttgatgactgttttctgcaatattgaatcagacagaaagttaatccaattttattattaagatggatgtaaacaccagatgcattattttttgacattgttattcatcatcaaggaccacagataaaattaaaattatctatgactttgtaccaacactagaaccattatattgtttttaaatattgaaactaaattcttatttttaatctttgttgtccagaacttcgtacaatgcctagaacacagtggaaactaaatacatactttttgaaataaagttaagtggaataaacattgggcgaggtttttcacctcaggatagcactttctatacagattaataaatttatacatcattttaaataagagccatatttaagccaacattaaagagtaaggttcttggtttactgataaaaaacaacaaagctgagttccccagctgggaatttagctgatgatgtctcatagcactgactttcactcactggaccctacatgcaattataacagaagatactgactagtcttttagtgaagtctgcacacaaacacagggtatccgagatgtcattattataaaaatgtctagatttagtgaattaacccactgtaaccctctctcaattttcgtttctagttgtagtcatcttttccctgatgtcagtgtgggaaccacactaaacaaaacaaagaaaatatctgctccactcaatgtcttttaagaacttttgagttctgttcaagtgaacatatttataattctactctccttaggatgattatgaactttacaagaaactccttatgattatggtagatatttactgttaagatattttgaatgactgcatagcattttcttttaatttcagacttttaggctaaagatatttccctagatatcacataagttctatgctgactcatttttctacatttacatgaacagatatagacataaatcttaatatttaccctcctaagctcttaacattacaccgaggaccctctgcctatcatgagagattatctcacctgtttggaaattgactgcatgttgtgatgaagtcgacttccatttgcactcttctttgtgttatttccttaccatagcaagcaggactaatcgtaaagctttctaagcttgtgtgctgagatgaagcctcatttagtcacctggaggtaaccgcctggtactgtttctagagacactgcggatcccaggtctactgcagcagcctgtgctttcccaagagatatcccaggtgcttgctgtttcaacagtttactagaattgaaattcatggggattttttttttccatgggaattagcaaaactgtaagatgagaactttatgggctgtggacaaggtgtgttgcatgaggaatgtttttatcttcctgaccaacatggcacatgtatacatatgtaacaaacctgcatgttgtgcacatgtaccctaaaacttaaagtataataataataaaataaaataaaaatattaaatactcataagctagtttcataataaacataaatttcttttcaaagttccactatttccaccaaaattttcttacttggtgctagggtctttatagatatcttattttagcagtcagcatgacttagaaacaagggttattattaatttttatattgattggcaaattaaagtgactcaatcagaggcaaagtaactaatctgggattcaaatattagctggtctgattccaaaactgatgactttttttttcttaccataccatatgcataccattatgattgaaccctgagggatttcagataactgttgtaattattattattagagaaatattttgtctaaaaatagatggcaacaaaaaaattaagacattatctctgtcttttagaagctaatagtctgatagaaaaagggtagttgaaacactaggaattccatgaattatggactcaagttatatggcataactctaggaaggttacaataaaacaatcatttatacattactggccacatggaattgattttaaggcaatagggcagtgttaagggtattaaaaatgttcataatctttaatccagtaattccccatctgcaaatttatcttaagaaaatgatctcaacgaataaaaaataagtaggcacaaatattttctttgcaacataatagtaaaaaatcagaagcaacttaaatgaacatcaacagtaaaaaggataatgttacatcaacaggagataattgttgtctaattctccctctcattcctgcatcattagttcaccctttctactagatttttctaatttatattcaaatgtgttataatatttctcatattaaaacaaaagctgaacaaatccaaatatcctgttattcagctaccattcctttttttaatctcctttataaacaaaggtctcaaaagagttgcccatatttattgtttctaataacgctttccacctcccattctccctgtatcagctcctgttaaactaaaccaggattgctacatccaatgttcaatccttaatattcctcctgttgatcttccttcttaacacaaatgattccttcctctgccctgataccctttcctgcctaggcttccagggtgccacactttcttagtttttcttctcattggccattccttttcaagttccctttgcttatttgtcctcatcttcctcacctctatacaatggacagcccaatgctcaattcttagtctcttcttttcctctatagtctgaaatttagcaggatctctcccttagaactcaagactcatgcatccaattgcatccttgacatacccccttaaataaccaactggatcttgtccacactgaactcctgattcctactctactcacctctaccctacatctgtttctctgtcaattctcttcctttccgtaactagcaacttcaatctttcatgtgctcaggttaaaaaaccagccatcccaggaagcggaggttgcagtgagccaagatagcaccaccgcattccagcctgggtgacagaaggagactccatctcaaaaacaagagacaaaaaacaaaaacaaaaacaaaaaaaccagccatcattcttgtctcccttctttctctcaccctccagagttggtaaaaccagttagcattacctatcaacaatattcagaacaagaccacttctaccacctccacatctatcatgggccaaagccacatctatcatggaccaaagccactgccaaagcagttctccctgcttccactctgcttttattgtttattttctgcaaaaacctggagtaatttttgaaaccataaattagatcatgtcagtactttttaaaaaaccctctggaggcttctaactcattcagaataaaattagaatctgacatggtcctatttgatctctctaatagcacctccccatcttccaccactcttctttgacttccacttcatttattctagtctccttgctgcttttcaaacacaccaagcccccgccagcctcagagcctttttaaaaactgtctcactgttagaaatcctctgagatatatgcagggctaactccctcccttcattcaggtctctactgaaacattaccttttcagagatgcctccactaatcagactcttttagaataccacgtttcctgtcaccgtctgcctgcttaccttgctttattatttttttccttagcacttctcatcattgatgtattatattctgttcctattagaaggtatgcttcaaaaaagcaaggattttgactgttttgcttactgatgatccacagagcctaaataatgcttggcttatggcagaaactcaataaatatcttttggatgaatgaataaagcaggtctataatattaggtaaaataaacataatgcaaatatatgtatatggtaattacaactacataaatatgttaaagtctataagatgtaatggttttttaagatacaaaaaaatgtaaaatagttgtgggtgatggaatttgaataaaatattttgttgagctgatttcagatatttttaaaatacaaaattaccatgtgtatctggaaaatgattgtggttgacagttacagagaatgcagtggctatttttgagaaacgacttgcttcaaccacatatctcagaggaaaaaaaacacagtgatttcagagttaataccactccccacatttggacatcatctcccattaggtatagcacaccagttaagtgctatgattcaaagtcagactgggtctgaagcataactcttcaactcagctggataaacctgggctagttacttaacctctcacaaggtcagtttcttcatctgaaagagaagataatggtctactacgtcagaggttgttaaggggattgattgagaaagcttctaagatgtgtagggtgttgcctggaacctaatatgtactcaataaatgttaccataagatagttttgttattattaagttgggcagagattttcagcgatgaaattcaaaatggttaaatgacaactaataaatggcagaattaggccttcttaccccatatttaatttttcaactatgtcatgtggctactcttcaggtgacaagtaaaggttggacccattctgcttagtatggttgtctcttggtgaacttttctgtcatatcttgtatctatgtcataatttactaatagtggcatctcataagtgatgtaaatttcaaacttatatcttgcaattagcttattttaaaaatatggacaataagatgtaattattttaaagatagtttaaaacctttaagtttcaaataattttcaaattctcatataggggataggtattaagaaaaacactaaattttgtacccatgctgacttctgttatatgagaggtcttcaaaatcttcatggaaaatgcatattatgaaaaaagatgcatcaatttaaattttttttgcacaaagtaaactcaaatgaacttgttgtaacatgtctgaacaggatctactttgaggcactaagaataatgagatatcagtttgaaaagagcccctgtcagagcaacattaattcttccaaaattgaagaattttagcagaattctttccatttaaggaaagacaaaaaccaaatttatggtgaagtttggatagaatagtgaaatcattaatgatctactaaaagtttattgagacaatgtaccaaagagatcagcagtttaccaatggataactcgttttaagaagggatgagacaatgttgaatgtgaagcctgcagtacagatcatcatatcaatttgcaaggaaaatttttatcttatttgtgccctaattgaagagggacaatgattaacagcagaaacaatagcaaatactattgacatctcaattggttcaggttacacaattctgactgaaaaattaaagttgagcaaagtttcaacatgctgggaatcagaatcatgctcagatcagagcagagttttcaatggaaattctaaatacgtgggatcagaatcctgaagcatttatatgaagaattgtaacaggagattaaacatggctttatcatttttaatcttgtacaatcttagagacaaagcataatcaaaacaatggctaccaagaggtggaagtggtccagtcaaagcaaaagtagatcagtcaagagtgaaagtcatggcaacagtcttttgggatgctcgagacattttgtttgttgactttctggagggccagagaacaatgacatctacctattatgagagtgttgtgagaaagttagccaaagcattactagaaaaacacctgggaaagcttcaccagagagcccttcttcaccacaacaatgttcctgctcattcttccatcaaacgagggtaattttgtgagaggtttgataggaaatcattaggcatccaacttacagttctgatttggctccttctcacttattttggttgcctaatcttaaaatatatttcaagggcacaaatttttcttcagttaataatgtaaaaaatactgtattgacatagttaaattcccaggaccctcagttctttagggatggactaaatggctggtatcattgtctaccaaagtgtcttgaactcaaaatggagcttatgttgagaaataaggtttatatttcttatttttatcttttaattccattttccatgaactttttgaagttccctcatataccacaagctaaccacatttctttactaatgaactatttaacaaggtttgaagaaatgagggagaagatggtagctagttaagccagatactttgtctctagaatcccccccatagacaacagatgaaaattctggaatcatatgtgaaattttaaaaatgtacatgtaatcacattataaatatattttgtaaaaggtgtttgttgcttaactcagttgccaaaaatacagacctaatatgagaatggccattgctagaaataatggtgtgtccacctggggattcaggaaaatctggcataaccagaaggcctatgagctagaaatagtgatgtgtctatttacatgaatgactaaagaacttcttggaatggaatttgtcctaagtgacatgagggctaggtctcaaaagaggaatttaaggacaataaactggagtgaaatggaggggagggaagaggaatgtagatcaaaacttgtgtcagaactctggggaaatgaagcttgaaataaaacaaaaccaaacgaagcctttacgacattttgggcaaatatataactaacgaacacacacaaatggaggaaaagacacgagagaagactccctttcctttggtggtatttagtgcagagcttcagcccagagggcctccgacagctgatcaatacacatgggtcctcaatgacacaggaccttgaaccccagcagcaatcagagaacagtgtccttggtgcagatatcaatgacatcaggatcaatcctggaaaccttgacatagccacaggcagatactaccactgccaacaactatggcaatttcctatgcacaggagaccccatagaaggtgacccggagagtaagagcagaaaacttcacttctgcatatgtcatgcaaaactaaaagaacccttcttatgacagcaagtggatgtcttctagagattcagggtgggacagttgagaagggctagagatctagtgatagttgatgtgtagaggtgtggtaagagagagggtagggagattataatctctgttataatgcaagtcttattgccatgctagtatggctaaggcaatatatatttttttaaaatccttttgggatgccacatactctaacatattctccttgtcatttttcacctggcttactatttctcaaaattctcaaaaggtctcagttcaaatgaccctttctcaggggctcttttgttacacacccaacttatattaaattacatctcctatttcctaaggtgacattctttctaaatataactgtaatattctttgaagactcaagcaagttcaagtaaataggatgttggaatagcttcaaaacagaataataagaaatgtgatcaacctttgatgattttccagaaagccacaaatgaaaatttcatagtaactctaaaataagataaatcctcatccactgaatgtgtgagaataaattcactgtttgttattaactcataagaattcttctgagtatattatttttgactttttattaccatgataaaaatatagccacatcatttattatttatacagtccattagagtttgtataaatatcatttctatttgtatcacaaactagagaaatatatgagtacctcaaaatttattattctctttaccccaaagccagcggcaaaattttaagatttattgtcattgttagaatcattcttgatacaaaaagtaaacaaaaatcttaaatatgtttggttaccaaatgcatcttatttgatgtgcatactttacggtgttgattttggagtactgctcactgtcatgtgttttgaggaaggcaattgctaaataacaaactgtcagaaacattttattgggtcctatatgttcaaaatgtatttagtagattttttttttttttttttttttttttttgacacagagtcttgccctgtgacccaggctggagtgcagtggtgcgatctcggttcactgcaacttctgcctccagggttcaagtgattctcctgcctcagcctgctgagtagctgggactacaggtgcttgccatgaagcccgactaatctttatatttttagtagagacggggtttcactatgttgggcaggctggtcttgaactcctgacctcaggtgatccacctgccttggcctcccaaagtgctgggattataggcatgagccgccatgcctggccgtatttagcagatttttaataacagataatctgtcttccatttcatttgactaccctgacataggcacaataaaagtgagtaaaatgagtttatgtgtccctcatcagaatatacacttttttttaacattatagtttccctagccttgtaaacaaacattgactctatgactgtgaattaaatcttaccaagtgccaattagcacctttaagacaaaatagatatgtgatttataaatatgtgttttggtttaacataatcagtacttttatcagtgctaaagataatcatggaagctaaggaaaattacatgcttctcaacaaatgtattagatccctgccctgtatctcaaaatgaattaccaaggtagaaaacacatctcttccattgagaatttacgtttttaggggatcacaatagacataaagtaaaccatgaaaaggaaattaatgaaatgccacagtggctgtatatgtatattaaaaaaaaatccggtgtgatttaaaaaaaaaatttaactaaggccgggcatggtggctcacgcctgtaatcccagcactttgggaggctgaggcaggtggattatcaggtcaggagttcgagaccagcctgaccaacatgatgaaaccctgtctccactaaattagccgggcatggtggcgtgcacctgtaatcccaactactcaggaggctgaggcaggagaatccctcgaacctaggaggcagaggttgctgtgagccgagactgcaccactgtactccagcctgggtgacagagcgagactctgtctaaaaaaaattgtctaaacacattataaaataagcaataactgatgaaggagtatggataagtcgtatccttctctttgcttttgactatgctttgctctttcaagctctctctttggatatactgcttgttttgtttccctggcttgaaatgaatgtttacttgattcactcaacaaatatttgagtttctaatatatgccaaggaatgttgggcatacagtagttatgaaggcctcatctctgccctcacagtcctgtgaaagctcttttcttctcttatcaaaggcaaaatccctccaattatgctcccatccccaactgtgttctcaagaattttcttcccttttcattttctacatcatcagtttctccttcactactgggttactcctacaagcttataaatatatataagctaccttgaaaattaaaccttcatagattccacatctctctctacccattggcccatttctttgtttccacataaagtattttcaagcaaatcatctacagtttctgcctcatcatcatctctattctgctcttcaatcactctcatctgacattatctcaacaatggaaagaaaccaatcatgtcaatggtctcaccaatgacctccaaactgccacttccaatagacactgtgtgtccttatctagttctcaggatcattttggcaccattgagtactcttgtcttcttgaaactttcttctcttagcttctgtggcatcatatattcctgggttttctccaatgccagtggtgttctttctcatctccttcactggctcctcttcttctactcaacttcttaatgctgatgatgcttagggttcctgcctggacactttctatttctactctttctattttttatactctttccctaggaaattttattcagtcccatgttttacacattctatgtgctgatattttccaaatgtctctgtcttcagccaaagtctttcctctgagttccatagacttttatatttaactactacctgatatctcgattgagatgtctgaaaggaatctcaaattcaaggtgcccaaaattgagatactgattatttttaaacctgttattctaacattcccattttagtaagtggaactactaatcattcaattatacaagtaaaaacctgggaagtacctgtgaatcatgttcttccctcaccacacccactccatcctcagatatgttagttctgcttccaaatatacaataaaatcttcccatttttatctgtctccactgtcagcaccaaattcaactactgtcatctatgtcttgggatactattatagcatccctgcttccattcttgtccctttccaatccattcttcatataacatcaagagaaatattttaaaaatatacacgagatcaaatctattttatctattcagtgcagaaactctttaagttgtcttttcctactgcttttacaacaggctccacagctcaccctggtttacaaagccctgcatatctaagtctctggctcacttcactggccttgtctttctttccagtgctccagccacactggcctagtttctgttttgcaaacccttgtcctggctcttccttctgttcataatgtgatctgccaaatcttgaaatgctgcttactctgattcatcagatcttgacttaaatgttcattttcatggaggctgctctaatcattttatctaaagaagcaccccacccccaccctcatcacattctctatctcagtatctggtatgtatcttacatagaccttattatagtctctaataaccccatttgtgtgggcttatttgttgtctcaatgttagctctttgaggagtaagccactttgccttgtttaacccagtacctatcctagtccctggtacataactaggtgctcaatagattttttgttggataaataaatgcaggcaaacagaaaataataaaaagtgtaaagaaatagtaaataacaaaaagtagtctaaggaccttggtagaagaagtataaggggctccataagcaatcttttaagggcaccaaacccctcaatcagagaaagacaagtctaagatccgcttacctccctgaccatacctgtacacattaatttttatcctcaaaaaacagtccagagtacctatagcttaaagtacaccatttagccatgtaggataagtctatgtctatgtgtgttggatatgtataccatatacacataccacatgtatgttatatatacctatattaaacactcttaaatctagacatacctcaatgtattatttcataattacttaagtatattgttcttgattcctcagttgttaaaattttcaattgagctcccagaatcgcatgtttatttcctctaaaataaagcttcatctttgtgtattgagctttggcaagatgacatttcaaagaaattaagagccatgagagaaattaatatgtacttctaacaagcagtgttcagatgtaatatttatatttgtcattaaagatgttacagcactgatttttttttaccctatggacatatattttcacatagatatgtgtgtgttttcttatgaaatttccattaagtaacaaaaagtcaattctttcttggaaataaacatcagaaaatatctttggtgatgagaaaaagaagagcactctaaatgtttgatgtgcaaataatttcaaagaagagatgagtttttataaaataagcccagtccaagccccgttttttaaatttacagcatccacaataatccatgccacaaacactttgtcaggtagcagggcaggtcatggggcagaatctcagagagagcagcagcaggtaggcttcttagccagcccttttaattagcagctcatcataaatattaatcatattataacggtgattcagaagccaatagtcacaaagatatggttaaaatacatgacagcctagacagttctcgtctctttgatgttcagtctacctatttacctggaggtgcagccagcatctgggaatatgcaaccaatgttggaaggcacttgagactgtaatgaatgtgggcacatacattagtttggctatttcgctaaaataaaataccaaaagctagcaaagaataggcatactaaaacacctggagtgcatgatcaagccgcttcctgtctcttgaaatctgtctaaaccctttcccccctacccactgcattttagacatactgttctctctctttttttttttttgtgctgaggttatagagcttgatgtggaagtccatgagtacttacaaaatgcgatatggtatcaaagagaaacaggaacctgctgacacattaggccagtgagtagggcaaaaaaggatggggctaagaggagcaataagcagaaacttgaatatataaaatttcatatcaagaataataaaaagagctaacacttaggtagcacttgctatgtcccagtcactgcaaatacacttaacacattgacccaattaatctttacagcaaactcataaagtaggtatttttttcatttactaatgaggtaactgaggctcaaaagtattaatgaggccaggcatggtggctcatgcctgtaatcccagcactgtgggaggcggaggtgggtggatcacctggggtcaggagttcaagtccagtctggccaacatggtgaaaccccatctccactaaaaatacaaaaattagctgggtgtggtgacacgtgcctgtaatctcagctattcaggaggctgaggcaggagaatcgcttgaacccgggtggcggaggttgtagtgagctgagatcgcactattgcactccagcctgggagacaagagcgaaactccatctcataaaaaaaaaaaaaaaagtattaatgacttttcctaaggccacatgcctattaagtcatgcaccttctccccacaaaccccaccacacatggtgtggtattcattaacatggagaagatcatatttaaattagttttaataacaattttaaaaaagaactactgtagcatagtagaatgagagttaaatagagtaaaaagatctataataaaatataaagatttaggttatgaccctgaatcttcctctaattgtacaaactaggcagttcctttatatatctgttgttcagcattcttagttggaaacagatggagttgggctctaccttcttaaagtccattgtcatggttaattttatgcatcaacttggctgggctatggggtaccagatatggggcacccagatatttggttaaacattattctgggtgtgactgtgagggtgtttctggatgacattaacatttgaattgaaaaatgagtaaataagattgcctccccattgtgggttggcttcttccaatctgttgaaagcctgaaaacaacaaaagactcaccctcccccaagtaagaaataatttactttctctgcctgactgagtaggtacaccggttttctcccgctcttgtacgtggattcagattcgaacttacaccattgcctttcttggttctcatgtctttggattacaacttaaacttgtatcatcagctctcctggttttcaggcttttgtactcagactggaactatactattggttctcctggatcaccagctagctgactgcagaccttgggacttctcaacctccataaccacatgagccactccttataataaatctatctatctatctatctatagctatctatctccctccctccctctctatctcccattggttttgtttctttggaaaatccagactaatatatccatctaatattactggcaatccagaataaacagcttttcctaagatattatgattgaactcttctttctcccacatcctccttacagaaggttttggctttcatcctatagataggagggtaaaaacagatggtgcaggggtgtcgcagagtaggttgtggccacaaaattgagagaatatttattggaaacctgtaagaatcagtttgtctttagctcacattgctgaacagaatgattgtacagtataaataattgtcaccctctactttagctccttttcctgatagcaaagaaaaaatgttagatcatatggcgttctcattgaaataaaataaataatactaaaagaattattgaattatttataaaatacaagcagcaccagcttaaaacagctgtctttgcaaacataatttgttaaattaatacaacttcgtaaagagtaatattttcacagatgtcttttcatgattgatgaaatactgtctcatttactctatcaggtaatgatgagcaaattatattgagaagacttatgtaggagaagtcatattttgtcagattttaatcaatatatggtcatgggaattaggcacaagatacaaccattaaaatggctttaaataataatggcaatgacagggcagtgattttgttatttacctccaaatgtactgttacactttttgcaaacatctgttagataataattaagaaataagtcacattaaagtgctgagatttttagagattatattgtcttatctctctaaatttacaaatgcatttaacgaaatttagagtaagttagtttcccatctggggtcatgaagctattggaagacctgggcttccaacccaggttttcagatgtctatgccagggattctttctctttgtttccaacatttataattggtgtctatatcttgagatgtagcttttcaatatatgattctgtgagactataaataagtaattactttcagtattgaataaaatttcttccaattttgtgctttggaaattgctgatttaagaaaagttagacctgaaatgtcaatgtgaatgtaacttttggtctacatatgtcaaatttacctactttaactcatgagaatgagtatttgggcaaaatattatcatgtagatttggtttatattacatgcccacatagaatagaagccaatttgataaggctatctgttaattttatcttcaaaacccaaatttagaaagaatatttaccatatcttagaaaaataaatttttgattcagggtatgtgaagattttgtcactaaagcagttgccatcagctcatgagccaaattgctggattgtgcccctaatctctgaagcgctccggggggcataatacagtaattccaaatttcaaatttttacagaatttcatttctttaaaaccttctcctggccagtagagtccaggggccagttctgagtatagggagttagcacctgcagatcacagaaataaaattgcagggcaatcaccaaaagaagcactctttgggtttgtcaataccaagtcaatatgtccagagttgaatactaaatctaagtgcaaacaccaagaagaagcagtatgcaaattcaagtagacaagaggccaacaagtacttcacaaacatgtaacaacttgaagcttgtggtaaaaagatcagttggaagatctcacaggaccactggataggtgctctggtagcttcccatacagttcccataggttctactatgagaattctaggatcatgccgagacaatgctgcccatggagaaacagaaggaagtcatgcagaagtaaaataaggaaaatataatgcctgaggaaagagattctctaccattctttactacctatcagaaggcaggtcagtttcttctttctaagcatgattaggccatttgtatctatttgatgaggaaacagaattgaaaattattctcagaaattatttgcaattgatcttctttactgccactaaggtgtgcatgcatgtgtgcttgtgtatatgcctgcatgggtgtgtgtaacatgcatgtgcaggtgtgtgtgtatttatgtattcaggtggatggcgggtctaggataagaggcacataggatgaaaaatttaaggagatacctactgttaggggagtgcaagcatttggcattttggaggtttagaaatggaattcaaataagatagtctgtttgcatgaccctgagagtgagtgtcttcttaaattttttgccctcaatgcctgtcttgtttcacctgttcctggctctgtgtgtgtgtgtgtgtgtgtgtgtgtgtgtgtgtgtgttaaggttaactttaaatttgagtctttatttcttgtatgcttgttatagttaggttggttagctggctattttctttaccatttgaagacctctgggccgggtgcagtggctcactcctgtgatcccagcactttgggaggccaatatgagtagattgcttgagctcaggagtttgagaccagccttggcaacatggcaaaaccctgtctctaccaaaaaatatataaaaattaggcagccatggtgatatacacctgtagtcccagctacttgggaggctgaggtgggaggatcacttgagcctgggaggttgatgctgcagctgcagtaagccatgatcacaccactgcattccagcctgggtgacagaaaaaaaaaagaagactcctgatgctagctaattaaataagaagtaaacttacctacatcttcatagaaatactataccaatatccatatggctcaatacaatttaagaaagtttgctcagggccacacaagaagttaaggacagaaatgggattagaatcagtctgtttcctggttcctggcttccaccacactacccactgacttcacatgcaaagacagactgttgacagccttgatgaacgtgcgaacatattgtaaaccacgggtcactgcactggtgtttgcagaaactcaaatttcaagatgatcattgctacaaaaagaaagttttagtttccagattgcccattgtgaaaatttgaaaaaacagtataaagaaataaagatcatgtccatatattcactaaaagatagcaaataatattttatgtatctctccccatgcttattttgtcacacacgaacgagatagtatatatcctttatatcattaatttttctttcacaggaatagccttttattttctatgatgttattcttttgctgtcacttaatatttgatgccattttctaaaccaaaagtataggtttatcttagcattgtataaatattttaaaacatttaattagatcttactgatggacatttatgctgtttctattttatcctgtaacattctttttgtacttcttgcagtgctttcttagaatttatagaattagttaaaatcaatgatttttgagggagtttatgtatatatgtatatgtatatatataattttattatttattattatttttgggacaggatctcattctgtggcccaggctggagtagagtggtgtgatcatagctccctgaagcctggagtcagctatgatcctgggctcctgggcttaagcgatcctcccacctcatcctcccaagtggctgggactacaagtgggcacccccatggtgggttccttttttactttttaaacttgtgcagagatagagtctgcctatgttgcccaggctggttgtaaactcctggtctcaagtgatcctcctgtttcggctgggactttttataattttgccaagttgcccttcagggaggttgtaaaatatgaatttccattagcagtttattaaacatgagttgtctcatttaatccttgcaacaaccaaatgtggtagataatattattattcccattctaaggatgaggaaattcggatgcattgctcaagattatataggttgtaagttgtagagttgaaatttaaactgtggcagtttgactccagagcctatgctcttaatcactaggctatatacacatatatagttctaatattagaaaaattatgtatatgtatttcatatagcatgtgtgggtcttggccagaaacagaatgtggaatataattgtgccaaagcataaagttctttatatgtaatatatagacctttaagttctgatgtggtctgccccctggccaagtggtacaaaaggcattgatctggtagatttcttaccctcacaggtctgagttgaccaaccaaccaattacagatgtgtcttcaggagggaacagggagaaactagagcattagatccattcacttgcatccaaatcctatgtatattggctgcctgtttggaaatcatttcaaatgaaagcaaccttgaactggctctgagtcattactctagacagactctagagagagagagagaacatttcagcatttcaatagaacccacagtaggagacattgtgtggctacaggaaagtcttgtttgggcttagtaggtgataagatacgcagtttgaccatagatattggcatatatacaagatatagtggttggaaagaatgaacaagtaatgcaggttaggtccaaatcatcaaggaccttgattgctgggctatggagtttgagtttgattttgtaagttctgggaaactactgaaagttaaaccatttgtcaaagcaataaaggtcccctatgaatgaacctcaaaatctgtttgtaaattcacagcacataacttccttataaaaacacttgtacattctcttagatccagacatatcatactaccatttgcctcttcctcagacatgccgtgccatttttactcctattgcctttccattgtttattctgttcggaatcgtagttcccatttcctttaccaaatcttacttatcccaaaatccccaacctaagtgctacttccatgatcttactctaaatcagaaattgctcttttcctgtcctacaactgatttctttctgtttgatttagttgttctatgtggggatagtactgggagattgaccccacagaaattctcaagtccctccttttctcttgccatttcccacaagacgggttggaaaaactaagtactcatttctgcagccttccttacagctaggtgtggtcacatagcacagttctgagatgtctgcaaggaacttaataggaaagcttatgtttccttataagaaagacatgcagtagaagggaactctttgtctctttccccttccttccttaaacactgacatgatgcttagagatgtgcagctattttacaaccatgaagtagaaagtacaaagccagaaggcacatgcaaaggatagacaagtaaagggatgggacattgttgaactactgcatctactcaggactgctcatgtgtagacttcttatatgtgagaagttaaaattatttattgcatcatcctcttaactgaatttgttggtttttgctgctgaatgcatttctaataaatgtaatctacttgcccaccttttaaaaaaatgcattattaagaactatagtcatcatgtcatacaatagatagcttgaacttattcctcttcacgaaattttgtatcttctaaccaatatcttctccccccaccccaccagatacaatgtacttgtccatttttaccactggattctaaattttagttcagtatattttaaattccttgatggaaagttttaagtatcttacagaccggctgaagccatggcagaagaacataaattgtgaagatttcatggacatttattagttacccaaattaacacttttataatttcttacgcctgtctttactgcaatctctgaacataatttgtgaagatttcatggacatttatcacttccccaatcaatactcttgtgatttcctatgcctgtctttactttaatctcttaatcccatcatcttcataagctgaggatgtatgtcacctcaggactctgtgatgattgcgttaactgcacaaattgtttaaacaatatcaaatctgggcaccttaagaagaggataacagcgattttcagggaacaaaggagataagcttaaagtctggctgcctgtgggctgggcaggacagagccatatttctcttattactgaaaacgggtaagagaagtattgctgaattctttccccagtaaggaatactaataattagcagccctgggaaaagaatgcattcccaggggaggcctctgaaatggccaccctgggagtgtctgcttttatgcagatgtagatagggatgaaacacaccctactctcctgcagcacccccaggcttgctaggattaggaaattccagcctggcaaattctagtcagactggttctctgctcttgaactcttttaagatgtttatcaatgacaatgcgtgcacagtgggacatggaagttcattagtgattctagttgccctgaacttgtgatcttgccctgctcatctgccttgtgatcttttgttgcccttaaagcatgtgatctctgtgacccacaccctatttgtacactccctcccctctgaaaattgctaataaaaacttgctggttttacagctcagggggcatcacagaacctgctgacatgtgatgtctcccttggacacccagctttaaaatttctctcttttgtactctctccctctatttctcagactggccaacacttagggcaaataggaaaggactcacgttgaattatcggaggcagtttcccctgatactactgaaagttagaccatttgtcaaagcaataaaggtcctctatgaatgaatctcaaaatctctttataaattcagagcacataacttccttataagcacacttgtacattctcttagatccagacatatcatactaccatttgcctcttcctcagacatgccgtgccatttttacccctattgcctttccattgtttattctgttcagaattgtagttcccaattcctttaacaaatcttacttatcctaaaatccccaacctaagtgctacttccatgatcttcttactctaaatcagaaattgctcttttcctgtcctacaactgatttctttctgtttgatttagttgttctatgtggagatagtatagggagattgaccccacagaaattctcaagtcccttcttttctcttgccatttcccgccagaagggttggaaaaactactcatttctgcagccttccttacagctaggtgtggtcacatggcacagttctgagatgtctgcaaggaacttaataggaaagcttatgtttccttataaaaaagacaggcagtagaagggagctctttgtctctttccccttccttccttaaacactgacatgatgcttagagatgtgcagcttttgcaaccatgaggtagaaagtacaaagccagaaggcaaatgcaaaggatggagaagtaaagggatgggacattgttgaactactgcatctactcaggattgctcatgtgtagatttcttatatgtgagaagttaaaattattcattgtgttagcctcttaactgaatttgttggtttttgctgctgaatgcatttctaataaatgtaatctacttgcccatcttttaaaaatatgcattattaagaactatagtcattatgtcgtacagtagatagcttgaacttattcctcttcactaaattctatatcttctaaccaatatcttctcccaccaccccaccagatacaatgtacttgtccatttttaccactggattctaaatttaagttcagtatattttaaattccttgatggaaagttttaagtatcttcatctttgtatttattttttgttgatgaactttgaatacagatcctcaataaatgctaaattgattgaatatggtttcatctatcaatacgaacaattcaaataaaagtgtgagagagaaactaaacatgaccactaaataaacattatgtaaagtcgtacttttaaaaacgatattctgtgaaacatttcttttagattttaacttttcccttgttgatatattatctaattttggacaaaggtgagctcagaatgttgctgagccagtttccaccttatttagatggacttcgaaatggaaagcatattagcaatttgttttcataagatatcccacaaggaaagaataaacaatcaccagcagtcatgtaaatacagtgggacttttctagtgacgtcatcatgtttcactatttatcactcctcatttggactattcccttataaataccgccaggtaagcatcagatggtttgtgaagccttaaagagctaccctgaagttattttcggtagctctgtccccaaaaaaacctcagctaaaattaataagcaattggtgcagttgaatgggatgattcaaagcacatacagtccctagaatttgctttgcagaagtcaggtataaaatgtcaagtggtagaacagctcagtgtgtatttcctaacattaggtagtaatattaaaaacacttattctttaagaacgtagacataatatcattactttcacagaggtcttttccctcattttctaggtacacgcaaaaattagtggcaaaaggtcaatgcattaatctctttgagagtcatcacttaacttttaacagttatttgattatcagttttaaaagatcactttcttgaatactgaattaatgcaacgatgttactgttatgtataataaatatgaaaatcataccaaaaccttaagttgcctggaggtgcttactgagaaatcatttctctgataaattgtttggaagttaagtagtttctcaactagaatgagaatgctctagtgagaaatgtacctaaaattttaaatgacaatggcaatctcagtgccatgcctatttctttctccttaacaaaatagcatgattatatgtctatctttcacagaaagacaaaaactctctgagccaattacctttaagacctcatatgtaagaaaagcaaacctaattgaaatgcgctatggcaattctatgactgcacatcctgtcagcattaactaggatttgatttaactgattattctcctaaagagaaatgcatgttagtgaatgtgcagtgaagcgtttaacaaaaagtcagtgtgcccttaggtatctttgtgatttctcggagacagtgaggaccgtaggatgtagattccctataataaaacctcacatcaataaaaacacaagataaaaaaaagagcaacttcagagtaaatgttagatgtttgcatttgatggacgccactgcagtttctcaaccaatgcataacaaacaaggaaaggtactgttctggaataataatttcacgggacattattatgaactgacaggtgcctacaaaatatgacattctcatctacattttatgtggattttatgacagaagttcagtaaacattctcccaaatgtgaaattctttgggcagctttaaaagcaaatgaagacagacatgatatttgtagtctggctggttaaataggtgaaagtatgcatttttaagaatgctttggcggttttctgagaaaaaactgcctgcaaaaggttcaaaagcaaatgctatagctcttaaaataaatgcttctaagtgaacaccattaggtagaggcaggcctccatgcaaaacacagcagaaaccttagaccatcaactcaggcaacgctggtctccaggccactttcattgtatattcgcaggtatctgaagcaaatgtaggttgtgttggatatttatgattgttaacaatgtcaacatttattgaaccttttgcatgtactagttcattaaattgttcccacaccctgatgcagtaagatctattgccatgtccacactaccaatgaggaagcaacagatgaagggcagagaggtcagtgactggcccaaggtcaaatagctctaagcagtggacataaggcccaattctactgctaaaacattattcattgtgttttcttgtacagactttgcctgattccaaagcagccaattaagcaaaattttaatgatgtcatctagcactgactgatagtcacaaaaagattttcatgtttttataatattaccttattttagcttttcagctcactttaatcaagaactccttaaaagaggcattggtcaattggtagggattgtcaaagtgatccctcagtctttctgctatgcaagaacagtttacaattctgcttttctatcagttgatccttactgatcactttttttagattagaaaaaattagaaagctacaaaatctcagaggtgttagattagaaaagtgagtcctcggttctataagatgctgttgtaaatggcaatataattgcacaagagacactggcagtagagtgggtgaaagaagcacctcagtaatgcatgaatcattaacatgggcagccacgtgacacccaaaagggcaagtttcagaggtgccacaatgcaaattgttccagaacatgagagctttcatgaaacattaacactgatttactatcccaggtggactactcgtgaaagtgctttaaaggagggagagagaaaaatccacatgcccactccatttaattcctcaaggaataggtttattttctgccatgtgatcacctctaataatactgcagcacttttagaaaggatagatatgatttccctaacccacgtttcccatctgagaaactgcaataacaattaactattaatgacaagaagaaaataagctttcttttcccttggcaatctgtcacagtgaactccgctggtagcttgagaagcagttcgatgtgtttatctgtcaaaaggatatcatcttagaggtaagaaaagcacactcttcagaaaaatgccctccttatggataaaactagagctaaatgtattttattcttgcagataggtttccattttcataaatcacagacagattaaaaatttcactgaatagagtcagaaacaggaaaattgtacccctggctttctggagccataaaatcagcccccagtttaattgcttgctcattgagctattctgctttctgaaaatcaattttgagtatcaaattagttttaacttttcaaatctgagagaaagaattttagaactctccgacataatttgctatactttggattgtctcaaaatcatgactggaaaccactttatccaaactctctcttgtataatatgtgatcgcttaactttttaatacatgcagcaggaactaagcttttcatctttttgcccaagcacatacattcatcatcttgtacatggacattggctaaatgagatgctacaacttttacctaattttcttcaaaatgttgatatgcaatgtatagtaaaatgttaagattaaatgaaaactctaccatctttgcaaagccttcttaaaaaagaggattaacttttgcattgacctattacaggtcctttgggaagccttccaaaaattctgtgcatctcaacgtggatattttacgtttttgacaatagaacttaaacctgttagaaatttccctttgaaatcatatattcatctcctttgaactcaacaattttctaaataccatgcatattgtgtttcttgaaatgtgagaagttaggaattccacttgcaggtgtcaaagagtaacaagaactgagttagtgactcttctgccttaaatgagtataaaactagaccaaatatgtgaagcaaaagttttcagatgttggacaacaggcagcacaggacagtgatccttgagaggaggaaatagtgggatgagcgtcaccagcacctcagcttcctgcctgaagagaggccacacatctccccaagttcagaattcaaagaggccaaggaggctagaattctcagggcagagtaccagagagcagagtgctgtatggaaaagagagacctacatagaacgatcgcttgctctacagggttttcctggagttttcaggtgagtcctgatcagcacaaggatgggaggaagcttcctgaggcagggggaataaaaccaaccagaaaagaacacggggaatagtcctcagagttcacacaggaatggggatagttcctgtttccaccagccagagtatcaaagccttatcatatacagggtactgacaagagtattcagaatgacttaggcaaaattaaccgtagatcagtgtccataaattttttctataaaagcttatctaattttaggctttatagtctaagaggcaaaagcaaatttattttgtaggtgcttgcataacaagagagaaaactctttttctccctcttcctcatttgacctagaggggcaggctgtccctgttttgggaatgccttgtcctaattgtcatctgggaatgttcttgggatgaaagtaaccagccttaattaagggggagggcttgcccttaagattgtgtgggaggggaagggtggtcaccttgggcgattttgttctctgcccagtgacacctagatcccggtgcccctttctctcctcccagagagcctggctgtcttaacagggaagacaagcatctaaagggaagttggcttgctaaatttcccactcccagattgagatttctactgcatgttgtttggcagttgccaacagggaggtccccagcttatagtggagatccagcttatagtggagatcctgaacagcagcaaggcatggctgctagcaggctagcaggctctgggagtagagggggccggcccggctttggctttgtctctgtgtttcacagtgcttagagatgccttcaagacatgaaaacaaactgtaggctgaatgtaggtagcttctaggctgtagtttgacaactcagctttagagtaaactgctctggttccacctagcaaagtttaatgtaagtctcaaaagaattaaactggttttaagtaactcaattacttggaaacataattaaaaattttaacaaagctccaaatatttgaaggcataaaaatatttggcacccaacaaggtacaattcccaatgtttggaattcaataaaaagtcccagatatgcaaagatttaggaaaataaaaccaataatgcagagaaaataataaaaaaaatagaaaacagaccagaaatgatatagatgatagaatttgtagataagggcattaaaacagtaattacaactacgctccatacacttaataagtagaagaaagtctgaacattctaaggagagataagatatcaaaaaaaaaaaaaaacccacgtgtcacttctagaaaaaaaattgcaatgtctagaataaaaaatgcaggggacaggattaacagctgattagacactggagaagaagggattggtaagcttgaagacacagcaatagaaactttccaaaatgaaacagaaaaaagattgaaaaagaatatgaacaaagcctcagttagttgtgggacaagcttaagtggcctaataaattggtgggggggagttcttaagtatattttaagacataatggatgaaaaatctataaatttaataaaagtcttataaccacatatgcaagaagttcaatgaacctaatgtagaaatgtaaagaaaactgtaatacagcacctgatataccgaacggttttaaaatgtcagaagtcagactgtcataattgagtttaccgttaatataaggagggtgaggaaagtaaggatgtatgagactacttggggggacagatttagcatcatgaaaatggagacttcaaagagaatataaaacttctggtagcttctatgtgttaagcatttaggttgttacttctgactgaaattatatgttttgaagttggaaaatgatgtaaggtctcattcattgattaactcactaacattcatttaacacacatttgagctcttatttctacaaaagcacattaggacacataaaaatgaagagcaccaacactggcctcagacagctgataatctagttaacttccaagtgctatggcctaaacaattttacaagtgtttgacagacacatatatagcttttagctgttttttccctatttccttgtcacatattgcgatgaacatgaaattacaactaatttaaaagaaacactctttcctgagttatctacgtcttcttaatgtgtgaaatcatcctttaggaggactgagggagtggcattgtttacggtaaaaatagttttccatttagtcacctctttaattcattattctttacctttagcacaaatgtttcctgaagtgtcttatctaaaactttatgacaagcaaaaaatgtaagagtcacactgtggtgcacaaatatttataaacaaatatgaaataaatgagtacaccccaggaaaatgatccttacctaggagtatatgcaaatatgaaaatgaatgcacattcctcaagaaaaatatgacctttaaacaggtctatgtactatagtagtagtcaccaccataaaacaataacctggaatagataatgaaacataaaatagttcagccttgaagataagtcctggcccaaggaaagcatggtgcaagaaccccaaggattgttcaagataattcattgaagtgaaaaaaaacattcaaaatttatttatatttatttttatttggctccttaaaattttatttttggtaagttttataataaacatgtaatactagtatactagtaatacttttataaataaaccagcacatatgcattagagatataaaattttttttaaacatatgtggtgtgtgaccaaaaacatccagaaaccacaggtctagacaagttatctttaagcattattagaaacagaatctttttttaatagaaaatcttatgtaaaatctcaataacaagagaaaaacagtatttatttaaaatattttaaaatagaaactatgtttttcaacttctaagttacaatgtttgattttaacaaaatcatccagaaattgatgaagatgattcgattttaagtgaatgattatggacagctgtagtattttatcagcctcagcttctaggtttatttctatgaattctgcaatatttatagaatgatcacagtctattaacaggtcatctcatcctgttaatgtctcatcctgtctcagtgctatatagatctccaacactactagtactgctaaatagatgggtgaacaaatgaatgaatactattatgtgttatactttttaattcaataaggtagcagaagacactttaaggtcactttaaactattttaaaaaagtaacacctatgttaaagtttgatacatggcagcccacaaacactttaatgtgttttaaaagttttaaaagttacttaaagagcttaaaatatatgaaaaattaagtaaaaatcaaatatttgcagactttttcctttttgttgctacaaaagatagaatagagaaagatgccaatggataaggtctgtatattaagtaatagtattgtatcaacgttattttccttattttaataattgttttatggatataaaagagaatggtcttgttcttaggaaccatacactgaactacttagaggtaaagagccataatatctgtaacacattctcaagtagttaattttcatctatttttgagtcaaaattcacaacttaaaccatgttgaatgatctgctcaagagctaactattaggtgccactctactacttttatacacagtcttgttgaacaggctgagaaaagattgagagtgattccaaaggaaatgccggttcaaaatgattgttctgaagaacaccaggctgttgttcagacagtgccacatcctctaagaaaggagatgtgaatacttcacgagatatgtttgtcaataagagatacatttgatacagacccacaagcacatgcacatataacttaagatgtcactcagtttatttgacctaaaccatttatagctttaatagctttctgaaattatctttttaaaattagtttataactttattgcctttctaccacatactagaaagtcaatttggttggccaggtgcagcggctcacgcctgtaatcccagcagtttgggaggccgaggaggtcggatcatgaggtcaggagctcgaaaccagcctgaccaacatggtgaaaccccatctctactaaaaatacaaaaattagccggatgtggtggtgcctgcctgtaatcctagctactcaggaggctgaggcaggagaatctcctgaacccaggattgaggcagttcaagctcttgaaatgcagaggttgcagtgagccaagatcatgccattgcactccagcctgggtgacaaagtgaaactccgtctcaaaaaaaaaaaaaaaaaaagaaaataaatttgtgagacaggacatacacacacagatatgtgcctctctctctatctatcatctatcaactatttatttattgagaaagagaaagaagaagagagagaaggataggtagctgataacatcaatgtaaaacattaacaatggggaatctagatgaatataagcgtactatgggaatatgagagcattattctcacacttttcagagagcttgaaattatttagaatctaatattatttgaaaattatttgagatcattgcagaagaagattgaacttgagaatcttgaaaggagttatgtagaatgaggctaatatgattgaaaattatgaagtttctttatgtcttacagtgatttaagtcatggttggctcatagttgtcatgttgccttagaggcctgtttcattctatcttatagaatactttaccaaaaatctgtgtcaaatcactttaaaggtaacagatattcaatcaattttaagatatttatattaaagatattttcagaaaaaaataaaagaaataaataatgatttaaaaactcacttcacaggtatctattccaaaaaaaaatcatggtaagccaaagatcaattttagattttttgtcttttctctacttttgaataaaagtgaacagccttatccaaacttgtaatttgattaaattctacaaacatgtacacaaatgaagaagcatgaaccctgtctacaaggaggtcacaatcttccacagaagaggaggagtaaaatagggtaaaaaataaagagaaggtcaggtgtggtggctcacacctgtaatcccggcattttgggaggccaaggcaggcagatcacttgagatcgggagtttgagaccagactagtcgacatggtgaaaccccatctctactaaaaatacaaaaattagccaggtgtggtggcgcatgcctgtagtcccagctactccggaggctgaggcatgaggaggtgcaggttgcactgagctgagattgcaccactgcgctccagcctgggtgacagagtgagactctgtctcaaaacaaacaaacaaacaagaaagaataaagagcaaaaatagacattggctcatagaggtatggtcaaattgtgcatttatgggcttcatatgttttgcaaagtatttatggtcagggttagaaatggagtcaaaattacaaatcaatgagctgtaatttgaggggctgctggaagattccatctgctcaaaattttcacttcaatttattacacattgcctgagactactatagaatgaaaatgtctcataagatgtagaccagtaagtcactattctctcatggaaatctctttattcaggtgttttggtcttcatgatatctagaagaggattttaaagaaaaagcagtttgggaagatcaagggtaatttggacatagaatggaagaattgggtggaatcctggaaggaacagaatacagagactcagaaagggaggatggccgagaatacacattgcctctttatgcattgcttttggtcaaacttatttgtacaatggcattaaattgtccaataatataaatgtgtacactttctacatcatagaataatgtaaagatattttctgtgttcagtctaaactacagctatgaagagaagttcttcaattatgacaatctaattttatgaaatgtgagaaaagatcaactattttttgaaaccttaagccaaaaaatttaaagaaagaataaaaagctatatttatatttgggataaagaatattagaaataggttgaaataatatgaaagaaatgtaacattttttatgaaagcatactggctgtgcgcagaaatgtatggaggggtgagtttatttatgcatacatcaacaacaaggcttggcatttataatttaatccataataatgacttgcttaaaaataatcactagacaccactctgttctattgtcttggcagaaaatgatactcaatagtctgggaaaagactgagagtgattcctaacagagactctcttcttgataaaacttcagacaggctcccctgagctcttttttcttttttctttttttggtgagatggagtctcactctgtcgcccaggctggagtgagtgcagtggcgcgatctcggctcactgcaagctccgcttcccgagttcacgccattctcctgcctcagcctcccgagtacttgggactacaggcgcccgccaccacgcctggctaattttttgtatttttagtagcgacggagtttcaccatgttagccagggtggtctcgatctcctgagctcgtgatctgcacatcttggcctcccaaagtgctgggattacaggcgtgagccactgcgcccagccactgttttttcaatgaggtctcatccttgggctctgcctttggccaggcaagaggagtttcagcaagaatcctgttaagccagtttagagagaatccccacttggtatcttatcactttcattttctgatcaagttcctcattctttacctttgagtccttagcctgccttcagcaagagtcctgttgttttagcaagaatcacaccactccacttttcctatctcctcttagtaatttactattcactgacccttcactctccttgctgggtataagtcctcaactctctttgttgtattcagagttaagcacaatttctctcatctttcacaattgtcttgacatcaaatgcagtagtcctgaataaagtttttcttactgttttaacaagggtcaaaataaatttttctttagctctccaaagtaaatgtgaatgcaaaaagattaatgaagaaaaaatactagactggttgtccatataggacgatgtcctccaagaaaggagatgtgcttctttcaagagatacatttgtcaatattgcccatataaatgcaaaacatgttgaaagggatcactgctttttttttttttttttttttttttttttaggacagagtttcactctgtcccccaggctggagtgcagtggcacaatcttggctcactgaaacttccgcctcccgggtacaagtgattctcctgcctcagcctcctgagtagctgggattacaggcacacaccaccacgcccagctaatttttttgtatttttagtagagatgaggtttaaccactttggccaggctggtctcgaactcctgaccttgtgatctgcccactccggcctctcaaagtgctgggattacaggtgtgagccactgtgcccggctgcgatcactcttttattgccttgacctcaggcaggaataagtttggcgtgcttaagaactagcagaaaggctagtgcagctggagcttactctgtgagggagagcgtggggagaaacctatgtatgtatgtatgtacgtatgtatttatttttttgagatggagtctcactctgtcgcccaggctggagtgcagtggaacgatctcggctcaccactgcaagctccgcctcctgggttcacgccattctcctgcctcagcctcccaagtagctgggactacaggcgcccgccaccacgcctgcctaattttttgtatttttagtacagatggtgtttcactgtgttagccaggatggtcttgatctcctgacctcatgatctgcctgcctcggcctcccaaagtgctgggattacaggcatgagccaccacgcccggccgaaacctatgtatttattaagtgagggaagtatttgttgacatgtttgatttctgtggttaatgtgtagaattccaaatgctggtagaaagatcaaccttaacattccaggaagttctcacctatttaataagcatttaatgagcatcactgtatacaaggcatggtgttggatgttgcagaaaatgcaaaggaaaggctgtattgaacatatgacactttaacctaacatggagaacagagaacacagaaagtggtataaaacctgaacagtctggaattatcaattggaatccatacaagtgaatggtaacaacagcagacagcaaggatttccctagaaaatggattaggcttgcaaaacataccacagagagctacgtttttctgcatttgtagaaacaaataatttgtgctgccagaggaagacagtggaaattaatgccagaactcaggtttaattttctctcaaataaaaaataataattataatattcatgaaaaacatgtgtcatgccctgtagaggctcagccaattattcatttattcataattttgtgtctctggtatcagacacatggtggggaagcagcaagaggtgccaggattctgcatgaaattagatggcaagccatggagccgtctccctcccagctcacatttatataaataactcctcccaccttccaggcaggatttgaatgaatgcagaggaaggaaattaaatcactctatccatcaatatcaaggcagggttgccaataaatgcatccaacagaaagcattttaaaatgctcttttagcctgtagaaagttgccgctatggaaaagacatggacttcatacgaccataatttattgaaatgtcctctcatctcttaatttattggtagattagagcgtaatgttaataaaattaaggtcatagggcataatcctttttcagacctttttttgggtgtgcatttctcatccttgggtagaaccctttcctctaaagcccaattaaaaaaaaagtcaagtgaaaccaaacattttgggggcttatctccttttcccttaagttttgctttctttgcctttccctcagcaacacaaagttctctctctctcttttctcttctctcttgctgtctctctctctgacacacacacacacacacacacacacacacacacacacacacacacagagttgtcgtttttctttctgaaataacacgactggttctacaagattacccagcagtttaagactgccttttagttaaactagaataagagtgaaacaaaagagattgatcaaagaaaggatggcaggctcctgaaacacattgacccacagtacggcagagcagtgacagaaatatctgctctgtagaaacctggacactgctgtcaagtgacatggaagcatccagcctagctgaccactgtatctcatggaaagtagagcaagtgattagaagtaaaactgccctgaatcgaattctgaaacagtgtcagaattatcagctcctcctctatattcccagagtgccctacacttattttttgttactgtgtgttttttttgttttgttttgttttttaacaacttgtacttattatgttcctctcctaactctcttggcttagcttggagctccctctcccttccttacagttcctgcagtgtggggcagcaagaaagatggcctagttctctggaagagaacaaagggctgaccttgcttagggaggtggcagctgcctgccaagggacaggtccttgtctgagagagttaggagcacacggaggattcagaggcaggaaggcagggccagcagcagccaagagagggccagtgagggccgaactagatagaaaggggctgctcctgggtcttgtaagcgggatgtgctactcggcctgtgggccctacttcaactgtctaaggggccatagtggtgggtagtgaggctctgaggaggggcaagtagtggtggcaattgagcagtgagggagacacaaggggaaggtatgagtcagggttcttctcagcctgggaaaagaaacccctccttcctcaacaacggttcacagaacccttagcattgatacactactctgggccagaggtcccaacgttagacagacttattgggaaaccgccccaggttaggcgctcttcttctgtgtccttggaacatcgcttagtccttacacagcagctcagcatgctgtgttgtagttgcgtaattataaaccttttaatagaggggctgtattgtattcgctcttatgtccttaaagcctagcatggcacctaccatatagtaatcacttaacaaatacttttcttttttggtaaatgcttctcaagtagaaacaaatactttttcaatcagaggaatacataattttgagcaggacaatcctttaatttttttttaaaatgtaagaaataatcatactataaaatttgtcatctccatcaagaaaccatggtagctaaaggctactgtgaaggaattaaataaaattgtatttgattgtctcaaaagggcattaacatacatgtgaaaataccatcccacctacatttcagcctggattacagacaatgcttggttcccaaatggatcagcattctcttgaatgaccctgattttagtagttgcctgtacagggagaagccacagtgtgtctggtggtgtcagctgctggttcgtgttgctttccttatccttccagtgctagagagcaaatatttggctatgcctttgtcgggatggggttggtgggggcggagggatatctgtgtaagagtaaagatgaaaaaaatcaccattccttcgggactaaacaaagctgactctcacatactgctttgacagtgggcttgctagaattaacaatcatgaacatcttaagtgcttattaagatttcatggactattctaagtgctttacatactcctcacagtaaccctgctaggtaggcaatatcgttgctccatgtacagtcaagaaagctgagtagaaatcttaagttaggctgggcgcgttggctcacgcctgtaatcccagcactttgggaggctgaagggggtggatcacaaggtccggagttcgagaccagcctggccaatatggtgaaaccctgtctgtactaaaaatacaaaaattagccaggcgtggtgggcctgtagtcccaactactcgggaggctgaggcaagagaatcgcttgaacccaggaggtggaggttgcagtgagccaagatagcgccactacactccagcctgggcgacagagcaagattctagtctcaaaaaaataaaaataaaaaataaaaaaataaataaatgttaagttacttgtcaaaattcacttacagagtaagtgacggaggcaggattgcaatccagacagcctggcccaagagtgcccactcacaatcactacacaatcctgctgcatgtgcaaactgcatccaaatccaaacacatacctcttgataccacagagccagaatcagccctctaccacccaaaatgtggatttagtgctaatggagaaaagaggcctgggcctgccttaaagcatttagagatggagtcatctggtcttttctcaaatccctttccctctattagacctcctcaaggcctgggttggaattactctcccactcattcctcagtgttacctctctaatatccttgttacagactctgttgcacggtgctcccttgtgggctccctgtcgcctcattggatgtttacttctaaagggcaggaagtgtgtctttaccatcttatatcgccctcagttatctagcactgtgcctggtatgaaaaaagtcttcaataaattgggggaagaagcaatggatataaaataacaacgtaaggcaaagtggctcccacgttacagctggtattgtagcaatcctgctgtttttgggctagaaaacatatcacaactctttttataacatatttttaagcttttataagtcttcatctcatgattcatataaattgattattgatcttttcagaaactaaatttctctatgacaggggattttaaacatttttaatataagactttctggagttctgagtgagcctctgctagagaaggaggaatggagagagggaaagaagaagggagagaaagaaggaggatagggaggggtaggaaagcaagagaaatatcagtgttatcaaaatcctagattattactgagaagaaagctgaaattttgttaacacctttcctccaattaatccggaaatggaatagtgctaatagggtgtggagagaagcagtgaggtgcaaatggaacggtgatagtgggaaaggtgagaagagggtgggaagggctgggcatttacacccatctcattgcggcccagtgacagagatggggctcatgctgagcacaacttgtgctaatgagcactgctgccttatctgctcccaaccccttctgggaactccttgaaattgctactcaatagcacttaggaaacacttgctataaatcatatagaaccaagaatccagccccatgacaggatgcatacagctaggcacaattagagacaaggttttccccaaacagttctaatctaaaatattctgtcctggtcaccctagaagcacgtgtaaacttgtcaatccatgtgctttgatttttatttgaaaatatattcaacagaaactaatgacatgaatactctgagataggactggctgcaaaacatgtatggcgttcactagtcctttgctccggataatgtcaatactctgccaagactctccagtgacttttactagctccagaagaaaatctaaaatccttgcctcatcctcaaggctctattggatctgatccctcctcctctaccctttaatcactgcctcccagtgacactggcctgctttctgtcctgtgaacatgccaaacctgcacctgcctcaggggttttggccttgctcttccaccctcctagaatgttcttccacttgaagccatttacagtgggctccttcttatggttcagacttggattcagatgttagctccacaggacaccttttcttacagccaaacctcagctagcactatcccctccccagatactttcttgggcatggccctctaatatcaccttcatggcatttatcatgatctataatcaccttatttacaggtttagttgtttattttctgttttcctcactggaatataagttacagtggggcagggcccatgtctctccagctgctaggatagtgtctagcacatagcaggtacttaataaatgaatagtaggtatccgtcttgatcattttggactgatataacaaactgctctagactgagtggcttaaaaataacagaaatttatttctcagagttctggaagctggaagatctagatcaaagtgctggtagagtcagtgtttggtaaaggcccagttcctcgttcatagacagttgtcttcttgctgggtcctcacacagtggagggggtaagggagctctccagaatatcttttcttttttctttctttctttctttctttttttttttctttttgacagagtctcactatgttacccaggctggagggcagtggcatgatctcggctcactgcaacctttttcttccaggttcaagcaattctcctggctcagcctcctgagtagatgggattataggtgcctgccaccacacctggcttttttttttttttttttttttttttgagatggagtcttgctctgttgtccaggctggagtgcagtggcacagtctcggctcactgcaacctccacctcctcctgggttcaagcaattctcctgtctcagcctcccgagtagctgggactacaggcgcccaccactacacccagctaattttttgtgtttttagtagagacgggtttcaccatgttggccagtctcacttgaactcctgacttcaagtgatctgtctgcctcaacctcccaaagtgttgggattacaggcgtgagccaccatgcctggcccagaatttctttcataagggcgctaatcccggtcatgaaggttctgctctcatgacttgatcacctaccaaagtccctacattggggattaggtttcaacatatgacattctgagggacatacatattcagtctgtaacagtatctaataaatagatttgataaataaaactgtcttgtcccctttagtagttaaacacagtgttaaggacataataagcctcagaaatttgtctccacattccttttcttgccctttgatctgctcctttgtcctttgggaacttctcacttgtcgttttggttcttcagcccctgaactaatattgtcttacagaaaaaacacattcttcagtccacatatagttatactaactcctgcaatattcaaagattacatctaagtagccctctcttgggaatggggtaagtgggagaagaaaatatctttaaatggaaagagaattagatgcattttggcttcatttttctctttgcacatttccacaagactcataaaccacaggctgtaggaaggcagagaggttactcagctggccatagtcattcccaggcttacccttggccatgttattatttctcagtatgtagtactttcttatgcatattatatgcagtgattcatatcgattcttattagctagaagaatgtggttagctttctgaatgtattcgaactctgattcctctatgtctgccaacaaatgcaaagcagcacctaaaacaacttgtcttgttataaatttctcagaataaaccacttaatgttgatagtgtcgtgtgactaaatcctttatttctcacatttgtggggcgggggactcaacatgaaagccaggtcttctaattcatgatatttactcatttgaaataaacatttactgcaaaccttctatattccaggcagcaggcaaggtgccggggatacaaagtctaatgagagatgcttctttcatattttcaaggatcttgtactctaaacctatgaatatagtccacagagactgtggactgtgatggagacatgcatagggaactatggacacatgaaacatcagttcccctcagacaggtaagctccatgtgggcagtaacttgtctattccatatctcagtgtctagaacagtggcacataataggcattcaatgaatacttgaaaattgaaggaaagaaggaaagaaggaaagaggaaggaaggaaggaaagagaaataaataaataaataaataaataaataaataatgctgtccagtaagatttcctggaaggaagattgaaaagcggtctacttgaggaagaatagtaaggaaggacattcttactgaccctgaccctgctttgccctgggatttctaggctgggaaagatgctcaggctattgcaaaccactgtgtgagatgatgaagcatctgtgaatataacttgggaataaatacatttatttatgtacttttatatcagaattctgtgttcattgatggtgggatctaagtttttctccctgagacaatgcagttaaaagactattgtagtattatttgccataagaaaatgcgtcctttgaaaaaccaagggatgttatcatcaagtctcttctctctgcatggcacttttggactgagaagtgtttttcaattagggatataccagttgagaactttgacctcccactcacagactaaccttctaaggaggttggtcttgccttttgcagtcatgtctgtcagtcaatcaatggtgttggctgaggatctcataggtgcatagaaagtaaggactttctatgaggttataagaactagaaatgattttctacattagtatcaagctttataaggtgcttcctaagaacaatttgggatacattgagcagatactttggtgttactcttcctgttttaccaaataagattgaggctccaattgattaattgatttgctgaatataatgaagctaaataatgggagagttgggtcttagagtttggctctaggtccagcactcattctcctactctgcattccctccaagggaacagcaagacctgatccaccaaggacataaaacaaacaaaaaagcgtgctcctgcggcagtattagggcctggggtagaaatattgatgtatttgttgatgttttgtggccatcaaagcaaccagatttacctgtttctgatgtgtgagttaaaataaaatagattatgctgcattaagaaatgatctcaaagtcttagtagcctttacaataaaaggatatttctcactcacgcactccatgtccacagggagttctgctcactgccccagtctgagggaggctccaccttgacatgctgccataataggcactcaataaatacttaaaataaatacataaaaggcagggcaaaggagtatggttagctgtgccttggctgttaaagctcctgcctggaaatgacaaatgtcaatccactaccgttttgtgaccaaagtcacatggcaaagtctgtcatcagtattcttctaggaaagggcaattaatatgcatgaacaatagtacaatctagcaaggttgctcaagcagctttcattatattttaagctataaaagtgatggacaacaccattgccaaaccagcacctctgcatcggaaacacagtcacctgacaaggctgtcaacactttgtgcttctgctggaggatatctttgggcagggatatgatctctttgccagagaaaaaaggagcagctgctaatcagggctctgagttctctatgcatgcaaatgacctgcctgaaattgttgaatcaaagcagctatgaaatatcttacactttttatagccagccactagtctaaggtccatgaagggaaggactctacctattttatttaccaacgaatattcagtacctagcacaatgcctgacatatacagtgttgataatagccaatatatgtgccactcttaaaagactttattgtattagctctttaaatcctcatgacaactcaacacaagaaggagctgttattattcccattttacagatgaggaaactgtggcacagagagcttacataacatgcttgagttccttagaacattagtgagtaggaatttgaacaaagagagtttacacttttacccctattatttccttgattgaacaacaaaaaaactcatattatgttgcaaagaataaatgttcaatctattaattgagtattcattttcatttgtgaatttggtggtaggagttaggttaaaatcacttcattggcaatttatcagaaggtactacttcactattttgaacccagcagtcttactatactagcagtcataatcatcaatcaatagcctaggtaaaggctcagttaagctcttcaaatatcattttggcattctgtgtaaatgaggagccaggctggtaagaaaattgaaaggtgattcaatcagccagcaggtggagaagacataatcagagaaaatcaggggtccaacccatctaatcacccatggaatgtgctggcttcattctgggtgaagtgttctgttgttacaaatgctacaaaatagagcagcccacacaagtgttaccattttcgttttggctggtgttctgaagagcaagcacatgaggacagatggcaagctatcatttcaggcctgccttctggctcacctgcatgtagccacataaagctttctcatttcctaagaaagcctttcctatctcaagtcatatttatagcctctgactcatcctcattactcctcctagatatcttaaagcctttcttaaggtcagaaagtctgccaacatagagcttgccgcttgaactgaggggttcttcttgtagcactctaattatattaaagcctggagctccaatttttactcaccaacaggtctagttttaatgttcacattctgaaacaaaatcgctttccccatttcagtgttctctttcagggtctaaatagatataactttatcatagcaaatttgttactctcaatgtctagaataggtaagaataacagagaagaatttcctgatcactaaagcagcactattcatttatggcatagtgttcctgtcgctccatatgctggacgctctgtgatgcattaacaaatgattttgtgagcttttgcatttctctgggtcagggattgtaaatttaaatacctttggtggctagacaagtatgtaagtagagtagggcttgggcctgctgccccaaagctctgcccaatttttgctgtatggggaagcaggctctatgctgctagatcagtttttttccaagagaaggtcaacattcaggtttttaaaaatgtacaatcttctgatttttaaatgctatcttaattttaaaatattatggataaagggcatttcaggtaaagggaactagagagaacatgatacatttggagaaattcaagtcatttgatgtgatagggtggtgagtgcttagtggggaatagcaggaaatgggactagacattcacttgcatcttacttgcaggtgacatggttagatttacatttatattagaatggttaagaggtggtctaagaggagaaaactggggtggggataggaaccaagaggatatcacaacagtcccagggatcatgttgagaacagaacatgggcagtgtgttagtccattttgtgtggccacaaaggaatacctgagactgggtaatttataaagaaaagagatttggctgatgttctgcaggctgtacaagcatggaccagcattgactgggcttctggtgagtactcagaaagcttctactcatggtgggaggtgaagggggagcaggcatgctacttggtgagagtgggagcaagagagagtggaggagatgccaggctcctttagacaactaacacaaggttcctgttccctacaaatgtgccagggcagattcagaaactatctgaactattttgaactatcagagcaagaactcattaccatgggcagggcaccaagccattcatgaggaatctgcccccatgacccaaacacctcccaccagacctcacctccaacactggggatcacatttcaacatgagatttggagggaacaaatatcctaaccatatgaggcagggactttgaggggagatggactttagagataagtagcaggaaaagaagcaggacatggtgatggattcaatatggtagtgagggataagaaagcatagaggttgccactcagatttctaggttggaaaggtgggtcttggctcctgtcatttgttgagactataacaagaggggcaggaacaggtaggctggagtggtgggtgggggtaaaaatggaggtgatgaattcagtgtttgattagttttgtgcttgttagacagccaggtgggctggagaaaagttgctggaagacatcagtgtaaaggtgagcttgaactcatgggagcaaatgagaaacagcctgggaatgggagctggagtgcaacaatttaaggtaaagaacagaggaggatgacttgtgagattaatgaagacatagtagtctcactccgatcactgttgttcctcagagacttaaatcccaccataagcctcaattggtgggtacaaacaattcttcatcttgcctgcatattgcaatggtttggatcgaagctgacaagcgggaagctcaccttgtatgtggcaacctgatgaaagactcctggtggatctaagtgtgacatctgtaatagtccctgaaaaggccccagatgacatgtattgaatacataaagaacttcaagtttttctgggctgctcattccctcccatgcaattcttcttcaaaaggcagccccagccaggcattttatcacacttttaaaagggcctacaatgatcttggctctgactctatcagtgggctttctagatattcagacagttattgatttctgaatctgccctggcacatttgtagggaacaggaactttgcgttttgccatagataacagcctcctgggcttgggctacagttaactgaaaatatcgcttagcactggggcaccagagacacctttgctgttattatgggacacatagtacctttagaatatggcaaccatacagcatttctgaaacttatttctagagataaatctatttacattttgcttatgtaatctttaaaaaatgttttattcattttaagtttttattttttacagggctgtgtgcttttgctccatatttatggtgacaagcttgtatatctgtatagcaaagcctcatgaatgacaatgttgtgagctgtctgccactgcacatccccacatttcttagaccacctaaatgaaagtttccacatttgagatctcccttgttcaattttgtcaggctgttcaaataacatggttaacgcaaaatgcaaaattggctcactttctcaaatgagtttggtgttggcatccagtagagaaactgctttcattatctcatgttgaaatatattcataatattcacttcaatatttcatatttcattattttagtggttcaaactactagagttcaaatgatgagaatgttattaactgttttattccatggttagaatcatgcctaggacacagcaggcactcaatatgtaattattgaatagtagaaggaagttacttccaggtaatctttcagagtaattctctcaaaaagagcatttttaaggagaaaaatcatattgttattctaggaggcagtatttatcattctacagataaggcatcctgatcatttgccttcctggctagagaatatttttctagcatctcttattggaagtagttgatgctcaaagttacattagagtcaaacaatatgtctacgattagttgtggggatgatttaatgaaaagagcattgacttacaatcaaagacttgggtttgatacttaccccttcttacaccactgtatgctcttaagaaagacatttaacctctcccaagtggactttctcttctgtaaaatgggataatagctcccataaaaacttgtgagataaataagtacttctcttcaacttttcagactcaggaacaaagtaagaggaaaataattaaaaataattaattaagaaggtattgtaggtttctgcctaccttttgagattgcttttatgattaaaagagactatatgcataaatgccctttgtatacttaaaattgctatttgagaggtcaggcaattgcttacttataattagtgttgagtaatttgtaattagtgctaagggattactataaattcacttatagtataatattattatttatagtagatcatgattaggattcaaatagggtttcagcagtttcaggtataattcctgtgtactctatgttccatttaataactgatggtgactgagcagagagatatggcctgaatacctattaagtacatagaaagtggctggtgagtattcaatatcatcatgagatattgttacactgccagccaagctactcatgtattccatgaacactgattaaaaactgactctaaagtattgagcacatggtaaagaaaactggtagagcacacatgtttctctactttaatagtctctctaggtactgaagacaaatattaacttctagttccaagctttcatgctagaaaagtaaaaccttgactcttgatttttcttcaaatttcagatgtgtcaaaatgaatatcaattttaataaaataaacatttcattataaacataagtggattaattgttggggaaagtgagcccagatattttcatttttattttactctccccagtacacttatttcattgaaacggtagctcagtaaactcctacttagctaacattttgcagaggtggccattctggttcataaagtcatacttctgttaacaagctctccctcatacttgtcccctttttcccctttccactactgctcccacagatttggccaatatcttctctttcctattgggatgcccattgcactggccatcctgtctgtagcctgtcttccacattgctgcagaaggactccactaatacttgaacctggtgatgtcattcactagctcagataacctcagcggtttctcatcacctacaggatagaatccaggcacccttgaatggcatgtatgagttggtccctgcctaccagagctatctcatcttttcctctctgcttatgaactgggaacaattctaatggcagtatctcaagacatgtgttttttttttttttctcggactggtgtgctcttgcttcatctgcctgcctggaaacgccctatttttcctttaaatctgaatgcatacattacaccttctacaaatgttttctttaccctctctgggaagcttagataattttgctgcacttctgcagaaataggacatatcaccacaaatcaaaaaattgttttggactaaagtccaaaaccttaacatgatcaaccataccccatgtaatctagccccttctcatcactctcctgcccttcttccattaggatcactatgttcaactcacactgaccttgaaagtgcatgctccttgctgcctcaggaccttggtacatgctatttcttcagcctgaagtctctctggatctccactctcactcctcactcccactcccactctttgcttggctatctcttattcacccttcagatttcaccagctgctactttatcagggaagcttttcttaacctctcagactgttttccccagttatatgcttacacagcctacacattcagagaatgttattgaccattctggtctcaatgacagtatgtgttcaatatataattaattgaataaacctctatgtaaacatttatcttgctgattatacatgtaatatattttatcactaaactataagttctctaaagaaaaattatcttatttaaaatattttgcaatatttaaggtatataaatgtataaagcataatactccaaataagaagtctgttaaggtcaatgaagccagaatacaattgggaacaaaaggcttaaaaaaaaggcaagcagagataaaagaaattgtgggtataaatgtagacccaatagaaacccaagatactgtacactgcattgagcatccacatctggttccacttttggctttcccagctgaaaatttcctcacatccatggatgtggcttttagtcagtgaaatgaaagatgctgagctatataatctgtaagtgcttttctatttcttatatttcatgctgctgagaccatttggctgccttgataagcactaatcagctagtctgacagaaaagaaatattcaattcagtggatctgagaatacagtaataacaaacaaacaatttcttctaccacattcttacaacatgcttctgacacaagatatgtgggggttgtcctccacacatcaagcaagaaatcaattctaaagcagctctcggaactcagggaaacatgtttacttgtttattataaaaggtattacaaaggatacagatgaaaagatgtatagggtgagacatatggaaagcagtgctgaggtttcatgccctctctgggtatgccaccctctagaaacctccacatgttcagctttccggaagcctactcctttttgggttttcatggaggcttcattacaaaggcatgatgattaagtcattgcccattggtgatcaacataaccttcagatcccttcctttccttgaggttgaagattggggctgaaagtcccaatcctctaatcctgccttggtttcctgggtgaccagcccagatcctgagctaccagtaggttgccagccttcagtcaactcattagcatacaaaagatacttgtcactctgaagattctaaggatcttatgagttgtatgccaggaaatgaggacaaagaccacatacatatttcacaatattacagtggaatattatgatttccccaccataagttcaatttatgcatttcttttgctgaccattactacagagagagctattgacctgaaatgtcttgtcttgtctttgatcctgaagactggatctcattttctccgcatttctttacaaaacaaacaaaaatttccaaatgccacaaagcatcttaaggatattgacaataaataatgtattgagggttgagtcctcaagactcgcccacctcactacattaggatagatgtgttttcatgaatgaggttgcatatttacagtctaacatggatttggtctcaaagcaatccaatttgcttaagtagggctactaactgtttagcattagttttatctactctaaaggtcaataacactaaaacataagacctgctgatgtcattctttcctaatgcatcttgacaaaggagaaagctcttgtctgctgtcagcataaagatgatttgcatcacaggtcattgattgagactatttgggagtgaaagagaagaatctgggctatttggaatttcaggttatttggttggctgggaaagaacacttaaattcagaatatggcggaggcatataactggaaacaaaaataaataaaaatgatatcacaggaacatagtgaagaaaaagattataagctggtagcaaaggctagtgaagctaccatgagcaaacacagacatagagtgaagtacaaggacagtaaatgggcacctagaaatgaatcaaaattaggaaaattgtagcagaagccaggggaagatacacctacaaaggcctaggaccaatctggtttgactaacggggattgttctagctctgtggacccagattgctaattaatcctctattttttgttaactagtagaatcttccaagtgtccactgaacatatggacacaaatctgtagattacacttccctgagtcccttgcagcttgctatggctatgtaactaaattccggctaatgagatgtttactgaggtcatgcatacaccttcctgcatacctcaaacagaagctgtttgctgtccacttcttttctttatctataaactaaaatgtgaatgttgtgatgctgaaccatgtggaaaagggttattccctaaaacataatagagctgctagaaagacaacatgggtctctggataaactcatagatcagaactatcccacctacctggtctgcctgccaggacaaatttttgtaggaaaatgaagtaaagccactgaactaatatcccatctcagtcatttttttcctctttattctggatatgtgtgtgtgtgtgtgtgtgtgttaaaagtgtccaatacatcattgaccatttgaacagcattactacaactcagatgacttatattacttaaaattaagggaaaaatcttagaaatgtgcaactgcaacattttcttctgtagttgcagcatatgcttcatttgtgaagttatacagactatttaaaaactattattatatccagtgtaattgtgtcagcattggtttagttaattaaagttaaggaggataaaacattctatgaaacattatccatatggtctgcaactaccctttgttttaatggtgtaagaacacccatagagagcaagtaaaagaaattattagtggattaccaactttgtgataaatccaacagaacctggctattgtgtgcttctgggctcccccttttggtaactggctgcttgtattcacatgcgggccaggtatagagcttcgcttctctcctcctgtggagccaggatactggttggtactcttatttgagtttaaaatttctttcttagaaccagataaaactactagtcgttcaaaaccaaagtgcctatgctgtcctgaaacattaataccctcttcttggcctgactacttccctataaatgtcaccatgtttttggatttcaaaacatgaattaagtaactgtctgccgctggattctgattctgtgattattcctgattgccactgtattaatttcctatcattgccataatgaattacctcaacctgattggcttaattaatacagatataacttatagctctgtaggtcagaaatctgacacggtcttactaggctaaaatcaaagtatcactggggccatattcctttctggaggttctggagggggaatctagtgttttttttcctcattccagcttctacaggttatcgtgtttcttgtcttgtggccccattcttccatctccaaagccagaatagccttgctatgttctgctcacactgcattattctgacgtcctctcctgtctttttctcccacttttaaggtcccttgtgattgctttgggtccagaaatccaggatcagcttctatgtcaaggtcagctgattagtaaccacagttccatctgcagtcctttgccatgtaaagcaacacattcgcagttcccaggaactaggatgtggacatctttgtggggccattatttagcctatcacagccacttttgagctaagtagattaattttggggtttctgattctataatagctagatcgcttttttaacttgacctttcccagcacagggcagaggtttaagagagtgaacaactgggaataaaagcacatgagagggttaaaaatgaatcatcttaagaaagccatagaacacatttactgcaaatttctcactatgtcgaaaggtctgggaccctatggggaggggtaggagttatctttgtgtctccatttgagcacattaatacatctcactgaattgcaaggaggtaagataaagggcattccagaatagtctcttccaacaaaattatcacaacaggggccaggttcactagagatactatgaagtcaccgtgccattcacaaccaatattatcaatgtggtaagaccaactgtctttctgtcttgagtttttatggctttttttttttttttgtctaaaactgggcttatctcggagataaaacagccctgcaaccaagttcttctgcactgtcagtaactaagtcttgagttggtccaggagaatttcctgcactaaaccttttccctgccccagaaaagccatatggtcagaaattccattccagctcatactactattagaggcattagaatcagactccactctacccttacccccccaacaaaaaaattgcaaagcataaatagcaacagccagctttatcctgaatcacctgtgaatcagcaagaaagtaaaatacagcttctcggtatgctaaatgaaaagatttgattttaaatttatcagtgtagtgtgggcactccaatttcccaaagaggtgttgcatagttttccacatttcttattttttttcatttgcattacagaccggaaatcctgcacttctcagcttgttctctcaactctgttgagtgattttccagaaatgaatggttactatttctagaacttaagtctcacaacctgactccctctgagttccagagtccataaaaaatagctgaaaactgatgtgattgcacacaatatgtttaatattgtaaagtaagaaaacttttttcataggaattgaaaataacttacagaacaaaagtaaacattaagtctgactttacctagtagaataatacttttaaaaatattcaatgtctcaaatattttatttaagctgaataaaagtaaagacatcattttcctaaatctaatagagatttctaatacaaaatgcaatagcctttattttttcatttaatttctcatggtattagttttcactgtaaattcaaaacccaattattattttcataatgagaatatatgaatgggcacatggtacttagaaaacaatttactaataccttgtggataagccttcccattgttatctccatggtggtctattagcattgtcaatttcctttaggtaatatcagcaccaggtcccatatcttcaaatttaattttacaaaagattttttcaaataacaatgttaatatattccctgaagtaatttacagccatatttcctcttaaaaagccctacaaagcaattcctatggaaacaaaaatgtacgtatgcccaactgctatgactttttatgcatgacttgtgaattttgttttttagattactatattttaccttttccctataattctctgtaagcaacacaacagattataatgagtataatcagatctgtagaattattgaattcctcaaatactgttcttttggaactgtttgtttagtgacatcccaaatacctgctctatgcttcatcttgggttgttcccagcataaagatgagctgttagatacttagtacatttatttatgacatgcatgttggtttcctgtggctgctgtaagaagttaccacaaaataggtggcttaaaacaaaggaaatttattctcacacagttttggaggccagagtctgaaatcaaaatgttgcagggctgcgcttcctccccccaaaaatggagaatctgttctttgcctcttccaacttctggcagctgttggcattgtttgacttgtgaccatttcactctaacctttgcctctgtggtcacattgcctccttcttgtgtcttgtcttctgtctgttcaaatctacctctgtatttctcttagaaacacacttgtcattggattgagagctttccaggattgctcagtgtgacctcttcatgtcaagagtcttaatcacatctgcaaagattcatcttccaaaataagataatagtcacagattccagagatttggcatggatatcttttggggcaccattttttggcctaccacagcaagacatttaaaactgttttgcttgaaatctagttcttctgccttataacaccattgttctctcagcatatttaatttgaagagctagaaataattctagaacattttgtgcagataggcactacttagatatcttaagaagcttgttctaatcaagtttggaaaagtattttactccaggagttgaaataaatcacccacaaaatgaaaaaacaaagacatacttgtacaaaaaagtgacaagtgacaattgtctgtctttgtataattgactttgtcacactgagaacagaggctggcaaagagcagccactgaaaaaaggatgtgttgatttgttaaaataatgaatagaaggaataaactagactttgacttctgcagtctcaccactgttagtctttatgctctctggttatggttcctcttatcccagaaatgtcgattgcaaattaaacaggctacaaaagtctttatgaactgaaaacatttaaaaatgtttaactttctcatgaaatgtaaatggctaatatttatcaaatatttattgtgtgctaaggctctctggacctgaacataaacatcttaaattacaatattaatattacacaaccatagaaggtaacctatcttcatagttaagtgcactttaatgaactctccaattgctctgtaagatatatggaatgaagttcagagcttgccgaggcctgctgacaagtggattaactcctagtaagactgtatgattctgcgccgagtagttgtctgtttactaaaagtcagtagatgtttccaaacctgtttatgctaattatctttgttattgtaattgatgtaatttaagaactgttatatagaatgactaatatgattaccaaaagtggattgttgttatttctatgaaaattaagttgagagctttgaaagatttgagacataaatgttgctgaaaattttttttttttttttttttttttgagagagagtttcactcttgttgcccaggctggagcgcaatggcacaatctcggctcactgcaacacctgcctcccaggttcaagtgattctcctgcctcagcctcccgagtagctgggtttacaggtgtctgccaccacgcccagctaatttttgtgttttcagtagaggcagggtttcatcatgttggccaggctcgtctcaaactcctaaccgtgggtgatccacccacctcggcctcccaaagtgctgggattacaggcgtgagtcaccatgcccggcttaaaaaaattatcgaattagatttaggtaagacaattgtaatagactaggaaaagttataaaattattaaaggactcggtacttattgtatctttgtgttctcactccattttaaagaaaccaaaaatgaattagagatgatacattttgagcctgttttatacaagaaagacaatatgacactaactagggcatccatatgcaaaagatgggtcaagggttatgtgtttgaagctaaataaaataagactaaaaggtgtatgatttttattattccctactgtgattgaattcaagtagtcaacctatgatcagttttgatcatatcacataagaaggtttataatattatatatgtctaacatgtgatctcaccttcatgtggaatctagtaatgttgaactcatacaagccgagtagaatagtggttactccagggactgggaggtagggaaaatggggagatgttggtcaagggcacaatcttgcagttatgggatgaataagttctggagacctaatgtacagtgtgatgattgtggttaatatatactatatttggacttgacttatatgatagttttagtttgaatttaaggttcatcatttacaaaattccaatagacttcagctgggtactatggaaagagtgcccaatttacagaaagtaaaaaagtcaatacaatttttacatatgatatatgtctagcattgcactagatatcatatgaaaataccaatatagtataagtcatgtttcatgctctcaaggaattagaatttggttgagggtaagaccaaaacaacaataacaaaaataataatcaatacataggatgtaaaagtctcaggtatattttgtaaatacataaaaagaatgtataaggaaggatttatgtgggctgttagaatcaaacaaagtttccaaaaggagactggctttgaactggacatggaaaaaggaagatttggaaagttagggaagacagttggagctaattctaaagactgtgaatgcagatcttatgggctgcagatgttcacttccttctaggaaggtttcagtggtgggtgagagttgacagaatacaaaagtggagggagaaaagaagcttataggtgtgcacaggaaaatctccctaaaacaagagaaagtcataagtataaaaaagggaacatattaggaaggaattatcttgattagaaaaacaaccaccccccaaaaaaaggacagaaataatactgaaccatactagggattgcattggacagagccttaatgtatgtacatgatctaagagtaaagactgaaaagttggagtcacagtaggacgcatttagaaaggattcctttatgagcttagagcaataacatttatagtgcttttttatatccctttaggatgactcctgtacgcttccagaattaatcctatctctctctttgccttcctttgcttctcccagctctccgtatttttaaattaacctaaaaagtctattatttcctttaagaatgacctcaactgcatcatgaatcttaagtcttcattggataaaatgcctaagaaaggagaagattcagcacctagtagttatataaatggttgcatgaatgcaacctaggaagttaaaattagaaaatccagaaagaagggagggcaattcgctaaattgctacatttctctctgtgaagtcactaccactgatgtttggtgatctagtttttctataatcttctggaataagatcataagcctgcctttcctgaacctaagtgccctgaatttggatttatgaccaattgtttcagagtgttaacatgaatcacagtgcttcagtgggacaagagaagaaaagcaatttcaatactgaaaaataacaaaatgaaataaaatatagaccaagaatggaaaataaatggatagttaaatacaagtatatgtaacccaactaagcaacaacttaaggattatgggataataatcaccaaatatttgaagaatctaaataacaaagtagaaaacaaattagttggcttgaaggatagtgttatggttaattaacatggaaagaaatgagcaaagaaaacgcttcctttccactagctacggaccagaaaaaagctttaggttcattcaaagactagattatgagattacatacaaagaaaactcataggaagctttttagagagacctgtaaaaatgtggcttatgagcatcttggaggcagactggcatctcaccagacatggcccagaggaaatgtggagccctgaacgtaggtacctggcatgggtaggcacttaagactcacttgtttattttaagaaatggttatattagttacgaagaagaaagcgtatataggcattgctattgtgtgaatgtttgtgtcctctcaaaattcttgttgaaatcctaacccccaaggtgatagtgttaggaggtggggcctttagggattgattagatcatgagggcagatccctcatgaatgggactagtccccttaaaaaagaggccaggagagaaggggcttgtttgcccccttccaccattgaggatgcaaagggaaagcaccacttatgaaccagagagtgagccctcaccagacgccaaatctgctgggtccttgatcatgaacttcacagcctctagaaatctaagaaatcaagtttcattgcttaaaagctacttggtttagtgtatttcatcgtagcagcctgagtggactcagataggcatctgtctttcctcaatctatccacagcttcccctgcttgtctcagtgcaatatttatccgaactgaaattgcttatgggtatctgcctcttccctccctctcatgccactgtgtaaactcctggcatggggatctttcctggggtgtccaggcactgtacatcctagtgcctgacatcttgtgaaactcaatgatggaagactaactttcctgctttgaaggatgtgaaaaacaaacgcctgacacgagaacttggatgttaagcacaaaagttttgacaagagaccttgctctgccacagtttatgcagctgtaacatcaatataacaatggtgcctatatcacaggagttgtgtgaggcttaaatgtagtgcatgtaatgtgcttagcactttgcctggcttggagtagctggtcattaattgttagctcattactatttattatcgatgcacaaaatttatggtcaaaccacaaacataatcaaaacatttggtccaacatatcctctctaaaagccaatagaaattataatatggtcagtctagttggctctgatatttcagatgactgataatattttttctgcttgtattattgcaggaaacttggaaatttacatctcaaaatatgaggttttggggctgtggatgtataattgccacctccttcaatttgcttggtgaggttaaattttggaaagactgggtgagccatactcttcctctccattctccacttgaaccaagtttaaaaattttttattgttcctacttcaccaaaataaaaatgccaattaatgggatttgtccataatgagctttggatttaatcctcctacaaccctaatgcttagagagagggaatttttaaacttcaaaattttgtggctctaagcaccagatggacacttagaggttccagaaagactcaacacaataaagaaatttggctgtattttcacttttaagaagtatttgttcgactttttggtaaagaacagcttaaaaatagttgtaacatataatttgtgttacttttcataaacataatgattttcagtgaaaataacttgtagtcagttgctttcggggtatccccttcatcttttccctgagattctgaaaactatttcatatgggcatgataataatctactattgcctaaacctaagtgtgtcctgagggtcattactataaattacaagagattcccatccactcatattacatataatgggaggaatgtcattaaaattcacttagttctcagattgactcagtacaggcctaaacgaactgtcaaacaactctaaaaataaaatataatgacttgatgtgtagacaatcgtactagcactgaataatctccatttgcaatagttatccggttctatgaccaatttttattctcatagtattattcccttcgaatatttctatgttcatctgtgttcacacaaattaatggttgtttttttgagatggagtcttgctctgtcacccaggctaaagtgcagtagtggatctcggctcactgtagcctctgcctcctgtgttcaagagattctccagagcagttgaaactataggtgcatgccaccatgcccagctaattttttaaattattttatttttggtagtgacagggttctaccatcttggccaggctggtctgaaactcctgacctcaagtgatctgtccgccttggcctcccaaagtgctgggattagacatgagcaaccacatccagccagattaatgaatattaaattgtaatgatcagattagagaattatctaataatttaagaatgcagatgtactttaaatgccatttggttatactaaaaatgttttgaataatttaaaacaatcattcacaatttagatgacttatagttacaccaaaacactggggtagaatatgtgatagatgcttagagttacaatttgaatctgggaaaataacttctaatgatactttctgtgtagtatcactcaaccaaacacaattaacatattaaataacctctgttgggaattattaaagttttcacaaataattttttaatatagataatttctgactgcttcatcttgatgtaagttaaataatttttttatcttgcccacatccccaatcaccatttataattttttgtttatgtgaaaatatgccctttattcaaaaaaattgactaatagcaaactttgggaatacaatttagcctggagaagaaaagatgtaggtagaatttattagctgttgaattatttggatgactattatttggaaaacaatgtattagaaatgactatttccaaaggtagatatttgaaccatggaagtagatataagagataaatttcttagcaaaaaaaaaaattttccaacaggcacagctgaccagaagtagactggctgctttggatgagagtagctttcctgttaaagagagttcttaagaataggccagatagccactcaagaagaaaggtttggagggaatccaagtctggaaagaatgtttagacatagctgctaacgttttgtcagtttgtagttgccaaaaataagagtggagattgacagtggattttttcaactcaactaccagtttctttcattaacatagcatggcacttctttctgtagtaacacatcaccaaatttgagaagagggacatctggtggatgaaataagcaaaaggaaaggggttttgtttttacattataatttacaacatattttgacatttccattgatttttccatgaaaagaaaatctatcagtctacaaaaatatgtggttgacaatgggcaaaaattatttgtgaccaagtgatttgggtatggtgatcgtttcatctggccccttactatatgtttaataaatgcctttttagtcatttttccttaattaattcaaattaggatatttgaggatgaacttgcttgtcttaataaaacataaacatgtgactttcttggccaagtaagagctgttatttttagctaaattactcagtagacggaatgacaaacaaaaaccaaaagacatccaattgcctaaactataaatgcaattgtttttagtctttacaaaaatattcatttcagtttttctattctaataaaatcaaaattaatttgaacttagacatttaaatgtagtgatacatttctctatttaaaaaaaagtaattttctggctgggcatggtggctcacctctgtaatcccagcactttgggaggccgaggtgggcagatcacctgaggtcaggagtttgagaccagcctggccaaagtggtaaaaccctgttgctactaaaaatgcaaaaattagctgggtgtggtggcgggcgcctatagtcctagctactcgggaggctgagggagaattgcttgaacccaggagacagaggttgcagtgagctgagatcatgccactgcactccagcctgggcaacaaagcgagattccatctcagaaaaaaaaaaataaaaggtaattttgtatctatttccagaaagatcaatagggcagcaatttaaagcaaggttgcttgaaataataagctgaatccaactctactaactaaaatgactacctacctcattagtgatgttttcccatcaccgatttctatatctaaatcacaaataagtattggaagcatcattcttgaaagcagagctattattttattctttatatcctgaatacaatatattgtaggcacttaaatatttggtggatgaatctcttcaaatccattgtgaccgggaataatttcacccttccttgaaaacccagacctctctctgtgcctctcgacgcttttggggaatacgaaattgatgtacctttcactctcgcattttactcagtgccaggcccaatgcagaaaacagaagcattttgcaagttccttttcttcttcagacctagctataaggaagatgctgtccctacattgctttgcacacaatacaacctcagtacatcttttgttgaatacatgaatgagttaataaattgctaactcttctgagtgtttctcctgtttttttttcctcattctcttcccttttacttcagtctcatatactatgatttcataaataagccaacatttgttgggtattcattatatttaggtattgttctaaatatgttatacataagtcatttgatttaattctcatgataaccctatgaggtaaacttaaaaaaatacttattttttaaaaaagaaaactaacgttaggtaatttgcccaaagtgacagggctagtaagagtcaaagccagaatttggacccagttagtttctgatttcagagataggtctcttaaatattgcatttatcctgactctaataatgaccctctggtaaaatacccagacacacagacaaaaataagtgagaatgagaatccatattccaatgtcttcacagaagatgatggaatattctaaaagacaaaccaagagatgggaaaagtgtccaaagtcctatatggaaaaatcagaaaaacgttttgggtagaggttaagagcacagcctagggaaggagtctgggttcatatcctgaccccattacttactagatatggcactttcttactagatatggcaacctctttcactgcctatctctccttgtttctgcaatctgaaaacagagagaataagagaatccactctgtaggtgttttgtgaaggttaaagaagttaacatgtataaggcatttatgaaaatgaatggcacacaatacttgctagtatttctatcatcacagttcatcatattgaagacatactccattataaaatgatctattttctatatgactctaataaaaaatgcctattgtaaatgcaagaagccattgatgtttagatgtatcctgatgtcagagatattgaaatgtgaaaagaagtacacgctggaattatgtgcagaatagacaagaaagaaaaagccagctggcagaattaaatgttttcatacattaacaatttcatttttttcaattctcttttttactttcttttcattattttttcaaatattttgtatctaatcatgaggtttcagtaccatggttctgggaaaactactcatgtttaggctttaaagttagctgtggtactaaatccttcgatgaaagacagaatgccctggaaggaaggcagacagtgtatgagtgcatgagtgggtgaagggaagggagctgaagggtgtgcaggaaatgaaatttacctgatgagaccagatgctttaaaaatttttttcaagtcaaaatccaaagtcacttggcaaatacgagaactaggaagatgtaaagggttggaaaaatgaatcagggacaaatcaattattcaaattattcattcaacaattgttaaattaaacaccaatgtcaactcaactggctttgcatgctatatgaaagaaattaaaaaataagaaaagattacaaaagaaaaatatctaagagaaaattgacattaaattgcattacaaatggcatagttaactgcaactatgacctagtttctgcagtggtagcatgctgttttcctgattaatactgtattacttctttttataccctgattattatcaaagtaatcagcactgagcaaacagcaatcgaatcccttctcaggagaggctgattctctactgatgttaagctaagccccttcatggagcttaaatcagcccctgaggagccaccagatggattgtgagaatttagaagaggcagtattagtgtggaatagtggaatagacaacagaaaaggagttcaagtaattgagttcaaggatcacctttgtaacaaactagcagtgtgacattgtgcaaattatttactttttttggacttctacatacttgctcatattgaggactttacattttctccccccttctattctttaattttctgatattgcgtttaacatgatgagacaggcaggaaaggagctgctgtcagacactgggcttggtgtgcatgccttatgatttacgggcaggatcttggggctttcaaaagaagttctgtcctcatgggagattaccgtggcaaatttctatcttatgttccttacaataatcatgactaccgttcacgggccaggggccgccacactttatctcatttattcctcactacaatcctctgaggcaagtgttaggacttttattttatggaggagaaacaggaacacaaaagagattatcattataataatgaggagaataattatttgtgtttactctgtgcaattactgtgctaagggcttctcatatattaattctctccatccttacatccacattttaagaaaggttctgctataattaccagccttacggcatctaataattaaataatctgttcatgtcatcacatggctggtagtgggaaaacaggattcaaatgtaaacagctagattgcagaatccagtacttgaccattacacattctgcattaaaactacataaggtcgcacaactaatatgaagaaaaatagaaatccaaatttgactccaaagcatggacatttgcttaatggacattgcttaatggttattaagcaatactgcctttggcccttgcccaaccatatgttgtcttcctttggattttctgtggtttctggcctttccactcaatattgctcaatcttggtctcggacttgatatgtaacattggcctgaccgcaaatatgcttttgcttcttgtaccaagccctggggtcctattgtgcctatcccaggacatggacccatctctggtcactacttcttacttggctctggcagctctagggccccaagctttgctataggacccaagtcagccagccatgtccccgctccgcctcccgcaaaatgaaaaacactggtcacatatgtttgtgaaaaaacttactatagatcaataagtgggaaagataaggagattaaatgccaagtggcgagttgtttctaccttactcttactgtacatcaaaaagtgggacatacagaaaaggtcgtagatgtgtgtttgtgactcaacaacaaatctctgagaatcaagtagctacaatatcatcattattatcattattaccagatttagaatagtgttctatcaaaccttaacacttacaaacatccaaatcatgtcccttctttcccattctaaaattgcatgccagcaaggaataacctaattatttcaaaggcatatattgaagaaaggataactttctctccccttttctttccatgaccaccaacagtcccctagtttgaatgctaagagttttttgggaatcacattcaacttctgtgtgtcactgagcaatattaagggctggcaaagaagagcaaaatttctaagaaggaaaacgcagagcaaagccagctgttcctgccaatgtactaatttacatttttgcaaaatcaaagcaccacaacgagacacactgcattcagtcgacttcatgaggtcactctatgccatgtgcccttttcaactttgtgactgaagcagtaggcacatcttcataaggctctcagagtcttctgtgtccaaagaggtgtatgcttagtgttgcacatgcaaacatggcattctcagttcatttactccaaggctccttagctctcttttcatttagaaaaactattctttgacctcctctgatgctaatgatctattttctgtttcctttcatggatcacacaaaagttgaaattgcatccaggcaccagagggtagaggctggctctggatctagacagcctgggtctgaatctagctctgccatccacaaactgtgtgactgggcaatgtccttaattctcagtcctttgatttcctcatttgggaacaatgaaatagtacttactaggaagagttgtttacctgttaagcgtttgttgtgagggttaaatgtactaacatttgtaaaatgttgaagacagtgcttggtacatagaagatgcttgataaatattagctgctatttttacccaatgtggtatattaatatcggcaggcaggggttgcaaactcaaatatcttctagggtcagaaatgtaaacaaatgacataatagggtccacagcaatttgaagagtgcatagtttgcctaaagtcttccaaattctaagtgctttttaaagcactgtgaaatccaaaccaaacacatctgctgctgaatttagtctggtgcagagaaatgtgggctaggagaattcttccatgaatggtacaataaatattctagctctctttgcagaattaaggaatttcagtttatccttgttttttaagaaaattactgcgatggatgttttacatccaagaagacggaaccatgcagaattgaagcttagacataaacccaaaaggaatagttatcatatggggtgagtgaaaggatttgctggtgtcaataaccagagctggcagctccagcctcagctagggcagcagggaagcctgttaaggaaaagcacttgggaaatgaagaactcccacaacatccatggtcttgagactgactagggccaagagcagcattgtaggaatgcaaactgagctgtacttgtcctgtacatagaaataccaaggaggctacaaggatagaaagaagaaatgagtttagcagccagaagtcctaaattccagctccaggatcaccacacagaaactgccaaccttgagcaagcttcctagcttcttagacctatgccatatataaaaagatgatcatttttgttctgactacctcactgagatactttgaatactgaataaaaatggcatgtgaaaactgttcagaaactttagcatactatgtgaagaaaagttattcgtttttaaggcttttaggccaaattgcatttaaacaacaaagcactgcttgaaaacctgcatataacaacaatgttttgcaacatccccatgccctatttacactgggaatttgcgatacaattgaagctattataggtagttggagacaatcttctgaagttgctcctaatggaatgaaatctgtgcactttagtaaatagaagaaaattgtcacccaaaacccacagcatttttttactccacaatatttttttcctcctatatctcttcaaggactgttttagaataacttagaagatatactaactttaaattaaaaaaaaatcttcaggactcaattcactcactcactctcactcatgtattcattcagatacaaatattatcaggcacttaaatgccatccactacaccaagctctggaaatatactgatgaaaagatataacccctgcatctaattaatgttgtctatggtggggagaaagacattccaactacaggacaatggtactggctacagtgaaggtgtgtgaaacaagtaatgggagaattgaggaaaatcatctaatctgtctgggatgtgagaatgccaggctggcagatgcagtggcagatacacaagggcaagtcagaatgagcatggtgacttctatgccagtagttcaggtcaaatggagcacagagaagaaaagtgagaccagagggcaatgacattgaacatattttcaggggtaagatgttgaaggctctctgggacacagaaagcaacatgtgaactatttgatagtgaaccattatagaatatgagtaatataatgatatttgtctgtgaaaatcacttcggagataacagaggtcacacctagagctagggatgtcaacttggaggacactgtgctaaacagggcaggaaattattagtccttaattattgcaattgcagttatgatggcgaagagtatatcagttagaattatttagggttggtgtttgatttgacttagaaagcaaggatagagagggaggcaggaagagagagagagagagaggtgaggagtggagtgggggagagagggggagagagagagagagagaatctactgtcacttggtactctatatgcctatatgctttaggcaattgggtagatatatttaccaatacaggaaataacagaagagaagatgtggacaaatatgtgtgatttgatttttaaatgactaaatttgagttacctgtgtagcatctaaaggcaaatgtctatgaaatggtcaaatgaccaaatgattattaatggtgtttggttctggagctctagagaggagtctatttggagatataggttttgggaatcatcagtaaatacatatttgatatcctggatgaaaatgatgttgactagagagaatacatacagtcaaaataaaggagctgggacacacctctgaggaacaccagaattttggaaagctgagaaagaacagacagagtagtagtaggaaaggccggagaatatagtgccatgaagaagggaggagtcaacagtgtcaaaatctccagctacacaagaagcgaacatttaactgtcaattaggtcatggggaccattatgatactgtttcattggagtgatggaggtgaatccatactgtagtggattaatggaaactgagaaagtagagaatgaggatagactactctttcaaggtgcctgactttgaggctgtataatagaatataaagtttttagtgattattttagcttgcacaaaattagaaagtataaaatgtagtaaaatgttaacatatttgcagggtgaatgttggcagtgatggtagaacaagaaaatgacccataaaactggcaaataaattggttagacttttaaaatctatatagagtgaatatggttggctgcttgtaagattgtctatgaatgcgatggggaatttggaaacacataaaagcctaattgaggtgacaaagtttaccctagggagacaggagaagaatatatgcataacttagaaggcaagaacataactcaattatattgtttttgacaatatactgcaaggcaaaagtcaggctggggcaagaagaggaacctataagccagaagttggggcatttctctagggatgtggcagccatggggttgtgctgctcagatctcccttcaagaaaggacttgttgctgatgatctccagctgctgcatcttcaagatgtgccccagtttcttgacattatattctctctgcaccactctagccaatgactgagtagatcaggggcactagagacaggccattcctgtccattgagagattccgcttatggccagtttttgctctttggttcctcatcagtctggctacactgcagtgtgaggctcttcttaattgattctttcttttttccctctctcctttcaaaagtgtcagaccagcatcatggtccaatgactcttcccacctatttctgctccctttccccactttccttctcaagaatttcctccaataaatctcttgcccatctatttccatcttggactctgtcttgtaggatggacactgacacaggatagatgcagaagttttaaattgtcagggcataacttttccaatcataagagaagtgtgatctacctaagtcagggatcacttagcacatcccattgtagcagtggaatgtttctcttgaaggtcctacctccctttattctgatccacccaagatcatgccttttgtggagagaaaactatcaggtttcctattagagtttgggcactttatcctctatttgatagtcttattttcttcttctctgcatttcaagtaactctctcccatgatctattattctattttctattatttcaatcattttcttttcaatatcttcagcaccttgccccatgacctttcatcccatccacctagatgaagccgagtgtccaactgcttaccttctccatatctttataaaggctactcaatgttgctggagagaatatttaaattggtgccattctaagtccataatgagttttagctggcaactgcttatatattcggttgagtcctgataactgcctatacttctagatatgctttgtaggcattttgaacacaatgtatctaaacttcatctgattttcttctagcatttcgccctttttttttttttacattggctctaacaggaagggatcttgtatttcttatttaaataaatggcaccaaaggcttgagcattggtttcttaagcaccagttcttcataccaggacatccaatctgttgccaacttctgccagttctgacatctaaatagattttaactctatattagccttcgtgaattctttaaaattcagtggaaataaacagatgaatgactggttgttaaggggagaagagaataagatatagaatcacgtatgccaatgtttgtcaactctagctgtgagttagaatcagtagagtagctttaaacaatatcagtacttgggctgcacccctcaaagatattattccccttcatctgagttgggcctccaggtttctgttcagcaatctccaggtgattctaatatgtatccagggttgacaactactgacatagagtccaaagagaagttgtttgttgttaattgtatcatcgttttatgataaaagcacgtttatgtactgagagaaaaatgctaatgaagaaggttgaagattctcagggaggggggtaattgatggagctagtgagggtataagatttataatgaatagaatagtcatttctctggcactctggggaaggaggaaaggaaatatacagatctagagatgtttatagatttgagaagcaggaaaggaattggagtgagtttctttgtgatgtcttttactgttttccaagaaataggcaacaaatatatcagctgagagggaggctgaaaactcattacaccaagatcctggcactgggtaaacacggacttctgtggaaatcttttctcccaaataatttatcattctaatggaaaaataactcatatgtttctgcccctccccaaacaggtattacagtgataaccacaaaccaagtgctcaaaaaacattttgattgatctcaactcatagcttattttttccttttctgttattgaaataattctcctttattttttcttccttatcctaaaagctttttattatgtacccactccaagtcattgcttttttccccctcctcaggggttaagtttaaactcttccctttcataaagctcacaggtcttcgctttcacaaaatccacactgggatactttctggcaaaaggatacagtgacagttttcagtactacagatacatctcttttggattccacaaggcagcatatcattttgtgtgtgaacatcacttttaatagagtcaaactaaggaaatgaatgcataagtacatacatcttgtgtaaaatatattttcagtttttcaacacaatgacaagcacatatgaacatactcctttaagaaatactttcttaaatgaaattctgtgtgacattatttgatacagaccaagtcagttcaaatcaaacctagagagttcagactgcctttcaattaaggatagcccaaaaggcccatggacatttcagaaattatacaggtagacagaaagttcactttaatgtatggatacttagttacatgtggaaacttctgtattagtatgaaataaacttttgctaggtgctccatgtcctgtacttcatgtgtatgtgctaccttacttatgtatgttcacacttacttgtgaaaatcccacaataaggtttggatttatcaaccagcaacattctgagacccagctccatgtagtgttttacagagatctgaaaataaatgtaaggtccagtcttcttctgtaaaacatatacaacatagactagtcaggatattaaggtatttgagacacaaaatatctgataaaaaagcatttacttaatatttaatgtactggatgtttgaattcctattatgtgtcatatgtgtgctaggcagtatgaacaactgaagcctcttccttgaccagtttatataaaccaggtctacacataactctctattcccttgcttgttttatttttatttttgccattttaaattgttttctagaacttagtgctggaaatagtatgcatgcatttgtttatggtctgtcttcctccattggaataaaagcagggattttttgtttgtgttgaattcctagaatttaatgtagtgcttagaacgtaaaaatgctcaataagtatttgttgaataaacgaagaactcctgcaaactagaattagagtagggcaagactaatataaactaacagtgttcaagaagctccatagaggaaagtcctcttggcctagcagggaatgagaggtgggatgctcacatggggagaagattccagctaaggagaaagacagagtatctcatagcacagtctctgagggcatctgttaatgtaatggttaaatcatttccttgccatgggtttctgtaaaattagtttcacatgtggtctttcccattcctagaattggtaagtatttttcaaatccccaaacgcttttgttatggtggctgtaaagttgagtttgagaactgcctggcatatgaaaaataggataaacttttgtagaagtcatcagtcggattgtaaaatttataaaagcgtaagaaggatgggcttttctgttccaaatatccttatggagatttaattccaatggcatccatgcaaatttcccaaagccttatggaatgactgggattgatcgcagttggggctgtgttctaggctgcagtgaacacagttggatcacagagacctttgtttagtcctggggccgggtaagcagatatacccattctcctcataccaaattacagtcatctgtctaagggagttatgatattgttaaagggccatcaatctctttctttatatgaggattcatccaagcacaacactgtggatacaaacaggtggccttaattggctactaccttcctaatctagttcttaaagggtacagtttggatttcaaaaccagactgtaaacttgagttcagaaatggagcaaatgctcagatggtcatgctcttttaaggaagaattttaaacagagtgacatctggtcagagagtgagggcacaaggtaaatatatcagaattgctcatgaccagacctttcccacaccaaagcacagccagtttaacaaagtccatgattagtagtagagaaagtaaggtagttgttcatagttcccaggaaaaagtgaagcagtgtgcaaaaaattaggagagtttgagcaaattctccaaggcctactgaaagctatgtctccaccaggttaaattccagcttcagctctgcagccctggataagttacctatgggtaacctacttgagtctcagtttcctcatatataccatgaagataagggtaccttttctacagagttgtagtataattagtgtagttaagtggtcaacgattgctagacttaattatttttattaaagaaaatgtggcacatatacaccatggaatattatgcagccataaaaaatgatgagttcatgtcctttgtagggacatggatgaagttggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagggatagctttaggagatgtacctaatgctaaatgacgtgttaatgggtgcagcacaccagcatggcacatgtatacatatgtaactaacctgcacattgtgcacatgtaccctaaaacttaaagtataataataataaaataaaaaaaagggaactaaggtggttagaaaattcaaagggtaaaaattaaagaaattaaatcaataattccagaacaaaaaagaagtacaccagccattccacctgtttcttaatttttcaaaaaagaaagaaaagatcaatcaacttatgttttataatagcctctcatttggaatctaaagcatgtccaagtttaccatagcaattgacagataagaaagcataaaaggaagaaggaaactggatggaggaacaggtggactagtgtcaaggctgtagtagaatatgtcttttaatcaaccaattgccctattctctactagaggtctaaccctactctttgcttttacagacacttataatacgtaataacttacattgtatctaactagcattgatcaaattacaaacaaaatataaacaatgtgcactgaccagaagaagactataattaaagtctcttgactaaacatgactatataactatgcttaatataccaggatatcagcctcctaaaattaattatctccctaatgcaagttgtgtgctatcagaataaccaatttacttttttcaacaatctattcacaccagtttgcaattaagattcaaaaagccaagtcctgatgagcaaggaagtcataaatgatgcatgactgtcctacttttatgtaatgttacatctattattctgctttaattgcctagcatgctttttaatttgtgaaaaattaatgctggggttattttatacagattatacctactttgaaggtaaccattctaggaagcatattataaatataagtatgtcatctttttaaatttagcaagctgattcctaaaatggtcaattaaattttaatagttttttttgtttaactgacatcctttttagtccaaagattctaatgaaccaattatctattgtttcatcttgcttcataacagggtgaaatatttcttgggtattttcatcactgtttttgtgttcagaatttaaggattcaggaacactcacatcttagaaaatgtccagtactttaaactgttgaatctccattctgttcagaacaactctctgggagttgtagtgcccaaagcgaaactcttggttgcctgtgatcttgactctggcaatgctactactccacaatccctcctttagtaaattccactgccatgctaggatcctgggttaaggcaatgttccaggcaagtgttttaattataaagaacagatagcctcgctgagataaggcagaagaggaaagttgtaaagatacaaaagggtaattttgtagacatccaaagacagccaagactcacgtatattgtatctggaagctgcaaaatcagaaaatgaaattctcttctatctcccagtgactgcattagttgtgcatattccttttgtgcatgaccagactggcaaccagtccctaatccctagcatgacccatttgaccaagcatcctccactttgttgtctcttggtttgggttatgaaaagggaaaagctctgaaatgctaagcttatttcttgggaatgctctttgcaacaggccatgccataggtttctggtcagccaaagatagggagtccttggcttaggaatcttctgtggtcccctaatctgtggtcagaagagagggtcacatgatcaatagggttgattttccagggcctgtgggaggcaggcactcacaatgaatttgtctccatcatgactgctattgttacttcaagcaaatatgcataattaagttctcataaatgtaagctatcattataaataccatcatcactatcagagttcattcattcaacacatatttgttaatattccattatgtgccagtcactctctgagactggacataaagatgacgatatggtttggctgtgtccccaccaaaatctcatcttgaattgtagctcccataattaccatgtgttgtgggagggacctggtgagagagaattgaatcatagatgcagtttccctcatactgttcccatggtagtgaataagtctcacaagatccgatgattttgttgctgttgttgtttttgagatggagctctcactctgttgctcaggctagagtacagtggtgggatctccactcactgcaacctccacttcccgggttcaagtgattctcctgccttagcctcctgagtagctgggattacaggcgtgcgtcaccacacctggctaattttttttgtatttttagtacagacggggttttaccatgttggtcaggctggtctcgaactcctgaccttgtgatccgcccgccttggcctcccaaagtgctgggattacaggcatgagccattgtgcccgaccgagatctgatgattttataacgggtttctccttttgtttggccctcatttctctcttgcctgtcgccatgtaagacgtgccttttgccttctgagaatgatcgtgaggcctccccagctacgtggaactgtgagtccattagacctctttttctttataaattacccagtctcaggtgtatctttatcagcagcatgcaaacagactaatacagatgaagaaagtctttatttgaaataaagcagatcctaaacattaaggaactgatatacttacgagacagattgggaagaggaaaggatggtcaccttccaaatgacagaggacaggtggaaaattttcctccagtgaaacggaagggatactaaaatgatgatgagaaatgcctcgcctaggtgttggtggattaaaggctgagagagtcaggcagaaaaaagaaatatccaaagggaagatccagctaacctacaaatcttaggatgatactgaatgataacgctcatcctctgcttcgtctgaacccatgtggattaactcaaagttttctaatatatatgaagttacagtccctgacaaaattatctgaacaaatgtcctctaagatgtatgttaatgctttgttttagaatcactgttgtaaactcagatacttaatacagggtccaagcagttcaaacaaatgagtagaacataccagatataatatggcaagatctaaggtgattgagagagcacgtattctgtctaaagagagaagccatgacgcaaccacctcaaaacaagacactgttataccagatctcttaattttttaaagaaatactgggtagataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaacagcaaacacattcaaaagctagcagaaggcaagaaataactaaaatcagagcagaactgaaggaaatagagacacaaaaaacccttcaaaaaattaatgaatccaggaggtggttttgtgaaaggatcaacaaaatcgatagaccgctagcaagactaataaagaaaagagagaagaatcaaatagatgcaataaaaaatgataaaggggatatcaccaccgatcccacagaaatacaaactaccatcagagaatactacaaacacctctatgcaaataaactagaaaatctagaagaaatggataaattcctcgacacatacaccctcccaagactaaaccaggaagaagttgaatccctgaatagaccaataacaggctctgaaattgtggcaataatcaatagcttaccaaccaaaaaaagtccaggaccagatggattcacagccgaattctaccaaaggtacaaggaggaactggtaccattccttctgaaactattccaatcaatagaaaaagagggaatcctccctaactcattttatgaggccagcatcatcctgataccaatgcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacacatgcaaatcaatagatgtaatacagcatataaacagaaccaaagacaaaaaccgcatgatgatctcaatagatgcagaaaaggcctttgacaaaattcaaaattcagcaacccttcatgctaaaaactctcaataaattaggtattggtaggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaatcaggaaaagaggaagtcaaattgtccctgtttgtagatgacatgattgtatatctagaaaaccccattgtctcagcccaaaatctccttaagctgataagcaacttcagcaaagtctcaggatacaaaatcaatgtacaaaaatcacaagcattcttatacaccaataacagacagagagccaaatcacgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaacttcatatggaaccaaaaaagagcccacatcaccaagtcaatcctaagccagaagaacaaaactagaggcatcacgctacctgacttcaaactatactacaaggctacagtaaccaaaacagcattgtactggtaccaaaacagagatacagatcaatggaacagaacagagccctcagaaataatgccgcatatctacaaccatctgatctttgacaaacctgacaaaaacaagcaatggggaaaggattccctatttaacaaatggtgctgggaaaactggctagccatatgtagaaagctgaaactcgatcccttccttacaccttatacaaaaattaattcaagatggattaaagacttacatgttagacctaaaaccataaaaaccctagacgaaaacctaggcaataccattcacgacataggcatgagcaaggacttcatgtccaaaacacaaaaagcaatggcaataaaagacaaaattgacaaatgggatctaattaaactaaagagcttctgcacagcaaaagaaactaccatcagagtgagcaggcaacctacaaaatgggaaaaaattttcgcaacctactcatctgacaaagggctaatatccagaatctacaatgaactcaaacaaatttacaagaaaaaaaaaaacaaccccatcaaaaagtgggaaaggatatgaacagacacttctgaaaagaagacatttatgcagcgaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaatgggaacacttttacactgttggtgggactgtaaactagttcaacccttgtggaagtcagtgtggcgattcctcagggatctagaactagaaataccatttgacccagccatcccattactgggtatatacccaaaggattataaatcatgctgctataaagacacatgcacatgtatgttgattgcagcactattcacaatagcaaagacttggaaccaacccaaatgtccaacgatagactggattaagaaaatgtggcacatatacaccatgcaatattatgcagccataaaaaatgatgagttcatgtcctttgtagggacatggatgaaactggaaatcatcattctcagcaaactatcacaaggacaaaaaaccaaacaccgcatgttctcactcataggtgggaattgagcaatgagaacacatggacacaggaaggggaacatcacactctggggactgttgtggggtggggggaggggggagggatagcattaggagatatacctaatgctaaatgacgagttaatgggtgcagcacaccaacatggcacatgaatacatatgtaacaaacctgcacattgtgcacttgtaccctaaaacttaaagtataataataataaaattaaaaaaaatacttaaaatgtatttttagacaatagaattccaaatttaagaaaaaaggctcactgagggtcactcaaaatatgtctggtccagtttgtggtctataaattgcaagccctgtttgacagtgaagagtgcagattgacctggcaatcacagtcttgctttgaggagactcacacgaggggaactccagatgctgcgtcctagaagttgatggagctgtcctgagttgcccaaagtgggacactattatccatggagaaatcaacagggttagcaactgtggtagactgaataataggcccccaaagaggtctgtgttttaattcttgggacctgtgaatattactttatgtggtaaaagggactttgtcgatgtgattaagttaactatcttgccatgggagattatcctggattagtaggcccaatataatcactggagttcttacaagagggagggtcagaatcagagagagaaggagatatgatggctgatgaagaggtcagatggggcattgctataaggggaccattagccaaggaatgaggtggtctatagaaggtggaaaaggcaaggaaccaatttttcccctagaatctccggaaggaattagccttgtagacaccttgacattagccaaaaacagtgattttgcacttgtaacttccagaactataagataataaatttgtattcttgaagctaccatgtttgcagtcatatgttacagcagccataggaatctaacacagccatacagaagttcacaaagagttggacaacctcttctggtcagagagaaggctgtgggaggggagagtcaaagaggaaacattttcaccggacccatgccatgaatttaagagctccttgaccctgaaggaaactactgtctattagaaggccctcagccttctctacataaacaattattctgctgggagcccaggacagtagccatcaatcatctccagttctgatcagaccatttccaaagcccacagatgaaaggggatgcagagcaacatgatggaaagaacatcatctttaaaataaatgagatactttgagtgacggcctacctgagcctcaatgtcattatctgcaaaatgggaataataatatcacacagagttatgagacagtagaatgaaaaacctctaccatagtgctttgtgaatataggaaccctataaatggaagaaattgatttgttattccctactgctactctttattctgcagatttgctattatcacaagattaagttttgctccctattctcagcaaattagcgctcaatgggaatgacaacaaaaatctttacatctcatttcaatgtcctaatctcccaaagacagtgaatgaacatatgcttccggcactgttaaaacgttagacttacaataaaacctcctgtcactggaatgtcaaaagaatgagaggcttctcaaaaagttaaccatcctaagtcatcctgacaactatcatgtccaatatgtacactgtgttgctgatgcttgttaaagaagagttcaattgtagcagcttcagactgtgtgcttgtggcattcagcagtcttcaggctctgcaaagatgcacagtaacattttgaccaagatttccacagtattattgcattaattaatactgtgcaatatgtaaagcaacatgagcagagaatatgtaaagcaacatgaattcacagacttgttcttgaataaaacaggcaatgggcacaaacacattttagagtagactaaaaatataaccaacacttgggaaatagaggttcactgaactttgaaatccaaaaccagcatcacaaactcaaatgatctcaggagccaggaaggaaggccaatgagtaacggagagggatctaccagtgttaaggcttgtggcaaattgggttgtaggctctgcttgagggtgctccccttcaattccattcaaacatcacagactaacagactctctgtgggctaactttagctgataggctgtgatgtgtagcccctctggcaaatgggtacttggccaaaaacttcaatagcagcaaactcagcctgagggatacataggattaggagaagtttgtcttcagagctgctcattccacaaatcacccttgctcccactcctacatcttaggtgtgcatgccctgcgctttgcactctgactgctcacatctcccctcgcacctggcctgactttgctcttagaggctattccaaacctagatcattctttctctccatgggcaaaattatgtatctgaaggctcattcattcccttaggacaagggtaggaatctacagtttccctggtatagcaatatacattctaatttcagtatcaataaagcatgctgtagaaatgaatactttgttggcaatatttagaaaaattatatggggactgtctcagtacttgagtatggtaaacatcaagttctacaatgtatacagagatataccatcacatgatactccagaaatatatatggttattatttgtcagttaagagtaaaattaaagactttaatcatctctgatatcctagaaattaaatgttcctgttagagtaaattgttctctgatagtgaaattttaggctgtgacaaactgcttgagtatatatttttgagcagggaaactcttatcacctcaggtcacaccttggcctcattcccataaagattataataatgatgagtgaagacagctagaagagtttggagaagtaacaacactggccttcagagtggctctcttgagcctgttcttgtaaaaacaaacatttgtctgaacaccaaacaacaaataaatttagtaatcttatttcttagctctatttttttcttataaaatagacgtgattttcataaacagatttgattgtagccacatttagtttttttttctaaagttcattctgtaaaaggccatctaaaaatgtaaacagaaattacatttagatataacttttatttcatgcttgtaaaattacttgtatttctatagaagatcacataatggcacatgaagtaggctttaggaaccagggttattgagcatgtggacactggaaatggtcttcctgagtttgaggccttgcatacaatatattgcccatattaaatgtttttcaaaggaaagatagcagaaacatcctcctgcttgtttacagaatccaccaagtcagccgcttgcggtggctcacacctgtaatcccagcactttgggaggccgaggcaggcggatcatgaggtcaggagatcgagaccatcctggctaacatgatgaaaccccgtctctactaaaaatacaaaaaaattagccaggcgtggtggcgggtgcctgtagtcccagctactcgggaggctgaggcgggagaatggcatgaacccaggaggcagagcttgcatgagccaagatcgcaccactgcactccaatctgggcgacagagtgagactctgtctcaaaaaaaaaaaaaaaaaaaaaaaaaacaatccaccaagtcaaccattttgccttttcagggcaagggtaaatgtgtgacaatgacaatcttaaatgagatgactttgttagagagcctattcatagacagtaactcagtaaatgatggctgttgtaatccatccagtgatgtctgatgttcctactagaagaaatataacaatgaactttaaaacaattttatgatatctggcatttgtgcataatataaatatttcaaagtgttttaatttatttgatcattactaaaatccttgtgagggaaacagaactgatattaatatcctgatttttatgagaaaaaaatgaattcagatgatccagttcaaggttctttttgtctctgatgagcttcctgtctcaaacaagccatctcatatttcttggggctatccacaaaataagtgagttggacaggtggtaggtaagactcctacgcctatgagtagtttataaatttggagatcaagtgactgaaatgatcaagacttcacagtggagcaaaatgatcaggctgccagctctccatgatgtggaactgagccttgagactcactccctcttgtcagtgcccagggtgatggaaccctgagagagcaacttatgccagtcaaaatgcctgggaaatgaaggtgcctagggattttatttacactgagaaacaattgcagaggaaccagaattcttaaaatcctttttattgttgcattttcaccctgaagtcaagctggatgagatgcccatctctaaacagaagtcagctttgttgagtctacaataaaagtaaaaggaattgaaatgaacaatgcaacgtctttaagagaactgagggattttctcactgtggatgaatctatggaacaaaaatatgtggaatcctctgatgaagactagcttccctgggagagtgctggatgtacaggaccacacttaccatgtgttacttttccttctgtgtgatatctttattatcttttcctgaagtcatatgtctaggctgcaattttatcatgagaatataccagggacaatgtcggggagtggtggggggtgggtaagagaaaatacatgtttccacatggcagtgtttgggacactctaaaaatcagagtgtttgtgaatgtgagtgttgtgatagcagtatgtgggtaagtgtaaacatacagcattatagaatttgtcaggatgtcataatggagatagccactctattctaagctgatgattttaggttaaaaagttttcctgctatgtgctaagtgggttctgaggctactaataccctaattagactgaaagtggtattcaacagctttaaggagcagaactcaagccttttaactgtcctttattaactaagatacttttctggaaggcaacttttctttaagaactgaatgattattaaaatatcaagctaaaatcataaacagtactctttgggcccatacttttactcttcagtaagagtcttattgactgatgtttaaatattttgaacaaaaaaagtcccctgattttaatgcccaaacttttcaaacatatcagagacaaccaaataagtagagtggtggcatgggcaaggagaccactggagtcaggcacaggtggcgaccaagatattcagagagagtcaggaaactcacaaagctaacagactgcacgatgcagtaaagaatgatgaatgatctggagttgtacagaaagggcaagttatttttggtaacttctttgagaaactagaataataatgagatataaatttatgcctttcagtcacaaaaacaaagagtgattctggtagggatgaatggtggatactccagaaattattggtggaaatgcaaattgtcattatctttcgggaaacaattcagttacatataacttttgttaaaaagcaacctcggccaggcacggtggctcacgcctgtaatcccagcactttgggaggccaaggtgggtggatcacgaggtcaagagattgagaccatcctggccaacatggtgaaaccctgtctccactaaaaatacaaaaattagctgggcgtggtggcgtgcacctatagtaccagctgctccagagcctgaggcaggggaatcgcttgaacccaggaggaggaggttgcagttagcggagatcgggccactgcactccagcccagtgacagagtgagactccatctcaaaaaaaaaaaaaaaaaaaaaatagcaacctcacgtttgggaatctgttccacagaaataaaagcactagcacgtagcagcaaatgtacaaagatctttttataacattattcatatggccaaaaataaaggtattaacaatgtgaattatcattcatagaggaatggttgaataacttatggtataaccataccatgaagtaatatgcaccattaaaaagaatcagttagaatcatgaatcatgaccattgagtaggaaagttttccctggatattactgagacagaaaggaaaaataaagcagagaagtgtctataatattagaccacgtttgtagaatacaaaacaacacaatttctatatggatatgtgtaggtataaatgtacatatttttgtgtgattgtgcatgtatgagtgtatgattatttaaacatgaagaaaataaatggaagaatacatatacatattgggttcttagcatgatggaccaggagatacggaggttcaatagaagacaatgaagtgggtaaaagaatggagaagaggggaaggaagccaataaaatgtcaaacaaaaatggctgcaacaaaaatgaaatcaatgatttcttacctatgtagaagtatacatgcagaagtttatctacatataaagaaaccagggaattataaataagttaaatccgccttgtaagaatgactgggatttattgctaagtagaaaaaaaaaaaaagacagggtcacaaaaggtagttttttgaaagagacaaaaatgtttgaacacaaaacaatttttaaaaaaagacacagaaaaaagggaagtgattatgtaggaagaaatatctgtaacccatatggcagacaaatggattatgttccaataaacaaagagcagctacaaactgttgagaaagagataacccaatataccagataagattaaacaatttgcatgagaggaattccaagtaactgatacacatgaaagatgttgtccttttccatagtcagggagatgcaaaggaaagcagtaatgaggtacagttttcacctccctggtcagcaaaaattaaaaagaacaacaatgaactactcctggtaagactatgagtacatcaggcacctttatgcacattgctggtgggaagataaattgctacaacttttcaaaaaataataatttggtaatttattaattaaaatactcttgggctaaaaaatctttcttttgaaaatctatccaattgacatatatatgtaaatggaaaaggaagtcaatggaaaaggacatatatatgtaaatgtaaaaggaaacatgtagtatatataatatatacataaatatgtatcatttatacacatacatagacatgttcctctttctccaaagatttctataaaagatgattatcatagcaattttgtgtggcaaacataaaacacatacacaaagaatgaactctgtaaatgaaatagatgtacattgactcagaagaatagtttcagaaagtagtgtatatacaaacgtgaaaattatgcagctatttagaagaaataatttgactttatatctaaagactgagttatacctatgacatattaagaaaagccacttgcagagtaagtatgacccaattttcagaacaatacaaatttatgtatgtatttaaaggaaatataaattaaaaagatttacatccctacatgagtgtaagcttcaattacctagagtgtgtgtttaattgtatggcatctttattacttgatcttccctaataaattgggagttattttgcatttggattaataacatcttttttaaaaaatagtcttctttctaacagaagttgctgataatatagctaatgttaagaactcaaaggaaaatcgctacattatttaattcaaaaaaaatttaggtgaaatgaatgagtcagatctagaagtaggtgataagaggtgaacatatggcaagtgttgggtagcacattctggctgatggaaaagatgtttgggctctcaggagataagagtagcagttgggtgtctcacaagaagggtggaccacggtgacatgaaaagctatcaccaggtagaagtgggctggctgtgagatccaaagttcaaagtcaaaactagtaagcagccagctttccagtctcagaggaactgacgtgccagttggctcaacaaagcagacactcaggcagggaagatgaggtaactagaaatggaatgtaagtagggcttcggtcaggccagcacatgtggctgtgtaggctgtgtgatgcacagctccagggaatgccatttacttaaactgaagtgtgaagggtacctcctaaatttgtccaaggcaagaagcccattacacttctaagatttactccaaaatcagagtagatcagcaacagaatgaaaaccctgtcaattatcatcatggtcatccccactaccaataccagaaccatgataactgacataattacaattcaatgtgctttacagaacacatttactgatgccagaaagaatcaaatgaggtatccaggtcaggtattacaattaccattaacatgcccattcacaattgcttcaaagagaataaaatacctaggaatccaacttacaagggatgtgaaggaactacaaaccactgctgaatgaaataaaagaggatacaaacaaatggaagaacattccatgctcacgggtaggaagaatcaatatggtgaaaatggccatactgcccaaggtaatttatagattcaatgccatccccatcaagctaccaatgactttcttcacagaattggaaaaaaactacttcaaagttcatatggaaccaaaaaagagcctgcattgccaagtccatcctaagccaaaagaacaaagctggaggcatcacactacctgacttcaaactatactacaaggctacagtaaccaaaacagcatggtactggtaccaaaacagagatatagatcaatggaacagaacacagccctaagaaataatgctgcatatctacaactatctgatctttgacaaacctgagaaaaacaagcaatggggaaaggattccctatttaacaaatggtgctgggaaaactggctagccatatgtagaaagctgaaactcgatcccttccttacaccttatacaaaaattaattcaagatggattaaagacttacatgttagacctaaaaccataaaaaccctagacgaaaacctaggcaataccattcacgacataggcatgagcaaggacttcatgactaaaacaccaaaagcaatggcaacaaaagccaaaattgacaaatgggatctaattaaactaaagagcttctgcacagcaaaagaaactaccatcagagtgaacaggcaaccttcagaatgggagaaaacttttgcaagctgctcacctgacaaagggctaatatccagaatctacaatgaactcaaacaaatttacaagaaaaaaacaaacaaccccatcaaaaagggggcaaaggatatgaacagacacttctcaaaagaagacatttatgcagcgaaaagacacatgaaaaaatgctcatcatcactggccatcagagaaatgcaaatcaaaaccacaatgagataccatctcacaccagttagaatggtgatcattaaaaagtcacgaaacagcaggtgctggagaggatgtggagaaataggaacacttttacactgttggtgggactgtaaactagttcaaccactgtggaagacagtgtggcgattcctcaaggatctagaactagaaataccatttgacccagccatcccattactgggtatatacccaaaggattataagtcaagctgctataaaggcacatgcacacgtatgtttattgcagcactattcacaatagcaaagacttggaaccaacccaaatgtccatcaatcatagactggattaagaaaatatggcacataatacaacatggaatactatgcagccataaaaaaggatgagttcatgtcctttgtagggacatggatgaagctggaaaccatcattctcagcaacctattgaaagaacaaaaaaccaaacaccacatgttctcactcataggtgggaattgaacaatgagaacacttggacacaggaaggggaacatcacacaccagggcctgttgtggggtgtggggagggggaagggaaagcattgggagatatacccaatgtaaatgactagttaatgtgtgcagcacaccaacatggcacatgtatacatatgtaacaaacctgcacattgcacacatgtaccctagaactttaagtataattaaaaagaaaaaaacgatatgtaaaaccaactgatggcacattatattgcaaagcaaggtatccttttgtagttacctccctccttgtttatttttaatgttgataaacaatttgaagaatagaaatttacagatcctattgtaaaaaaaaaaaaaagaagaaacaaagactcagaaatgttcattgatttttcccacgatctcaaaggcagtctatagtagaacaagcacatgaacccgtcatgtctacttccaaaaccattctgttaccactgcctcaagctgctcacattaggaaggagaattggtccccaacattaagattggactgatgttggggcttgctgagcaatgagccaaacagaacattatgtatattgtaattctatcttaagaaatatagtttctttttttcatgctcaatggataaacaatttctccctgtaaggggagttcttgctgtgtagtattcagactcaacttgtccacactgattgctattttggcgtagtgactgtttagacagaatatgttacagaaaagatttggggcagcttgcaaaaacacgcataatacaaaatataattgaataaaaagtaaggaaataaaaaaattaaattagaggaaaaatgagtgaagaaaacatccagccaagaatgaggttagttcacaaaataaattaggcattcagtaaaggtctctgtatttgttagacgtaaaccacaattttggccctcagctttttagcagtcaaaggaaataaaataatcatgattctctgcatttaaaagtataatcaccagccaaccaatggcttaggagaaatacaagttttcttggtactgaggccaaaaagatacatttttcattgttccatataatgttaataataacagtcaatttttataaggatcttagtatgtgtcaagagtgatgctaaatgctttcaataccttatgtcattcaattcccataattccatagggtgggtattatgagtatcacttttttttataaacaaggaaactgaaatacaagatgctaacttagtcattgaaggaaacacaattaattagtaaatgcctaatttgggatcctaacacagttctactgactccatagttattcttctaccacacagcttctaattataccttgatttactctcaaagtatctctgaatatctaacagaatccttcaatatccagtgtaaggtagtccccactattttctccctgccacatggttttgttttgtttttttcattgcacttagcactatccgaaattatcatgttcatttgtttacttgttttgttgtctttcttcgattagaatataaactacacagctgcaatgatcttgtttatcttgttccctattgtatccctagagtctgttgtactgcttagagttcagcagaaattaaataatttttttgaatgaatgaatgtttcaaggagcaagaattcagtgtccattcgaaatctttacacatctgagaagcccattgtccttgcttatttctagttccttacagatattacttacagattctcaagtctccatgacttatttatgctcctcaccagaatgtattgtttcctttaacttggctatttttaataatccagcttggcatagacttgattttatcaatttgattttttattttaaaagttatacttaacatatagatgacatcatcatttgtaatacatgaaaaaaaattttgtaattcattttcccacacacaatgactgctgattttttaaagcctatatccaaagaatttgcttagcagcccattcaagtagattttgctatacgctgcctaaaatttcctatttaaaaacagaccagcttcaaaaaaagaaacagaaatgaacttgatggctcaagtcacatagaaacaacatgtacttgttcaggttaaaaaccgtaattctagttgccatgttctcaggcaggaaaaataaacaaattcttaaataatgcagcttcactaggtcagcaataggagcatgaaataattaagggaaacttagcagtaagacagattcctcaccctggtcatcctaacacatattattctcagtattctctaagtccttcaggctgtcttggaatttttatcacctggctatcattttcagagaggagggcaaacatctctcacacatacacacacctcttcccacaattgtagaaattgtttgtgaacatttggcctatcccctcaaaaatgggcctttttattggaagttatttgctgctaacttattgtttcagtcaaaagcctaaaccatgtgaaaatgtaggccaaatggaaagatatctaaagttggtaatgttctcttgactttgctagactcaaagggtccaaatatgtcacctagtaaggaaagaaacaacttgagatatgaatattggctggattatattttcatccttcaaaaacaaaatttagaaaacgtcttaagtagaagattctgatcaatcttctttatgaaaggacaatgataaatagctatggtgacaacatgcgtgtttgtatttctgaagtcattctgacacaatgaatagattcaacagcgagaagaagcaaatatatttgaaatagttctcttaagataagcgtaaggaaaggatattttctttttaattaaagggtggagagttgaatatttcctatatttgttttctcttctaaagtattgggtgtttattgtgacactattgtgacacagcctttgcgttacgctgttggatttcttgtttagtttcataccgataactctattaccaatcttcttcaacctggttaaaggtttttattctgtcatcctgtgtctggaccactgaatcccctacatcaacatctttctttccaaactccaagaagcaaattgaaatctaatcctgcgcaagagaaagtgaagagatctccaaatctagaagctttgtcattaaatatttacactggcttagccctggaggtatttccttttggaactattcctttacttgttattgctgattccaagattctttgcaccccatcactagctatgatagataggaggagtgatggtcagaatctgtatcctaagtcactaccgtgactgctgcccaccccctggcttcccagaggatatagaacaccaagaacactctagactaaaacatcaccaggagacccacccttatcatactaaacactttggagaaaagtgaaaaacaagaaataagagtcaaggaggccagtccggcaagacgcaagagtttgcctctgtgtttacatttatttataaaaactttattctcccatagtgactgggaatatgatgattgagtaagacccattttttttttaatttgccaaaatcttcatctgaaacctattgctggtcttccttgacagacattttctaatgtttaggcttatattacttgttgccaacactgatccaaagaggcttcatatcctcaagtgtttgtaagctccagatcctcatctattccgctactggtttgagtcccagttatattaacgagttactttgatgtatactttgcctataaaatagcaataacatttctcttcctatagttactatttattgagtgttcactattcactaggtgacatgtaagagtattcaatgtgttttatcatttaatctatacacctctatgaagttggtaattttaatcctcccatttaaaagataatgaaggctgggcaaagtgactcatgcctgtaatcccagcactttgggagtctgaggctggtagcaggagtttaagaccagcctggccaacatagtgaaaccctgtttctactaaaaatacaaaaattagctgaacctggtggcaggtgcctgtaaacccagctacgggggaggctgaggcaggagaatcgcttgaacccagaaggtgaaggttgcagtgagctgagatctcaccattgcactccagcctgggtgacaagaacaaaactccatctcaaaaaacaacaataaaaaagataatgaaacacagacttaagtcacataaaaattagaggggaaacagcaaggatttgagccactgtattatgctatggctatttttgaattacttccaatgttttccccagtcttaccacttctctggtaagccgaatgattacctaagtgtgcataatatcttaacaataacaatatcttcacacagcttaagctaggaccttggcttattttgataatttctccacattcccccctagttctctcctttaacctgcagataatttctttctttttggtgcaagtatttaagaactgttgtgtgccaaggactatactaagttaaatgaaaagcttcgtgcttttcattttttgagtttttttaaatgtcagtagaaaccgtgttactttattaaaatactgagttttatttcacatgtcttaataatgtcacagccagatctggggtcttataccctcccaggaaaaaaaatgaaaggattagttaggaagcagactttgattgtcatgaaaatctaatatttggctgaaatcttttgagtggtcaagattgccagaagaatttatacaatgaagctcctacatttccatctgttccttctctgtgttggtcctctttccacttctgccacagtaatagcttattctattctattgtttccctctgtctgcattctctcacccactcaaacagtgttaacagccatgcatgggtctgtggatatctcccaggtctaaagctttggctgtgacctgtctgaactctagactcacattccaattgtagactagcactgggagttaagcttcttaactttgcccagggagagaaccttctagggacttttagcttttgtatttttcctaaaaaaagagaaagaaacacgttgcttctaccacctgagtcatagggatcacagtgagaaacctaagcattttgctaagtggtgccaatcccatcactcaggagcagggccaaatgccccgaaagcccagtataatcatccattagcagtgagatttttaactgaactattgaatagtaacaagatagtaagcatgatttacaggcacttatgattacagataaatagacaaagaaggaaagaaagaaaaggggacaaagtcattaacaaaaggcatacgggagaacagttcttaacaactggaaaaccaaaggcaattttagagagaactgaaagctccaagtaaatatttgctccagagaaaagatactatttttgtttatctgcagatccccctttttgacattattgtggaaattttggattaaaaatttttttgccaggcgcggtggctcacgcctgtaatcccagcactttggaaggccgaggcgggcggatcacgaggtcagtaaatcgagaccatcctggctaacacggtgaaaccccgtctctactaaaaaatacaaaaaaaaaattacccgggcgtagtggcgggcgcctgtagtcccagctactccggaggctgaggccagggaatggcgtgaacctgagaggcggagcttgcagtgagccgagatcgtgccactgcactccagtctgggcaacagagcaaaactctgtctcaaaaaaaaaaaaaaaaaaaaaaaaagttttgcaggctccaacataaagaggaacagcactgtccttcttcctcaaagataagttctgaaatagaatgttttgtatcttctaatcagaacattctctttttttgttctgtttactcctttggctattttaaatatttcactttacttaagatttaaggtctaagatctttgaaacgtacataatttgcccaaatgaaaaaaattagatcctatattacaattatatgaagaatttataaagaaagtagctttccctgagataagctcaccaaattctctcagtaatattaattgggcagttgcttagaaaataatactatattagatattgtcatcatttatttctccttctcaggatgagtggccttaaatcagtgactgtattgggaatataagtcaatatataaaatgtgaaagctactatacaatgaaatttttagcagctgttaaaagtgatgctgtacaatgatacttaacgacttggaaagccatccataatgtaaacataaaactaaaaaattacaaagcacatatatgcagatttcatacttttgtaaaaaatacatgcatacctgtacatagaaaagaatatatagagagagcaagattaccttagttatttaacagttaaggattttttttttttttttttgagacggagtcttgctctgttgcccaggctggagtgcagtggcacaatctcagctcactgcaagctctgcctcctgggttcatgccattctcctgcctcagcctcccgagtagctgggactataggcgcccaccaccatgcccggctaattttttgtatttttagtagagatggggtttcaccgttagccaggatgatctcgatctactgaccacgtgatccaccagccttggcctcccaaagtgttggaattacacgctgagccaccacgcctggctggttatggatggtttttatttccgcttttccttatctaaactttctaaatattctacaactgtatgaaaatgcataatttttggaattagaacaaaaatattactaagttattccctgctcattcactgcacctggagagcaaggcctaatgacaatcaattaaaccagctctcttaagacttgagtcatcctaatagtgaatgtgtatgatcccaaacaagcagatgcactgagtggtccagggttgtaacctcacacagacattgctgaggcttagcctctagcttttccagagtgcattccagcatcgtccttgctgctttaatagctagaaatggtgaaaagcaacagatggtgacagttatgactgtcaggatgccaagctcaagaacggaatttctacttcaggactattttgcaaggatacagtaatagctggggaaatctgagcataaagctttctgcaatgctagtctggcgattatataagaaggtgattatataagaagatcttataatttaataggaagcattaacattaagttaagagcagaacaaaagttcaaccaaacttctggagtagatcattgaatttctttttctaggctttcttaaaaataaaatctaactgaaagctgtattttattttttattagtatctgtgaaatggctattatggatcctttaagtcaactcaaatgattttgaatcctgggaatagattaagcaatcatcaatattcattgactagctattttgcatttgctattgaaaggttatagatacaaaacaagtatatttttaatggaatttctactctaggtggggagagaaaatgtaaaacgagatcatataatgggtaattaagtgttaaaattgcatattcaatcatattttcttgataatgagatgtactatttatttaattacaagcttttgaattgtgtttcttttggcatcaactcattctttcatcaaataaatagttatgagcccctatatcattgtggtcactggaaatacagcaggaacaaaataaaaaaatctcaacattgtggaacatacattataactcgggaagaaagagacataaaagatattagctagaagtgcttcataagtactaagaagaaaaataatgtaggcaggtggacataaatgtctttggaagctgtagttttaaacagtgtcaccctggctaggtgtaagacagtgccctccttctttcagtgatggcgtatgttcccaatgtttattttctttttggttttacatttctacttttgaaatttgttcctgaaaactatccaagctgtctgttaaaaatttaagtaggggccaggctcagtggctcatgcctgtaatcccagcactttgggaggctgaggcaggtagatcacttgaggtcaggagtttgagaccagctgggccaacatggtgaaaccccgcctctactaaaaatacaaaaaatttagctgggcgtggtggtccgtgcctatcgtcccagctacttgagaggctgaggcaggagaattgcttgaacccaggaggcgaaggttgcagtcagccaagatcgcaccactgcaccgtggcctgggcaacagagcgagactctttccaaaaaaaaattaagtaataaggtgaagaaaaaagtaggaaatttactgcaggttgaagtaaaaaaatgcaataagaaatctttcatcatctcagtgtccaaaacaactgcattctgttatttgacatttatttattaatttaaaaataattaatgagccttcattatgtgctagacacaagatttgcaggaagtatattattctaggtagaacagcaagagtaaaattcctgattcaggcaggaataggctcactgtcctgaggaagagagaaggccagagcagtttgcagggagtcaaggagaggtggagtggtaggagatggactcagagacacagggataggccaggtggtgtgctatgcttcccaaacctctgaaaacccaagtatcctccagaatgcttcctgaatgcattgattcctaggatccatcctagaactatggaatcagaatccttaggcaagagttctgggaatcttggatcccaggtgatgtaggatataggccatgggaaaatgtttgaattttagttcaatggcaataagaaggcagtcgtgaatgtgtgtatgtgtgtgtgtgggtgtgtgtgtgtggtgtgatatgatctgattcaaactttctgcagatcaccataacaaaaatgggaaagagtggatacagtgactagttagcagcatgttccaataatttattagagaaagaaaagcaaaaaatcagagataatagttttgttgttgccacaggcttgctgtaacaattatatgagataatactcgcatagttcttagcatactatcaatgttttatgcttagcaaaaaataatttacttatcactatcatgatatcttttgaaaaaaagctattcaattgttccagtctcacatggtcaataatattttcccactcacttgtgatgcctcccttatcattctttaatttctcatatggactcagattgctctatgatttctacttttccatttgtaaatttgcatgcatgtactttcagtagttgttgtttaaccaactttcttgtgttgcaacttttaaaatcagatttattctcttagggctttatatgcatcccatctaggaacttgggacaggtgttctgggactatatggaagcacatctgagtcacacctcacattacagtaggctttcgcatttcaccagtttagtattttggacttggtattatattattttgatcccatatacccttaacacatattaattcaaaaaatttcccaaagcctgtgtttgaatcatgctttctttgagtttgcccaccaagagcaagtcacttagctcaagaataagcctagacatctgcttctccacagctcaacacagacctattgtccctactatgtaagtaatcactgtcaagaagtatacaggctactgtagtttttcacaaaatttgagacttttcagggtcaaaatataaagaattcaataggttgtactaaagcatcgtgctcaatggcaaacagtctgaattttaagacatatcctagggatcttaactttctcctatgtcaggagaaatgttaaatgctgattgaaccatatctagagctaaatgtactacaaaagtgttggcatttgaaccaataaattttctccagtttgggttggatttgtcatcacttacaacaacatattcctcaacaatacatcttctatgacatggctgaattctgttgatatgtacatagactaagcccatccttcgggtaatccactacacaaatataaaattataattaaaccaatttgtctattgaaaaagtatccaacagttatttatccacatcacacagtaaatgctacagaatttctttacagtggcaaagcaatgagaaagccggactttcaaagcccttcacataatgtctagagattatcactttacttataagatgaatccaaaaggtagtcaacagcagaacaaagctgaggcatgccataaacccgagtttagaatgtaattaaaacccatagctatcacacgtttttggatttaatagctttctaagtcaaatacctgacaaaaagtatttgcaaagaattttctgtgtcacagaaacaatagaatgtctgtctatatgttgatctgggtgagtggtgagcaagacaagaaattttaggattctaggatctcaaggagaggatcgcaagcccctggaaactcatcatcttcctatgtgctcacagaatgcttcctgcttccctaaaaactgcctctgtatcctctcctcccttctccccccgcttctttttcccttctttccttgcctcctttccttctcctgctgctcttcttcctgtttcttctcctccatcttctcctttcctttatttttcttacccatgagtccatctcacagagtaaatcataatcttcccatttccatgccgtttcactgatgtcaaaaaccaccccttatattcccaagccttactaatcctcagtttgctcagatttctgtccaggctagaacattcttcactcagcagcctatgctgaactgaaatggcctgtagttgctaccattccaccattttcacttgcacctctgggttccctccttcctggtgttgtggccttgtgtcttgacaaatatcctgaggatccagtgacaagagctatggattttacagcatactttcatctaaagcggtatttttttcctcttaccatagtactgaccttgaggcattcaatatcttctctacattgtacttgcacagaaatcctaataacagcttcttaattgagttccggaacatagttagcattatttgggataaacattctaattgtgttgtactctccttgtaacaaataaactataaattttcctgattactaataaaaagaagaaagagggaaaaaattcatttgtggataaatgctcttatgaaatgctttgcggtggcaattgggaatcaggaagggaggagagacacaactttcatgccctttttaaaggtagcattctaaaactcattgccaatgatagttgaaacaagaaagaaaaaagtattggaggaaaaatgcttgatccttccttctgagctaggaagtcttagaagttacatataaagtttagaggttgagtgtagctttttaccctggctggaaaaaaaatgcctataatttctccagttcaagacactgatagtcagaacatggtctatttgagtataaattaagtctcaaaataattcttagtaccactgcaatatccctcaaacaagaaggtctgcattgatgtatatgttttatactcatgtacatatgataagcacaaacacacatcaattattccattaaagtcattatgctgccccagaatatatcccttgcttcctgtatgccccatccatacatccattttctgtatggaatgggtcttcaaatcagctgacatttaattgcatcacccctttgctttttgaggaagctaaacattattgatttatttaaaaaataaccctgcctccccagttttgctgctaaatcatcatgcacataagtaatctaagtggattgcaggaaacattaggactggcaattggtgttgccagctaccaaagccacagcatggtcagaggctagggaaagctaatgcagcaaaattgcctattgcctctatgtaatcatcaccccaaaggaaaagcacagcttcttcatcaatctccaaaccacaaataagctgaaagtgaaatgacctgccagaattcctcattggtgccttttattgtccatgatattaaattaactagacagtacatgacattacaagatagaacaagcctcttgaactgtaattcacagtgactttaagagttgatgactatgggtatatgatggtcactaaggaaatatctcccatgagccctagcattaacaggagcatctccagatacagagacatcattaacatcatttatcttcactgaatagacagagtacatgactttcaccttcagaacatctgctactcatgtaaatgcagaaaacttgttcaagtatttcaggatgccaagtgacccacatattttctcttaacaagagttcatcttgtgttcttagcttatgatttttattgaattattgatatttccctctggacattttccaagcaaaacaagagactgtatttcatttgtctctgtttccagatatcccaaggggaaactagatcataataaatactgagtgtatgctagctgaaaacattgacgaatggaactttgattctcaatattaagtaaagtatactatatgtagtaggttaaaaaaataaagaaaaaaaagaagcttgttagatttaattacatttggtgcatagaggagttgccaaaatgcaaacatggtttcattgaattatcttggccacacaaatcaactcatttgattatattttggagcagagatgcaataacaaccatttaactactgatttgtagtttcaatgtggatccttctataatgatgttaaaccagagagtgactgtagttcaaatagggtgtcaacctcagtatgtatttaaactatgataacctccacaatttggaaacctctgacctgggttatacaagcaagggaactttaagaacataagcaatgggatcattgtatcacttttattaataaagaatggttattattcagtaatatcaaaaatgttatctatcaattactcccaactcattttatttgctccagtgacagaaaactactctccctctaccacacctcccctttcagttgtcttatttattgtaatttgagtcaagtgaccagaggatcttcaataagtattatttatttacacaggctgagactaaggcctatctgcttaaaacagattctcacagaaggtaggaggctcagtacaagatataatcaactataattgtaaggccttcctaaagtaatcttttattcaaatatttattaagcatctaccatgtaccatgcattctgctatgagcggaggatacagacaagttttctgatttcgtaagaggaagaaaacagacaacagtcaagtaagaaattagaagtaccacagaataagtgctgtggtacatacccgttgggattcattgataactattcacaatcagtgtttttcttttttcaagcatcaatgacaggaaagaatcaacatcagcctcagcatcagtttaacatactacttaccaccacaattacatttgctgctgggattgggagattttccacttcaagatcttgaccatccatggccagcagattgagagacgggtcatatgcgggtctaggaaatgctgaattgacaatctggtggcgtttgcttacttgagcttcggaagaggaatggtagctatgtctgtagattttttgtggggctatatccaggctcttctcaatgtcttgtgaatgcttataaatgaataccggcttcccactcttcttctgattaattgccaaaaaatgatcattgtttcctgaaaagcaccctgaaagagggaagaagcagaaacaatatcaaagaccctattcagtaagagaggtagatatatctgatgaagaggattaccctttcttgagaggctttaagacttgtgaaggatttaggttagtctccatatttctttgtctgcttcatgatcctcaacaaatagtatacacctggtggtatgaaggcctctcaaagactttaggtggataaaagtgggcgtactttgaaaaagttctatttttcagatattctgatgccacttttactaagaaatttcctcctttatctacacccatagtttcaatacctacttgggcttctattcctggatgtcctatctgctgctgaaattataaatatttttatcatatttaagctttccttaaatataagcatttcctacaattcttatttcatacttattgcttgtattacaatgaacagttttcttcacgcttacagagtatttaagctctctgaggtaagaaatctgagtgtacttattgtggtagcaactttcagtagtccaaacaatatccatcgtctccttacttgtgtaagtaatatggccatctagatagagactacatttctctcagtcttccctgcaactaagcattgccatttgatcaagttatagctattggaatgtgagtaaacagatgttagcagagatgtgatatggccttcctttctacatttcctcttttgtgctggctgaaatgcagagagtctggtaggagcatgaggtagaaaccatgtgtcaaagatggtagagcactaagacaaaatattctgatccctgatgaaagtgaaactaccataccaacctcacagttcccactctgatttttagagagaaaaacaatattctattgttttacctgctattattttaagtatctttgttagagcaattgaatttatttagtaacaaatacattcatctttatttcttctgttagataaatattcattgcattgaataatggcttctcctgtttgctactggccacaggaggaaacagataatacatatgaatcaaaaagaatattactaggtcaaataccagttagaaaagcaaacatgagatctgttttataacatagtccctagcaatggtaccccagattttcactggaaatgcttgtggtaacaagtgctgtccttagaaaattacttacctctttttacaagaattcttctccaatctcctactatttttatcttttacttcccaaatcatgcaagcgtctgtactttattttgtttttcttgcaaatttcagctatttacatgcccaaattcaatagaattatcatggcagatctagtactcatgctactgggcatttaaatttctctattttctcttaggtgagagacccacgttcatttatgcatacaatatacctttcccaaagcacagaatcacctctacatcagtggtattagaaaagtaaaccaggatgaaagtagtatattattttatttcttaaccccaaaggaatcacttcattgtagtgatatcagatagtttttcagagggaaagaagaaaattactctcctttcagaaatgtagaaactcttctaggacactacaatattatttagtaaattatttttagtaaaataataaatacacaccttgtggtcagaaagttcatatacatctaaaacattttggcaccattttccattgataaaacagtggtaagaacaacaacattgagatatcctgttctgaattccattatactacatatgttcttaatgagagtttcatttccaaatccgaggaactcatttaatatggagaaataaaatgtacaattatttaagggtcatcattgtccaatcatcatctttggcaaactatgggtggcttgattgttttaaaaaagttatggtcaatttagcatgctcggaactgaagacatgatgattagtttccattactatttcaggatccacataaaatataattcaagtggtccaaaaagataaagctactggtaacagaagatgattctcatactattatatcgtggaataaagcacttgggctaagaaaataacccatctttataaccccacatgaaagttgaagggatacgggtgaaacagagttgctgaagatgtaagacgtatatgttggtcacacaaggcttgatggaaagcaaagcctgtaaaaactagcaattcctctactctggattctctataaatagtaaataaaaagaaaaaagcagcttagaagattggggaaagtagatatcttaaaagaggagaaataactgacaaactgagtaaattacacaaatatcttcaatctttctttttatatattatcaatcacaccaagtcttttcagagccactttatctaaatagaaaagtccagttaataaatgcatgctaaaattggcctaccgagaaagggacaaaatctaagttgaagcgcaattgaaacacaatgaaaattttccaaccttatccacttgtctgtgtgaatgaacttagtcctgccttgttcctgagtaatgagttctaagatagcagtgtaatattaggtgtcctaccacaatcattaggtaagaaaaaaaatttcatagtgctgtccttaggttctctgtatcagagctacccgggacatgatgatacagtttcttagaccccagactagaactaccaaagcataatctctatagatgtagcctaggaatctggatttataatagaattcttatgttcaaactctgatgtttgaggaccactgacctaatgtctggaattggttttgtattttctatcctcaaatgctacctatttcctccttcacttcagctttatgaatatactcaagtaaaaattttggaaaagtgaagactgagaagccaagttatctattagtgaagccgtaattctaaagcagccaacaatcatagctcttttccctctctctcctatcaatacctgaccctggactcagatgcaggtgtagaagcgcaagaaactcacttcaaatataatgatatggacacatttaaagtgaaagagtgaaaagcaacatatcatgaaaacctaatcaaaagaaacctggagtgactatattaatatcaattcagcacaaagaaattcccaaggataaagagggacattacataatgatggacatatgatgcaatgtacataagaatacataatattcctaaatatatatgcatcaaaaatgagcttaaaattcatggagcaaagctgacaaaaatgaaaggagaaatgggaaaattcacaattatcattgaagattttaactgttccctctcaatagtaagtagattgaggagaaagaaaagaagcaaaggcaaggttgtaaaagaacaccaccatcaaccaactggatttaataggtgtttatagaacacacaacccaaaacaccagaatacacaatcttttcacgttcttatggggtattcatctagacagatcatatactgggccataaaataacacatgttgaaaactgaaattatacaaggtatactctttgaccatgaaggaattaaactaggaatcagtaacagaaagaaaagaagaatatttccaaaatttggaaattaaaaaaacacatttctaaatatccatgggccaaagagaaagtcacaagacaaattagaacatattttgaactgaactaaaataaaaatataacatatcctgaatggtattgcctaggttttcttctagggtttttacggttttaggtctaacatgtaagtctttaatccatcttgaattaatttttgtatcaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctgtgttctgttccattggtctatatctctgttttggtaccagtaccatgctgttttggttactgtagccttgtagtatagtttgaagtcaggtagcgtgatgcctccagctttgttcgtttggcttaggattgacttggcaatgtgggaggacttcatgtctaaaacaccaaaagcaatggcaacaaaagacaaaattgacaaatgggatctaattatactaaagagcttctgcacagcaaaagaaaccaccatcagagtgaacaggcaacctacaaaatgggagaaaatttttgcaacctactcatctgacaaagggctaatatccagaatctacaatgaactcaaacacatttacaagaaaaaaaacaaacaaccccatcaaaaaggaggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaattagttcaaccattgtggaagtcagtgtggcgattcctcagggatctagaactagaaataccatttgacccagccgtcccattactgggtatgtacccaaaggattataaatcgtgctgctataaagacacatgcacacatatgttggttgtggcactattcacaatagcaaagacttggaagcaacccagatgtccaacaatgatagactggattaagaaaatgtggcacatgtacaccatggaatactatgcagccataaaaaaggatgagttcatgtcctttgtagggacatggatgaagctggaaatcattctcagcaaactatcacaaggacaaaaaaccaaacaccacatgttctcactcataggtgggaattgaacaatgagaacacatggacacaggaaggggaacatcacacaccagagactgttgtggggtggggggagggggaagggataacattaggagatatacctaatgctaaatgactagttaatgggtgcagcacaccaacatggcacatgtatatgtatgtaacaaacctgcacgttgtgcacatgtatcctaaaacttaaagtataataataataataaaaaaagagaatccatatgtagaaacctatgtagataacctgaattaaagcaattagagaaaccttaaaaaaaaaaaagccagcctagtaaatgagtatagggattatgaagtttttgcttgtcttcaaatttctaattcaaagtgatacttctataaatgtgaacccaatgcattatcttgtcaatatatgcacttttaaaaagacacctcattttattttagttgttctcttatttatattgtttttctacagtttatgtttttcttttcatcatcatttagtctttttttaactccttgatactctttatataattatttttacatattacatattacatattcaataaatatatatattttaaaaatccttaacctataaatatatatatacacacatatatatgtatatacatatatataacatgatttgtgggatgcagttgaaacagtgcttaagaaaaaattataccattaaatggtctcaaatcaaaggtctcaaatcaaaaatataagcttccactttaagaaacaagaaaaaagagtaaaataaatgtaaagaaattaaactgttaaaagtagaaatcattacattgaaaatacagagagagaaaaacgagtgaaacaaaagctagttatttgaaaagattagtaaagctgataaaactctagcaagactgacagagaaagagagaaacacaaatttctaatatcagaaatgaaaggagggatatcattacggacttagcaagtgtaaaaatgtataaaaaggaaaataacaatcctctacaaataaattcaacaatttagataaaacgatcaaatccttaaaaccacaaactattgaaactcaccaaagatgaaataaataatctaaattgtgctaaaattataaaagaaatgaaatttctacttaaaccttttctgaataaaaatcttcaggaccaaatggcataattgaaaatgtctaccaaacacttaaagaaaaaataacatcaaatctatataatttctcccagaaaatagaagggggaacattcaccgaaatcatctgatgaagccaaaattaccctgataacaaaagcagatagagacaatcctaaaaaaaaacactatagaccaatattgctcatgaacacaaatgtaaaagtcctcaacaaaatattagcaaattgaatgcagaaatacagaaaaagacatatgccactaccaaatggggctgattttcctgggaatgtagggctgcttcaatatttgaaaaacaatctacataacccactctactgagagtctaaagaggaaaaataatagtcatactaattggtggaaaaaactatttgacaaaattcatgtctattcatagtaagaaaaaattaagtaacctagaaatagaagagaatgttctcaacctgataaaaggtacctacaccaaaccccacagtacacattatgcttaatagtgaaaaactgaatcttccccttctaagacaaggacaaggcacccataccattcctatataacactgtattaagagtcctagtcagtgcaatgagacaaagaaaaggagcaaaagacataaaactgttctatttgcagatgacatgattgtctatataaaaaatcccaaggaatttaccaaaatcttcctagaactgacaggtcagtttagcaaggtcacaatatataaaggcaacctacaaaactaaatggcatttgtataagttagcaatgtataattgaaaactagaagtaaaaaaaacaaactgacccaaaaataaaatacttaggtataaatctaacagaacatgtgcaagatacatatatatactgaaaactataaaatgttgaacaaagaaatcagagacgacctaaataaacaacaaatatactatgttcatgaattagaagactctacataatgaagatgtcaatcatctccaattacaataaaatatcattagaattttttgtagatgtagatatgctgattctaaaatttacatagaaaggcaaaataaatagaaagctaaaacaattttgaaaaaataataaagttaaaaaatactgctcaattctaaaacttactataaagctatagttattgaggtagtgtagtgttggcaaagaaatagacaaacagatcaatggtgcaaaatagagatttcatgcagaagcatgaaattggattcatacatcacaccatatacaaaaatgaattaaagatttccatataaaatccaaaacaataaaactactagaagaaaagataggcaaaaatctccacaacattagtctgggcaatgattttttttaaatatgaccccaaaagcacaggcaactgaagcaaaaatagacaaatgggattgcatcaaactaaaaagcttctgcacagcaaaggaaacaattaacaaagtcaagtgataacccacagaatgggagaaaatatttgcaaaccacacatctgataaggagttaatatcaaaaatacataaggaactcaaacaatgtaataccaaaaaaattaacccagtgaaaagatgggcaaaagatttgaacagatatttctgaaaagacgacttacaaatttccaataggtaaatgaaaatatgctcagcatcactaaccattaggaaaatgcaaattaaagccacaatgaagtaacaccacatacctgttagaatgggtttatcaaaaaagatgaaagttaagtgttggccaggatgggaagaaaggggaactcttgcacattgttgtgggaatgtaaatgagtacaggtggtttcttttccaaaatgcttgggaccagatatgttttgaattttggatttttttggatttcagaatatttgcagaatatatactaattgagcatccctgattaaaaggcccaaaattcaaaatactccaacaagcatttcctttgagcatcatgttggtatgcaaaaagttttctattttggagaatttagggttttgaatttttgaattagggatcctcaacctgtacagtcattatgggaaatggtatggcagttcctcaaaaaactaaaaatagaactaccatatgttccagcaatcccaattctgggtgtctatctcccctagattaaaatgaattgtcaaagagatgcctgcactcctacgttcactgaagcgttattcacaatagccaagatacgaaaataacctaagtgtccatcaatagacgaatgggtaaaagagcatggtactgctataaaaataggcacatagaccaatggaacagaatacagaacctggaaataaacccaactacttacagccaaatgatcttcgataaagcaaacaaaaatataaagtggggaaaggatatcctttgcaaaaagtggtgctgggatcattggctagccacatgtagaagaatgaaactggatcctcatctctcactttatacaaaaatcaactcaagatggattaaggacttagatctgagacctaaaactctaaaaatcctagaatattggaaaaacccttctagatattgtcttaggcgaggatttcatggccaataacccaaaagcaaatgcaataaaaagaaagataaatagttgggacttaatcattaatttaattattaattaatttaattaagcttttgcatggcaaaagaatagcagagtaaacagataacccacagagtgggagaaaatcttcacaatctattctatttttagtttttaaaggaacctctataccatttcccataacacatctgacaaaggactaatattcagaatctatacaaactcaaacaaatcagcaagaacaaaacaaacaatcccataaaaaaagtgggctaaagacatgaatagacaattctcaaaagaaggtatacaaatggccaaccaacatatgaaaaaatgctcgacatcactaatgatcagggaaatgtaaatcaaaaccacaatgcaataccaccttactcgtgcaagaatggccataatcaaaaaatcagaaaacagtagatgttggcatggatgcagtgatcagggaacactttaacactgctggtgggaatgtaaactagtacagccactatggaaaacagtgtggagatccttaaagaactaaaagtagaactactgtttgattcagcaatcccactactgggtatccactcagaggaaaagaagtcgttatatgaaaaagatacttgcaaacacacgtttatagcagcacaattcgcaattgcaaaatcgtggaaccaacccaaatgcccgtcaatcaacgagtgggtaaagagactgagatctatgtctatatgagatactgagatatataatctatatatatgtctctatatatgtatagctatatctatatatacacacaatggaatactactcagccataagaaggaatgaattaatggcattcgcagcaacctggatggtattggagacggttattctaagtgaagtaacttcaggaatggaaaaccaaacatcgtatgttctcactgatatgtgggagctaagctatgaggatgcaaagccataagaatgatacaatggactttggggaccagggagaagagtgggaggggggcaagggataaaagtctaacaaatagggtgcagtacatactggttgggtgatgggtgcaccaaaaatctcacaaatcagcactaaagaacttacccatgtaacaaaacaccccctgtacccccaataacttatgggaaaaagagaaaaggtagcatgtacatataatgtaatactattcagtcttataaaaggaaggaaatcctaacctttgtggcaacatggataaacctagaggacattatgctgagtgaaataaggtgggcacagaaagacaaatatcatatgatctcacttatatgtgaaatctagaaaagtagagagtagaaagatggttatcaaaggctgggacagggaatggggaaggaatgaggagttgttggttaaaggatataaagtttaagataggcaggaaaaacaaattttgagatctattgcacagcagggtgactatagtcaataatttattgtgtatttcaaaatatctaagagcataaatttgaaatgtctcaccacaaaaatgctaaacaagtgaggtgataaatatgttaattgtcttaatttaatcattttaccctgtatatctatataaaaacatcacattttaccccatacataaaattatgatctgtcaattaaaaataatgtaaatcaaaaataaaataactgctaaataaaatttaaaaaatgaattcagagaaagtattaccatttgatttttgataaaggtgaacaataaaggacagccttttcaaaattacatttaaagtattagacatccatatgtaacaaaatgaacatttacctaaacttcacactttatacaaaattaactaaaaagtttcacagatctaaatgtgtaatgtacaaactatagaacttttagaagaaaacatagaataaaatctttattacctaaggttaggcaaaggttccttggacatgacatcaaaatcacaatccacagagaaaaagataatctggatggaatcagaataaaaagaaatttgctctgtgaaagatactgttaagaaagggagaaagctagctagagagtgggagaaaaataattacaagtcacatatccaacaaaaggtttgtaactggaatgtataaagaactctcaaaactcaacaattagaaaacaaaccagtttaaaaatgggctaaagacttgaacaaacactttattaaagaggatacatgaatggcaaattagcaaatgaaagtatgtccatttctattagccaataggaaaatgcatattaaaaattgtgatatgatattagaattgctaaaatgaaatgtactaataatactggagaggatctggagcaactggaagtctcagaccttgcaggtgagaatgcaaaatggcaaaggcactctggaaaatggtttgacagtttcttgtaaagttaaacacatacttagcatatgatatagcaatttcacttctacattcttaccccagagaaataaaaatgtatattcccacaaatgtctgtaaacaaattttattagcaagtctattcataattgcccccaaatggaaacaactcaaatgtccttcaatgggtggatagataaactatgatacatctaaacaatgtaataccactcatcagtaaaaaaaagtgagctattgatccacacaacttgaatataaaaggcattaagttgagcgaaagaagccagtctcaaaaagtcactgtatttttccattacatgacattctcaaaagacaaaaaaatatagttatgaaatacagatcagtggttatttgggtgtaggagttggagacaaaaagatagtaggaagtttttttgtggtgagcgaactattctgtatccagattgtggttgtgatgacatgaatctatacatgtgtgaaaattcatagaactatacaccaaaaaagtcaataggttatactatgttttgtaagctacttttttcaagcgtaactatatcaaacatcttttctcataactaaatttaagtctttttcataagaaatatcattgatgaatttataaaaagtagtttcagtgtgttgggaagggacagaaagctaaatttaattgaaatgaggactgagtaggagataaagtagaaacaaaataagtggaaaaatcaagtttgggtataataagagagtgactatgtgttaccaggaaggaaagatagggttgagggatgtgtttttggtttctttttaagaaagtagagattttggcacatttaatcctcaaggagaaggagccagctaaaaggagtgatcagacataagagaatgcagctggaataattagtagactgaactcccccagaagataggaggagagaggacccagagtacaggcagaggaatgagccttggatttgaggaaggtatttatttcattataggtagaggggagggagattagggatgttaatgggtttggtgttggaagttgagaaaattatcttttgatggtgtctatattttctgtgtagaaggagatgaagtcatctcataagagagtgaggactagggaggaaagatgaaaggtttcaggagaatggagaggaattgaaagagttattgtaaagaaagttgatatgaaatacatggtaggatttcttgtcttcattgagagttcagtgacagttttccctacctgtgagggatagagtgtctcttacagaatgtttagtaagtagcttgccaaagatactaatctacatttaaaataaaagaacttttatcataaaaacaacatttacatgaaaataaccagtgagatttgatggtcataaaattgcacagttgaaattgaaatttcattctgggtatgaccttggtagcctctgaagagatctttaacaaaggaaagagaaatgaatgaaattacaatgtttagttagagtacattatgattcattatttcaaattcagtgttggttattcctgaatgcataaggtagaatggccttgtatacactctctcagaataaatcctcgcattgcaagtacttaagtcaatgtcaataacttgtgaaagaaagaataaaacagtggtctccaaagagacttgaaaaagtgaacaatcaaaaaaaggcttttactgtgtaatcattttttgaaaagacaatcattgttttgttaggaatgttaacaccttcttctctagaaaggagagataaatggatagcatcaagggcttcccttgagaatttatgcatgagaaatgattaggctcccatttatttgatttgttaatgcctctcaggaaaattaaaaatacataattgtagcaataaaagttcttttgggaaaggtgcctatttagtattgagaaaggaaagaaacatgctttttattaagaggaaagaattaagaaataaaggaaggacctagattctaatttaaatgacctcccaacttctctcttctcgtctgtgttagctcaccccaatgagcctcagtcttctcatcagaaaatgtaggtggtttttgcatatctacaactagattagaaatatatttcagtaaaaaagaagccacaattcagttagacagattttgcatggtcctgattttttttctaaagaaataagtttttccataaatagtataaaagacactttgggaacttacagaagcagggatttccagaaattctactctgggatgtaaggaggctaatattaaatctattatttagttgttctatcattctattggtaatagtaacaagagataaccagaatactaatctccagttaaaagtgtcaacagtaataacactaaaccccactgataaacattacagccttcccaaaatatgacaaccaatgttagttaggataacctcccaaaatacaacatatgctatatacaaagccagttttacagaattcagtttctgtgccttagttatgttccaacaatatatgcatatgtatgtatatatttgtatgtacacacattgttttgttttgtatcctgacaccaaataaccaatttgacaaaaatatttatccttaaactagccattttgttacaaaaagtttttttaaaaaaaaatcagtttctacgagatgacaataattaaatttgccaaaattataaacatggacccaaaaaacacgtggataaacttattaaaagaacacttccaaggctggtcccagtgcagtggtgtttacaactaattgatcacaaccagttgcggatttctttgttccttctccactcctactccttcaattgactagccttaaagaaaactaaaataaaattttaacacgtccttccaggactggtttttctaagatccagtctacacactggctactaagatgtgaaaatataattctaccaggaagtgttgtgacattctttaatattatttaaactctccacatatttgaacagtgatgtgtccaatacatctataataaaaataaagaaaccaatagcaaagtaattgttctgtttttatagtgctagctctgatcactgctatttaagagaagaacctgaatcccattagagtaagggatgattttaatcaccttgtaaagtttcctcacatgttttttcacatttcccaaaatattctattaggaaaagtggctcctccttccactgtcagcccagcataaatactctggatatcccttacttctccctgtttatccattgaaagttgagctgaacagtgtaaacctctatttgggagttacagaattgacaaccgtttcaggaaaaatccattgtctgctatttgctggtggtaaaattgcaatgaaaggggttcatgtttcctgatttttgcccagctttaatagagttatttttcatttgataaatatctattacagagtggaacataatacaattaaaacggtaccttgggacaatgtgactagacataagtcatgaagaaagaatgagcattaagaccttgggcctcagactctgctggaaaaagtgaaatgtgtgccagctgaggtatagcaatcagatgtcccccagtttctgaagtattgagtcaaaggatactgggaggagaggttgacaggagtgaatgctactatatgttaaatgttatacagccattaagagaggactatcaaactacaccctctgggaaaaggcagaaaaatgctcatatggctagaaagctaagactgcagaaatcacaggagttcagttctgtttgcactcactgaataatgaagtagtacatttagaaactaattctatacatcgttcattgttatacaaacagctaaaatataattgttttcaaataaagattagaaactatctccattgttttcatagcagagttctccagacaacttaaaaactgggctccaattttaagacaaaggaaaaaaaagtgtctgttttaagaataattctcatagcagattaggaattatattaaaacatagcaaaacgaacattagaacacataaatattaaaatctcaccatagtaatgatactacagagacattaatgcttatatattaggggaagaggaaagtgggtgtattagtccattctcacgctgttaataaagacataccagagactgggtaacttataaagaaaaagaggtgtaattgactcacagttccgcgtggctgggaaggcctcagaaaacttacaatcggcagaaggggaagcaaacacatccctcttcacatggcagcaggtgagagaatgagtgcccagagaaggggggaagtcccttataaaaccatcagatctcgtgagaactaacttactaccacaagaacaggatagaggaagccgccccatgattcaattatctccacctggtccctcccacaacaggtggggattatgagaactacaattcaagatgagacttgggtgaggacacagccaaaccgtatcaatggggaaagaggtctgtagctggccacttgaagagatccctgtcctggtctcccttgcctgtgttttgggatttgaggggcacttggtagaccctttcaacactgctattccatctcgttcttgctctttcatccaccatttgaaattaatggcactgggctaaggctctgctttctaatgattctttgaaaaatcaaaattaaggaagggccatataattaacagctattcttatctgaagtagatcagtgtggcacatcctttctgagaagagatctctcctggaataggaagcagcaactacccagtttagctgagggtggagaagaaagagaaaattggagattgaagctcagattagaaacatagttcccaagtgtaaacttcaagacatgaagggctggtggagggaggacctgaggggcgctgccagcagtgacagctgatgctgcagggtgaggtattgggtaccagaggcacaagacaggcctggactggcaggaattgatcctgcacccactgggaatttgctgcagactcagcaaaacttaacccaaggggagacaggacacctgattccctaattgtatgtgtgagaactctctttgatttcataaagtgcataccctcccccaccacacacacatcaaagatatgtggacaggattttcaaattggagtatgcaaattgtgcacaggcatgaagaatcactgtccagatcctcagcttttttctaaaatttatctgcttcagaatgtacctatagtcagggacacatttcatgctggcactcctttccggaacaaagcatttcatcaaactttacaaaaaaaaggtacacctgtaacttaatctgaactgaatttctccatcagggtagaaaaacttctttgagtctccactcaaaggaacaaaacaaaacattagtataagcaaagcctctgttaatcagggcccccttcacataaactcattgtaggatatcaaactttccctgtctagtacatatttctctaagactgaaagtcagcattagaagtggaatgttttggcctttgttggatgttgtggattcatatagtctgtagagtagggtagcagaagtgatgataccgcatgtcctacccaatccctgagactgacagatactttgtcagaagaaaggttgcccgtggtggcagtgcctctggtggttagaggttttttttctcttatatacttgttttgaaagcaggatttagtttcttcaacatgaacttgctaattatgagcatttaaaaatttataagacgaaggttttactagtattttaaaaattgggacatgcttatttgatcttcatagcatgtactcttcacaaatgaaggttttagagtgattttttttaataggtcaatagtcaatgtgcaccatttttctttttatattttcttttcattggtcttatattgcagctataggaaatacaggaccaatgaaagttttcacatgttaatacaactcctacaactactagtattgaatatagaatatattcagtgttccaggttccatgctgcagggtcttatacattagctttttaaatgggagaagatgggattcgaactcaggtagtcaaatcctagagcccaaatgtttttttgtttgtttgtttttattgtactacatgagttaaggcatatttttgttgtttctgaagtataagcatgccatttcaaaacatttttcaatcctaaaaggtaaggcaattatcttacaaaagcaccttgggtagagtttagcacatcaaagggatttaggaaatactcatttgttatctccttcctgtcttaaaaggaaatctatttgtcttttccatatgaaattcaatgcttgtcttgagaggaagactttttattatgtttctgtagcttcagttaatgctcagatttaggagttacaaataacatgataaaatttataatttaagccctctaaatatcaggcattcccagtttgaggaaataaaacaatcaaaagtaaccaatgaatgcctgatgggaaatcctgatgctctagaggtacagaggttcccagcaatgccaagagacatgcccaaatgcccaaggggaccaggcttgtgaggactcatgtgaattgccctagtgagcttcttaaatgtcatgaaattttcagaggcactgaaagagctgccagatgtgtctctggatttgcatagagaagtgaagcatcatgaaaaagtttctataactgaattctgagttttcttgtgaactatgggtctccaagggagtcaaactgaagctataaataataggtcacctgaggtaaaatcagcagcgagaagagtcctggaaaagcagggtcagctgagtagcctgggttttaggggagtggtgagtagttcaatgaataggttgtggctgcatgtgaccttttccattatgttcttcccatacccatgcccctccttctatccctttacattcaaacacccctgtcttggctggtgtctgcagaaccacaggcagccttccacatggacctacagcccaatggtctagaaattccatgggctacaaatggtaaataggatagtatcagttggtcagtagagaagaaggatggccagaggagtagacaacagatgggaagcctatagacctatgagcagcatccctcgtccatgcttgagcttttcaccctttgtgggtccctagagggattaattaggaagatgtatcctaggacaagtctagactgcctgctaagcaaggcagtgcagtaggaactaggcacttcagatttatgatgtttatgtaaatgttacacattttcagtcacaatcaggcatatccaagagaaatttttatttcacattcatttaagtagaacttgctgaagacatgatgctagaattcatgtttagatgaaacttttagaaaaggcattgggagagatatctgcagggaggtagatattttcgagcttcatagtccactacaaacctgcacatatggtcaggctcctgcctatagcatacagatgaaaactatcaagaaaaggctcaactgaaaaaaaaaaaaaaaaaccactcagaatccagaatgtatctaggtgtgtatgcttacccagtattggcataaacataaaaagaataagaaattcctccaaggtacaattaaccatttatcatctccttagtctaatcacgtaatgcctaacacttctatgacactctctaagactgcaagtttggatatattatcccacttaactctcaactactatggaattctgctaaaaagttatctagaaacatgacatttccccttgtttaaattttctcctttcttctgtttaagctactttattttcttcagggagaattttaaaaataccaccttgaatcaagaagacaaagaaactaaattgcttatgattgaaagccatacatttacattaatggattgatggtctttcaacctaactaactcactatgatattatgtttgatcatttttcccagataagtgaaagtcacccagtggtgaactgattctgtgcatttattgcttccttttctctccagtatgcctcaggaattggatcattagtacagtgaaatagctgtagagtcttgctctgtacatattgctgtacagtccagtgaatcactgtgagatgcttttactctgtgctcattaaatgctcctttccaaagaatcagtagtttaggactgcctgaggccagtcttctcatttaagtcagaaaatggacattgctttagatctgaaaaaaaggaaataaaaaataaaatagaaataggaaaaaataattcatgtccccaatgaacttggcatttgctaagttctagactgctgcataatataaataatagttttgctttgttgttggtccatgtggctgcaattttaatggacatcaacatcttaatatattaaaatcaaatgagatttgattatgaggaaagtttatgcagtcattatgaataaaaatgatttaagtggaaagtgctaatgtttataatataaatttgctaattgtccttttgtggcaaatatcattactatagtaggcacttatagttacattatatggtacataagcattaggaaatttgatcttaaaataatattttagcattacatctttatttttcgaaactactaacatcctttatgttgggaaacatcaatgctactctaagtgtgtcagcatttgtaaatgccttgaagatgaaaaatgcactcatgggccaagtagaatctttcaaatccccttttaaaggaaaaaatggctttcactagcttttgaatttgactcacagaacaacttttaagatttaacaataaacttgccataaaatataacatccgtgttatctctaatactaatggcaatgaatgggcttttgatttgtgatctgatcatctcacataaagcgatttttaaataattcacaaaatagtctccattcttcaggtgtaagaatgtcttctatgagaaaaaatatgtgggatccaaaaactttatggttctataaagactgtatacacacaaaatgagagaaaaaatgtatacaaccactcaaatattcagacattttgtgtgatgatttggtttttaattcagagagaaaaggagggttgaataatttttggtcttgatttattgaagccactgtctcacactcccacctgattttgaatgtgtaaatgtcttgtatttgctataggtagataataaccaatcagtaatcagggttaggagttccgggtccattctgtagtggacaactatcatgctatgttgtttatctaactctttgagctctttaaagtaaaaaaaaaatctcattctattcttaagtagtactggaaaatcatgcaagaatgtctatccatctagaaagagttcagcacacaagtacactacaaatagcatcatgcccatgggacacaaacttatcttatggagtgtatttacatagaaaattttctgtcccatctccatttccttgttgtcaataagtgtaaattgcactaaggtggcagtagtaaagtcaattaccttctttatggtcatgaagatgagatataatctcttggtcaatgtaaattaatttatcacaattcattttaacaaatatatttaatatatgtattcattcattgaacacttactgatgccatattaggtaacaagcatagttctagggaataagtatatagaaataaagctgcaattgtgttattgttctcaaaaaacttcagtatacaggttaagtacattgacaggggaatatacaggattgaaaagggaaatgtaggagagctacttgaatgaggtgagtcatccaaaaaaaagaagattctcaaagtgggctatgcctgatcaacatttgaagttggagaaagagtcatctaaaaaaaggagcagagtattggtatttaagagaaatagaacagtatgtgaaatgattcaagacatggcaaaccaaaggaaattttgtcttagtgtgatattagtgtgcaaaggagggcaagatgagaagacctcatcgcaaaagactgccttcctaatgagtttggagtttattctaaaagaaaaggagatagctgtattaaagaattttttggagaaagaatatgatcaggtatgcttttaagagtttcacctccgacattattataaagaataaatttgataggaggtcatcacaagatattatgtgagaaataaggatctgtctcaaggcagtgacatgatcatggagagtggagaacatcttatgagaagagtttgaaacctttaagatgaaagtagcaaagggatgatctaggatcaattatttgtttcagacctgggtcattgtgaagaatcctggtgttattcacaatgttagggaatatttatcagagtaattgtgttgagaagtgttgagtaaaaatagttgtatataagattattgtggggccaggtactgtggctcacacctgtaatcccagcactctctgaggttgaggcaggaggactgcttgagcccaggaggtcgaggctgcagggagccatgattgcaccactgcactcaagcttgggcaacagagtgaggccctgtctctaacaacaacaacagcaacaacaacaacaacaaaaacaaaaagattactatggaatatacaatgacttctaggtaattttaaatatagaaccagagttcaggggagataactgagatggaaatgtggattttggaatctttgacgtgcaagtctgagtataattatccagggagattgtatacagagaaaaataacaaaaaatcaatgacaagctgtagagagcactaaccattaaataatacacagcagaagacctaaaagtacaaattgagaaatggctggagaaataagagggaagctaggaagtaatgactgtctgtggaagtcaagtgaggaaaaattttaaaattcagaaaggggtcaaaatatataagtactatagaaatgcattgataacaagaacatacattacaataacctctttaattatgttcaaccataggatgataggatgaggacggaagctgatagagaagtaggtgagaaataaagaagaaaaggctgaatgtgcataatgcatcccagaatttttacaaggtgttaggtaggatgtgattttcaatggaatatgtgaggtgctattctattggaggtgctagaaatatgtcatctccaatatacatattcctgtgtctcttaagtaccaaagaagcaaatcagttttttctagtgtattagactctctgtttgtaaatcagctgatccctgtagccattcctacatgtacaaggcatttcactgagaagtgaaaatgtagccaatcagcaaagaatttgggctgcacaatatctggcaatcagtttgaaagacttttttcactgagttgattagtagttctggtctaacacaaacccatcctttattgcccttcagttcacaatgacagcaaaatctgttagagatagtgtgttttgggggcatgtgaggcaacatgagttttggacaaatgagctgtttaagtccattccagaagtggctaagtggactatgtgtgttttttgtgggtgttaagaagatattaaatgcaaaaagaagagaccagaaatatcactgtattacattatttatttaacttatttatttaatctttagaaagattttatgtcaggaactgcccccaggtactaggtagcccaagacctctaatacatgcaataataaacaaaacaggcaaaaatatgtgccctaaatgggcttacattttaatacagagaggggaaactacaataaaaaaagtaaaatatattgtatgttgggtggtgaagacctctggggaaagaaaagttaggcagggaaagggtgctagaatttttatctgggtgatggggggaagggaaaatgaaatatgaaatagaataacctcattaacaaggtaatatttaattaaagttctaaaattattgtgggattaagctgtggagacacctggagaaagaaaaaagcaaaacagtatgaaagggtgagtgcctggcatcttctagaaacagaaggataaatatggctggagagaggtaaaaaaagaagaaagtagtgagagataatatcatagaaataatgtggagagagactctagaccattgtaaggtctatattgagtgattttcaataggaaaaacaaattctggagttctaaggaacatcttaaaatcttaaaatatatcatttacctgttagtctatcgtttcttttgagggtggtacttctgcaaatcatctcccagatcttcttggcaccatcatagaatacctttcttctcagagactagagaaattgactatgcacttctctgagagattttcaataggaaaaacaaattctggagttctaaggaacatcttaaaatcttaaaatatatcatttacctgttagtctatcctttcttttgagggtggtacttctgcaaatcacctcccagatcttcttggtactatcatagaatacctttcttcttagagtctaaggaaattgactatgcacttctctgagagtgaagagatagtttcaggagatacattgaaggcagtctttgtgccattcaaaaaggctgatagcaagaacaacacagaaatttgaaagaaccttttccagaactcaaagagaaagcaatggattgaaatcagtttctgtattttgttagcaaaacattccctaggaaaaagaaagctttcacatgagaatttttaatatatctcaaaaatgtactcttttgcaactaaaatacaacactataaataatatctcctcaaatggaatatgcttctttggacaaaggaagaggagaaatgctgaagaaaataagctctgtggatcttccacataatatttttttaccattcgtattattgtggtggcttttaattgcctccttgaatattcctgaagtggtattttcaactggagtttatatattaaactggttcacgaaagagtaaagaataaggacagttaggtaaaaagtattttgcaccactaacttaatcaatggtggcctcacctattgtagaaccagtgtataattttatatagtatgcaaccacgggtctggaaacctgggcttttatcccgactatgctattaactaccactttaatactctagatcttcattttctcacctgtaaaataagcagttggatggacaataaccacaacttccttgttaggtgatctataaaaatcggctgccatgggtagagtagtgtccagcttctctaacaagaaccatgcttagtaatcctttagtgttaatttacccagagatgccacttacacagcatggtacccactcctcatttttctcccacagctattatagaccacagtacttctccctagccagaatgcgagtcataatcttctttttccccccgatggtgtcttaggcaaccataagcaaaataatgggagatggcactcaagttgcaagcagtttgctacttatcattacaggcatggttatattgaaggcaacagttcctaatatagctaaaaagaacacttacatcccgttagcacattcctcccatctctaaagcattataaggtgtcatcagttccaccagcataaagcagttgctgataccctgggcgtaaccaaaatggatcaattagctttacagttaaagaggcctgaatgtatagaattcatttcccttctttatgaagtcagcctctgttctgagagaaaagtcttccataaaagtaacaaactcacaccttcaacaagtagagattaatatcttgatttcttgatctttgtcatcccatccacttattttcttaatctccaaatgtatagaagcttagaccaaggagctgtgtttgttttagttctgatgaaaagccctaacaatgttattagataactgtgataaattttaatctgatgacagcttgtgacccacaaattgctgtttaaaattaaaatgcatttaaaatgaaattggcaagagaactataatattaaacttacaatctgctgtgataaaacaccaatgtattttactatattaaatatgaatacaatgaatagtatcttgcaattgaaatataaaaatgtccttaaatgcattttcttattaaattaaaattggttgattaatcttactttttatctttgttttgcaaattaaaaagttgaagtagagatggattggattggctttggtaatataccctttggcagaactccaggtaaaatctagggctacaggcttctaggtttctcatctgatgagcaaaagtcctcatttttctcatcccgaatattcatctacagtaaatcaagacatgtttttcacatgcttcagtttatttataacttttaagatataattactcaagatgtatcaaatgtgatctttaaacttttttatatgttagttttgaaaaaatgactacactgatattgttggcagaccagctaaatcattgctaccttagtaagaattgagatttttctgtaatgaatgtttgtgtcagtctattattaagcaatactataaataaaactcaacccaatgtgtatgttttcatcccacatttcagcattgaagaattgtatgtggtaacgaaataattcactacagctgtttgcaaataatttaataatcaagtcatagctattttctacttctcaaaatgtgccaaagaactattgaaaactccacaatataacatcataattataacaattaacatgtgtatttaataatagctttaataatcctatgcattatttgctcaaaagattcatgatacatttaaataatagcgttagctggaataagaaagtaccatatttcactcctactattgtacacagagaataaaattcacccactcttttaaaaaagatactgcaaggattgtaatttcagaacaattatttttactcattacccctagaacatagtatacactcagcaaatgttgcttgaaggaatgaatggatatgtgtgattggatgagaagcacactcagggaaaatgcctcgtctctggttgttacaggactactgcatggacaactgctgtcacagtagggtttctaaaatctccctgccatattttattttggttcatgtgtgtgtgacaatgataaggaattcagcctagcaagtctgtctgcattaaatagaggtgctatgtatgcaaaaagcagggacaccacatataatatctctcaggtacttcccaaggtttgcttcctcacgagacttgatattgattctggtgcctcaaatctatttatatttgggagcagtctcactgttactcttggttacaccttatcaaatctgtccgagggacagtgcctaacccagggttgtcagctttggaactgtaattgttttttttttttttttttttttttttttttttaatatgccagcggacgctagccacggtgctgaaagagacaagaggattctatttgaaaccttttcttcctcttattggcttagaaaattcgagtgacaagagcaggggccaaaggagcctggtgcagcatcactaatgtgaaccatgtatttcgatcttttgggcggagatgtggtccatcaggttacagccaatgccttcctatgagcgctcgctagaccaagagaccttatgaatgtagtagccgctgcagtagaaaaggttacatctagcaggatgtcttatccctctcctgaaaaattgacagttaagtgcatagcctagaaacaagagcagggaatctagacggaggggaggcgaaggggggagcaaacctgtattcatattgaaaatgttcactattttcgtataaagtaaagaaaaatcaagagctaattttaggttaagttttcggcctcagttttccaacaggtgcacgactccctcaccccttccctgtcaggtactgtcctgttttacctttttagaaaggctttcttcgcaaggcaagcttttcctagagtccttaagcatgtgcagtttcccatctcatgcacagctccggctctaagcctggcaaccccttacctgcagcgtgaagattaaggagcaggcacagcgcagggaagcagactgctctccgcatagtgtttgcattgagaggtggaggagaaactccaccacgaccccacttcaggtaaagtgctattagaaagagccaccgccaagggtcttctagtctccgggattcaggtcctcggctggggtttgcagagcagtcagtctgtggcgccgacagaaaccagcaccagcttcaacctccctaagagagggagagaggaagagcagtaggaggttgcgggtaaggggaacagaagcgctcagaggcggcaaatgcctggccttctggacgcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagc

SEQ ID NO: 608 - DNA, 116536 bp, Homo sapiens
tcagtatttagtattaagagtttattggcagtatgaaacaaagtcaacattgctgcattaaaaattcatatatgagcagaacagctagtgtttgctgagggtagttattttaattttttttgtctcttgaagattgaaagctttcagaaatgtaaggacatacatggaaatgtccttataaggagcctcgaaaatgggacagattatatcattcctgaaggcatataccttttgttgagagagagattccaggtagatagcatattcaaaaatcccttcttagcaaaagagagacaagtagttaaaactcttgatacttcagagttgctacaaatttgtttttcccttttaaagtaaaatgactcacgatgtggaaatacagtggatagagttctggagcagaagccacctttatgcccaataatagagagtaaatacatatatacccaatgacaatcattgtgctctgtaattgtttgataggagggactataaatacacatttaataggtaatattatcaagacacatttccatataaaatagttactgtttttgatttttgtttttcaaaaacaaagacttctctgttaaaaatccattatcaatcacttgcaactttagcagcaagattctggtaactgagaaaggtaatagcacttcaaaacaggaacagtttaacagctgacagtccattcacaagacagattttgcaaacattaaagcatctaacacataatacgaatgtcttcagcagctcatccagtcatcacctgatgacatttattactgaatattacatacatacattctgtgtggcagatagagtcagtacagacaaaacaaaatctgccttaggctgtgtgataaacctatcatacctccatcatcaaaaaaccttcagaataatttgggggatgcttacaaatgcattcatatacacaaggagctggaaatcttaaatatgttgcccagtcttccacaatccatgccatacatgggcttcagagcttctccttccttccattgcaggaagctccttctagaagccttgggtgggtaatttgattaatcaccccaagagattgatggtctgacaagtcttcaatgactcactggacagtctctgctgaaagtctgctctcatacaggcacagagcatggtgcacaaattcatactgctcactggtttgcaccattccacctctgcaaggaagaaatcataaaataactgattttgctaaaatcttgcaatttcaagtaacacagagatttcatccaagctagggtattatgccaaagacacatagaacagtcgacctagtggttcttttgttatccctcttacctgtgtccaaatgtctcaactatcaaagttaacatggtaatgtatataaagggcttaacacagttcccagcacacactaggcacgtgattaatttttacctgtgtaacattactggggaggtggtacagcctaatgatcaagtacttggatttggcatcagccaaggtgagttcaaatccctcctctgccaattcttagctgtatgcatcttggacaaattcctcgaaaccccttgcactttagtttcttcctctgttaaagcaggatagtaacagtaactactgctgtgaaggttaaataaattcattgtagctggtatatttgtattacttctcaggtgcctcatgattcatctcttgttaaaatggtttatacatttggcttaaaattgattgacggagacaaaccaaacaaaactcatctgcaaaatgttgctttctacaagtaaaatgaagtctaccttggaatggtttatttgaatatgttgtacagaagcaaccttagccttttggtgtacggggtgtctaaacacaatagtgggtgggtccttaaatgagttggaaaaagggaattggctctgctgtgacattttcctcttggttatcaccattatcatcactagctgcccagcaccctccttgtcaatggattcatagaaagcacttgccttcatgagaaataacggtgcttctcattatgtttttatatacataatacctatatcacattttcccccttcataattatgatccttttttaattttagtttttgagaaaacgtctccttaattgcttaggctgttgtgcagtggcatgatcacagctcagtgcagcctcaacttcctgggatcaagcaattctcccacctcagcctctggtgtagctgggaccacaggcaccaccacacctggacaatttttaaattttttttttcttgtagagacaaggcctcactatgttgcccaggctggtctcctggactcaagtgatcctcttgtcttgggctcccaaagtgatggaatcacaggcttgaacgacggtgtccagtcctataattatgattttttagcttgacaaagttaccagacattaatatgttactattcctgctcactgtataaaagcatcactatcggtaactatttaaagtcttgtaaattctctgtaactctgcaatcatgcaactgatcttatcttttagtttaactctatgttttaaccagatttttccaagtggttgttagtatcattcaaaataactttcagattatttaggcacttcaacttaaaaacaagatatcttgtctcactgtaacaagacttctagttaatggtaataataaaaactgggcttctatgtttatttgtcaatctatgtcaatattagagcagtaaaacttccttgttttaaactaaacagtgattccccaggaaaattaacatgatgtcaaaatgatgtaattggcaaaaaataaagaggtaaattcacagtttttggtgacagcaacttattgacagaagtatttaattggtcttcctcccctagagctgtacattttgttgcattgaaggcaaccttctgggctaagtattccttggtcagaagtgaacaacagaaatggccagctgagaatgtggtaatggtttatcttcttagctgtgtgatgacatctgggctcatctaaaatcatagcaggtgttccgaagatgctggcttgaactgtgaagcttgggagacaccaccacagtaaatattagggtagctccagggagctgagaggtgcctcccttcctctggcatttgcacagctcagggcaccattactccctcttgagctgcagacagtatgtggaagcttctatgtgctccacctcttaggctctggtctgtcagcttcctctcaccatttacctcactttgaggcaagattttccccttcttgtatgttctggtcagcactggtatttacatgtccaactggtgaatgaatggagacacagtttagaatttaataactgtttcaccctaagtgggtcagtggtgtaatttaatggttggagtatatttactatgacattctgttcactaaatcaaggttgttttagccagtgaaagtggggaagatggagaagcatactcattaattgtgggctggcaaaattcttgcaggtctgaaggcttcaggaaagtatatgaaaagttctcttacctcccacttaatttggaaaataaaaatgaaaaaaactggcatcagaggaattcttagagatcatccattctagtcactgacaatatagcttttttagaaatcttgcaattttagaggcagccttttccaaggttggcaggaaaacttttaagacatcaacatgaatctgtcctttctaactttcaccgcattggtccaactgaaataacccaaaagacgtcttaaggctcccctgtagtcacacaacagctctccaaaggctggaaaacagccatcaaagtcctataatcttttcttctttagactaaacatcctgtggtcactcaatatttctgtacagcctggtttttctgtcactcaccactctagtctccctcttctacaggctattttatcaaatatgaccttcttagagagttgtgtctccttctgatgagatctatgaagcaggcttattttctcttccagctgcacgttagagaccaatagatctgtgtttgcaggtgcatcaggtggtgaggtcccccagtgcctacatggtgcctggttctcggtagtattttaagatactaactgacggtgtagattaaataaaaagtcaacaagactttttttgaatgtggacattatagctttctcccatcctgtaattatgctactggatttttgaaactaaatgcaaggctttctatttattcttgttaatttcaacttgttagtttcagcacaatgctcttgtttactggatcactatctatcgtcaatatattagtcttccatttctcactcccagcgttgtgtctcccaggtatttaacaaggatcccttacatctttttatctaaggcattattaaaaaatagaaaaagagacaaagtagggtctttaatatgagtaagttgatatcatgatatatactatctaatcccattctataattatttccaactaggttgtaggtcctttaaagacctacaagcataatggcatggtcttcttctacttgtaacaataaaaagcacttacgagtcctaggtaaatacttgtcaaatgaattacccaggtcatgctattttcatgtcatgtgaaaacagataaactctaggctaaaagaaagcaaaaggtattccaggatgcattcactggaggctggttcaaattcaggaactcatcataatcatctctgaaaatattaaataaatgtcctattgcatatattgatatatagaatagtctattggctggatgcagtggctcatgcctataaccccagcactttgggagtgctggatggatcactcgagcccaaagtgggaggatcacttgagcccaggagctcgagaccagcctgggtaacatagttagaccctgtctacaatttaaaagaaaaattagctggacatggtggtatatgcctgtggtcccaactacacaggaggttgaggccagaggatagcatttgctctataacaggtaatccattcttagaaaggtcaacagagtcttctttcttcttatttttgatatggggtcttgctttgttgcccaggctggagtgtagtcatgcaatcacagctcactgcagccttggcctcccaggctcaggtgattctcccacctcagcctcccaagtagctgggatgacaggtgcatgccaccatactgagctaattttttctgtgtgtgtgtgttttttgtgtttgttttgtttgttttgttttttaagagagagagagggttttgccatgttgcccaagctggtcttgaactcctaggctcaggcaatccatccacctcagcctcccaaagtgctgggattacaggcatgagccaccatgcctggcaaatgcagttttttagataggctggtcatagcaaaaaaagaaacacctaagaagctagtacagtgtctgtatacaaaatatatttatggaataaatgtataaagcttggttaactatggaactctcaagagagctctatagttattcatcctcaggagagctctgacttgactccaggaagctcttaggtcagataggtttcatggatttgctaaaatctggatctatattactgatataaagttcccaatacaaagtggttctgggaggtgagaaacaagggtactctttttcttactttttttttctttttctttttggggcagggtctcactgtgtcatcctggctggatcgtggctcactgcagcctcaacctcccaggtcaactgatctccttagcctcccaagtagctgggactacaggtgtgcaccaatatgcatgcaccttaaattgcaaacagaagtgaaacttacctcaggttcatatctgataaatgcttatgttagaactaaaacataaccccagccaatcataagcatccaactcacatattgttatgtcagtaaggactttccaatacagtacctgaaaaaaggcaattatgtaattgcaaaccaaccaaataaattgtttgtttctgtactttcccaataaatacttgcctctggcgttttgtcattggaacactaaacctcttttggtctggtgtttcccaatgtatgactggcttcttactaaataaactctttaaaattttattgtgcgtcagatatttcttttccagtacacgtttgttttcccaggaggtataatacattaagtgaaaatacctactgctaagcaggagttagtttaccaaaaaagagtaaggtcaaataaaaatgtcaagagaaccccagctagctgagagaatggtgccaagttcattaccaggggggaccagagtatgttaagagggaaaaagacagcatacactgttgtcaagacaaattctgtctccaccacttactagatattttacccaactacacaatctctgcagtgctcagttttttcatctgcaaatgatgcgacaataaaaacaatagttcctactttatagcattgttgtgagaaataaatgggactatcacttaacatgtttagcacatagccaagcacatatcaataccataaatgtcaactattattattgttattgttattgttactctttggtaccatctggtcaaataggactggttaggaggctctggagtgaggcccccaaagaccctggagaaccaagagcaaatctggcagaggacattagtttgcccattaagttccaaatatctttctaaatattgaccagcctagaagacaggcacagtggaggcagatgatgaaaatagtaggcttggagtctgacagattcaggtttgaatccttgtttttttaacttacttagctaaatgattttagacaagtcatttagtccttcccaacctggcttttctcacttgtaaaatggcataaatgacaaacgtcatcgggttgtgaggattaaatgaatcagagcatatcaatgtctggctgaaggctattcacagaatccccagaagcccagggttctacaaaggtggctgaggaccctgggcagggcagaggaggaggatgggtcattaggactagatgccaatcccagctttgaccagggaagttgtgttttttattggttttctgtgttggtgttctgtggaagattctgcctgcaaaaagttttccattgttcacaaagaagtttgaaaaccactggcctggctaataaggtatttaggtatttatctaataaggcttcaagttttacaaggtttaaatgagagaatccacaaaactcttggcacagtaactgcccttcagtgagtactaaataaatgctgtgtattatttttcttattcttagttaatacgacacctagggtaaccatgtttggaagagttgtggttcattggtgttgtcctggtgtcattatcaattgggtcacctttcactctcagaagtaccttggtttggatgataaattatttgttcatcctaatgatgccccattccatgctgtggaagaaagtcattccctttattgcaaaagtggtgttagccacgtggcttggatttctttgtgcccacagactatgaaatgctgtgtttggccaggccagagaggattcagatatactaccctcctataaatgtcagataatctcatatcacattagccctgccaaatacaaagatcagtgtcgtctcagtctccgtgcagaacagcacgtagctgtgtcagctgggggtaaactcaggttagaaagggaaaaaaaaatgtagttttttccctttgctactgggagggtgttttgaaaaaaacctctccagatgcccaggagagagatttggcttttaacatgttaaaattttgaccttttgtgactattcactcacacatacagagagcaacagcctttcctgtcgtaccgcccagcccgtatccggtctaatcagtagacagaagaaattctgcagtgatgactcacttctgggctaacaatgaaacttatgctcctttgctttttattattttcaaatctggaattcttttggtaaagtttggtacagtaaatttagaacaaaaggtgtggacgttaatgtgcctcctgggtaaagttccaagagcttgggcatgagtcaagtgaggctactgtctgctgtgcttagccggggtcagctgtaaggtgtgtctggccccttggacagaggatttcccatggctttacacagatgtcatatcaaggagggagaacttaaatgtaaatttggccaattctgaccaggtattttgaacatagacaccttctccaaaatagatgtgttctaaagtatttgtaggtcataaaaatcagcatatatcaaatgataattcaattgatgagtctaacatattttgagttccatttttttttcctctgaaaattagccgttttcctctgaacactcaagttaacacctaattaactccaagctaggaagaaggaaaatgtcctggcagccacttggaagattcagtcagcataatatgttttacaaagtagacctcttgttgtgatctcaggaattataatgtcaagtaaatccacaccaatttctagggctttatctccaagtgtccttaaaataagcaaatcaaaatgttgaattcctgatcttcaaatgagatctttgaagttcattaattagaggaatctttgtgattatttgggaatgcagagaaatatggataaatgtaaggttacagttgataaaccttagaccaacaagcagaaactttagttttgaaattatttcaaccaggttttggaaacaaaaaatatgttggggacatatattagccttggaaattgatggcatatatattcttctgagatggctgtagttaaaaaaaaaaagaaaagaaaatcatcgaactgaagtgactaatcaaaacatttaaacaatgatatgatgcacattggaagcatctttttatcctgtgtgggaagccacaagtgaggcctttggatgtcattccagtttaagccctctaaggtaaggatgtacaggcaactacaaattccatccttgactcttaaaaagaaggatttgacagataatttcctgctactcaggaagaaaaaaaagaggaaaaaaaaggccttggaataagatattattttatatgtttcacttcccaggttctgttttaaaattcttccagtgtccagttgccaatgggattaaaaggaaaacgatgaggaaaaagttatctgaggtcaatctgcaatggaatatgttcctttcctgcctgcttagatgtcttctgatagtcacgaattgatttgtagtcatacttctgtaatatctatatgcatgtgaagcactgtctgatgttaaaatataaacatcatctatagtaataaactgagacactgcatctctcatgctaaatgtgtaaatgaccttctgtcactatctcaaactgtagaaccttgacatacccaagcctaaatgaatcttttttagcaagagctacatgcagcgaagctggttggcttagctttatagcaattggtatttttaactaggtggtatagttgaacaatttagtgatatttgagattagaaggtttaagtattatatggaagggctttctaagtaataaaaaatgattatactgtgttcagtttagtactaatgttatggatctttttttcaactataattttaaaaaattgacctatacatttacggtaatctcctgttaataggaaaatgtgattgagcaaaatatcccttttgcaacaatgctggccaacagaaagttcattgtacttatcatattcagatattaataagtaatctaaactaaaataatcagagataaacaatttttcctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaatttgagcaaaattgaaagttcagttcagagtgttttataaaaacttcaaaattggtcatgtggccttggagatgtccccttttttggttttggattcttcctttagaatgaaaactttgggcaatatattcctgaggctagattttaaaaaaaaacccacccttttcctaggagatgtttggcaaatgttatgactattgcggctatcccattgttctccacataaacaaatcttcaaagactcaaagaaagcaagagctgagagggatctcagaaagccagttggtcactctgcaatcactgaattccagcatggaaaagcatcttgttagaggagtcctgacatccacttaagctttgttgtgagtcacacaatgaatattaacttgcaagcattaaaatacaacaatcaggtggaggtccatgaaatatcttactcttgatagtaagatatttctggtttttataccagaaaaggttggagatcactgttacgccccacatctccttttactatgtagacagagaggcctagagtggacaaatggtcacacagaaaattagggggcagagccacgcaccaagctccttgacatctagtccagagatgtccggcacctcattcttttgctagtcttaccagtgttcagttgcaattgccataccacccacttcatcttttaattaaaagcgaatgcagtgggaatgaagggatgatcccttaatgcccttctaaataaaacattcgtgggtgccttgcactgaatttgaactcctacttggaaaaaaaaaaagaaatcttattttagttcaaaatatgctcaaaagtattagtaaaaggagaatcacagactcatgaatctgcaatgagaactgagcatctattaatagaagttgtcacaaagccaataaaaataatgtcttgccagagaatgaggaatctaccaaatggttttgtcattgttatactggaaatatccattcagcataacacattcgtctctgaaccagaccatttgaatttattactaaaatgcagatttttaacttgagtagaaattgcttgttcttttcatgttaaattacaatgaccaggcattgtaatttttggggtggtggtggtggaaatcaaaattttaatcctatccagtgttcaagctcttgactgatcggtcatgaaatgagccccatttcaagtatccaaatcactgccttgtctttttctttgctgttagccatacctggactcctcagaggaggcagctacaagtggagaggggtagattataagaataagatgcacagtatgcagccttcattgctagtggttggaggttgttaaaaaagagtagaaaaggatagaggaaggcctgtgaagctcgtattctgccgaatacaaaatatcagccttctgatatactggttctgtcttttctctctcttattacacttagctgcttttaattagttggttccaccattcctttcccaccacctttgtttttttgagtctcactctctcgcccagcctggagtgcagtggcgtgaagtcggctcaccacaactctgcctcctgggttccagcaattctcctgcctcagcctcctgagtagctgggactacaggtgtgcaccaccatgcctggctaatttttgtgttattagtagagatggggtttcaccatgttggccaggctggttttgaactcctgacctcaagtgatctgcctgcctcatcctcccaaagtctgggactacaggcctgagacaccgtgccgggcccttttcctctttttaggggtccaggttcaggcttaaattactatcctatctctagtcttctcttcaccacaaagcttcttgaaagaacagcttatctttattattacaacttctttccctctcatttagatggttcttgaggaaattcatctgtggtcaaataaatgtgaaagagtgcttaaataaaattaaaggagtttctacattggaagattttagattttttaatgcattaatgcttattgtgagtctccgagtggggaagacttcgaagaaatatagtgtagggctgggtgccatggctcatgcctgcagtcccagcactttggcagcccgaggcaggtggatcacctgaggtcaggagttcgagaccagcctggccaacatggtgaaatcctgcctctactaaaaatacaaaaattagccgggagtaatcccagcaactcgggaggctgaggcaggataatcgcttgaacccaggaggtggaggttgcagtgggcccagataatgctactgcactccagcctgggtgacaagaaagaaattccatctcaaaaaaacaaacaaaacaaaacaaaatatatatatatatataaacagcttttccccgaacttagtcaagaacctactttgtgcctgaacgccaccaagagggtttggcttaggaggctctcagtaaataattgttaattaaactatgtcctgagaaggacaatctgggaaactgggaaagctggttaagacacccatttttctacacccaggtgcctgattcatgctcagtagcagatgtctagtgatgcctgttgaatggatgaatgtatgcaggattcaggagcaccactctgtgcagaggtctcagatgcctgttccacagaacacaggatgcaggcccatctattaggttggtgcaaaaataattataatagcaaataccccaattactttggcaccaaactaatacaaacactcattccattctaaaaatatcctaagacagagttagcttcaagggatcgtgaccagtgcagtcatatacctctcaccttcttgtgctgagaaggaccctgaacttgggttaatgctttgctgtcactgtcttgaagtatttgatactttttaatcaacagatgccacattttcattttatactgggcctcacaaattatgtagctggtcctgcccacagtgtcccttggagtgctcttcagctctgtcttagtgccgcttgctttcccaagacaagccatgagcttatctaacagtctccttgattgaaggacctcgccatggcgtgtccagcatcggaagccctcttcaatttcccttcaccaaaacccaagttctgaatgtattcctaatgccaggagttacactctctccagctaccacactgaaaagaacagatcacttcgtttagattgaagcgttaatagcatagtagatatgaagtgttatgccatctcccatctccagattcaataaactttagaaaaagataattcttttaaaagaatccatccaagattagctctttactagcagtattttagacattcgctatacattttagcatcctccatagatagatattttaagaagcagcaatgttttgtccctcaaattgtactcttaaggcagttgccgacaacgtcactccaactattcataaaggagctctcatttatactaaaaactgttttaaaaattatggtgtcccgttgtcattgcattttgtttttaagaggtggagttttgctatgttgcccagggtgggtggcctcgaactcctgggctcatttgtttaaaatggcagagtattatcaaagagatatgtttttgtcaagaagttttacaataaacatattccaaaagcctatttacttttctataagattgataaagatcagagaaataattagagatcaggcaaatgtcccagattccaataggtccattttgttacttcccaagctacttgactttggacaagttactcgctatctcgaattctttggttcctcattaaaaaaaaaaaaattaggccaagatgcttcttttccttcacttgggtttattttgggagttaaataagtcatgtgctttgaagaccatggtgaagagtccatgattaaatacattctgtatgtattaaatacatagtgcattctggaatctctggacagattcagagctgaaggtaaggatagccaggaaaatcggaatttggggacaaggtttgaacaagtgatgaagaaagatatgctgcaagtgcataacggtagacatttggattggctgagaccagttttccctttactgccatgagccaaaaacatggttaatggcagcagttagccacacattggaatttttaaaatgaggtatgataggaaaaagctgaaggactggaacaagaggcaagaataatgtgggagaaaaagaagtaagatgaggtgaaacgaaagggataggttttctgttctgcttttcataacaactagaagagtgtacaacagaaggaagagacaagaaaaggaaaacatatgttgatcctgtgaaggaaggaggctggaggaaagacctttcaaaggaaggttcaaggagaggatctgtttcataaacaacagaaacagctgctcagaaagaatgcagaaagggtcttgatgaagaaatcagaatgattttgatgcatatattggcagtcattcaaactcaagggggttgggtgcctataggcttcagatcagcagagaagttggatgtgttttcaagatcctatcagaagtgaaaagacaagacctctgggaagaccttggtggtgacggaaggccaaggctaaggtttctgaccatttgctttaggaaggaaggagcagatagaggaggcattgtgatgtggtttaaaaaaatgcatttgtaattccattcaaaactagaggacaatttgttagacctgaaaggggaatgtgactgggaagtggaacccaaggtggaggtcaggctatgaaagtgggcaggggaggtgggagatgggagggtgagcaggcaagaattaatggtaacataacaagagccaagaaaaagagcaaaccaagcctgtttttcagcacgttcttccaaataggatcagaacaggtgttgctggaggccagcttggtttggagtcactttagatccatgcatgtgtttggcattcatggagttctggcactaaacaagaacacaggactccaaggtatgaactggagtccccgggtgatttggggtctcaggtggcagccttgtctacagaagcacaaatcaggacagatgaaagtcaatgtgggagcagctctggctgactgagtgctgcttctccccctcagagttagggcccctttcctgtgtgaagacaggccctaaaatttgaagtgaagcaactgatcctattccagctgaggtggactacacaggatggaaggcaaaggaatatcaggagattaaggcagcaattataagaggagaagggataattggaactgatcttttttatgtaccaaaagaaaacatttttggaagcagttacatgtggggtgtggtaagagggaagcaggattggggggtaaagagaggataagcaatgtaggctgagtgttctactaaatacatttcaggtttaatgtcatttaaatgtggctgaagtcctgtgagttatacattactatttccagtttacaggcacatgttaggttccttgctacgtatagtgataacaactgtggaaacttgattgaatgcttattacacaccaggcatttcacataggtcatatcatcttttcatccttacaataataataggaaatatatactactattactccaattttccaaatgagaaaactgaggcatggagaagggtagtaacttgcccaaggccatacaaccaaaaaaatggtggaatctgggatgtaaactcaggcaggcaatctgtttccagagcccagaatgttaatcgccatgatgaactgcttctagagtttacatgctaacagaaagagaaaataataaagaaagaaacaaacatagtagaaaacaaacagggaagatacggttagaaagacttagaggctactgtctaaaaaggagacaagaatgttacagatgggaagggaaaaactaatctggatagggaaatttgaatgtttatttttttagaggtaagagaaacttcacagataattttaataataaagatgataataacataacaaacatttattgagggcttactatgtgccagactctattccaagtgttttacatatattatctcatttttcagaataatcttcttgtcttttttattgaaatgccaggacatagcacatagtgctcaaagcatatttgttgaaaaaaaaatctcgaaaggtaattatatggcctggcacggtggctcacacctacaatcccggcactttgggaggccaagatgtgaggattgtttgagtccaggagttcgagactggcctgggcaacatggcaaagccccagctctacaaaaaatacaaaactcagctgagtgtggcacacgcttgtactcccaggaggtcaaggctgcagtgggccatgatcacgccactgcactccagcttgggcaacagagcgagactctgtctccaggaaaaaaagaaaggttagtgtataattttatctttttagaaaactctaggtcatagggctgaagctcaagggaatcaatgcctgtgtccctctttgttttattacttcacagcatttatttctgtctgaaattatcttggtttattttgcttgtttattatctttttctgctagcatataaattctaagagagcagaaaattcttgtttaatgctgtatttgcagcatctagaccaatgcctaggcatatgaggtgattagtaaacatttgttgtttgctgtttgtttttagagacagggtctcactttgttgctcaggctggtcacaaactcctgaactcaagggatcctcctgttttggcctgccaaagtgctgagattacaggcgagagccaccatacctagccaacaaaactcttgttccactgtagtacactgaattactgagcagagacgcctgctgctcatcattttgtgccttctctgaagcagcatctgtccactttctccatcactaactcaatcgtccatttacccaggcaggcttagttgtggagcaaggaagaagagaagtttcttgtttatcttgttttcaaaacaaatggagattataacaaaggtgatcaaaccatatctctataaaaatgactcttccatctcaccctcataaggatggctactatcaaaaaaagcaaagcagaaaataaaatgtcagtgaagttgtggagaaactggaaccctcctgtgttgttggtgggaatgtaaaacagtgcagccactgcagaaaatactatgatggttttctcaaaaaattaaaaatagaattccgtatgatccatcaatcccactttttgggtatatactcaaaagaattgaaaacagggtcttgaacagatatttgcatacgcatgttcatagcagcagtattcacaatagtcaaaatatggaagcaactgaagtcttcatcaattgatgaatggataaacaaaatatgtgtcctaaaatggaatattattcagccttaaaaagcaaggaaattctgacacatgctacaacatagatgaaccttgaggatattatgctaagtgaaataagccagccacaaacagacaaatactgtatgactccacttacgtaaaaggtgcctagagcatttaaactgacagagacagaaaatagaatggcagttaccagttgggctgagagaggaatggggagttttttaatggatactgagtttttcaacatgaacagaattccagagattggttgtacaacaatgtgaatgtacttaaccctaataaattgtccacttacaaatggttaggatgataaattttgtcatgtgcattttgtcacaatttaataaaaggattaaaaaataactttgggagccagatgcagtgcctttcacctgtaatcccagcactttgggaggccaagaaaggaggatccctcgagcccaggcattctagaccaacctgggcaacatagtaagaccctgtctctacaaaaaaaaaaattacaaaaattagccatgtgtagtggtgctcgcctatagtcccagctacttggggggatgaggtaggaggaccacatgagcccaggaagtctaggctgtagtgagccataatcacaccactgcactccagcttgggtgacaaagtgagaccctgtctcaaaaaaataataaataaataaataacttcaggccaggcatggtggctcatgcctgtaatctcagcgctttgggaagcccaagtgggagattcacttgtggtcaggagttgaagaacaacctgagtaatgtaacaagaccccatctctacaaaaaactaaaaaaattagccaggcatggcgcacacctgtagtcctagctacgtgcgggggctgaggtgtgaggattgcttgagcccaggagtttgaggctgctgggagctgagattgcaccactgcactccagcctggatgacagagcaagaccttgtctcaaaaaagagagaaaaaaaggctttttaatataatgcatatacttaagcattttacaagcatctctacagagatttaggaccttggagcctgagatgtttatgcatgaagtcaggctgatgagatcaggctgtgaatgaaaacagtgctctgaaggcaagcctctgtgacactcacctatccatacgaagctggcagacaatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattataagtagtaggatgagaggggtggggggaagtggtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggagagaaagaagaatggtgatgccctgaggccaagtgcatgctggaatagggtgaatttgaaggaggcagggaaggggagttttgccttggacatactgatgttcagaagtctagtgaataattgagcaattgaagattggattcattttaggagagggtgcagctagaggcacatatttccaagagatttgtatagacatgataattgaacagaaatgatgtctgtcctggtgggtttatacattcaactgccttagacgatatgtccataaaatcaacctcacaagcacacgtgctctctctgtctctgtctgcagttttaaccactaacagtctctatgtaaaagattctttcaaatctacatctagactccctaaatttcctaaactctagattgtcattccatctcctccttactattttggacttgcttcagttcaatgtatctaaattcaatgtatctaaaacagaattaattatcttttccctcaatggcattaccagtctgccacaagttttccagcctagaagtcttggaaccatcttttacatctctccctttctcacctcccacatccaatctgttaccacttcttctattttccatctctgctgagcctgtgggattcatgctttcctttctatagactgtaatcacgttttcaacatctccttttttcatgattagcagtgatctcattatagtttccaagtctcaagtcttttccttgacaaattcgcacagctgctaagttcatctttctgaaatagggacttaattatatcattccctactcaaaacctatagatggctccattaactatagcataatgtctaacctccctaccatggtattcatgaccttgcaaaatctgaatgtgactaactttcaagccttatgtattttgctgtcttccctcccgtgtgccatgattttcacttacgtcaattgtttgggcttttggttttccaatttttctgtgttaacaatgttttcttggtcagaaatgccctccctccttttaaaaccacaacattgattatttcaaaaggctcagttcagcattattccaatttttagaggttttcttcagctcccatggttggaaataattgctcccctcttggcactcaaatagcacctatttctcacatttggcacttgttttctgttgaatgtgagtgcagaggaattcagaggagtggctctcttttagctgaagtgtccacagaaagttcatttcattgaagaaataggattggaactgtgccccatgaatggcaggtattttggctgttataactgagagagaatattctaggtacgacaatgatatacaatgaaagaagaaaagaattaatgagaaacagcaaatatgatttgcaacaataagtagaacagcttgtcttgaagagaaagttattttagtggaactatgggaaataaagatagagaggtaccctgggatcttatatggaaggctaagtggtttgaaatacatccttttttttttttttaagtaagaatttgatgaagactataagcttccactcttcagaaaaattcacataagtttacatactcaaatgtgtccaaataatttcaaggagttcactgacctctgcggtttatggataggttcaacgttagggacttttgctctagttttttttttttttttttttttttttttttttataagacagagtctttctctgtcgcacaggctgctgaaatacagtggcgggatcttgactcactgcaacctctgcctcctcggttcaagcgattctcctgcctccgcctcccaagtagctaggagtacaggcacattccaccacgcctggctaatttttgtatttttagtagagagggcgtttcatcatattggccaggctggacttgaactcctgacctcaagtgatctgcctgcctcggcctcccaaagtgctaggattgcaggtgtgagctaccgcacctggcccattgacaagctttgagcagagactccatgtaaggtgagacggagaaagggcacaggtaggccatggtggcggtgagagcatgggggaatgcggtatgtgtgtgcattttaccagctacttctaaaatacatggatgaggtcagaagggcctgaactatggtggctggacaggaaatggtgattatgggagaagctttgaagggaaagccaatctagtgactgattagatactgatgttggagttaaaaggaggaccagagataactgtcaacatgggatcctgagtgactggaaaaaagatagtctcattctcagaaatagtaatcagaaggggagctggttttataggggaagtgactagttcattttagatatcctgagtgtttaatgactttgggtgggggacagttccagccctaacgcatagtcagttaggctgtttttttgtttttgtttttttggctccaagttaagtttaggataaagccagtattatctacctttggataaatagacacatagtaaactttactcttaattaaaccacacaatctcaaaaaaggaggctaaaattatactctaaaataatatatttattaaatatatcatcaaaagctgacttaagagacctatgcggttaaacaaagcaacccaaattattttgagaaagcatgaagaataaatggctggctgggcatggtagctcacacttgtaatcccagcactttgggaggccaagacaggtggatcacgtttgaagtcaggagtttgagaccagcctggccaacatggtgaaacccccgcctctactaaaaatataaaaattagccaggcgtggtggtgcatgcctgtaattccagctactttggaggctgaggcaggggaatcacttgagccaaggaggcggaggttgcagtgagccgagatagcgccactgcactccagcctgggtgatagagtgagactctgtctcataataaataaataaataaataaataaataaataaatagttgttcatataaattactttaaaaatgctgccttcagtttggttacattaaaaggaaaattaggggaaggaggtatcagttttaggaagagagctttgaactagaaattagggacaggaaccagcacagaccctgctgctgttgttggcttggcctctagtgctccatgttctggtaacagcactttgttttcctttggtgacttgctcacttctcatttcataaatttgtttcaacctgtttttctggagataactcttaaaataattgactggttttcaccaaacttgaaatagtaatgttaccaagatacaagccaagcagagttcacatgtcatgttgaaacaacaaaaaagccactgataatttcaaaaagtgcatctttattcctggtgtgtacaagactgatgagactaaatcaatcaatataagtttcaaagcagataactgctgaataggtctcctgttcactgagccatttattacgaacttgtatttcgccgactgtgtaattgttgtttgtgaaaaatgacctaaaagcatgacttcacttctgtcagcataatcttgattcagactcaaatattacagacttaaccaatttcaataaatatttaatttgccaacaaagtcacatccaggaagcaaaacccacttgcacctgctctgtgactttacaaagaatgggccattgcttagacagaaaggaccatacacgtcttacctgcagtggacaaccacaggccctcggccctgggaagcaagtctgtcttcttctacatccagcatgagctgtaggaggggctgggcactgtctggagtcttgtgatcaggccatgaggtgtaccagtaatgcttcacatgttgggtgtggcttccttgctgaaaatagcaacagccaccaaatgcctcattcacttgtagaactaaaagtcatccaaaccacaatactgaatgccttttatcacccccatcttgctggcaatttatttctaggtgggaaaaaaatttagaagatttttgaagagtgcccttttactttgagaagactttactgtcagtaacctgtttgcaaagtgagaaagtcatacctttgttgagatttacatctctacctatagttataatatagatcatataagtaacatatgctaaatatatatttataatttattataataaacaagatggtaggtgaaaatgtagccaagaaagaatgagatatattttgtttcctgctctatgagcattcctgacaagttattataaacatgttaatcaatagaacacttaatttcatatcagtcatgctaatacttctacactcatccaaaactccagtatttaataggagtgaggaatcacagcaataaagaagctacatgagatccctctattggaaacacttgggtgagggcccacacacctcatctccaaacccagcacgggtgagggtgtggcatgaacctcgcactccagaacatgtgttgaaaaataagttttggtaaatgccttcctattccaaacttccccggcactccagaacatgtgttgaaaaacaggttttggtaaacgccttcctattccaaacttcccaacaaaagccatcactgtagctctgcccctgttttcttcctctttgtgatgattctatcccagcagtgaggctgcagataagatcgaaatttttgggtgattattctccagaagcaaaaataataccatggtaacatttctcagcatctgctgcccatgagttaaataagatagttttcctatgacataatctcgtctggggaaagtccctataaattactgtaactccacgcttctgaagatctcatcaacacttcaggcttgccttgcttcccactgccacccacaaatgcagattttctctttcacagcttccaggccttacgcaaagctgcttagatcaaaatgacattaaaaaaaatcatggtaaagtctccagcacagcctttagttaaaagctttcaaaaggttaaatcagagatattttattaacgcaaattagaggatcacaacatcctacataatgaattttcttaatgtctacttacattcatttaattatactgcatattaatagtagttgacaacaaaaaatacatgagggaatgattatagtttctctttgatcttaacattatttaatttgcttaaattgcatttgtagtacttaaataatttcaaagtagaaatgtaatcctctaacatcatctactttgtagatggctatagctacataatcttacctttaagacaaggtttcgaatggtgtagttatcacattcatttacactgataaccagaacctcaacttttccatatatccctctcttttccggccagtatagcacacatttctggaggaagggaaagagaatacagcaaatattaatggcttttattagccatggagtacttttcattcaagcatctcaagagttttatatcattagttttaaaatatcaaatatcaatttttatagttttgtaaatatactaaaaccattgaattgtaaatcttaagcagctagattttatggtatataaattatatctcaacagttttttttaaagtatcagtttcatatgtgcctattaaacactgtcactgctggctccatacaaaaaaaaaaggcagaattacccaaaactcctcagagaaattaagaactaattaagaagttaagaaatttaagagttaagaaattgagatccaaatattagaatttatcatgtgctgactagaaataaaagaatgttttcccacaataattgaggaaagttacattttcctgcttcaacaaacttatgtctaatgagaatatctaatatgttaggtggcatacaaccaagtttcctttatatgtaaggcagatataatgatcattaatacaactatggtattatattttcccggaccaacagtttttttcacttatggaactaatttacaaaaattacgttaaaaatatttttataatggatcctcctgaggagctttaaaagagtgacaataattatactgcaagcaaggcaacatagcatggtggttaaggcgcaggctttgaactcggaacctgagtccaaattttggttctaccattcattacctgtgaatccacgaacaagatacttaaaccctttggttatagtttctttattattggctatctggaaagtacttaggataaagccaggcatagagtaagcacttacaacatgttattattgctgttgttattttaaaactactgggtgataggtttttggcccaaagtgattagatcttcatgcattaaatattattttggtattattatagtcagttatcattattaaataaaaattgcaaaatgagattcaagcatacatataatctcattttgctttttaaacaactgtaaaataactattttttaccacaaattttgatgataaagaatgtaaaatgacaaatgtttatgttttattttgagtgctcttggaagcaatgttaattttagaaatgtttaaatagcacttattttctcccaaccatacatacatttacatagaaattctttcatttgttgccttcaatcagaaccttttaatacccaggacacttgtttcttcacatctttgtcaaaggcatatgaatacacttgataaaaatttaaatacttatagatttaaaagagcagcaaaagactcacaaaattatagaactgaaggaaaagtgacacaaagtatcagaaacacacctccagggctctattatgctaagtaccactactctacaagctagcacagcgaaggaagtcacttcacctagcagaatcagtttctttcatccattacaataaaaacacatttacatcctctacattttgaccctttttctaaatgaagtaaattgtttcagctttatttacatgccacctgagactctcaggctatcagaccaaaagacttactctggctgacttaatgttaacattaagagaagaaacctttttaaagtagagcaactcatttctctcgaaatctatgagttgccaaatgtctaaaattttcccactttgttaaaggtaatcatacaaaccaatttgcctggtttctttcaatgaagcatcaattatttcgctgtaagacccgagctactgtgtatcttaaaacccatgcctcccgatgagtccaagaagaatgacaaagaatcttggaaaaggtattgaacaaagaaagaggcattcattcagtagtccagcagtctggcgtacgtgccccattgtccacgatcagacctgagcagcagggccctctttaggaaggtggctctcaaaaccagtaagaaaagctgcaaagcaggagcttgccgcctgcaccctgactcttaatacttgcacaggcttctgcacctacttgataaatggaaatgctgctcgcttctctcccaagcttgccgggggccctcttgaatgttttttttgactcgttaccaaaaaagcaattggcagtcagctcccagtagacaatgcaatgtgacttgttcattcaaacaacccttaattagcatcccatctcctttctgagatacaatagcttatttttacacactgaatacatttttccctcatttagatgacagaaaaagagaccagataagtgtgggtacttttgaatatgaggtgggggacagctgcaaatgcagttgtttctaagagtacaagttcatgttcaaattattttcctgtacagctttttagggtttctttattgtggtgctaacaatgagataaaagaggcagaaaaggcagggaagaaaaatgctgccttacagataatactgtgaaaccacactaattgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgtgcaaacaagttattatcaaactctgactgaaaagattctggacattaaccagtgctttgtaactggtggtttacagcaaaagtaggatgtaacacaaagcaatgcaaattctttttttttttttttttttttttttttttttttttgtgatggagtctcattctatcactcaggttggagtgcagtggcacaatgtcagcttactgcaacctccacctcccgggttcaagcgattctcccgcctcagcctcccaagtagctgagattacaggtgtgcaccatcacgcccagctaatttttgtatttttagtagagacggggtttcaccatgttggccagactggtcttgaactcctgacctcaggtgatctgcccaccttggcctcccaaagtcctgggattataggcgtgagccactgcgcccggccgccagctcatatttttgtgatcttttttcttcccttgattctccttctggcccccaccaagttagggctatgtgaggaggcggtctagctagttgtttagttgcctgaaaaaaaaaaacctatttttaagttattttctttttagtttctatatatttaaatatcagagatattgctctataagctaaagatctgtatcatcacatagaatgtggctctaagtaaataaaatcttcatacttagcttcatttgggttatattaatacatgagagggatagaatgggtcaggttgtctaaaattattattactatagctacttttattcctggtgctccgatggaatattactgacataggctcagagatttaagtaccttcaccaacatcatatcatttagccccttccacaatcctttgaagtaggtagggtgggtagcaggtattattattatttaaattatttttcagatgaggacatgaaggctcaggtgttttggtaggggaaaattgccttggggggctagaattttccaagaaaatatcactttatgaatgaaactttccatctttgatttccacactgactcttaaccaatgctacttaaccacagcattgaccaatgacctgttccctctgtcaaatatgttgaggcacatgcaaccttgcatagtcttggttcactctcctactgagctcagtacttctgttaccatcttttgatctctgtgttcctcaagttgtttttataccaaaacacctttatggcaggtgtacttattattgaagtccagtaatttaattacatattacagaaatcaataaaatatgaggtttaaaagagaaaagagctttatgagataattgaataagttgcgtaagtttttcactggtgaaaaaagtaaaccagtaaagaaaactacagtcaaatcagggacaggtgagacaatgacagaaatttgtctctaagttaaaaaatctaaatagaaaactgcatttatattgtttcataggcttttctattttctctttcattttaaataaactaaaatggaaaattttgataatatataaacaatgtgattgacataaactatatgatctagaactccatcttcagaccaacactcataagactgaaccccataataaacaaacacatttgaatatgaacaaatgtacatgttttaaaataaaatactttttttatgattctcacattgaccatttttgattaactgtgtgtttttctgttttttttttttttttttttttttttttttttttttttgagacggagtctcgctctgtcactcaggctggagtgcagtggcacgatcttggctcactgcaagctccgcctcccaggttcaccccattctcctgcctcagcctcccgagtagctgggactacaggcgcccgccaccatgcctggctaattttttgtattttttagtagagacggagtttcaccgtgttagccaggatagtctcgatctcctgacgtcgtgatcctcctgccttggcctcccaaagtgctaggattgcaggcatgagccaccgtgcctggctgattaactgtgttaaacaagagggcttctaactatagttggaagtaaagcaggctaatgcagtttaaacataacactgtggattaaacattaaggtgcaaagttagatttggaatatatgcatgcctggaaggacaggagagtaattttgtttgggcgcagtcagcatctgaatttctagccacccttaattgcttggtcagcatacccatcaaccccctggttacccatgaaatgaaattaggctgcctgtcactgctggacagtggtggccaggttgcctctccaccaacatgatggccctaagtcagaggctaggtggccttggtcatgcttgtggtggctttggtctctttgcttcctgttgaatctatcttgaatggattcgtgtttcataagcaaagtcctgcatgagatcctaatttatcttgtgactccaatttatgctcatgaatccagttgaccagcgacagcattcataatatctaattctgatcctccaaaggaaagctgaataccagaaagggactctcttctgcttgcttgctaggttggactcccacaataataccttctctgaccttgtttggatagaccctctggttgtgggacttggtttgctcgtttcttttcattcattttcaaagcatgaatcctttagtctactccacagtgatctgcaaattgaggacgacttctccctcataatcctagtccacactttcaaaattgtccactagtttgaataaacagattcaacgttttttttaaaacctgatcaaaatgtcttgtctatctcctcttccaaaagagaatggttatagatttctaaccttgaatgtaagcaatcatacataccactttctggatgcaatcacttcttgcactgtagactatcctttcccaccataagtggattccaggcagcagcatagtgtaatggtgaggaggaggaagagaaggaagaggaggagaggaggataaggaagaggaggaggaggataaggatgaagaagaggaggaagaggaggaggaggaggagcagcagcagcttgggagtcagctgtttggctttgggcaagttgccttcctgtgcctcagtgttctcatttgtaatggggtttacaaatatgtttactataaagattaattttcaagcacactgttagtgctccataaacagttgttcttcagaagatccaacagtccaatttctgagctttccatgtatatttgttgaaccttctagattaccttttactctactttttaagctaattataaatgatagagaagatatattttcattttatgcatttagaatttaacatggcacacttaacattttcttattagtatcttaccagaataatttattttctcctcaaacatatagtttaataaagtccactttattttaaagtaaaatttacatatctattgagtagccaatctttctatctgaatgaatgcacatctgattttataatgaaatttaaggcaatgtactccattaatgtatacttactacatacccacaaaattaaaaataaaaatttaaataaagaaactcttttgtaaaggcaaacatgggctgtgctcagttgcttagtcaatatttatatttccaaaaaaactttcttggaatgtatttaattaatcaaagacatatatggtagctgcaatttgacttaatgaggtcttaaggtttttgtggacaataaattggaaacaatttaagtacctatcaataaggaaatgattacattttagcacatccacacaatgaaattctagtaatttaacattttgatgaattattaatgacatggagaatactcataatgttaaaagcagaatatacatcataatacaataccctcttttattgtctttacaccaatgctgtaccttctcatgacatctgatctctctcacctgtgcatttctccagagtacccttatttctaactgcttaatagacttaaaagactttaccagccagaagtctccaacatttatcaaacttaacaggttaaagatgaaactgatatcacatccactcaacctcccaaaccagaagtcctgaagtcaagctctcacttactcccattcgatgagaaactaagcactgtggtttctactgctggaacacttaaatatatcttccaaagctattttatatatatatgctatttatatatatatatatacacacaagctatgtgtgtgtgtgtatatatatacgagctatatatatatataagctatatatatacacacaagccatatatatatatgttatacacacacacacacacacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccacaagtgatcctttcaccttggttttctgaagtgctgggattacaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccgtttgcaaagtactgaataagtcaatgggcaaaatggggcttagagtacttaagtcaagtagtttaactcagatgaaagatgcatgtaaatgtagagaaagagtacagctgtgttaaactgagagcagtgtgttaggccaaattatccagtaattccttcacttcatgaaagataggttcagggtcttattgctctttgggaccaaaagtgggttgcttgccttctaatgtcttaattctttatttggctccttataatgttggggcaatgattaagtgcctgggctttggaattaaacaagcctggattgaaatttggactccatcaactcactaactttgaggctctcattctctctgagctttggttttctcatttataatataggaatagtaaaacctactttgtagagttagaggaaaataaactgaatttatgtgtgttcaaattgtgcttagcacatatgatcaataaatggtagtggctagaaaacatcttccactgtgtatgtaatatggtcaacatgtatacctacttcccttcttttctgaaaggggagagaaatgcagtaagtaacttccagaagtagtatgggggctttgtttcgctggaagtgtgcaaaaactacttgccattttggattgctcttgcagttccagctttataggtttaagccactatgtcttctctagcagtggaatttgaacactgtcatttcaatgtttccttctctgaagaggaattccctttctcttgagatttatctaaatgaaggaactcaaacttaccagcaataaaatctctttaattgcaacttaactgttttttcagctatgtatattttcatttttaatttattttcattttataaacattgaggtcatgagaatattggagttattaaataagagatggcaattattcatttatttatttgctagaaagtagaaagttgcatgaaactataaagcctgggaatttctaaagataactccatctccatatgttttttggaggaaatgatttttgtcttttccaaacaatgacgcttaacacaattgaaagttggcacatttttggtaaacagaattttcctggtagtgtgaagtctactgtgtatttcttttgtgccagacttctcagtatcattttgatctgtaaaacatcagcgtttcctgtattgtattatatttacgtctttggagagtctagacagaaatttttattttaaagagtaatgaataataaaaaataacaaaatttttattgtaatatttgggattatgactggctgtagggaaaaaaagcacaaagcagattacacataaaagacatataacataaatgtttgactttgatatccccagaaggtatatctcagacattaaaaaagacaggaggctaaaaattgtaacacgcaaacaaaaatcatttctccaatttctgaattatgtggtcaaagaaaaaaattaaaacttcaaccacccattggtgtaggaattgttaaaaaaaattctagctttccacagatccatttggctctcctgtaaagactgaaatctgagaatggtaacaacaggttatctctgaggacaattactgcacttgagaaagaaagaacaagatacgctttattcccttgcagatactgaatggagagctctgagcatcataggtaaaccaactctgtgtcactctgaaatacatatttgaggctgctgcatgcagttccccggctagctgcagtcattggtgccagtgctcaggcacctgctgtccttgacctctggccccacaagcactaacccagcgcaggaggaccagccaccgccgccaggctctgatgctggtctctggtagaagaaggttgctcacagctctgctgcaggctcagaagtggccctttcaaccctccagagacatgagactagtccagttccaggcaccccacctggtggggcctcacttgggcccagagatggagaatggtggaagggttatcaacctcaatgcctttgactctatgctccccaaaatgatgacacagttcctagagcagggagaggccatcctctcagtggcaagaagagccttgggtgcccagttgccagtcctaccatggttggaagtgacctccctggctccagccacatggccagataaggtggtgtgtgtgggcatgaattatgtggaccactgcaaagaacagaatgtgcccgtgcccacggaaccgatcaacttcagcaagtttgccaactccattgtggagccctatgatgagatggtcctcccatcagagagccaggaggtagactgggaagtggagcagctgtggtcattggaaagaaaggcaagcacatcaaggccacagatgccatggcccatgtggctggcttcactgcggctcataacgtgagtgctcatgactggcaaatgagacatgatgggaaacagtggctgctgggaaaaaccttcaacaccttctaccctctgggccttgccttggtgaccaaggacagtgtagcagatgcacacatcttaaagacctgctgccaagtgaatggggaagtggtccagagcaacaacaccaaccagatggtggtcaagacagaggagcggatagcgtgggtctcccagtttgtcaccttttacccaggggatgtcatcctgactgggacctccccaggtgttggtgtattcaggaaaccttctgtctttctcaagaagggagatgaagtccagtgtgaaattgaagaactaggtgtcatcatcagcaaggtggtgtgatggctcctgcacaggccctggtcataggatgggggcatctgctcccactcagcttagcccagggaaatgtcgaatgccaggtgtgggcaggtgccagccctgtaagcctcctcttctaggtagaagggagaaggatagagctctcttcaataaatacgtcgggccaaagcaaaaaaaaaaaaaaaaaagaaagaaagaaagaaatatatatttgacttatacagcagttctggtacaatgacatccttggtcttggagaaggaggatgagagcaaccgtctgctggggctttggcatattaataattgctcacatcatccctattggatttctttaaaatatgtcacatattacacaccctctaggaaatgtcttctgcctaaccagcaatcttagtttctgtcctgctaaaaccctgattcaagaatgaggtaaagcactaaaggcacattcctgactttttctataagagtgaacacagataaacatacattacaagattcaaagattgaaatgctcaaaagaacaaacaccgtaatgtatcttacacagttattacaatgtattctgtaatccttgtgagatattgtttcacatatcatttgccaagtgttaatccttagtacatatgcaacactaaattgcatgtaataagtaagtaatttttctggggaaaatattatttgttttaaaacatttacatacttatatttacaaatagtttcataaattatggtgctatgttgattttataagattttatttgtaatagaagaagaaatagaaataataagaaatatttaagggcatgaatgcactttgaaataatatttattttatgacaatttactcagaaaattcaaaccaaagtgggcaggggtaaggcattttgctcagatctacgaaatggtgctaaatattgcatgaagttgttcatagtgtcctcttttatttaaatctctgctttaattatagtcatttttaatggttttttttgcatttcctttaattctgctagttttgcctattttattagacttcaaaaaattgacttttgtttacatcaatcctttttaaaaattttttttaaggcagggtctcattttgttggccaggctgaagtgcagagtagcccaatcataactcaccacaacctcaatcttctgggctccagggatccttttgcctcagccttctgagtagctaagacaacaggtgcgcaccaccacccctggctaatttttaaattttttgttgagatataagtctcattacattgtctaggctggtctcaaactcctggcctcaagcaatcttcctgactcagcctcccaaagtgctgggattacagaaatgagccaccatgcctggcctcatcaatccttttatctttgttttatgtttaacatttattcttcattattccttccttttttctctcctgttcattttatagttcttttactaacttaagtctgttgcttagatcacaaattcttttataatatcatattcatgcctataaacttccttctatgagcatttttagcagcatctcacaagatttgatgtgtagtatttgcatcatccctgaattgcaggtaatttacagttatattataaattcattttcatccatgaattgtgtgtgtgttaaaactttttttaagcatcaaagtgtattttttaatcttatctttctgctttttatttctaacttaatgcactgtaatcgaagcatatatgtacagttattcctggaaatttgccaagacttgctatatagtcgtagttggtcacttttcacaaaatctcatgctttgaaaatttatattatgagattattgattggaaggttctatatatctttcttaaactaagcttgctaatttgaataaaggttatgtataaactttttctatatttttattttttgtctgcttaataaatactaatatctgatttttattgggttttctcccagtgtgatggtgatttatcaattccttctttaattctgcccattaatgcttcagatatttggggggaggttatgtatattatgcatttatatatttagaatcttacttgtgaatttcacattttagtgttatagattgacattccttatctctagtaagctctctgataatgattgttttgatttgaaattcattttcatctgacattctttatctctggtaacctctctagtaattattcttttgagaatattcttttgagaattattcttttgagagtcagttttatctaacttgacttttgattagtattagtttggtgtatttttttccatcctttccattttaacatttctgtgtcctcttgtaggcagcatttaactgaatttatttattttatcagtttggtaatctctgatatttaatttgcaagttatttgtttatatttagtatgatttggatttttttctatctcccaattaggtaaaagtttatcctgatttttctatattaccttttgttttcccttttattttggtttattttcgaaattctgtcttttctctcttctaccagattggaaattatacattctaattccatccttttagtggctaatcttaaaatttgaacatgcatatttacctaaaagtctaaccttggcttatatttctcttttcgtgaataacacagaaatattttaactttcctcatcttctcaaattttaaatactatcattatccagtattttagtttcaccttcatattttactttctttgctcactattatttcttgtatttgagtactttttttctggattgaattcttcttcattctgttttatcctcccttgtagttgttttggtaagattttttttggtggtgaattcttaccatttttgttagtttgaaaatgtctttcacacctggccctgtaggatagatttgttgggtataaagttctgggtagtcaagtattttctttcagttctttgtaggtaatattctactgatttttggcttctagttttgctatagaaaagcctttttttttttggttagttactctggtgggagtaattactttctttggtgctttttcagttccagagatgtgtctagctgtgatttacatttacctattcagcctaggatttattgtgctttttagatttttgaactcaagtcttccatcagttttggaaaatccctatctattatttcttcaaatattacttcttttctcatatcctcttctttctccttctaaaacacctgttatggtatattggatatcaaatactatcctctatgtctcttagacactcttttttatttttttgtcattttgatcttctaggtattttccttagctttatatttgaatccattagttattcatttagctgtgtcttgtttgatgctaaacctatctaataagatttttttaaactttaatgtctttataatgtttatttctagtatttgttgttttaaatcttcatagcctttttggatagtaacttgttcctgtgtcaaattttttatgctttttgtgcttaattatttaaaagagtagcctacatttattatttcagttattttaatttatgtgaatctatttaattgttgctgcttctgattttttctcatggtttttattggttgcttgtatgcctcataattttgattgtaggcttatgtttgctgagagttttttaattttattttaattgacacagaattgtacatattcatattaatgtgatacttcagtgcatgtatatatgggttaatgatcaaataaaggcaatcagtatatccatcactgcaaacatttattatttgttgtttgtagtgagaatattcaaaatcctttcttatttctgggctctatgttccatattccattccattggtctatgtatttgttttttttgccaatatcatgttgctttcgatactgtaactttggggtatattttgaagtcaggtagtatgatgcctccagcttttttttttttttgtctcaagaatgatttggctagtcaagatcttttgtcgcttcatacaaattttaggattaaaaatttttttccatgaagaatgttattggtattttgatagggaatgcattgaatctattgattgtttagcgtagtatggacattttaacaatattaattattccactccatgaacacaggatatatttctgtttatttgtgttctctacaatttccttcatcaatgatttatagttttcagtataaaagatatttcacctctttggttagatttatttttaggtatctctatttattggtagcaattgtaaatggaattgttttcttgattttgtttttagctagctcaccattagcatatacaaatgctactgatttttgaatgttaaatctgtatccttgaactttactaaatttgtctattagttctaacaagttttggtgcagtctttagggttttccatatatatgatcatatgatctgcaagcagggatagtttgacgccttcctttccgattttgccttttatttctttctcttgcctgattactctggctaggacccccagtactatgttgaatagaagtggtgaaagtggatatccttatcccagatcttaggagaaaagctttcaacttttccacattcaatatgatgtttgttgtgggcttgtcatatatggactttttagtgttgaggtacatactttctgtatctaatttgttgacagttcttatcatgaagggatgaattttgtcaaattatttttcttcgtctattgaaatgatgatatggattttatccttcattctgttaacgtgatgtatcatatttattagtttgtgtaaactgaaccattcttgcatccctgggatgaattcccttgatcatagcggatgatgtttttaatgtgctattgatttttactaatggtttactaatattttatgagcatttttgcatgtatatcagagtgacctgtagtttcttttttggttgagtccttgtctggtttgggtgctagggtaatgctggccttgtagaatgagtttggatatgttctctcctctttaattttcttgaatagtttgaggagaattggtattctttaaatgtttggtagaattcattggtgaagccatcaggtcctgggttttgtcttcaatgggatacttttttttttgagatggagttgcactctgtcacccaggctggagtacagtggcatgatcttggctcactgcaacctcccagtcccgggttcaagtgattctcctgcctcagcttcccaggtagctgggattataggcacgcaccaccaagcccagctaatttttgtatttttagtagagacagggtttcaccatgttggctgggctggtgtggaactcccaacctcaggtgatctggctgcctcggcctgccaaagtgctggggttacaggcgtgagccacagcacccggccaggataggttctgttactgatttaatttcctcactcattagcgttttcagattttctatttcttcattgttcaatcttggaaggttgcatgtgtccaggaatttattcatttttttttagattatccaatttgttcgtgtagtattgttcaccatagtcttttataattctttgcatttctgtggcatctaaagttttgtcagttttatgttttcaaacatgatcttttctttttattgatgttttgtatttttctgtctgtatttcatttatttctgctttgatctttcttatttacttccttctactaattttgggtttaatttgttcttgtccttttttattttttgagatggagtctctctctctgtctcccaactgcccaagatggagtgcagtggcatgatctcagctcactgcaacctctgtctccttagttcaattgattcttttgcctcagcctcccgagtacctgagattacaggtgtgtaccaccaggcccagttaatttttgtatttttagtagagacagggtttcaccatgttggccaggctggtctcgaactcctgacctcaagtgatctgcctgcctcggcctcccaaagtgctgggattacaagcgtaagccacgctgcccagcctgttcttgtttttctagttccttgaggtgtgtcattaagttatcatctttcacttacatttcaacaaatgtaagcatttattgatataaacttctcttttagaacagctttttctgtattccaaagactttgatatgctgtctttctatttgtctcaaggaatttttaagtgtcccttttaatgtcttcattgatccattggttgtttaggagcatattgtttaattttcattaaacaatatttgtaaagtttctgaatttcttcctgttgttgatttctagttttataacattgtggtcagaaaacatatttaaaatgattttgatcttttaaaatttgttaaggcttgtcttgtgctgttaagaaaaacgtgtattctgcagttgttgggtgaaatattctgtaaatatctgttaggtccaattggtctattgtgtggtttaaatccaatgtttgtttattttctgtctggatgatctgtccattgctgagagtggggtgttgaagttgaagttcatgattattactatatagcagtctatttctttctttaatctaataaataattgctctttatatttgggtactctagtgttaggtgcatacatatttacaatttttttttgttgaattaacccatgtatcattatataatgatcttctttgtgcttttttgtgatttttgatttgaagtctattttatctggtataagtgaagctactcctggtctcttttagtttccatttgcaagtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgacaggtaagaacttactcctgccattttgttaactgttttctagatactttgtttctttcttctacttttattgtttccctttgtgacttggtggttttccatagtgataagctttgattcatttctctttttgatttgtgtatctgctgtaatttttttctttgtggttattctggggcttatgtaaaaagaacttagaatattttaagctgataacaacttaactttggtcacatacaaatattctagactttcccttcccccatccacaattcataatttccttcaggtcattattttaaattccttttcaggcaatttataaatttccatttctttaggggtcagttactggaggattcttctgcttctttgatggtgtcatgtttctttgctttttcatgtatcttgtatccctgtattgatatttgtgcatctgatggaatggtcaactcttttaattttatggagtgacttttgaagggaatgactttcaccagcagatgtgtctgagggtattggttgggtagggtacattggcttttgctctatgtgtgtgcagtagtgtagtctctgcaggtttttaagctgtagtcaactttattgataacctctgaaggccttggtgtggctagtttgctggctcaggacaggtcacccctggaaacagcacacttggctggtgagcacaagaacaaatccactggttaaggtggggacccgctgtgagatgcatacatggctggtgagcatgcagcagccagtctgccagcttgggttagggattctctgggggcagtgtacttggctggcaagcatggggcttggcttgccaactcagagcagaagtcccctgaaaatgacatgcccagctggtgagcttactggtggtatatgcggacaggtctgccagctcaggttggggcatccttagaagtagtgcacccaactgttgagtgcaccagggacatgcaggggctggtccactggtttgggtgggactcgctttggaatggtgcattcgctggtgagcatgctgactgctcatgaggccagtttggacttggtttctctgctgatcaagattgtctgttcctttgagggcaaggtgctatatgggcttcatggatggggcactggatctaggctctgagagacagggttcagggtgctgcagtcactaggatgtgaaaggtggaacacctcctaggagcttgttcccagggggtagggagctgtagcaactcagcaagggaatggtgtactactgtgtgtgaaggtagtgtaatggcagtgtagccttaggaatgaaaagagatggtggctactggcccctggaacaggatgtactctagttgtggctctggtttcaaaatggcatcatatagctgcagcttgaatcacagggatgaggggatacaatgtgggctccttctctggggcattgcagccatgtggctgtcaggcagctccctaaactggactcagggtctgtagaaactgcaggattctcagcaacaaagagtgcagatgtctgtgacattaatgggggctgctggggcctcttgcttgcctagtccccactggggatgcatctccttgttctgagctaatactggctggggagatggcggtgtggcagaggcagagtgcttcattctcttctctatgtgaccctcactaaaggtctccttgtctcacaggatttctgtctctctcctactgtattccagtgtgctccctcaaacactccagttcaaacatactttcttatttgttgttttggctcttttttttggtgggaagtatgagcattcggcttctctagtcggctctcttgctttgccctggctgggcttttctatggaaatctgtgaggtatatgctgagagtatgtgcatcagaaagtttttgccttcgtttctgtaaagtatcatagggcgttaccaacctagtattactttttatgttaatgacttcacttggtgtttcttgatttttgaattctgtgatttctcagctttaaatactcaagagagccttttcgtttataccataagaaggccagacttaggcgaatttcttagcatcatcctatattagtaggcagatttatttttgttgttcactttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgttgttcacttttttactggaggtgttacctttgaaggtgctcactttatgtaaggtctcagttccaacacctggctcctgcaagatcaggctttgtctccagttcttgtattaccattacaatatgtttaattttctggttttatgccttttagtctctttttattaagcactgggatttcctttactttttttcaaagctcttctttgcatgctgtttcatattctgcacagtgtaactggttttgtagtgagaggtttttcaggttatctagtctgctgtattacataagttctatgtaggaatgcacaaatgtacacatacagagaatacacctcttaaacttgaaaaatcttttctatcataaaaatgtcatgcatattaaacaactgtgaaggaattgtcagtggcttaatatgttgatagattgacactgtgtgggaaacagctgagaatattaggggttatttttataatgccacctcaggctttaatatcagattcatagaagtgtgtttagttagtaagccatgtagtgaattgagtatataaccttatctactggccaaaaatatgctatttttccagaatatagtgtgtttagttagtaagccatgtagtgaattgagtatataaccttatctactggccaaaaatatgctatttttccagaatatagttcaggaaaaaaagttttatctattgtagcaaaaatataagaaaatcacaaactttaaaacacatataaattgctgttttgtgagcctagatgatgtccattagcagcaggattatgctgtactcaaggattataatcaccaaaggcttataaaggaatgcttagttttcttaaattcttactgtcatggtgaagctctggtacaatatttttgacaagaaaacaaacactgaaatgctgattaaaattagactgtaaataatcccagtaagttgtcctaaaatgaaagcggtacctcggatatcagccctcaggaatattacaattgtatttttataatgcaaaatacagaataagtattctgcaagctaaatccttagaaaagactactagtatggaaatgaaatcaaattctgtctttcttggatttcttattatgaagatattgagaaagttgattggtttctgtaactgtcctcaaatctcgttttcttaatgaggctcaccttgcccaccctctttgcattattaaatgtaatctgcaattccccatcaccccctccttactgcctggtatacccattccacttagcctgctctactttctttcctatagcatttaatctcttctcatatattacactatttataagtttattatgtgtagtgttgtttgtctgtcttctcccactagaaagttaaaatctaccaagggcagggatcttggtgtgttttgtttactattgtatccccaatgactacagtagtacctgtcacatagtaggtgttcaaaaatgacttgggtgtgaatgaataaggttttatttatctgcttataaattagggtgataattcatggccccttatttcttttgtgggtacaaattagatatgtatatgccaagtatattgacttgtctgaaagaaagttgacattcataggataatagcacttattatatttgggatgtattaagtgacttagcctttaaatgtctcagagtttccatcttaaatctaagtccatggcaattttactaacacagtatctcttctatagcaacagaacacatataacattcagaacttgattaaagatcatacctcatttttttctttgagttttgtgatcataacaatcacagggctgtcttcctgccaaaccatctgccagaaatcatccacggtgttgatcatggggccctgcgtggcaatgaaggctttctccttgccactgtagccctagatggagtaaagaaacaaaaatattggtttttaagttcatgccttgcagtgaaagtgtaggtgaaagatcttcaacgaaatagctgggctagtacaaaagcaacacaggttacggcttcactgactctagtacaacaatttccatgggtattttggcagcaagttaaggatagcacatggtactgagggttgtaatgcccagtccccagcagagtacccatatagagcactgttgccagagactcacagtgaaaggaaagtcatcataaaagacccattaacaatgttgattatgactaagataaaaaaccaaacaaaatgaaatcttgctggtaatcaagttaaaccaagcttaatctactctaggaaaaagaaaataaaaccaacaattccaaataggaagtcaccagaaagaaatttgtacttatttacttaccctaatataattagcattaatgtaggtgctcaatgaatcggttacattttttggtcttaaacacactctgctgaggggatctaatgaagaaaacaaaaaagaatatattaaacagatttaccctttttaaagttccttagaatgccaataaccagtaagtagaaacctgttatgtattgattatctggtgcatgtcaatgtttgtctttggtgtccattgcttgatccatatgtttattgagggacatttgggcctgtcttcactcctgacataaagctcatccataagcctaagctgatgagtttatatttcaggccatttctcatctgttccggttctcgacctcatttctcatttttgcgcccactcttatacttttgatctggaatttgtaccaggtctcctcactcccatctctctcctttccctatggaggtaaatcaggctatactctaccaattatttatattttactatctcatctcatttagaccctcaggtctgaacctcaccttgtctgaccattatgtcctggccagatctcctgatcttccgagatggatgagattaataatctattacgtgctatctgtgtgaggataggcaagccaggggaagagggaggttgcaaagataaagataaacatgattcatttcgaggctgggcacagtggcttacactgtaatctcagcactttgggaggctgaggcaggaggatcccttgagcctggggcttcaagcctaggcaacatagtgagacttcatctcaaaaaaaaaaaaaaaaaaaaaaaaaaattagccaggcatggtggcttatgtctgtggttccagctacttgggaggctgaggcatgagaattgcttgaacccgaaaggccaaggttgcagtgagctgagattgtgccactgcactccagcctggacaacagagggagagcctgtctcaaaaacaaaaacgaaacaaaacaaaacaaaacaaaaaactatgattcatttcagtgagttttcagtctgctcataaaataacaaacaacatacatttattgtttattagatgtcagagtctgttctcattgctttacagatattatatcatttaattttcttgtaactttaataaaagtacctaagataatgggtaagactccttccccatttttcagataggaaactaagataggttaaataatttgcccaaaggtacacagccaagaagtaggtaatggagtcaggctttgaatccacacgaacactagggtaccattagccactacgctgtgctgcagctctcatgcgaagatagctatgtaagctgacgattaaaatacaaaatgttatatcctagtggttgcttagttactttcttaaaaaacagcaaattcaatgcttttcagcttcctttctcagtggagtgtggtgtaaaaacaggggtgcagcaaagaaaaacttctcccattcccatatttttttagtaacacactatcattgaacatcttctgggtaaacacaatctcttacgttccccacgaaaactgagacaaagaggaggtgaggtaggaagtactagacgaagaaagtttcatagaatatatttaaatgggagctaaaaataattaaaaatttaacaggacttggcaagccaacatttgttttaaatttcactttatatataactggggttaaagataataaaggccataattagtttcagaaaaaggctaaccagcccatgaggacggtgatggtttaaaaatgtagtcatccaattatctgacactccttctaaaagaatgtagtagagactaattcctctcatcttgaatgtgggcagaaattaaatagaatatggcagtagggatggtgtgtgacttggtcataaaaggtattacagtttcctccttgcgctctttcttgagttgcttgctctggaggaagctaatggccatattttgagggcactcaagcagcccaatgaagagagaaatagtggggaactgaggcctccagctgatagcatatgaatgagccctcttagaagcagatccctcagtgccagccaagtgttcagctgaccaaaggcttggccaacaactcaattgaaatctcatgaaagaccttgagccagacactcaactaagccactccccaattcccggcacacagaaattgtgagatataaatgtgtattgttttaagccactaaattttggggtaatttgttccatagcaataaataggtaatatagggaccaataaggagtcagtcacaaaactctggagtgatatcatgatcactgttattgtcattgcactcattgttgactcctatatgtgtcaggtagagcaggtaacagcattttattcattaggtcacttaattattacaattctataacgtacatactgttaacagtctctttatttagattaggaaattgcagcacagagaggttaagtaactcacccaaggtcacacagtaagaaatgaagcagagagttgaaaccagattaccaaacttagaatttaacaaggccattatcaaagatgatgttgaaaatatatagtaaaattttgctaatttgtcactaggatatttgaaataaagatattttatatatatgttatatatataaataaaacaagtaataggagcttctatccaaggatggataaagtagatttgagctataagggatctggctttggcaggagaaagtcccattctgcttaaagctttagattgacttgtgaagaccaagatgcttatctgatcttataggccacaggtaaaatagctcctgatcatgccatatggaagcaatgtctagaagatgttaataaattctggaaatcagtgggaagacccttaggtggcatccaagaatcctgttgatcgaggcaggctttcattcagtttgaaccaaaacactttgcaaaagatcctagcatgtccttttgggtgacctaaaggaagtagggtgactacagagaaacttacagtggaacaggtaaggactgttcgaatcaggatataacctaactgtgaacaaggaattgtggtcctatgctcatcagcatggaaatctcttgagacatgggctttgaacttatcaaaattcctcctcaagagatatgttggggctactggtactgaagcaaactaccctctttaaagcattctggaaataagtccaatctcagtcttgtccttcagagctttcaaaatgtagaccctatggagatggaagctagcaccaaactttcaaaagcacttcattttcccccaaatctcatacagtcttaacagatctatctctacatttcctacaattgttggtcaggggcagactgaccctcacttgcatgagccattttcaataagaaccttgtatcttattttgtattcataatgttgtattcattttttaagagtgtcttccagggcaaagttccatgacattgatgtgggcaaaaatttcttggatatgaccctgaaagcacaatgaaagcaaaaatagacacaggggattgcatcaaactaaaaagcttctgcacagcaaatccacagattgggagaaaatatttataaatcataccttaagaaggggctaatatccaaaatatatcagaaactcaaactactcaataacaagaaaataatcgtattagaaaagggataaagatttgaatagacatttctaaaaacaagacatgcaaatgtccaacagatctacgaaaaaatgttccacatctcaaatcatcagagaaatgcaaattaaaaccacagtatcacttcatacctgttagaagggctattatcaaaaagataaaagataaatgttggcaaggttgtgaagaaaagggagctctggtaggctgttggtgagaatgtaaattagcatagccattttggaaaacagtatggagattcctcaaaaactatgaatgaactaccatatgatccagcaattccacttctgagtatatatccaaaggaactgaagtcagtatgttgaaggcatttctgcactcctatgttcttgcagcactatttacaatagccaaggtttgaaaacaactggagtgtccatcaacagatgaatggattttaaaagtatggtctatatacataatggagttctatctggcctttaaaaagcaggaaattctgtcatttgtgacaacatagatagacttcacagatattatgctaaatgaaataagccaggcacagagagacatgatcttctttatgtgtggaatctaaaaaagttgaactcatagaaatagagagtagaatggtggttaccaaaggctaggtgggtgggtgaatggggaaaggggagatggtggtcaaaggatacaaaatttcagttaggagaaataggttctggcgatctattatagaccatggtgactattgtttaataataatattatatatttcaaaatagctgaaataatgggattttaaatgttctcaccacaaaaaataaataaatatttgaggtaatggatacattaatattagcatgatatgatcattccacaatgtatacatgtatcaaaacatcacattttaccccataaatatatacaactgttattttcaattaaaaataaaataaaacctaaagagtaatctccaaataatataagctttagctcccctcccttccaaaaaactaaatctacccttgttggtaaaacctctcagtctgcataaaatctattacaccctttgtaatgtagaaagacttctgctagactgctttttgttaccttatctttttcctccaaggggtcttgaacacctgtggagctgaattttaacattgagagtgaaattattccattgtttatacgtatcttccgtcaatcctattgatcaaaactcttggcagatcacaaaataacaaacaaggaggagaagccacagtggagcaaacaacatttattgcacactctccaccaagaatctcatggaggaggttccctgctgggagcctttggctatacagcgccctaaaagcttcttgccaagcatgctccgtgctgtctggcatttttgctgtcaatagctggagcacacaatagtacgcatatccaaatatgtactttaagagctagtcgtctcctagtagtcaccatccctgtctttctttagcaataagatcccaattctggctgagaacttggtaggatgcacagcttaagacttcccttcttaccaccccttgcattagttgcggccatgtgactaagttttcacttatagcaggtgagaggaagtgatgcgcgtgacttttagatcatgaaattaaagtgaggagtgatgttcttcttctaccacttctgattccatcttgctgcctgggatgtggtcatggtgatcaggatcttagaccatgcaaaggtaataccctagggatggcgaggtaaccagagagattagtctggaggtataacatggcaaagctgccatatcaaccctggcaggtatacttgagagggaaaaacacttttaaattatttaaaccactgttatttgggttgtggttaatagtatatataagttttctggcaaaaatatttcagaaaagaatagtattatcacaaaatcagttctgcctagggaggcattaatagaataggtacatcccaaacatctggggtttgtatatattcagaagtcaaattcagggtttcttagagttggagttcgcatgtccaataattatcacgatctataaaaaataacgttttagcaacataacaaaaggtaatcatcattttagtctaaaactaagccctcaggccccataacattgccattagaatgcacgcagtgattagttcagtctggatagccctaaattgcttattgcactgatttcctttcttctgacctacaacaaacacatggcctggacagaagtctttttcactatttggaagaagctgtctttagttagcatatgtagcggtttgttcactgacagcacaagtatctgatattggttagattcgtttagtgctagcaacattgtcttaaattctaaaatcactttccatcaagagttgaaagactctttgtggactaaagtgttacggaaaatgtggaaattatttttaccatcatttgcatacattaatattactaattcgtctctttatgatttctttgacctggtacactctgagctttttgaaggcagggatggggatttttcaccatctttataagatctaatgtcttgcatagcagaccttcagtgaatgtctactgcactgatttaaagatctcttctattttttaaaaaaaggtcagttctatatatccttctctagcaattattctattgcttttcttttttagacaggcaaacttctgaaagagtttattatacacacacttcctccatgctcatctgcaactcaatcctcctcatgtacactgtgatctatcctaaccctagcactgtgcagagactgcccttgctaaggtcaccactgaccctcttgttgttaagcccagtgatcccattgtggtatttttgttcatgtcctctctgaagcattcaaaaactgttgactgtatatccttttttcgagttttctcttcccttagattctgggacacaacgttctggttttcctgctcccttttcggtggcctctttccaatctcctgctcatttaatctgccccttttcatgttgctaattctaggattcaacttgaccctcttttatcctcacttgatactgccttgttgagtgactcattcattcctgtgactttattacgcacatcctgagggctctcaaatacatacttcagaccagcccggtctcctcatttatagtccagctttttctatttattatttccttctgaatggaccacaggtttgtgaaactcctcatgcccttcatgtgttcctgacagctttctgctattgtttaggttaggtgtgctgccacagctctacagtccgtgtagagtttctgtgcatttgaatgttagcatattctgcctgttctgtctcctaaaatacgctggggtctgtcttgcctctctgtttgcatggctgtcttcttggactaggactcaagtatctcctggtctccctgccttcaatcttgcttttttccaatccatcctcctcatagctgtcaaggtgctctgtaaaacaaaatctgatcacatgattccattgtctaaatgtcatccatacttcccaattgcccatagcagtatttcccaaaatatttattacctgtaaatcattacctctataacatatagaattatactatatgacttataaattaagtcatcttttacaaaaagaggttagtacccaaataaatatgggaaacattgggttaaacaaatctgaaccatattctttttactgcaggacttctcagggtcttcagtatgttaatggaccctgtgaatttccaagaaggtattgtatataatcctatttgtccgttggactcaattttattatacctactgtatttacatacttaactattatatttatatacttattgataattcagtttagagcagccctgatcaatagaattttctgaggtgatgaaaatattatctatctgtgctgtccaaaaaatgtagcctctagctttcaagcacttgaaatgtggctagtaaaaactgagaaactaaagttttaattttatttaattttaattcatttaagtgtaaactgacctagccataagtgggttctggttgctctacttgacagtgcaggcctagaagatgaatgccaagaggggtacttagcaagatagagcagatccttaatgatcatcccaaggcctcaccaacagctgctttcccacgtgtatcatataatctagccccatggacctagggcaatctcccaaatgttctatgtttttgcagattttatgcttttgcacatattgtttcctttgccttctctgcatggtaaagtcttcctcattactcagggctcaattcagaaaatactgtctttctgaagttctccctgaccttcccaggcagaattaggcattctcttctttgcttgggtcccctgagttttattttagtatttatcatcttgtattttaagtgcttaaatttctgcctgccctcaatggagtgtggtgagcccctagagggcaaaggctgtatttaattcacttttgtatcctttgtgatttctatttgggatgtggctcacagagggtttaatgtcagaattaatttctatgagaaagagttaaagccctgtttttgactttctagatatttttttcttttcttagcaaagaggacaagaaatctttcatgcctttcagtatccactgattgttagaagtttccataaacatcctacaccattcaggcttgaaaagaggcctgcttccttcagtttttataatgcctatgatgtatatgatttactggtaaagctaaaaactgcttagaaacagtttccctgtaaagctaaattatgttggtaattagtaacttacagtattttccaagtatttagaagtttccaaatcctttttattaaaaattcagagaggggagtctcactttgttgcccaggctgaattgcagtggctactcccagatgtgatcacagctcactgcgacctcaacctcccgggctcaagtgatcctcctgcctcagcctcccaagtagctgggaccacacatgtgcaccaccatgcctggctacattttgtattttttggtagagatgaggttttgccatgttgcccaggctagtaattaaactttttttgtgtgtgtggaaatggggtcttattatattgcccaggctggtctcaaactccaggacatgagccactgtgtgtggctccaactacttccttttacaaatgcaagaatacaacatataactgagtatggggaaatgtaggtttccaagaaaaactcttgtaatatatagcttgtactaaaaaaaaaagccaagaattaaacaaaaaatgtataatcatcatcgttttcatcactactgttataaatgaatgaaaatggggctcttgagtactttgcttttaaaactgtaaacttctctatacatagatggtacccctatttcctggaattggttctgaggttagaaatggattcatcttcagttagatagggagggaaagagaaactaacattagctgagggcttactattagttggaactttgacagacattttacacatactatcatttaattttctcggtagccttgtaggagagtattgttatcactacttttgggaataaaggatggcatagggagattaaatatcctgccaaaaattataaatgtttttgttggggtaggaaatcaaatctaattccagtatcttgctttagctacataacttgttgctttaatgagtggttcacttatttgcatatctactctgtgctaggtactttatataataaaaaaggaaacataatttaagtaggaaacattattagatgttaaaattttaaatataaaatgatgacctgagtaaatggcattctttaagtgtatctatattatcttatatttgtatcaacacactgcataaaagaaatatgcatacaatttattattatagtgcagcactattcacaataacaaagacatggaaacaacctagatgcccatcaacagtggattggataaagaaaatgtggtacacatacaccatggaacaccatgaagtcataaaaaagaacaaaatcatgtcctttgcagcaacatggatgcagctggaggccattattctaagcaaattaacacaggaacagaaaaccaaatattgcatgttctcacttataagtgagagctaaattctggatacacatagacataaagatgaaaacaatagtaactgggactccaaaaaaagggagggagggaaagggagaagggctgaaaatcttcctattgggtactatgttcactctctgggtgtcatgccgtcagaagaagcccaaacggcagcatcacacaatatacccttgtaacaaacctgcacaggtaccccctgaatctaaagtaaaaataaaaaatttaaacttattattacagtattttattgtgtgctaataattttctattgatgtatgattattattacagtattatattttattgtctgctaataattttctattgatgtatgattgttttttcctactacttttgtgatttaggatgtagacatatttttatcactaatatttgtttacactgcaaaataatttgatataaacttgactttagcattttaatctcagccaagataacactgtcattagagaaatgactataatttaatttataattataaattgatttattcataattgattcttgcctatccatatatctgttgcaaggcattctcagaattgtataatgttgctattatgtacaagctgtcaagcttttagaactaagaagagtttagtgtaggttaaaactaaaaacaatcataatgtttaaattcttgatcatttaataatcatcattttatgtaatatttcaagtttatctcatattacagtctaaaaccataaagaacatctttgtgtattcattccaggctttttggatgctttcacccaatagtgtggcttttctaagctatatttcctaaattatattttgtgcaacagagggtggtgggtggggcattcagcctgcagacattttcaacagaaaatccatcatttgcaacatcagctgtcagcacaggtgccctgaatccagcggtccacccagttctgtgaacggaaaaactgacacaggactatgaagcagttgtctgatatcatctgggcaggaaatggagaaggctgaactttgaactaatgctaataatttccaaatccttctaaaattagatgatggtttgggtatatataattgtgatggaggtatattcccttattacttatgtttggtatattttagataaaaatttaacagagagagagagagggagagagaaaacacaaattctaacacgcagcactttcatcccctttggccaagtatagtcataaaataaccttcaatggtgactctaccttaggtaaataaatttaactatatagagcagttaaaaatatgttatagtttaacaatgtatttccaattccaccagaaggggaaggccaaagatagtattaacagtaattgtttaattactttattacatcaccattactatgaatataaagaatttggtgtcttatgaatgaattaatgaactaaattatgaagattgctatttcaatgtcaaaagttaaaaagactttgtggctccatctttcctgagctttgtcgtgagatgtttactgattttgccaaaactccaactatatctgtttgtttagtcatagaaaatattacttcctctccatttttttttttttgcctaatttctctggacagaattaattactcagtcctctctgaactcctacactgcttgggcagtatctttattctggcctatgcactgagcataattaccatttatatgactctcgtttctagtctgtgacctccttgattttatagactgtttcttatttcttactggtccctggcattcaggtcattgcttgacgttaataaattccatgaagctcaatctagtttcacatatagtagtggttctcaaagtggatcctggtttcatctggattggaatcacctaggtgtttgctaaaagtagttttctgtgctcaacagcagatctacttaaacaaaatccctggggttgggcacaggactaacaaggactccaggtcattgtcatgcacagcaacatttttttggtaatagttttattgagaaataattcacattccatacaatccccccatttcatgtgccatcacagcatttttttttaaattttcacagagctgtgcaacaatcactgtaaatcaattttataacattcaattagccccaaaataaatacaggtcctttagcagtcattctccatatcccctaatgctaagcaaccactaagatattttctgtctgtatagatttagctatctggacatttcatataaatggactacaaaatatgaggtcttttgtgcctggcttctttcacttagcatgatgttttcaaggttcattcaaggttcatcagtgccttgttcctttttattgattctattgtgtgactatactacattttatctatccatttctcagctgatggttgccactctttggctattatgaataatgctgttataaatatttttgtatcatttttgtgtgaacacatttcatttcttttaggtaatatttacctagaagtagagtgtccaggtcatatagcaactcagttttatcttttaaggaactgccaaactgttttcctaagtagctgtagctgtacttaaaactgtagtgttaagtttccaattctctacatccttgccagcattttttattgtctatttttaaaattatagttatcctcatggatataaagtactatcttgctgtagttttgatttcactgatggctagtgatgttaaacatcttttaatatgcttgttggtcatttgtacatcttctagggagaaatatccattgaaatcttttgtccattttttgggttgtttgtgtttctattattgagttgtaagatttgcgtattgtagctacatgtcccttattagatacatgatttgcaaatatttattttcttccattctatgagttgtcttttcacttccttgaaggtatcctttgaagcacaaaatttttagtattaatgaagttcaatttttttttgctgctgtttgtgcttttgttggcttatctaagaaaccactgactaattcaaggtcataaagatttacagctgttttcgtttatgagttttgtagttctagctcttatgtgtaggtctctggtccattttgagtcaatttttgtcttcaacttcatttttttgcatgtggatatctggttgtttctgctccatttgttgaaaagactctctttttcccattgaattgtttgacccttgacaaaaatcaggtagccataatgtgtggcacaacaaaattttagaatatgtgtctattggaattgtgacctggacattataataagagtaaaaaggtaaaatcattaacttcagatagttttaatgattattagtcttgacatgtgtttgtaattccaaatttgatatgaagtgggtgttgtaagaattggaaatgctgaggtaagggttaatgggaagacttgtcttgtgctttacaatgtaaattattattattatttatactttaagttctgggatacatgtgcagaatgtgcaggtttgttacataggtatacatgtgccattgtggtttgcttttgctgcatccatcaacccatcatctacattaggtatttctcctaatggctatccctccccttgccccccatacaatgcaaattataaaatcaagaagcttacttggtaaaatggtcttatagcgatttttagttccatgacgcggaatatcaatttctttgggatccacaaagttcattggtatttcctgcaaaaataaataatatcaaattagtgtatctaatactgccacaaagaaaatcttcacaggggggcatctgatccagagttctattggacttcaaagccacttaaaaacaacagatctagcacctctggtggaccaacacccttcctttcctaaacatatcagctgcatccggacaagctgacttctaagaaacagctctgtgtgttagaaaatattgcttaatatgtagtcagtaaggagacatataacactggttagattttaagaatcctgctgtgacataattgctagaaagattagacagatgctaaaaagtgaatttttttaaaaaacaatgtattcaaatatattccagtttttacataactttagtaccaaaaattttactataatagattatcttttcacactaatagtgactcttttaggattattaaaacctctttcccaaaatggtaaatataaagggcttttttgttaattcaagtgatgacatgacttttttttgaattaagaaatggtttataactggactgttccattttaagttataaatgcactgtttttagtgaagggcattcaaacactgtttctcccacttaagaacattactattcttattttatcagagtatacattatatgcctcaagtgattggacagggaacaataggaaaagagtggctgtatgtaagtgcattagatctaaaaaggtgtgtatctgtagctaaccaggacaaataaagcaacaagccaaagttttcaaaagggtccaaacaaacatttgtttaaagatttgattatacaaaatagtatgttctctaactttgataagattaacatgaacaaaataacttttatgttatttaatgactgataaacattaaatatttgatcaaataagatatttttactacttaaactttctccagtagaaaatttaacttaacagtctaatattgattgaaatagaagaaatcatctttaaattcattcaaattatcctagttttcagtcattctgaaaatttgagaaaagctggactatactatgaatttgaggcttgttctacagagagaaacagctattcgtttattaattaatttatttttagagatgggatctcactctgtcacctaggtcagtgtgcagtggcacaatcatagctcactgtaacctcaaactcctgggctcaaggcatcctcccatctcagcttcctgagtagctgggattacaagcatgagccacaacacctggccccaagttacttatttttaaaataatttttcctttacctgcattatgctagctatccatgatatttatccctattctctgctccaactaaatgttttaacctgtttgttccaagttataaaaataagcaaaattgttgaatattcaatggaaaacacatgttcatgtttggtaatttcaagcacgtcagtgtctttgggcaaagccacaaaggtaatatctttattcctccccttcttccttctcaccttctgttttctgacacacactgacagtctgtcatcttccagcattctctttctcctgtgtactccttctggccttcaatttcctttcaggaaagtgggctatggtaaggtcttatttcataaacaaagagctgtctgcagttctagaaaaaaaaagctctaggtgtgcctttggctagctgtgtgaccactgacttgttctttcattcctacaggtctcattttcttcacatgtaaaatatgatacaccacagagtctgattttcatgtttgtattttactttggacacttaataatagttgatggggctaatagtagatccaacccattgctgaatctgtcaccattaggatggctgcaaatgcctgaactaataatcaatttattgtactcaaccaatacggcttaagatgcaagaggtgatcaacaaagtcaatattctccttgggcaacaattagacctaagaaggtttaatcttacttcatgttctctgagttgatgtatgttatcatgctttaagctttcactagcaacactggtatgtctaaaactgaattcatcattctttttagcccacacttggtcttcctcctgtgttccttatttcgttaaagggcaccatatgcaccctgttggccaaaccaaaaacacgaatatcaatccctgacttttccattacttttggctgcctcattcaattaatcccacttcttgtagattcctacagattctttccattttcccttctactatattagtttaggccaccaacgcagttccacaggattaacactagagcctctaaactgctcccttttagtgcctactccactgcaaatagaatgatctatccaaaacataagataaagtccaagctcctaaacatatattaaggctagggtttcttttatacttctgaggctcaacttttgccacttcccaccttgatttcaatgttccagttaaactgaacagtttaattccccagacagtgacagcaaggctattctttgtcctggaatgccccttctctgcccagctccctataccacttatttgcctcaccaattcttgcatattctgccttaatttagctctacattccaattttaatacttatcaatagtggatgagactgagtgaatctaaaaccatttcactttgccatttgtttactgtagactgcttaagtataggacagtatcatttccatacgtctctagtgccccatgtatcaaaataccgactgaagagtgaacaataaatagaaggctcaccatgaattcactttggagtaaatgtgaacttgccacgacgtccctcagctgagaccttgtgagaattcggctggctgactgcagatactccattgctaccttctcccgtggtgttggtatagacacaaagggttcaatgttccccaagctactcatgtccaatgtaagagatacgttggaccctcttctacattggagaagaatgttatgtttaaacaccacatacttattttgattgcaaaaacttgtctttctgtacatgcacacaattcagtgagaacttttacagaaataacaaccaactatattttctcttttagtatcatggttggccatagcaactacccatagttccttcacaggaaaataacaattttgttgttggaaagaactctaaattgagaaaatatgctataatttatgaatgcatatacttattacagaaatcataggttggctaataatattaagtgaaaaattaagtaaaaaaaaattaggaaaagctatatctatatctatatcttctgagtgaatccctaaaaaatggcttctggggccagatgaggtagttcatgactgcaatcccagcactttgggaggctgaggtgggtggattgcctgagttcaggagttcaagaccaacctgggcaacatggtaaaaccctgtctctacaaaacatacaaaaagtagctggatgtggtgacccacacttgtagtctcagctactagggaggctgaggtgagagaatcatttgagcccggggggttgaggctgcagtgagccgtgatggtgccactgtactccagcctgggcagcagagagagaccttggctctaaaataaataaataaaacaatagataaaaataaaaaaagatggcttctgtatcctctatttatgtgtatatgtatgcacgcatatgtgaattgacacacgaattcatttaattttgtggtaaacttataaggggccatagaaatcacagacccttaaaatgagttacaatttatcttcctctcataattccccttttcccgctggggggcaaggggatgctcttacaacttacacagaccctgagtcctgagtaggaagtgaggatgccttttacaagtaatattagctgtgtggaccaaggggtaactatgaaatagcatgtgagagactgaggattgaagtcagagatggtgtttacaaaaactgttacatttaaaggggccgtaggtgtgtgtcagatcaaatatagtgccaagcagttggcggctcaaggaagtagagagcagggaaaaacaggccaaaatatgtgagagtaaagacagtaagagtagatgctaggcccagcaaattattccctctggtattttaatacttactctggaatgcgacattaagaaatattacagtggcttgagcttaatttcaaacagtggaaaattattggaatatacaacaacaacaacaaaatccattaacgaaaatctatcagttttcttctctgatgaatctgcctctggttgcatttttgttgtcattctataatttgatatgtaatgtcatttttgttaatttctaaatggtttgtaattgagattttaatttctactttaatttgatggatatctgtaagtttagacatttattttccttataatttctagttatagttgtggaaattagagaatggctggccttttaatggttgaaactacttgattttttttcgagataaacactacatcattttctaaatatttcacagatgttttgctggcatctagtttgattatctgtatatgttcataagtatctatctgcacatatatacatatatatcaccttatttattataccattattttattgaagatattactttattccaacctattctttccttcctttttttttttctactggatttgtcaaagcctgagatatgtatgtgagtcttccacaataattatgcttgttatttttccttctaacagtttttaccttgtacattgcagccattgtgttatttgaagggatttagtcatatcttcactataaatgttaccaatattactttctttcctgttaattttatatttgccctcacatctggctttaaaaaatgaatattgatatgcctatatgttttggggggtatgtttctgaaaactttttctcatcctattattcttcttaactcttttggatcactgggttagggattagggaatagcatttattctagatgctcataaaatcctgcctacctaatagagggatatttttcccactccactttttcttatttggtttttggtggtggttgatagggttcctgtgcttctgagtaggaggcaaatagttgaagaagagcaaagaatggttctactcatggaccaagaatttaatctatttttagtgggaaagtagtttttaaagtttttcagttcagttctggacttcaaattgatagaaaatccttacggattctgataatagtttgccgattggtcttaatatttagggcatttgtgagaattcagcttttgcaagctttatagatattttagtatgaaggtgagagaggccgcttaagggatggctagtcctatgccctttaaaatcaccatgccattcagtcaaattttcagcctcaagagacaaaattgtctgccctctgtcaatggagtgatgcttgtgctatagatggtgagatctcttccatctggagtggtcagagcagattcatgaggtagaagtcatttaagttgggctttgaaagcaaacgtttaataggtgagtttttggtctagagttaaagaatctggtaggaaaaaaagtgtaggagaataaattaatacaactttgaagaacagcatagaagcagtttgagctagagttctcttgtataaaaatgtattttgaaattggggagcaggcttatgtaagagagatgagagagaagcaacagtcatagacactataagactataaaaagcccaaaaatagtccagggatgttggctgacatctgtaatcccagcactttgggagactgaggcaggaggatcacttgaggccaggagtttgagactggcttgggcaacatagcaagaccctgtctctacaaaaaataaaatagctaagtgttgtggtgcttgcctgtagtctcagctattcgggaggatgaggccggaagattgcttgagcccaggagttcgaggctgcagtgaggtaagattgcaccactgtcgtactccaggttgggtgacagagtgagaccccatgtcaaaaataaataaataaataaatacataaataacgaaaaaaaaagccagataaaagaggatccagaacatcatcagggtgtattaatttctgttttgacttcccacagtatacgctgcctaaacctgggagattagaagcctttgacatcccgtgtctaaggtctatttgatttaatgagttaattttctaaggattctgtggtaagcagagagctgtggaagcattttcatgctaactgacttaaataataaccatttatatattacagtcagaaagacatttcaaaaacaagataaacatataaacttatgggaaaattctaattaagacgtataaaaaaattgacagaatttagaaaaaaaatcaacataaataataggagaactatacctttaataaaaaaggaatgtggaaagcaagaaaacgaactctactgaaagctttacttttattttgtcttggaactgtgggcaaactgtttagcctttttaatgcctcatgattgctgttggacaaaagggaacataataaaaagctttatcaagctcctgctgcagcaccaattattatttatgccaaaaaataaataagagggaggaaattcaaaagataccaatgcaaacaattgaaggaaaaagcaaattcttagggaaaggtaaaaggaatgcaataaacagcatgctaattataattaactaaaaaggaaaatatgtataaatattatgggccagggcgacacatccatttcagcaagagaatataaacaactttgggtcaaaattgttcaattctaatgacatcagtttctaatgacttagaggtgggaagaaaacgtagctaaaaatacagtaacattacaactgagtgttggaataactcagaaaccaggcatttattttcccggtagttggggaccataatgctagattttagaagctgaatttaggaagaaagggctaaaatttctagtatcatgtctacgggctctaattctcagacatgctactttttttgcagtactttggtcactgagaacagtgagacttcaagcagtatacctcatttagcaaccaataaagaatggaaatggaagaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtgaaaagtatatataatttgtctggagttgtcttcattagtgtacacgtcaaatcttatgtggtgagaagcaagaactttaatgttgatgttgtcttcagaactgaaaatgtgatcttgaatcctttagtccaactattcatccttgtgtgttacagtggccatgaatctgacaatcttggcttgatcataaaaggtgaccttaaaccctctcacccacaacttatttaattttgcacatacaatttttctacatagttttctagaataactctacttaaacagaatgaaaaaggaaaaaaaaaacaagtttttgctcatttgaataacaaaggagacaaaagtggagaaatggagagatggaattcttttactttgtgtggactgagtggcataggcagtttttgcaactcccaattctatgacttttaagttccgaggttaatggcatttaataatgttatgctgtttccatctctttatcttccagtaaattatacatagtaccaaccctctttctggatcacttgaaagatgataggataaaacagaaataaacacggaccactaggaaagttaaattgtgacataaatggagtgttaccaatttcgagaactgaaataaatgagtaggtattgtgaccattcataataaaatttcccaaaggaaatcctgaagggaagaaataataataaatataaaagatgccaggcatgaacccaggaagatgatatatgaatttcaccctaaagtaaaaagaaaatcttttaacatagagaacatttttagtgtaggaaatgatccattttcctacctgaaaggacctacacctcactaggtagaatgttgctatgccttttgattgaatctataaaagttttgaattcataaaaagatgtctgaccttttatatgtgtataggacaaggcaaaatttactacacccttattttacaaaaaaaattcaaaacaatcatttaaaagaaccagatacattgaacttgtcacattactcttgaaatattgaccttggaaaatgcgttcaatcattgttctgcatttcgcttaagcaacttggaccttagactgcataatctgcaaatgggaataataataaaactcacaaaattgactcacaccataaaagataaataagcaagaatatgtgaatacttccaccctaatgtctgggatataataaacatatatgaattattatcataattaataataacatggtgatttttgcttcactctctatttacacagctatgtgggagctacatgagtacacactgatgaacatttgagggaggtaaagttgagaaaattggttagtgattaagagttagcagcagtatcacacatgcaaaatcaatggtcgtctaagttgggactatttttcatacttcaagtccttaacatttatacctaatgtctttaaagttaacaatgttttcatgattcaaaaataatgcatgttaactaaagctaaaaatagagattttacaaatttcataatacccatatttagagtaactgctaagaacattttttgtgtatgtccttcaagtccttatatgtatgacaaaaatctagatttttattcaatatattcttttatgatttacttttaaaaaaaggaagtaggcacagaaccattgcatatgatttactttttaaaaaaactatatcatgaatgtcttttcatgtcctcaaatttttttaaacactgttttcaaacatttgatagtatcccattattgagatgtgtcatagttatttaaccaatactttatttttggacattgagtcattttcaattttttcaccattataaacaaaactgtaatgaacatccttgtacttcaatgtttgtgcatttccctaattacttttcagtcaagaagtcttaaaaactaactcaaaatctcttgagtttggagaagtcagtgggcactcgcagtgtggaagaggcatgaagacagactcttggagctcgctgatattgatgtagctcaaactctcttcctctttggttcagacctttgcagttgttccttagcaaggcttcctaactctaaaatctcctagttcagtagattttttccagatttcactggaatatctgagcactgaaaatatgataaaacctgcaagtagctacccttttgacgtaagatgcttcctaatctatctactgtgtatttctccatcctcatctcctgtcacattctcatccggacctgtgtcccaggcagacaatctacctgcagttctgttctctatgcctcaaatgtgcttgccccaacactttcaggttcaatcctccaaatgccaggggctctttcctctgagacttcctagcaattttcccaatatgtatccaatatatatcatattcactagaaatgatttgcagtaaagtgtgaacacattgaggccaaagactttgacttgagttctcctgttgtacccagtcatgaacagatggagagcaacacttttggcatctgcgtggatgaatagttgcaaatgaattggttagggggatgctatatgtaattactgtgctttgacggtttttccagtcctctgaaaatacaggaattggggggactatattaaacaggagtctgaaaatttggagtgtagaagccaagcttacataggtaaatgttacagttgtgattcagtttgaatcttgtttaagcatcaataaagtctgagcattaacatcctaaagttacatcctatgttaattttattcagaaaaaggaagaaaatgtactgctttgttttgtaaccaaggatgattaatttttactccttttttttttgtcatttggtattgttttgactgtcattcatggtgaggaggctgtttccctttcaacaaaataacaaaatgatagtagttctatttttagttcctaagttaatttttcctagtttatataattatttaagaaaaagatgctaaaaaaattaataaatctcaatgactaagccattccttgtgaaatgagaagtcttctttgaatttcagctgatttaaatataaatacaaatacaaacacacacacacacacacacacacacacacggcattttctaagtagcacaatacaatgaataacctcctgtctctttatgcaatcaactaccaaagaacccttttaatcctgatcattacaaataaattaaatatattcatttatttgtaaggccagaaatgacacctattgtcctgataccaaaacctggcagagattcaataaaaaaagaaaacttctggccagtatccttgatgaacattgatacactaatcctcaataaaatactggcaaacgaaatccagcagcacatcaaaaagcttacccactgtgatcaagtaggctttatcctgggatgcaaggttggttcaacatatacaaatcaataaatgtaattcatcacataagcagaactaaagacaaaatcacatgaccatctcaatagatacagaaaagaataaaattcaacatccattcatgttaaaaactcttaataaactaggtactaaaggagcatacctcaaaatactaagagccatatatgacaaacccacagtcaacatcatacttgaatgggcaaaagccggaagcattccccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagcgaataaacaacttcagcaaagtttcaggatacaaaatcaatgtgcaatgtgcaaaaatcactagcattcttgtacaccaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactacccaaaatgatttatagattcaatgatggcacttaatattaattaagccaagtttgtaagaaatggcttacctgaattatctcatttaactgttacaacaatttttgagaaagactattcacagaactagaaaaactattttaaaattcatatggaaccaaaaaggagcccaaatagccaagacaatcctgagcaaaaagaacaaagctggaggcatcatgctacctgacttcaaactatactacagggctacagtaaccaaaacagcatagtactgggacaaaaacagacacggagaccaatggaacagaatagagatgccagaaataaggctgcacgtctacaactatttgatcttcaacaaatctgacaaaaacaagcaatgggaaagtattccctattcagtaaatggtgctgggagaactgactagccatatgcagaaaattaaaactggactccttccttatatcatatacaaaaattaactcaagatggcttaaacgcttaaatgtaaaaacccaaactataaaaatcctttaagaaaatccagacaataccattcaagccataggcaaggacataggcatttcatgatgaagatgtcaaaaatgatttcaacaaaaggaaaaattgacaaatgggatttaattaaaccaaagagcttctgcacagcaaaagaaactatcaacagagtataacagacaacctacagaatgggggaaaatttttgccaactctgcatcagacaaaggtctaatatccagcatctataaggaaccttaacaaatttacaagaaaaaaaatctcattaaaaggtgatcaaaggacaggaacagacacttcccaaaagaagatataggtgcagtcaacaatcatatgaaaaaaatctcaacatcactgataattagagaaacgcaaatcaaaaccataatgagataccctctcacaccagttagaatggctactattaaaaagtcaaaaaatgacatatgctggcaaggttgtggagaaaaaggaatgcttatacactgttggtgggagtgtaaattaattcaaccattgtgaaagacacggtggcaattccttaaagacctatagacagaaatatcattcgacccagcaatcccatatacccaaaggaatataaattgctctattataaagacacattcacacatatgttcattgcagcgctattcacaacagcaaagacacggaatcaacataaatgcccagtaatgatggactggataaagaaaatgtgctacatatacaccatgtaatactatgcagccataaaaaaagaacgagattatgtcctttgcagggacatggatgggtctggaggccattagccttagcaaactaacacaggaacagaaaatcaaacactgtatattctcccttataagtgggtgctaaatgatgagaacacatggatatgtagaggggaaaaacacacactggagcctattggagggtagagagtgggaggaggaagaggatcaggaaaaataactaaggggtagtaggattatttagtatatttatatttagtatatttatttatatttaggggtagtaggataactaaggggtagtaggtattaacctgggtgatgaaataatgtatacaacaaacccccatgacacaagtttatctacgtaacaaacctgcacatgtacccctgaacttaacatagaagtcaaaaaagagccctttattttaattccaaatccttaaatttgtttttagtcattggaaagaaacatttataaagttaagtattcacaaagaaaatttttacatttatgccaaggattatgtatttttaaaagtaccctttaatatctatctgaaagattctagattccatctcagtcatttgatataaaaagcagatatcttaagtcattaagcagggtacatcaaggtctgcctttacctaaaatgaactctcaatcaaaattatgaaaatctactctctccagagtttctccaaatgtttacccaagaacagtaagttatttaaatatacatctctgtgtttgttcagtgttcatttaaaagtgtaccacccgccatgtaatcgtgggctttggtcagttaggtgctttgcaaataaaccaggatgacctttgctccctacaagtcactggcctttcaccttggaatttcagagtagggagtggcttctttttggccagtggagagtcaatgactttgctgggttactctgtggccacagattatatttaaagtatcatcagtcttcaggtggaaggaaggaaggcgccaattacctggaagggctgtgttagaattaaatgaagagaatgcacttgatttgatcaccgtgatcagattcttgccagtataaatacacaatcatgttatcggtgatgcctagtacatggatgaatgcctaaatataaattatttaacacagttgccaatagttaaaataaacctctccccataagtaactgggatttgttgatttgatgccattcataataattcatttttttctgggtccttcctcatccagtgtcagataaaataattgcaagataaccctgaaaatcaaatagccattcactcaagtgcagatattaggcataccagatgaagtaaagagtttttatttttgatactgtgttttattatctatattatgtccaaggagcagatagactggtaaaaaataagtatttctggaatgcaaaatatacacattttagagtgaactgaaatttgtcacgtaaaggacgtttttatgcttgctataagaaatatatccctttgcttttccagaaataaaaatgttctaaattagcatgctttaaccaaatcaaacaaaatgaaaaaatgcccagaagcaattcccaaccaattttatataatattaatgagtaatatttatgatagaaaactaaagttatatatactccctcctcttttttattgagatcaacttatgtacaataaaattcacatttccaaagtgtaaaattcaatggtttttattatagtcacttagttgtataagcatcactacaataaattttaaagcattttcctcactccccccaaaaaaattctccctgctcactggcagttactctgtatttctctctctctccaggctctagaaaccactaatatacatgctgtgtctgtagatttacctgctttggacatttcgtataaatggaatcatacaacgtatggcctcttgtgtcttgtctgacttcttttacgtagcataaatgttttcacggttcatccatgttgtagcatctatcagtactacattccttttcatggcacaatatagtccattgtatggatacacccacattttgtgtattcattcatcagttgatagacatttgggttgtttctacttttggctagtatgaattattttgctacgaacatttgtgtttaagttttgcatgaacatatgttttcatttcttttgggtatacacctaggaatggaatttctgggttatatggtaactacatttaactttttgagaaactaccaaattcttttccaaagtggctgtaccattttatgtttccatctgcaatgtctgagatttccaatttctccacattcttgctaatacttgctgctgcctttttttttttttaataatagccatcctagtaggtgtgaagtgtatctcattgtggctttggttacatttccctaatgactgacaatgttgagcatgttttctttggcttactggacatttatatatattctgtggataaatgcctaatgaaatccttggcccatttttaatttgggttgtctttttattttgcgttgtaaaattatgtatatattctggacactagacccttattacatatatgccttcccattctatgaattgtcttttcactttctgatagtatttgtgatgattaattttatatgtcaagttgagtgggccatggtttgcctgggtatttggtcaaaccttattgtgggtgtttctctgagcgtgttttggatgagagcaacatttacattggaagacggagtgaagcagagcaaccctcctaatgtagtaggtcttatcccatcagttatggagacacagcatagattaaaagtgaagttttggcactaagttattctgaagtagatacctgaaggtatctctgtggtcttcatgactgtgtctgcctacattattattcaaataatgtggttactgttctagtctcacttcattttatattgaatagacatatctatgatataaatatctattaattcaaagaaaacaatatcttgttttaattattaaaatgttaatttaattataaaattaatacatacttatactaaagttttcaaataatgcagaaggaagcaaatgaaaaagaaagccctcttcccctagttcttcccgcctcctgattttctggctctgcttctcacagctcaccacaatttgggttatgtacccttctttcaattgcccacgcacttacaaagacaaatataaattggatcataaaatttcatatagttttgcaactttttccctactttacattatatattggaaaatttgtcttattagaacaacaatgtggatttcataattaaatgcacaattatatatatatgttaatagatatttatttccaattctttttgctattaccaacaatgttgccatggaaagtcttctactgtatatttgtttattcatgcaaatgtatctgtacgaacataatataagtttctcctatagaccaggtgcagtggctctcacctttactcccagcactttgggaggctgaggcgggcagattgcatgagcccaggagtttgagaccagccaagggaacatggcaaaagcccatctctacaaaaaatacaaaaattcgctgggcatggtggtgtgttcctgtagttccagccacctgggaggctgagtgggaagatcgctggagcctagggaggttgaggctacagtgagccgtgatcacgctactgcactccagccttggtgacagagtgagaccctgtctccaaaaaaagtttcttctatatattgagtatgccaaaataattttttttttgttatttaagacattacgatatcagggaacctgccccgatagtcatgtaggttcttttctattttccctaagcatcggctggtttgagaaataaagggacagagtacaaaagagagaaattttaaagctgggcgtccgggggagatatcacatgtcagtaggttctgtgatgccccacaagccgtaaaaccagcaagtttttattagggagtttcaaaaggggagggagtatacgaacagggtatgggtcacagacatcaagtacttcacaaggtaatagaatatcacaaggcaaatggaggcagggtgaaatcacgagaccacaggactacaggaccggggcaaagttaaaattgctaatgaagtttccggcaccattgtcattgataacatcttatcaggagacagggttttgagagcaaccggtctgaccaaaatttattaggtgggaatttcttcttcccaataagcctgggagcgctatgcaagactggggtctatttcacccctacagtctacagaccataacagatggccacgcccaggggggccagttcagagacccacccccaggcgcgtattctctttcccagggatgttccttgctgagaaaaagaattcagcgatatttctcccatttgcttttgaaagaagagaaatatggctctgctccgcccggctcactggtggtcagagtttaaggttctctgtcttgttccctgaacattgctgttttcctgttctttcttcaaggtgcccagatttcatattgttcaaacacaggtactctacaatttgtgcagttaatgcaattatcatagggtcctgaggcgacatacatccttctcagctgacaggattaagagattaaagtaaagacaggcataggaaatcacaagggtattgattggggaagtgataagtgtccatgaaatctttacaatttatgtttagagattgcagtaaagacaggcataagaaattataaaagtattaatttgggggactaataaatgtccatgaaatcttcacaatccaggttcttctgccaaggcttcagccggtccctccgtttggggtccctgacttcccgcaaccttacataaagcagcctctttacctcttttatctatcagcttctaagtgtttataacaggataaaatcattaaaatactggaattctagacatgctagaaaacactcagattgggtccactatatatgtactctaactttatctcccatttttgggtagaattgttaataattttcaatttttttctattgtctgtcttctaagtaaaaaaaaaaaaaaagtttgcctctaatgaaatttatgtatttgtaaattatatacatgtactattatacttatgtattatgcaaattatgaaatatttacaaaatttgaagtaggaaagggcaagataaatgtactttttttgtaatatatatgttttacaccctaatggatcattttacacatttcttgggatgcacatgccccactttgagaccactctctcaattatctagacttacataggtaatggtaacttttttcagccactttggatatacaagacagtaagcacctaggacctatggtatctaccatatcagctacaagtactattcatcaaagattatttaaaatagcattttgctgggcgtggtggctcatggctgtaataccagctacttggaaggctgaggcaggaaggatcacttgagcccaggagttcaaggctgcagtgagctataattgtgccactgcactctagcctggggacagaacaagtccctgtcccataaaataaaatcattttgtgtatcacagaagacacttcagtcttccctatagatatgcaactggtaatcattaagttctcactgcaagaatatatcatccaaatcactactataaccataaagacaaaattaaaatgttctaaacttactatattcaacatttctctcaggcagatggcagtgaagaatatgtaaaaacagacttttaaacaacggctacaagaatattctttgtttctctaacatactattcttcctcaggtattgttttatgagttaattcattatttcttttcatcagagatcttttaatataaaaatcataatatttatctggacaactcttaatttctgatactcaataatgacatttttattatatctccaatatatgtttctgtgaatgacataataatgaacacagaaaatctttaaaaacattgagcactaacattcttttcaaataaagagagagtgttaggtgagaataacttctgataccagctaactctgtcatcttagcatattaagctgtcctaagctataccagtgacatttcattctgaaaatgatcatttctgatgaaaatgaactcaagaaatacacaaatgagtctaagtactgaaagactctaacaaaggattacaagggatagggtcaccaaattgagcaaacacaagcacaagactcgccccagttagattttgaaaaatagctctatcacatttttgtaatttaatgaaaaaatgcttagtacaggacatgcagcacatcctgacaaagtcaatacaagacacaggacaaaattgttaaatacagaacatgtcccatatctacagaatgcctggctaacctaacaagatggaacacaattgacctaattttaatttcttccatgcatccgggcatttcctgtgtgcatggcagggatttgtaggtgtgaaaaggaaaataagaatgaaatacaaaggagtttccaaactgactagaaatgaattatttcttctgtttatcataatgttttgcattgattccaaaggaaaaaaaatagtatttgcttttattacatattaaacaattatcatataaaacctgataattggtcagtaattttcctgtaataatgcttattgatttctggcatgaataggcatctatgctaagaaaagaaaaatacaatcttctttttaaaaatactatacagccatggtatttgaaaagtctctcaaatactaactgtctgaatcaggataaaatgacttttagaaaacccattactttgatttaaatgttatattttttatagaattggaattgcttcttgtctgccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcctcagcctcccgagtagctgggattacaggcgtgtgccaccatgctcagctaattttttgtatttttagtagagacggggtttcaccatgatggctgggctggtctcaaactcctgacctcgtgatccgcctgcctagcctcccaaaatgctgggattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttacaaaacaaggattcaattataatggggaaatactagaagaatacataaatttacagattgaaacatatttataccattttgcacatgcttgaaatattgtgtaaaacaatttgaagataagtcctttggacttttttgctttcgtatgtctgaattatcaatacgcacattttccaccaataattctccatgtcagatgaggacattcggagaagtgtgaatgagataaaaacgaggtgcttaagacattctgttcaaacggatagagttcatttactgaatactcctgaccggttcctggagttcagatccacacctaacaaattcccaaagttcttcagacctcagcaagtcaaaatacgctacggaaatcatttttgacaagaactctcgggctaagctttaagtaatcagtatctggttaggacaggaatcacccagtatcctgtggaggaaaacagccgacatgaaggccatttcagctttccctcttctaatcatgctttctaacctactgccaattcgctcctaggctgtcctcgataaggcatgccgtaggattacgggaacccaaagttcacgaatgcaaacttcacgaggctgcccggccccatcctttccagaagatcatatctacagcaaaacggtgctttatcctagaaatcccttttcaatccaaatcctaatggaactccttgacaaccccttgactaaattacattagtaatatagttcctaacaatttcctttgttaggaaggggagcaaaagggcaaaaaaaaaaatcatttttttaaaaaaataatgaaaattgcaaaggcttaaatactgaaagaattgcttgcctctacaacaaatctgtatcattactaacaagcgataaaaggccttccgatggataccaaatgagaaccttccagagggccacgggcgcccagctggaaacccctgctaagagcatctgcagtctgaacccacagtgactgcgcgtcttctctggatgccattaacagacctctgcgaagggaggcttcggctgctccacgtcagctttaggattggtacgtggccctttctttgtttatctgatttgcctttaaatcttacaatggcaacaagtgtctcaagtaggattgttgaggacagagaaacaatgctcaaatgtcctttgaacaaaaccaagagcccaccctgccgacgaccctgaaacctctcctgtctgtaagtggcgcacaagcgccacctggagggtgcaaggcgcaaccatcgctcttctcaaagtggaattggtctgtgttaggctgaagagattattttattttaaaatgcttccattcctccactgaaaaaatttaatatagtctaattatgaatatggagaaggtggaaaaagaaaaatcctcgggtgccttagtcattaggggaagcaggaaatagaaacaagcgtgagatctgggggcacattacctgggctcgaatcctatctctgcagtaatgtactctgcgaccatggaaatgtgcttgaatgcctgtgtctccgtttccttatcattaaatttgagatgatataatttacccacctgaggtggatatgaggaggaaatgattttatatatctgtgatgcatcttgtacagtacctggcatatagcaactgctccacaaatgttaggtataggcatagacttaccaagtcttttccagttttttcctctctatgtagaggtattgctctgttaccctggtaattttttttttttttttttttgagacagggtcttgctctgtcgcccaggctggagtgcagttgcatgacctcagctcactgcaacctccaactcccgggttcaagcgattctcctgcctcagtctccagagtagctggctaatttttgtatttttagtagagacagggtttctccatgttgcccaggctggtcttgaactggtctcaagtgatcccccaggcttggcctcccaaattgctaggacttacaggcgtgagccaccacacctggctcaggtacatttttcttattggtactaccactaggccctaggatattatcctatatttgaatatgcttgatacataatcttatttcaccccactccctcatcttcgactccaataactttttctatttggtttcagattaaagctcagatttggttcttcactgaatagggtttgcctatatagaggtgctccttaacagcactgctttctagtataagcatgtcaacacaggtttagttatttaaaatgcatatcttatataaaccagataatccacaaaaacactcgtgccatattcccctaaaagaaatgtgttgcaggcatatacccattgttacttctcttgcttggaagtcctgcaaaagctcttacttacacatggtactgccaaatatcctaaagttctccagttagaaataggttagaaatataccgaggagttagaaatatactgaggagaaccaagagaacagttttgattagagtctgagtcagtcaacattgcacatatataaaacttctgtctaagaataggtaatttatctatcctggcagagcatttcatgaggggcaccgctattgtgaataacaatggacagccacctcccttgggcacaaccctttcctcggctgatggaacagcaggtggaaagaagagcaggcacacggtggatagctcctgtccaaatagattatcacacaaatcaaaaggtggactattgtgggggaggaattataaaatatatttcaacacattttaggtatttggcaggattctgtttgggttcaccatcagctttcttatagggccttggcaaatgcagtttccctgactgcttagaaatatttatgatcttgggcttttttctactaggcaaaactggaattatgaattctgcacagtataggattcataacaccgcaaacttttctagcccgtttaatctttatttcacaggcctagcttttctatggaagataccgtagtgaacaaataaacaaagtggattgaaattcgccctgctaatatatccaggaaaggaatcgttgggaggatagttggatgattattggaactggcaggtcagtgagggcagcagactctcaaagagcatgaacatgctgaccaattcattagagactctacagcccaaattgaccccaatttaaaatgtatccaaattttggcatgggaagtattgtattaagaaataagaacaaactagcagagtttgttttcaaaatgagggaggcatagatgaaaaatggctaaaggcttttttaccctttgaaaaatctgtcccggctatgcgccccccgtggacgcttcctttcccacccactcctttcctgctttcttactaccagaacccagggtccttttaggtcttgtgcctaggacttgcaaatgcctcgggtgaataagaatgcttttcctgtgtaagagcacaagacattttaggaacaggaaaagcctatccggtccaacatacctgccctttttaggtttatctaaatcccaccttcctgcattgttaccttccttcatcttcctatatagagataacatttcttgtatgtttctcatgatctctcctgtcactagacctgataaaattagacctatattttagtaccactctcgttaaaacaaatgatttctgaaaagagttcgcaaggctagtaaacagtttgtaatttttcttttttaagagtcataaaccatgagtttgaaagaggagactccaaagaagcttgacttggagggacgcggaggtcatccggcttgactttgtgcttagcttttatttatgagttatcttatttgccagaatctgggtaccaacattttctctcagagtgttcagtgacgagggatatgtttatttgggataagactcattatgaagaaaatatgcaggtggctaaagattaattacaagcagcagaggcctgttaaaaagcttaacattctctgagcccttccttgccccctgtttcacagttcatatctggaatttacaatagagtgaggtaagccacccgccgtcataaagaaggtgagatatttattgaacagatgtttcattactcaagaaaattcacattttcaagtaaaaagccaaaagatgggccttccacccaagtccctgaaaaagattcttggcagcatttatatttagtgcctacaagttttacgcactgagtttttactgtttagatgtgcgggtcaacaaatcactgagaagacaccaaaactgtctgccagatgtcgaccactgattaatttgtcttaagttcagccaaaagggaagaaaatatgatgggtggagcatgaacagcaagcacaatcaacatctgaccaaccagggtttcctgtcaccttgggaacaaaattgattggcactggtttcctgtgtacaagttaaaaaccagtagcaactgcagtaacaagaataaactacagataagagacttggaaattaaatcaaggcacatcaccaaaatttcagcttgcaaccctaagcagaaaagttccaagagaactttttgagggcttttttttttccccttttaagctattttgtatgtaaacttaatttttctaattttgccacttctggcaatctgaaatcattaaaaaggacacaattcaaatttatgttagaggtcataaattttgcccaggactcaatattttctcatttttccaaagataaaatcttatttatgcattatagcgacttggttttcactttatcttgaattatagcttttaagaggcagaaagaatcctttttataaggacagtctcaagtgtacacacagattaaatattacaaatataggttgcaaataaaactttcaaaatgtgggattataggaagcaaaagagaaccaaccaaagcatcaacaaatttacctttttgttttttttaaagatttttcttatttccttagctgcttttgcattagcattaaataacattcttattggagtggtatgtgcatggcccaactcaattttatttgcttttagtgtgaatctgaagttttattttttattgctttattcatttatttacagaaacttgttaagcacctaaatatgtagaggcatgtctataaattaaggagcatggcaatttgctctttatttttaaaaattcacagtgagagactccccaaaattagacaaacacacaaaaaaagatacagatttttgaggaagaatgaaataggagagcaaaatgtttgcaaaatatgctttctttgatagtctaagttggaagttgtaaaaaatgaccattttggttataagaggttttttaagttacttcatatcctttcattctattcttccaatttcagaatcacttccaaaatgtattcattcattttataagtgtatataaattgcaaaatactcctcatactgaattttagaattcatgctacttctgctgtcactaccagtatagtggttaagagtggattatggagccagactgccgggggttcaaattcaggttctaccctttaagactgtgtcaccttgggcaacttaacctgtatgtgcccagttttctcatctgtaaaatggggatacaacttgtgcacgtgcttcactggaattctatgaggcttaattgagataatatgtgtgaaacacaacagggcttgataacgtaataaatgcaacagtgtaactcttaactggtattattaatgttttttattactactgcactgctattgctgctgtttctgctaccaagacaccttcagtgctactgctacccttgttgcagcttcctctgtgtttctggccattgtagtgatatattctcaggttgttgctattactgacccctattggtagttaccactgctactgctactgttacaagtagtgttggtgcgtgctcctgctgcaattgctatcattgctgttactattattagcagttactagaggtgtagtgtgtgtatatatatgtatgtgtatgtaagtctggatatatatatatacacacacacacacatatatatatttatataatgttaatggtggctattttggtggtgcaactggctaggaaataatctttatttttgtttttgcttaaatatgctttcaaaatttctataagatgtgttatttgcacagttcatttaaaattaaaaatattaataagggctggagaaatattgaaatctcatattcgtcaatattttgtactgcctcatggcctattccaccttcctgagaaagaaagggtgttgagtgcaccctgccccggtatgagaagggcatcttatattatatcctcctattataaaataagcatgaagagacagggctgggagacatgatttatttgccatctagctatgtactaagagcatacgagacattcagtcactgactgattttgttatttttatctcatgtcaaaattttcctcacttatctttatgtttaagaagaaatatttttgataagaggagagatttttgtatgttttagccaaactattctcaggagaatgcccttgggttggcccatagctcaattgtgaacaattaccctgacattatcctgaaaacaatcccacaagttctactaagaataaataaagcacaatagaataaaattatccaccaaatctaggaaaagcagctatattttagccaggaaatagaagtccccccacctccccaatgtattaagttcttgtacttctgtcagcaaagaatttagcacatggaaaaattcagattctccagttattgatttggggactgattattagggggaaaaagtaccgagagccaacttaggtgagttgttgtaccctgacaattgtccttgtggtacaaatggttttaatagaacagagaaaatgggggaaaagaattaaaaaaaattagaattggttatttctttagagtaatggtaaaacatcccttagtctatttattttttacctttaccaagtgttacaaaattttaaacgtcaaagagttaaatatctggctctctgagacatacaggccaatatttctagactctgtcaaattctaggatgaatgcacagccctggttgaaggtaaattcaatgatgtgtctctcttcgctaaggagggacattactgcgcctgttgaaccctaaatagtaaaatcattgtcaatactattgcttataatgtacacatcatagatagatgatgatcacaagtgatatttttcaacatcttctttgtatgacattacccagaagatccaagctaaaacccagtaaagaatgatgctttttttttttgcagtctgctttatgtttttgcaaaacattttacattacacttgtaaaatatatacatatgtatatattttagtcaacttaattcaagaaaattatacaaaaaatctaatttaatgcaacaaaaacctatcatatgcccagtttttagggcaaaatcaggcttaaaatttgggtagaaatttaaggccctagaaatgtatgtacagtggttgacaatttggggtctggagccaggccacctgtattctatatttattgcacacctctcatggccaattggatgcccttgagcaagtgacataacctcctgcagccatggttttcctttctgtaaaatggggaaaataatgatagggtagttttgactcttatgagttatacatgtaaagtatttataacagtgcctggaatgtagtaagtgcttgataaatgttatctgttatcagtatcatcatgggatagtctgcatttaatttttttttttttttttgagacagagtctcactctgtcacctaggctggagtgcagtggcgtgatcatagctcactgcaacctccacctcctgagttcaaacgattcttacatctcagcctcccaagtagctgggattacaggtgtatgccattatgccaggcttatttttgtatttttagtagagatgagattacaccatgtctctgctaaaaggtcttgaacacctggcctcaagtgattcaccagcctcgacctcccagagtgctgggattacaggcatgagccaccacgcctggctgcatttacaaaatgcatttcttcctacttattcccatttttttctctccaatatttctaagatttgtatatttacgcaggggatggctaggggagagaagggggaaagtggaataagcttttggaatttggaagaaagaacatgtatgttaaaattcctatctagtattaaacataagtcacatattcattattgtgtatttgatcatgtacagcatatattgtcagacttcggtatcgtggaagaagaaatcttgaaattgtctcacaaattttaagggttttgtgctgtcatggaaggatcctaattggatggaactaagttttggttcctagtcccgatttttttttttctctctcagcaaaataaaacactcaggcacttattaattcaaatgtcctcatggacagaggtttttgctaaacaactattgctttctctgggaaactatagtagtttccagaaaagggattgattgaagaccttaattataaagataaggtaaaacacagcctttaaaatgggttataagaattaaaaaaaccagaattaacttctaagcataaatgtacataacttatgagttaatttgttaaaaaattatcaaagaaaaattcataaaagaagctatcagatacttttgtattgtgatcaggttttccaagtggccagtaaaaagtgtgtctgagagtattttctagaaagaattgaaaattttatattagttatgaacagccctgggaaactctaaagatgtcttggatacattgaggggaatgataggtggcagagaatactgcctagctacatcactgcaccaatagaggactcagacccagagtctcatagaaaaatgcatccaaacggcacagaatggccaaaacgtgagaaagacacatgtacttgaacatcacatgatctacttcaccctcaggtctttgatttcacttgaacatgtttagcccgagcagactgtctgagtaaacaactgtatcagtggtaatcaaactcttttcaaagctgggggctcttggttaagaaagaaaataagatcatacctgtaagtctaataatcaaaacaagtgcatgcagagctcagctcattgaggcatcagagaagggcccaggccccactagcctacctcttccctaaggccccatagagcataattgaaaagtactgatttatcaaaatgtgaaataatccatagctagccatgaatccagctacagttctattgttgaataacccaatacaggttgagtatccctgtatcccttatccgaaatgcttgggaccagaagtgtttcagattttggattttttttttttcagattttggaatatttgccatacatatatacagagctcagctcattgaggcatcagagaagggcccaggccccttctctgatctctctctctctctctgtctctagatatatatatatggcaaatattccaaaatctgaaaaaaaaacaaaaaatccaaaatctgaaacacttctggtcccaagcatttcggataagggatacagggatactcaacctgtactgggttattcaattatatatatatacatatatgtgtatatatatatatatatatatgtatgtatgtatatggcaaatattccaaaatctgaatatatatatatatatatatatatatatatatatatgccagttgaggatccctaatccaaagattcaaaatctgaaattctacagtgatcctttcctttgagcatcatgtcaatgttcaataagttttgaattttggagcactttggattttggatttttggattagggatattcaacctgtactgacagatggcttccttcaattctcaaagttctttgtaaactaattagttaacttctttatctccattccttgtccacacaacactaaagaggatgccttctggcaccaacagcctgtgatcctaacaattttagtaatgaatatggctataggaacccagtataatagagtaggtaagagctgttggaatactacggggccaaaaatgaaactgattttagaaaattattagaaaagcttccaggtttgcaatccatgagttgtttcagttctagaactctgcttccaataagggttatggccactgctttcacatcagaggctctgcaacagctgtagagttatgggaacatccttgcgacctggaccagggagactgagattacagttcccaaataggaataatttaaatacagattatagaaatatatactaatataaatatattcaaatacaccatagacatttaaatatatgcatttaaacttaaatgtatttaaacacatgcatttaatgaatatatttaaatatgttatacatgtttgcatatatgtgtgtatatatagatctttatacagattacatgtagagatgatctatttgtatctatctgtctatctatctatctatctatctatctatctatctatctgagtatcatctttccccaaccctggaccagagctgttgaagctgaatttggattggactctagaatattttccatctggaaagtctgtttagataggaatatctagaaatattacaaagtttccctagaggactatgttaaatgagttttggggaccactactctaaggtttctcccaactgtaaaatgctatatttttggccttttgagaggcccccagctctaaaatattaacacttacttctagattataactatgcccaccataaccacttttaccaacagtgagtgggaatgaaggacgaaattaagcatttattaaggtctaatgtacaccaggcaccttaataggcaatacaaatacatggacatggcaataaaaaagagacatccttacctccaagcagcttacaatttagtttactgaattacacagtttactttcttatgaagaatcataatgatttaagaaaaaaaaaacctgaggagtccaataaccatgttcaagccatgttttaattattttacttgttatttctattttgaggattttgacgttctaatgtcatttgatatttttcataatgtcatttgatatttttatcctcttggggggatacaactagtggatgacaaaaaaacaatgaaaaaataataattccaagcaaactattattgacattgtgttaaagattttgtgagacaccctgcccacactagatttcactagtatcaccctagaggatgtaagttctaatgagaatttctgtcacacccaagcctcgatttttacttttacagtatagtgctgtttcactctgccacctgcaggtcatatatggaagaacatatttaaattagaaggcctggcttggtggctcactcctgtaatcccaacactttgggaggccaaggcaggtggatcacctcaggtcaggagttcaagacctgcctggccaacatggtgaaaccccgtctctactaaaaatacaaaaattagccgggcatggtgacgggcacctgtaaccccagctacttgggagactgaggcaggagaatagcttggaccctggaggaggaggttgcagtgagctgagatcatgccactgtgctccagcctgggtgacagagcaagaccccgtctcaaaagaataaatgaattaaaaaaaaaaggtagaaatcagaggccaggcacagtggctcatgcgtgtaattctagcactttgggaggctgagacaagaggatcacttgagaccaggagttggagatcagctagtgagacccccatctctgcaaaaaataaaagaattaactggacatggtggcatgtgcttatagtcctatttacttaggaggctggggcgagtggactacttgagcccaggagtttgaagttacagtgagctaggatcatgccacgccactccagcttgggggagagagagagagagacagagagaggaaggagagagaatgagagagagcagaaggaaggaggaaggagatagagaaagagagaggagggaggaaggagagagagagacagagaatgaaggagagagagagacagaaggaaggaaagagagaggaaagagagaggaagtgaggaggaaggagagaggaaggaaggaggaaggagagatagaggaaggagagagagaggaaggagagagaggaaggagacagagaggaaggaaggaggaaggcaagagagaggaaggaaggaggaaggagagagaggaaggaaggaggaaggagagagagaggaaggaaggaggaaggaaaagaaagaaaatatactttaaagtgaaataaacaactctcttctatgaaactgtgatggaaagttaaaccattggtcaagattataatgattacctggatcaaaaatttggatggaagaaaaatccctccccagaaatgaaaaaaaaatgttggagtttaaacatgtacaaataggaaagcaatggtaaggacagtcacccctctacacaatgttcaaagatgaggaagtattgcctcacctggagaaacttgcaatcgccttgtctgagacctctctctagatttctagaccattctttcactaatatggaaccactcaattgtaggatattttcttaagtgtcttgatgcatatttacgctgtattaacaggttcaggatagagtctcttaaagtttacaaagtttattcattaaacaggagcagaggggccacgaccacagaccttaaaaaccaattggccacatagggtggttggataatttaagcacccgtgaaggaggtggcaagtgagaatttctccctttctctgggctttctagaatcaactggatgttttagagctgaaatagacgaatatgtctaactcccatgagtaaggctaactctgtatcattcagtcaatttttagagaacctctattatgtgtgtggtattaggaagtaggaaaacaaaaacgaataagctctcaggagatcctactgtgtgcacgtgtgcctacacacacatgtgtgagttcttgatggggtcagggaacaagagaggtaatttaggatggtttattcctagattctgtatttttctatgtatcggatgggagaagagaatttaaggacagcaacactgattttaaaaagctgccttgggcaatgaaaaaaagagctgcctggaaaaacggacaggtgtttgagtagggctgaccatcctctggagactgacaagatgaaggatccacatctgaggtatattccttcaggcaaagtgggcctctgccatactttgaatgtattcattctcatagatcctttagtacttcatcatttttactcttatttttgattaaggtgggtttaaaattccaacttttttttcttagaaaccttaagtagactaaggattctgtcaggaaaaaatattcctctgaatagggatttggtaacaacatgctaagttaggagccaacgtaacaagagtaaaacaaatgattcagaagatcatattcacagcagggaccgtgagggttttaggagctcccctcagagccccaggtgcagcgtgacattgccaaggacatgcagggagcacagctccaaggggctccctctcgatgtctaatgaggccaggcaacctgccagcaccacaggcttctgtggggcaagggcgaggtggtggtgagcatccattttttttttgtttgttttcctccgaggcagagtcttgctctgttgcccaggctagagtgcagtggcatgatctcagctcattgcgacctccgcatcctgggttcaagcaattatactgcctcagcctcccaagtagctgggattacaggcgcacgtcaccacgcctggctaatttttgtatttttagtagagatggggtttcaccatgttggccaagctggtctcaaactcctgactttgtgatctgaccacctcagcctcccaaagtgctaggattacaggcatgagccactatgcccggcgcatcatctatttttatttttttaaaacatatttcttcctataaaattaacttgatgtccaagaacttgttccttttttcatattgagatttaacaaatatttatggaacacgtacaaggtggtaggcattgtgctacagacaccgccttgagggaaatcaaagccgagagggaaaacgcaggaaatgaaaagtaaggcaggtgggatggggagggcctggaaaaggggagaatccttgagggctgtgttttaatccatgatttggaaaaaaaggtttccttaaataaacaaatgtatacactataagacattattagggaacaataatttcatttgatacactgttgttaaaattacttaaaataatgagaaatgaaaatgattggatgccaagcattgttagaaagtatatcatatttaaaagtgttcacaagaatttgtcaattctcaagttaaagctgtttcatcactacactgagacctgttttctaaggtatataccaaaaaaagattatgccttacccgccagagaggacgctgtcataaaaaaaatacaaacaaacaacaacaaaaaaaaaaaaaaaaaagaaagaaaaaaagaaaaattatggcaaaaaaaaaaagaaaaaaaaagaaaaaaaaagatttcacctttcttttccttccatgagacaaggggctaacaactgtgtcaacatgaagttctccactagagggaactaattccacgtcctccaatcgtgagcttcatcaggatgtgtctgagaacagtgctctctccatgtttagattgtacccagataatcatgctgcattgctaaatgggaacgacactttaaagtggtttttataagatttccagaaaaagatagttttatatttatataaataaattgaagtgtatattttatgttacagaaaaaacccacatcagttgaaaaataattgtgttcaagtcgcctgccatgagtaacttgtgattcttcactgttctgctctagaggtcatgtgctaatatctgggtgaatttgatgagaggagagtggtgcctcacttcccaggaaaacaatgtttgggcagttcataaaatgcacatagtgggaccctgaactacatagctttatgacacatttccaaaaactcctaaggcaaaagtctctggctgcaaggaaaaacctcctgacacagtatctaagattcagaactggtcgctcttaaaataggaagcaaagcttatgctgggaattatctgtgcctgccctgattaaaacgcttcttcagaacaggccatttcacctaattctgtcaacctatacatcaagatttggaacatggtcccctagcaaaaataaaaaaaaatctcattttaaaaagcactgcatttagtaccctccaaagtgaaactctaattaatcacatgtagaggaatcagagaatttgaatctcaaaaaattgtaccacgaccacctcttctttagggtcaagacaaaaagaactttatagaaatgcacaccctactgaattgccaaaagagttcccagggtagttagattttgtcccccatggtatgagtgcaaatggagagtaccctgtaaagctggaagcagtgtcctggatggggttgcaggctaatggatgttgaaggattgttgggggtcagggtggaagggctgagaagtcctttctgcttgaacctcagggtgaagcagcctgtatgaggggtggtctgggggcagatacagcagttagaggactcagtgggacttattcctgctgctctgccagggaccacaagtagagaaagggaaggcaaggaaaggaaaggagcaattactgtgattcctcttagagccactgccaggtctacactttcaggactcattagactacaatggcttaaacatttcagggtctgcttggagagaaattatgccaggcctgtgctttccaatgagtagtggccaatttttacctttttaggcaaagctcctctacttttaattcttaaataatatatgttggctcctgttttactcaccctgggttgtatccactgtcatttctttcacttaacaagattacatttttgtctcatgacgtaccattaattttcaggcaggtttcaaaacttttgcctcctttttcttcattcctgtggggtcttttatttttttagaataaaaaaccctatgaaaattttgttcataaccctccagaattccaacctacctatataaaatctgacaaataaagagaacagcttgatgctcactgttcatgaagggcttgtgcatgtttccagtgcctccctcagctctggacatccccatacaagtataagaatatgaaaatattttataaaaatgttagaaggtgattagtccgttctcacactgctaataaagacatacctgagattgagttaatctataaggaaaaagaggtttaatggactcacagttccacatggctggggaggccccacaatcatggcagaaggtgaaggaggagcaaaggcatgtcttacatggcagcaggcaagagagtgtgtgcaagggacctgccctttataaaaccatcagatctcgtgagacttattcactatcatgagaacagcatgggaaaaacctgcccccatgattcagttacctcccactgggtccctcccatgacatgtggggattatgggagctacggttcaagatgagatttgggtggggacatagccaaaccatatcagaagattaaaattttgtcatctgtatcacctagaaaaaggtaagacatggtagttacgtgcagattttgtaagcaggttgtcaagattgtatctttggctagatttttatttctttgtgacattgagcatattacttatctctctaagtctctctgttagcataactgcaagatgggcatagaaatactgcctgcctccaggatgttgtgaaggttgtctgagatcatacataagcacagtggttggcaggtggcaggttagtgtccaacccatcagctgtgactctgcatccttctattacagcagcacgggcagcagcttagtgcaggcatgaccatgtgcttctctgctgttcctgccacctccactgacaatcacacacacaatgaagtgggcgagttattatgcaggatgtttgaacaatatggagaccactccatccttttctgacttgagtattctgaattattgccttatagccccctcactttggcttctttgctctattcgtgttcaccttcctcttggtcatttatgtcagattaccaccaggcctccagaatggcaaaaatcagattaaggaaaaaactgagacagacaatgtgcttctagaatggcagtgaaatggttatctgtcatgagtgttttgagtccacctcatgaaattgcactttgcttgatttaaaatctgaaaaatattctgaaagccaagcataaaatttgctaagaggaaaaacagtgtgacgctccataatatacctacttgctaaatatactgatttgtagtttattttaaaattgatttcccacagattataggtgtgtacgcctcctcccaacccccaaagcatgccaatttattattaattaggagtacagcctctggagcaatactgcttgggttcgcattctatttgtcaccctcacaatcctactgacttactattaagttattagggccataacttatactctctgagcatgagtttccactctaaggaggggataaaaagtcccttgggttggtgaaatgagataatgcatgtgaagggtcaacagggcatactgagttgttatttttattgatgttatttggagttaaactggaatttacttctacgtgtttgctatattttatgtttataagccctcatgttgtcaggctgagcaactgagtcatggttgatagactgtgttcaatggggctgggtcataggttccaatagaatgaatggtgtttatttgaaggaggccgtgtggtacgtgtataatggcctgggaaaatcaaaggaacctggagtgtaaacttagctctgctgcgacctttggcaagtacagtaatgctgttggtgccccacccaggtcgcctttctccagctggtgccccatcctctcctgccccactgctgggagggtagcctgttagtggtgcccagctgccacttcgctggagcagccccctcagctgatgggtgttgctgagccagaggtgcctaggaagttatgcctccaccatccctgggtggcctggagtcagtggttggctggcatgagggtgcagaggctcagccccctcacctcaaggtgagacaactgtccatgaggggccactcatgctcagagatccctgtgcaatcaggctgagggtagatggctgctaccaccacctctttgcttgtcctcttctctgttctgcttgccctgctttcctaataagcttcccctgagagcatcttctcaacacatcatttggacaagagcccttgtctcaggctgtgcttttacagaacctcaccaaagacctaagagaaagattctgggccccatttttatttgacagaaaatgagagagttggatccattttcgattatgggtctatttaatgaatatctatctatctatctatctatctatctatctatctatctatctatctttcgagacaaagtctcgctgttttgcccaggctggagtacagtggtgtgacacagctcactgcaaccttgagctcccaggttcaggatatcctcctgcctcagcctcctaagtagctgggagtacaggtaaacaccaccatgcctggctaatttgttaaaaaatttttgtagagacggggtctcactatgttgcccaggttggtctcaaactcctggcttcaagtgattctcctgccttaacctcccaaaatgctgggattacaggcgtgagccaccatttgcagccatgaatacagattttaacttccagggtattttttacactttatgctctgatatgcagtcatattaattctattcccttctctttactcatatgtcccaaaaagagatcagtggaggaatgattaaagattctccaagttaaaatctttaagcatcgaaatgtacctctactagggaaagcgaggcagatacatcaggacattctgccttgccaggaggaaattgtaatacacaaaatcttttgagtttgaatgtagaatggtcaacattttcatggcatgtactgtcttttcattgcttccaccattgcagacaaatttctagttctgataaaaatctcccaagctcagcaacccctaaggaaacctttagactcacaatcctgggtgttatatcattttcacagtatttattgtaaatcataacatgtataccctattatggtacagctgaagaaaagttagtgaatgtttgttcgttggatatcagcaacccttgggggcctactgagacctccgttttgatagaaaaaaacacccattaatatcatagtcctgatggcccaccaactgattactgagaaatgaagtcaggatggagagtgctatattacagtgtgccactcttccttcctggacagttttctacctctccttgcacagtgtttacttgtaatagaaaatcaagtgagaaaaatgaggaaataatgtgaacatatccaatttgcctgttgatttcctttccataaaattggccattagccgtacagtagcccaaagggaaaatgtgcagaatctttcagattcataagttctagaaaatgtactttctagagtttgaatgtgattcctcatttaatgggaatttggaactcagcatgtatacaatttcccttagagtgatcagtggagcattttgggagggcaaggatgggacaaaagacaagagggaacatgaactaactgtggcctcacactgtgccagccatgtgacatttgtcatgtagcttaactgtcccaagagctgtgcaaggcacatgctatgctcctcaatacaggtgaataaacaggttccaacttatatatgtggtagttacagagcaagtgtttgaatttgtacctggactcgccatgagaaatgaatgcatttgttagaccagaattgattaaattgatactgttatttattagataacatttactggccaatttataagtatgtacttataaattacatgtaactgtatatttacaaataggatgaacaaaactatgttaattgacagttaaaaatataatgttatatgacaggctcaactgtagcaattcagtagaaaattagcttcaactcctgagttcaaaagtataactgacctagtgtaggcttgtgaaatggaatcagagaacaaaaacaaaaagaatattagatttccttttccttctcaaagacaccatgccattttgtattgattgttaattttgtagtatcctttgaaggtggagcagatattattttatagattgggaaaactatactacagaggacttaattaatccgttgagccacttatttaataagtgtcagaggtagtattagctgagactcaggtctatagtttatcattaagctattggttcttatggaagattctttagaaacagacgagatcttcagatgtgaagcaacattaattaactccataatatttttgagtgtttactatgtaccagggtttacaggaaccacaggagacacagagtatcttgagccatagtacctgttcttaaaattcttgtcatctgctgaaaacacaagacaaaccacttaaaaaccagttcaagtccctttctgaatgattgttcaattaaagtcattgccagaggagtggtatatctgagaatttataggtgttatacatcactgtgggcacaaataggttacatggccagtggtagggggtaagttttgtgttgggctctggagactagagatcggtaggctgagggaagaggaaggaccaggcaaacagaaatgcaaatgtggacaggagcgcagcactcagagggggatggggatggaaacagagagcatggaatagaaggtttattttaggatgtagttgcaaatggatttggagcaaatgatcagggccagatggtataggacatctgaggcccaacaagatggtctatgccttattctgtaagaaaatggagccaaatggggatttttgcacagcaaagtatgataatgaaagattgttatagcaagataaacctgaagactattgaagggggaaagagaattagatgcagacagataagatgaaataaaataatatatatgaaacatattacatatattagtcctaatatcatttgtacaattatatgacacaacaatttaatcatgaagtaatgagagctgggtccaaggtgatgattacagaaagagataatcaataatgagaaagttggaggagcaagaatcaatatgatttggcgattagtttgaaaaagggagaaaagaagactgaattgctatgtttctcttttttttttttctttttgagacagggtctcactctgtcacccaggctggaatgcagtggcacaatctcagttcactgcaacctctgcttcccaggctcaagtgatcctcccacctcagcctcctgagtagctgggactacaggcatgcaccaccatgcctggctaatatgttcttctttttataagattctttaatcttcataatttcagagtgtattctttatactcagttaagcaatccatttagtctctagatcttatttgacttatcttttaattttaaaattatattttatgattaatgatatcaaagtgatagattctcccaatcagggatgagaaatttatatgacatgatccaaaagattgggacaagtgacttataatgcagtctttatggtctcctggtgattttaatgaagccatacttttatgcaataagtagaagattattacctcactccaggatcaaaagatggagagctattaaacatgagcctattttaaaggcaccattagaacacacatatatatatataaattaaattttaaggcttaaaactgccagaaaagctttctgcatggaacactgtacattcttcaaatttggtcactcttaaaactcttcattatgccatcttggcagggaattgtggtagaaaaatgggagtgagaatagaacaggaagggatggtggaataagcaaagtgtttcccagtaactgctgggagttaacctgaggttagtcataaaaaagaatcattaattggttaattcactcattcaggcatttatctccaggagctcctggtttccagaaattatgttctatatgtaacagataaggagacaattcaatcatatatgtgtcctcaagaagcttagagtctattggctacaacagattagtaaaccagaacttaaagacaacaaagaagtgctataaatactgtatgcacactgggttatggaactaaagcagcggggagcctccatacagaagagaggtagctgaatcagtagtgggctggaggaaggaggaggaggcagagggagcctcaaattggcttccaagaggaagtgatgcttgaatgcccctccctgtattcctactccctctttcacctttggacctttgctgtattcgggctgccagggttttttggtgttttattgcatttgaagaaatctgagagcagaaagcagggaaatttgagtcctgtcatgggctttgtgttctaaaggccaggactttggtggaaggtggcgtctcggggtgtggatgtcagataaggtagaatatgaaataagccagagtagggttttctattcccaaagcctaagaaaacgcccatgggctcaggggagggtgaagtgttagaacggctgctttgtgggtgcaggtgagacccctggatccttcaccgctgagccctgggaagtgggggaccctcaataggaggactgtgatccttggtagagccatgagaaatggctggaaagtgtttctgggggatcatgccttagatatgcccaggttttcctatgcctccatttggggtagaatagtgagatgattcttgggcatctaacagtggtttggatacaactgaaaaagaggaagagagagagaaaaggagaaagcaactgctggaaatgaaggggctgcatgaatagcaacagggaacaacatggtggtaactgtcctgggaatacttatgagaaccaaagagataatggacattttagcagatgacaatgtgcacagatgacatcaaggcagataggggccttactcttcatgttgagaaagtctccttaaaacgtagaggaaaccctaggaaaccagaagtaggttagatgaatcagaaaagggctgagattgagtttctaccatttaggtgaaatgacatctagcaaaaaagcttaggttgagttacagaaaaataaaattgcatttcttgtttttttgatttgtagacccagattcatgcccactatattggtggtaattttcaagggcaaggagtagggaaaaggacaggttctaggcaagtattaattcttaggcttaaaagagaatggcatggtacctggaaaaatgtccaagtagcaggatgagtccaagggggtgtttagcaggaaataggggtcaacataggctgccaaaggccagatcagaaagggcttcatatttcataagtagaagttatcagtttcttcctgaaggcagtgtggaaacactgaggaattttataaagagaaaaacactcaaatataatttagaaaaccagtttaagaggtctagagagtggactggaaaaaaacagaattcgaggtggggaccaggaggagactggctagaattagggagatcctgagttctcagtgggattggggttggacgggggaaacagttgggagaaggtgccaggtcttcataatgttcggctatatggggaggggaaaaacaacacggagaagctgaggatattactggtttcagagactcacaatttaaaaagaagagaaaggatttgatgaggaaggtcttgagttccatttctgaatgttgtaagttggtagtgtttaagaaaggtcagagtagtgacacagagttcagagctgaaatatgggtctggatttcaacagaaaggtagattgagctaaaggtactttttcaggaatcactaaaaggtggtaagataagaagtggccatggttgggtgattcaggaaggagagaagaggacacagaatgaaactctgaggttaacaagagaagggaatctggaggagaccgaaggtagccatgcaagaaacagaaaaatgatatatatgaggccaaaggaggagagaagtttaagaaggagatagttactagtgctagatgggaaatgaaacatgtgctttggatttggtagtgagaccattgataattaacttgataatcgaggatgtgagagaagcaatgagaatgaaaggtgggagaagaacaatgaggcagcaagtacactctgttcttttaagacatgtatttgagaaaggaaggaaaaacaataccagaggaggcactggattaagggagtttctttaatacaagaaagaacctatttgtatgctgagggaacagcattagaaaagagggtacagctgaaggtagaggaggaaaactgatgaagttactagggttgaggtgaatgacctggagcccttgtggagagaatagtcttttcctgctctgaggtggaacaaagtaggaggtgaagtgtgggatgcagtgaagttgtagataaggggacagaggatctatttaacactgattacacacttgctctgctagaatcccccacgtggaccaaagagatgggtatgattccgtccttgtattcgcccttctcaaagattcactttaatgaaatgaataagtgaatatttaaccttatactcctttaaactgtagaccaacatgtccagcagtggtctacagagggcaggatgctgggaatggctactttcctagacaattttattctgaccttgcttagaattggtagtgcatgatgataataaaaatttgtcttttaatcagtttcattatgacccttcattgttatctactatagataacatggcctcctattgcctgcagaccctttcttgccaccggcccttcgttcatcactgatgcccaggtctgtgcttcaaagttcctctttgaagcaaacataaaagcacaaaaataatgtggatgaccagagtaaaagaaccagaaagaagctaaaaaatcaagttaaacctctttatcttttagaagaaaatgaggtccagatgagtgaatgactcaggtgaggccaccaaacccaggaacggcagggctgggtctggaatccagttctcctgactcccagttagccttagggagaaagttccattttctctacctttccacactgaatcacaaaaagcaatttagtgatatctacgtaagtgaatgtcacatggagacctacattgcccatcaagaaaccacaggtattttaggggaggaggtggaaagaatgacttgatcaatctctgttttcttcctgttgtggagtcaaagggttcagtgtttaaggacttttagagataaacacattcctttatttttatgtcatccattgttccttggcaatactttcaaataattatgaaggatcaattttgtattctgcagttcttaaaatcccaagctatattttctgaagggtgtgtttgtgtgtgtaaaccataactatttgcatagggcattgtgatgtatcatgggaaatatattcaaaatttatatatgtgatttaaaaacctcaggcaacaaaatatatggggttagaaaatggagacatggaaaataagaggagaatgaacctgggatattactttgagaacttactctcccactaccctggtgttcaaagttggatacactacaagtcatgttttaaatataaaattaaagcttcttattttaagaaacgccatgggaaagctttacttaatatttttgagaggcaaagaattagtctctcatttatgtattttgcaaatccaagttttcttacattggatttgcgtttaatggaaatgtattggtataaagtgaatcacatgtataatacatcacaaaaaaggtaaggcaacaaaaataatgtcatggattttttttttctttagatagagtttcactctgttgccaaggctggagtgcagtgatgctatctcggctcactgcaacgtctgcctcccaggttcaagcaattctcacatcccagcctcccaagtagctgggattacaggcatgcgccacctcacctggctattggccaggctggtcttgaactcctggcctcaagtgatccacccacctcagcctcccaaagtacttggattataggcgtgagccactgcgcccgtccagtgtcatggatcttgatactgaatgtttgttgtggttaaaaaatgcagagctaaaactttaaaaaaaattaatctgtggcatcaactcctgcctaactccagacaacgtgggcttttgcaggaaacactctgagttcattctcagtcttctacctaccagagtttcatgacaattaaacaagatagcatcttgtgaggtcagtgaacctcaataagctagaaattgtcttgtagttgaagatgaactttgcttggatctataccatcttgaatctagacaagcttagcagaatcagacatacctaacagattttatctaacacagttggattcctttgggagacaagaaacactacttcatctgactgtccatttagtggtgaacaattctacccaattatgtcaatcattactagttctttcttttttagttgatgaatactctttttataaaaagccacacgtagggtatacagaacaagctcttacctctcttgaagtcctatgggcttcattttgaaaggagaagggcaaacagaggtagcggtggtagctttgatctcaggagcacctcggccttgagggtccacgacaacattcagtacctttggggcctgctcaggttggaccatgctgtggactgtctttgcctcggacagtgctggctgtaatgtgatgggcgataggtggatctcctggtttttctctttgtcttgtcttaaggaaagctgaaatctttcttttaatctgtaaagaatctatagaaggagatataaaaaactcctgtcacattttctcacactaaacaagagtatgatctcctccaccccaccctggccgacaaaccaaaataaaggcttaacgataaagtaaacaaagccctctgagagatgatttctcagtttcatggtattgagatttttctcaagacagtacacttggtatttccagttatgctgcacatatgtatcaaataattgtgcacatgaatctgttccacaaagatatattcaaaagtaaatttaaccaattttatgaaaaatgccagatgttagtttggtcacatggggaaatggtaggcttacagaaggaataaccgtaaaacacacgtctatgacatttatagaaatggagatatacatccaacatggcttagtagaaaaaagtagtcttgcaagtattaataaaataatagttatgccataaaccacagtttcttatgttggtaaatctctgcattagtcatatatcaacttgagtatctggtaaatacttgacaaattaaatttagggtatctatgaaagaataatttggacaaccagaatttttattcttaccactttgccctcttaaattttaatatttattttattttatttcgatacaggatctggctctgttgcccaagcgaaagtgcagtgctgtgatcatagctcactgtaacctcgagctctccttaagggaaaagactatgcacctacgagatagaactagaaatgcatattaaacattgaactcctaagaaaagaaagacattttattgttttttatgtcagtccacctccttgtaatctggaaacttttatactggtgatattcattgactctggtagggtaaagttaaagcttaaattttgaaaaaagggtggatttggaatattcacatgataaatatttatcacatgaatgagaaagaaaagatgtctgatattaagtaaaaggtcttcttacctttataataactactttcaagcaagtgtaatgtgtttttttaagctataggatggaaaagactgaagatgaatgcctttatcatgtgcatagtgtctaaggtttttaactcactgcttctcttcagtttccatgaccttcacggtgtaaaaacaaaacctgcactagaacagtatcaatcagatgatacatatattttaggcttattgtgttcagctaaacatttaattactaaacgatgaggcaacagaatttaaaatattgttttagttgcaagaaagttattttcccaaatgaagaaacaaatatatctgtacctttacaaaaatacacttagaagataaggcatatattatatattttaagctcttcacatctaaatataatatgcatatgagaacatttgcttgcctgtttacacttggattttggagaaatatgaatcaacaacgaaaatgggaaagccaaggaaatcttgaccttctcaattgttcttgacaggtcaattttatgatttatattagtgtaaaacaaagtctagtccaaagtccttccttaccattcatgagcttatgtttttgatgagaaacctttgtaacatattttccaatcagtcatctgtttacttcatgtctggttacaggtcaactttgcaacctgtctctgtgtggtacgtgtacaaactgatttctacatctttaattagggaaaagtagaacctggagaatgtatgatgtatataagatagtgtttaaaaatactcaagagattgggctgtctgaaaaaatatggaaaaaatggaagagattgctacttggcaatagggtagttgtcatgaaattaagctataaggcagtgattctcaactggcagggattttgccctcaggaaacgtttggcagtgtctggaggtatttttggttgtcatattttcagggtgtgggggaaggagaagggaaagggtgctactggcatctggtaggcagaggctaactacctttacaatgcattggaaaggctcaccacacacccccgccaacagaaatagtaactccgaaatgtcagtagtgttgtttgtaaaaccctgacgtaagggatcataaaatttttgtggtgtaatctcctcatttcacatttaagtcctgagctattggatgagttatggaggtttggaaagaaaacctagaatccaagttttgtgacttccaggtatgtgatcattcaactctattgtttcctccaaagtctcatgtccttctttgaaacctctttccgaaagcatctggaaaagtgtgtcagagatttttctctgcacagattgagatctggaatatagcatattcatatttctctatgggaattcactttgttgaaaaactcaacctaaaagcttaccgtagcaatggcaagtcaacattttgccttcatctccaagagcttgtttgactcttggactggaataaagtcatgtaataatttaaaaaaggaaaagagaacagattattgaatgagaggagctgtaaaactcaaactatagcaagagaaagaaaataatagtgggaataaaaaaaccagaggaacacagaaatgggaggaagctaaaaaaattcgatgaagcttttctgcagcttaaaattttcgttcaaaaatctcatgagtaacacaaaacattctgtcaaatgtgttcagatttcaaaacgatgccaccaaccactagtctttaacatttgttctttacagtgttttacaattagttctgaaagagttcattcactcttttaatttaataatcctgagtcaatccctactacattccataaacaagatattgtagatgcaaaagtaacacagaactctgtcttctgggaattcataggcttccagaaaagataaatgtgtaaaaattatgttcagtacaaagtactaagtgcaaaaatagaggtgtgcccacagcacagaggtataatgtggcacacatttaccagttccatctgggtagaatggctctgataaatacagccattcgcatctgctactactggagttatttgtggccagaaatatatgttcacaagacagagtgataagactaaaaacaacaacaacaacaacaaacaacaacaaccacagtttgactcctttatgaaaacaaatggaattatggtaaagaatgctgactttcaatttagatagacttgggtttgaatttttaccactttctactctgccacccccatatccacccattgcatgttcttggtcaagtcatttattttttctgaatcttagttttctcataagtaaaattaggaaactaaaacatgttaggcatttagcactacagtaaatttagtaccagtttagtaccaataagtgtgcaataaatggaagaaactaatttttaatgttattactattaagacaattgtattcttcttaatacagaaaaaaaattgaaaattaatttgagatatatgcctacctaaccaatcattccagttaggaatctggtcctagttcccttcatcccgagggattatatttaacaaatgagaaaattatgtccacctttgacatgtatttattacatgatgttaaggctatagcaggtggttcaatgtaggatttcttgctgcggctaccagactacaactagagaaactctttccctcccatatggatgactctcctatgggtctaacatgccagtgtttttattgatccaaacaactattttcatgtgatttctaaaactgctttccagaagcaatctggcctgtagacatctctagctatatttcataaatgtctttgtacttgttaataaacctgtaaggacatttggatgtctaatttagatgataaatggtgttctttctattatttgttcaagtttaagaactaattcttcttagtaagtttctttcatctaaaacagactgaatggattggaagttgcccacacattttttcttggaaaactgtatttttctatttgtcgctccacccactgcacattcacatttgtgaggtgctaaataagtcagcatatttgaaaatgtcatgcctgtctaattttatgcctggcaacattttttttttgtattttaaggaaagtaaacaatatgccacttttcaaaaattctgccaagtcttatgttgttgttacatagcacatacaaccttccattacagcaatttacctatataattttataataaaacccatgcttttcatttctacggcatgtaggaatgccaatgcaaatggaggcacttgatttgttataaatataatcaatgccagggggaaaattctgagttatatctttcctttgtcatggaatcaacaaaactatgggaaacagagttggaatacatgtgtttcagaatcacgaaagtgatagtacaagtatcactgagaaatgcacgtgaaacacttactttaaatcaagcttattatcaaaataatttgaacacttagaaagatgagcttattttagataatcgctttgacatgtccctaaacatgaactcttgactcctctgtggtaagttccatcagataaacttggctttgtgctaatcctattaggtagtacttcttttcttgtgaatatgaacttcccgtctgtgtgctgcgggttcctctgttacttttcagaatttgtttttatttatatatttttcagaggcagagaatctgaagcccaggctggagtaaagtggcatgatcatagctcactgtagcctcaaacccctgggctcaagtgctcctccccgtcagtctcctcagtagctgggactacaggcatgtgccatcagcctggatgattttttaaacccttttttttttttttgtaaagacagggtctcactgtgttgcttaggctagttttagacccctgggcttatgcaattcccctgcctctgcctcccaagtgcagggattacaggcgtgagccactgcacttggtccccctgttacttttaaaagtgactccttcaaattaaaatttaagacagtgtttgaaatccatctaattatttctttcatttctttaagaaccatctgaacacgctcatcctcattctgaacgtgtccctctcccaggaaatgagaacatttccacacagtcagggaagccaaataacctaggagtcatccttaattttacccctgttgctgaggattgggacacagcaagttttgtcggttctactttcaaatagatctcaatccttcacttctctccttccccaccacccacccctgttctatgccaccagcatcttcttcactgggatattgcagaagcctccagaaagatcctcctccttccacaactctccccatcctctgtccaccaccactttctaccagaagaaaatgtgatttttaaacacacacagcagatcatatcaaggctctgcctaaaacattcttcccctagagcctgaacaggctaagcttattctaactgcacccacagtaccctctgcctaggggtcctttactcacatattcacccataggtctcaaacatctcaggttgctctgctccactcactcattattatggtttcttcttcatagcacttatcaacatttgattttttaaattaatatactattttttagagtagttttaggtttacagaaaaactgagcagaaaataccaagttctcacatacccttcttccctatctcttcattttcccgttattaacatcttgcattggtgtgattcatttgttgcaactgatgaaccaatattgatgtattattattaaagtccatagtgtagatagtgtagattagagctcattcttcataccttgtacaggttttgacaaattcataatgtcatgtattcatcattacagaaaatagaatagtttcactgccctaaaatctgctgtcccctacctaatcgttccctttctctgaaatctctggcaaccactgatattttctataggcttgacttttcctgaatgtcatatagttggactcacatagcatgttcaccatttgattttttaaaattaacttaattattttctatgtctccctctagagtaaagacttcaagaaaatagggatcttatctgtcttgttttctcctttgcccacagcaccagcaacaaatagacccgcagagaatattctgcaggaatctgttgattgaatgaatagatgaatccacctgctaacccaatagagagcaatcacctatacttctgaaatgctcctttcttgatttgttctaataacgttagagtcgacttccctaagtttctgacctttacattgatgttttgcaaatattgggaaaagaagagtcatcctctggccccaagtggttgagggtgtgactactataggtccttttgccacaagaccaacataggcatttatctagttacattcagtacatgagcacgccctgagttagaaatgcagaatctgaaacacattctatatgttaatagcaagctctgctctgtttctgctgccctttagtactcaaaggctgggcatgactctgctttcccacttcccttcttctatccttgcctttgctcttctgaatcacatccattgatcccctgaatattttccacttttatcactttcaattcctttctattctcccccttctcttatcctttctcatctgcaaagcagaaaaataccctaattgtgactgacaagagagggaacagcacttgagatttcccatataaaggaagaatcacgtatattaaaatgcaattaaccataacaaggaactatgtcctttaaaacagagatgcccagaagacgctgccataatttcccaaaacctcccactttctctcattaaaattctttcctcttaatctctgccatgtgaaatataaaaatcagtttttactcaattctaaattattcttttgtttattgagtcacaattcttagaaattttttttttcttaatgcttgacccataggagctacctctgaattcattatggtggaagatttagggtactcttgttacttcacagattttaaactctagaaaacatgcttatcttcaccctgtttaagactgtgcttgttttatatcctctaagtttagcccatgcagcctgtctttccagagggagccccaatctttctaacagtaaccccttcccagtaggggaagcagaaataaacaaaatccaataaaacacttagcaacattgttgattgtggagagaaataagtaacataatgacttttggggggcacttaaaaactaaggaagaagtatttatttaaatgtacaaaattaaaaagaacatagctcacagggaaaaaggacattaaaacctatttgtaaactctaattattatattacatcttgaaattttcaaatgagtagaaacatcttattctaccctaaagataccgttagttcattcaatgccaaatagtactgcttaatttagtgggttaagtttgttttgggttctatttttaaaattagaaacatgcttttaaaggctacacattattacttacagagctattccagcatatacatttatacttttgtactatttatccaccttaaaaatgaattagtagtctacctaacttagcctttgagggtataatcatctccttttcatagaatgctttcaagtccttttaaaaataaggaaatcaaccattccttagggagtaatcttgtctcaaagacatatctctttttaaattttttcctgagttccataaagatgatataaaaggagaaataaagtaaacccaaagtgtgcccgtgagactttactgactttgagggcttcagtgacctcagtaaatcactgtctaaagcttcattctcagagttgatcaagttactaaaaactgcattgcaattacagccttattattcaggtcagcatccttaattccataagctctcctttagcaatcgctctgatgtcagatatgaaatattcctaatctagcaggatcatagtcttccttctgctcggaagcattttaacattcatttgaatggcaatgtacccactaatatcaagcagtgggctgagcaaaggataaaatatacaaagaagcaaacttaccatcaaacacgttactataataacaaagatgctgagaaaaatgacaacagcataaaatccttctttgctccagattttgtccgcttcatgctgcccttgtaaaacatttttctttaaaagcaaaacagaaagtccgacgttaaatgagagcttgagaaaactggcgttcttatcagacactaaacatatttttagccttattccattcagtgtagtgcaacacacctacaccccccgctgccagagctgcttctcaaactgatctaagacaacagactgccatccttatatatcgagattatttagtctcctatgcaggagcaagcgtgcctgacatggcatctgcaggtcccaggctttctaaacatccctcagcgtctctcttggaaactacctggttcataggtaagagagttct

SEQ ID NO: 609 - DNA, 116536 bp, Homo sapiens; identical to SEQ ID NO: 608

SEQ ID NO: 610 - DNA, 116687 bp, Homo sapiens
tcagtatttagtattaagagtttattggcagtatgaaacaaagtcaacattgctgcattaaaaattcatatatgagcagaacagctagtgtttgctgagggtagttattttaattttttttgtctcttgaagattgaaagctttcagaaatgtaaggacatacatggaaatgtccttataaggagcctcgaaaatgggacagattatatcattcctgaaggcatataccttttgttgagagagagattccaggtagatagcatattcaaaaatcccttcttagcaaaagagagacaagtagttaaaactcttgatacttcagagttgctacaaatttgtttttcccttttaaagtaaaatgactcacgatgtggaaatacagtggatagagttctggagcagaagccacctttatgcccaataatagagagtaaatacatatatacccaatgacaatcattgtgctctgtaattgtttgataggagggactataaatacacatttaataggtaatattatcaagacacatttccatataaaatagttactgtttttgatttttgtttttcaaaaacaaagacttctctgttaaaaatccattatcaatcacttgcaactttagcagcaagattctggtaactgagaaaggtaatagcacttcaaaacaggaacagtttaacagctgacagtccattcacaagacagattttgcaaacattaaagcatctaacacataatacgaatgtcttcagcagctcatccagtcatcacctgatgacatttattactgaatattacatacatacattctgtgtggcagatagagtcagtacagacaaaacaaaatctgccttaggctgtgtgataaacctatcatacctccatcatcaaaaaaccttcagaataatttgggggatgcttacaaatgcattcatatacacaaggagctggaaatcttaaatatgttgcccagtcttccacaatccatgccatacatgggcttcagagcttctccttccttccattgcaggaagctccttctagaagccttgggtgggtaatttgattaatcaccccaagagattgatggtctgacaagtcttcaatgactcactggacagtctctgctgaaagtctgctctcatacaggcacagagcatggtgcacaaattcatactgctcactggtttgcaccattccacctctgcaaggaagaaatcataaaataactgattttgctaaaatcttgcaatttcaagtaacacagagatttcatccaagctagggtattatgccaaagacacatagaacagtcgacctagtggttcttttgttatccctcttacctgtgtccaaatgtctcaactatcaaagttaacatggtaatgtatataaagggcttaacacagttcccagcacacactaggcacgtgattaatttttacctgtgtaacattactggggaggtggtacagcctaatgatcaagtacttggatttggcatcagccaaggtgagttcaaatccctcctctgccaattcttagctgtatgcatcttggacaaattcctcgaaaccccttgcactttagtttcttcctctgttaaagcaggatagtaacagtaactactgctgtgaaggttaaataaattcattgtagctggtatatttgtattacttctcaggtgcctcatgattcatctcttgttaaaatggtttatacatttggcttaaaattgattgacggagacaaaccaaacaaaactcatctgcaaaatgttgctttctacaagtaaaatgaagtctaccttggaatggtttatttgaatatgttgtacagaagcaaccttagccttttggtgtacggggtgtctaaacacaatagtgggtgggtccttaaatgagttggaaaaagggaattggctctgctgtgacattttcctcttggttatcaccattatcatcactagctgcccagcaccctccttgtcaatggattcatagaaagcacttgccttcatgagaaataacggtgcttctcattatgtttttatatacataatacctatatcacattttcccccttcataattatgatccttttttaattttagtttttgagaaaacgtctccttaattgcttaggctgttgtgcagtggcatgatcacagctcagtgcagcctcaacttcctgggatcaagcaattctcccacctcagcctctggtgtagctgggaccacaggcaccaccacacctggacaatttttaaattttttttttcttgtagagacaaggcctcactatgttgcccaggctggtctcctggactcaagtgatcctcttgtcttgggctcccaaagtgatggaatcacaggcttgaacgacggtgtccagtcctataattatgattttttagcttgacaaagttaccagacattaatatgttactattcctgctcactgtataaaagcatcactatcggtaactatttaaagtcttgtaaattctctgtaactctgcaatcatgcaactgatcttatcttttagtttaactctatgttttaaccagatttttccaagtggttgttagtatcattcaaaataactttcagattatttaggcacttcaacttaaaaacaagatatcttgtctcactgtaacaagacttctagttaatggtaataataaaaactgggcttctatgtttatttgtcaatctatgtcaatattagagcagtaaaacttccttgttttaaactaaacagtgattccccaggaaaattaacatgatgtcaaaatgatgtaattggcaaaaaataaagaggtaaattcacagtttttggtgacagcaacttattgacagaagtatttaattggtcttcctcccctagagctgtacattttgttgcattgaaggcaaccttctgggctaagtattccttggtcagaagtgaacaacagaaatggccagctgagaatgtggtaatggtttatcttcttagctgtgtgatgacatctgggctcatctaaaatcatagcaggtgttccgaagatgctggcttgaactgtgaagcttgggagacaccaccacagtaaatattagggtagctccagggagctgagaggtgcctcccttcctctggcatttgcacagctcagggcaccattactccctcttgagctgcagacagtatgtggaagcttctatgtgctccacctcttaggctctggtctgtcagcttcctctcaccatttacctcactttgaggcaagattttccccttcttgtatgttctggtcagcactggtatttacatgtccaactggtgaatgaatggagacacagtttagaatttaataactgtttcaccctaagtgggtcagtggtgtaatttaatggttggagtatatttactatgacattctgttcactaaatcaaggttgttttagccagtgaaagtggggaagatggagaagcatactcattaattgtgggctggcaaaattcttgcaggtctgaaggcttcaggaaagtatatgaaaagttctcttacctcccacttaatttggaaaataaaaatgaaaaaaactggcatcagaggaattcttagagatcatccattctagtcactgacaatatagcttttttagaaatcttgcaattttagaggcagccttttccaaggttggcaggaaaacttttaagacatcaacatgaatctgtcctttctaactttcaccgcattggtccaactgaaataacccaaaagacgtcttaaggctcccctgtagtcacacaacagctctccaaaggctggaaaacagccatcaaagtcctataatcttttcttctttagactaaacatcctgtggtcactcaatatttctgtacagcctggtttttctgtcactcaccactctagtctccctcttctacaggctattttatcaaatatgaccttcttagagagttgtgtctccttctgatgagatctatgaagcaggcttattttctcttccagctgcacgttagagaccaatagatctgtgtttgcaggtgcatcaggtggtgaggtcccccagtgcctacatggtgcctggttctcggtagtattttaagatactaactgacggtgtagattaaataaaaagtcaacaagactttttttgaatgtggacattatagctttctcccatcctgtaattatgctactggatttttgaaactaaatgcaaggctttctatttattcttgttaatttcaacttgttagtttcagcacaatgctcttgtttactggatcactatctatcgtcaatatattagtcttccatttctcactcccagcgttgtgtctcccaggtatttaacaaggatcccttacatctttttatctaaggcattattaaaaaatagaaaaagagacaaagtagggtctttaatatgagtaagttgatatcatgatatatactatctaatcccattctataattatttccaactaggttgtaggtcctttaaagacctacaagcataatggcatggtcttcttctacttgtaacaataaaaagcacttacgagtcctaggtaaatacttgtcaaatgaattacccaggtcatgctattttcatgtcatgtgaaaacagataaactctaggctaaaagaaagcaaaaggtattccaggatgcattcactggaggctggttcaaattcaggaactcatcataatcatctctgaaaatattaaataaatgtcctattgcatatattgatatatagaatagtctattggctggatgcagtggctcatgcctataaccccagcactttgggagtgctggatggatcactcgagcccaaagtgggaggatcacttgagcccaggagctcgagaccagcctgggtaacatagttagaccctgtctacaatttaaaagaaaaattagctggacatggtggtatatgcctgtggtcccaactacacaggaggttgaggccagaggatagcatttgctctataacaggtaatccattcttagaaaggtcaacagagtcttctttcttcttatttttgatatggggtcttgctttgttgcccaggctggagtgtagtcatgcaatcacagctcactgcagccttggcctcccaggctcaggtgattctcccacctcagcctcccaagtagctgggatgacaggtgcatgccaccatactgagctaattttttctgtgtgtgtgtgttttttgtgtttgttttgtttgttttgttttttaagagagagagagggttttgccatgttgcccaagctggtcttgaactcctaggctcaggcaatccatccacctcagcctcccaaagtgctgggattacaggcatgagccaccatgcctggcaaatgcagttttttagataggctggtcatagcaaaaaaagaaacacctaagaagctagtacagtgtctgtatacaaaatatatttatggaataaatgtataaagcttggttaactatggaactctcaagagagctctatagttattcatcctcaggagagctctgacttgactccaggaagctcttaggtcagataggtttcatggatttgctaaaatctggatctatattactgatataaagttcccaatacaaagtggttctgggaggtgagaaacaagggtactctttttcttactttttttttctttttctttttggggcagggtctcactgtgtcatcctggctggatcgtggctcactgcagcctcaacctcccaggtcaactgatctccttagcctcccaagtagctgggactacaggtgtgcaccaatatgcatgcaccttaaattgcaaacagaagtgaaacttacctcaggttcatatctgataaatgcttatgttagaactaaaacataaccccagccaatcataagcatccaactcacatattgttatgtcagtaaggactttccaatacagtacctgaaaaaaggcaattatgtaattgcaaaccaaccaaataaattgtttgtttctgtactttcccaataaatacttgcctctggcgttttgtcattggaacactaaacctcttttggtctggtgtttcccaatgtatgactggcttcttactaaataaactctttaaaattttattgtgcgtcagatatttcttttccagtacacgtttgttttcccaggaggtataatacattaagtgaaaatacctactgctaagcaggagttagtttaccaaaaaagagtaaggtcaaataaaaatgtcaagagaaccccagctagctgagagaatggtgccaagttcattaccaggggggaccagagtatgttaagagggaaaaagacagcatacactgttgtcaagacaaattctgtctccaccacttactagatattttacccaactacacaatctctgcagtgctcagttttttcatctgcaaatgatgcgacaataaaaacaatagttcctactttatagcattgttgtgagaaataaatgggactatcacttaacatgtttagcacatagccaagcacatatcaataccataaatgtcaactattattattgttattgttattgttactctttggtaccatctggtcaaataggactggttaggaggctctggagtgaggcccccaaagaccctggagaaccaagagcaaatctggcagaggacattagtttgcccattaagttccaaatatctttctaaatattgaccagcctagaagacaggcacagtggaggcagatgatgaaaatagtaggcttggagtctgacagattcaggtttgaatccttgtttttttaacttacttagctaaatgattttagacaagtcatttagtccttcccaacctggcttttctcacttgtaaaatggcataaatgacaaacgtcatcgggttgtgaggattaaatgaatcagagcatatcaatgtctggctgaaggctattcacagaatccccagaagcccagggttctacaaaggtggctgaggaccctgggcagggcagaggaggaggatgggtcattaggactagatgccaatcccagctttgaccagggaagttgtgttttttattggttttctgtgttggtgttctgtggaagattctgcctgcaaaaagttttccattgttcacaaagaagtttgaaaaccactggcctggctaataaggtatttaggtatttatctaataaggcttcaagttttacaaggtttaaatgagagaatccacaaaactcttggcacagtaactgcccttcagtgagtactaaataaatgctgtgtattatttttcttattcttagttaatacgacacctagggtaaccatgtttggaagagttgtggttcattggtgttgtcctggtgtcattatcaattgggtcacctttcactctcagaagtaccttggtttggatgataaattatttgttcatcctaatgatgccccattccatgctgtggaagaaagtcattccctttattgcaaaagtggtgttagccacgtggcttggatttctttgtgcccacagactatgaaatgctgtgtttggccaggccagagaggattcagatatactaccctcctataaatgtcagataatctcatatcacattagccctgccaaatacaaagatcagtgtcgtctcagtctccgtgcagaacagcacgtagctgtgtcagctgggggtaaactcaggttagaaagggaaaaaaaaatgtagttttttccctttgctactgggagggtgttttgaaaaaaacctctccagatgcccaggagagagatttggcttttaacatgttaaaattttgaccttttgtgactattcactcacacatacagagagcaacagcctttcctgtcgtaccgcccagcccgtatccggtctaatcagtagacagaagaaattctgcagtgatgactcacttctgggctaacaatgaaacttatgctcctttgctttttattattttcaaatctggaattcttttggtaaagtttggtacagtaaatttagaacaaaaggtgtggacgttaatgtgcctcctgggtaaagttccaagagcttgggcatgagtcaagtgaggctactgtctgctgtgcttagccggggtcagctgtaaggtgtgtctggccccttggacagaggatttcccatggctttacacagatgtcatatcaaggagggagaacttaaatgtaaatttggccaattctgaccaggtattttgaacatagacaccttctccaaaatagatgtgttctaaagtatttgtaggtcataaaaatcagcatatatcaaatgataattcaattgatgagtctaacatattttgagttccatttttttttcctctgaaaattagccgttttcctctgaacactcaagttaacacctaattaactccaagctaggaagaaggaaaatgtcctggcagccacttggaagattcagtcagcataatatgttttacaaagtagacctcttgttgtgatctcaggaattataatgtcaagtaaatccacaccaatttctagggctttatctccaagtgtccttaaaataagcaaatcaaaatgttgaattcctgatcttcaaatgagatctttgaagttcattaattagaggaatctttgtgattatttgggaatgcagagaaatatggataaatgtaaggttacagttgataaaccttagaccaacaagcagaaactttagttttgaaattatttcaaccaggttttggaaacaaaaaatatgttggggacatatattagccttggaaattgatggcatatatattcttctgagatggctgtagttaaaaaaaaaaagaaaagaaaatcatcgaactgaagtgactaatcaaaacatttaaacaatgatatgatgcacattggaagcatctttttatcctgtgtgggaagccacaagtgaggcctttggatgtcattccagtttaagccctctaaggtaaggatgtacaggcaactacaaattccatccttgactcttaaaaagaaggatttgacagataatttcctgctactcaggaagaaaaaaaagaggaaaaaaaaggccttggaataagatattattttatatgtttcacttcccaggttctgttttaaaattcttccagtgtccagttgccaatgggattaaaaggaaaacgatgaggaaaaagttatctgaggtcaatctgcaatggaatatgttcctttcctgcctgcttagatgtcttctgatagtcacgaattgatttgtagtcatacttctgtaatatctatatgcatgtgaagcactgtctgatgttaaaatataaacatcatctatagtaataaactgagacactgcatctctcatgctaaatgtgtaaatgaccttctgtcactatctcaaactgtagaaccttgacatacccaagcctaaatgaatcttttttagcaagagctacatgcagcgaagctggttggcttagctttatagcaattggtatttttaactaggtggtatagttgaacaatttagtgatatttgagattagaaggtttaagtattatatggaagggctttctaagtaataaaaaatgattatactgtgttcagtttagtactaatgttatggatctttttttcaactataattttaaaaaattgacctatacatttacggtaatctcctgttaataggaaaatgtgattgagcaaaatatcccttttgcaacaatgctggccaacagaaagttcattgtacttatcatattcagatattaataagtaatctaaactaaaataatcagagataaacaatttttcctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaatttgagcaaaattgaaagttcagttcagagtgttttataaaaacttcaaaattggtcatgtggccttggagatgtccccttttttggttttggattcttcctttagaatgaaaactttgggcaatatattcctgaggctagattttaaaaaaaaacccacccttttcctaggagatgtttggcaaatgttatgactattgcggctatcccattgttctccacataaacaaatcttcaaagactcaaagaaagcaagagctgagagggatctcagaaagccagttggtcactctgcaatcactgaattccagcatggaaaagcatcttgttagaggagtcctgacatccacttaagctttgttgtgagtcacacaatgaatattaacttgcaagcattaaaatacaacaatcaggtggaggtccatgaaatatcttactcttgatagtaagatatttctggtttttataccagaaaaggttggagatcactgttacgccccacatctccttttactatgtagacagagaggcctagagtggacaaatggtcacacagaaaattagggggcagagccacgcaccaagctccttgacatctagtccagagatgtccggcacctcattcttttgctagtcttaccagtgttcagttgcaattgccataccacccacttcatcttttaattaaaagcgaatgcagtgggaatgaagggatgatcccttaatgcccttctaaataaaacattcgtgggtgccttgcactgaatttgaactcctacttggaaaaaaaaaaagaaatcttattttagttcaaaatatgctcaaaagtattagtaaaaggagaatcacagactcatgaatctgcaatgagaactgagcatctattaatagaagttgtcacaaagccaataaaaataatgtcttgccagagaatgaggaatctaccaaatggttttgtcattgttatactggaaatatccattcagcataacacattcgtctctgaaccagaccatttgaatttattactaaaatgcagatttttaacttgagtagaaattgcttgttcttttcatgttaaattacaatgaccaggcattgtaatttttggggtggtggtggtggaaatcaaaattttaatcctatccagtgttcaagctcttgactgatcggtcatgaaatgagccccatttcaagtatccaaatcactgccttgtctttttctttgctgttagccatacctggactcctcagaggaggcagctacaagtggagaggggtagattataagaataagatgcacagtatgcagccttcattgctagtggttggaggttgttaaaaaagagtagaaaaggatagaggaaggcctgtgaagctcgtattctgccgaatacaaaatatcagccttctgatatactggttctgtcttttctctctcttattacacttagctgcttttaattagttggttccaccattcctttcccaccacctttgtttttttgagtctcactctctcgcccagcctggagtgcagtggcgtgaagtcggctcaccacaactctgcctcctgggttccagcaattctcctgcctcagcctcctgagtagctgggactacaggtgtgcaccaccatgcctggctaatttttgtgttattagtagagatggggtttcaccatgttggccaggctggttttgaactcctgacctcaagtgatctgcctgcctcatcctcccaaagtctgggactacaggcctgagacaccgtgccgggcccttttcctctttttaggggtccaggttcaggcttaaattactatcctatctctagtcttctcttcaccacaaagcttcttgaaagaacagcttatctttattattacaacttctttccctctcatttagatggttcttgaggaaattcatctgtggtcaaataaatgtgaaagagtgcttaaataaaattaaaggagtttctacattggaagattttagattttttaatgcattaatgcttattgtgagtctccgagtggggaagacttcgaagaaatatagtgtagggctgggtgccatggctcatgcctgcagtcccagcactttggcagcccgaggcaggtggatcacctgaggtcaggagttcgagaccagcctggccaacatggtgaaatcctgcctctactaaaaatacaaaaattagccgggagtaatcccagcaactcgggaggctgaggcaggataatcgcttgaacccaggaggtggaggttgcagtgggcccagataatgctactgcactccagcctgggtgacaagaaagaaattccatctcaaaaaaacaaacaaaacaaaacaaaatatatatatatatataaacagcttttccccgaacttagtcaagaacctactttgtgcctgaacgccaccaagagggtttggcttaggaggctctcagtaaataattgttaattaaactatgtcctgagaaggacaatctgggaaactgggaaagctggttaagacacccatttttctacacccaggtgcctgattcatgctcagtagcagatgtctagtgatgcctgttgaatggatgaatgtatgcaggattcaggagcaccactctgtgcagaggtctcagatgcctgttccacagaacacaggatgcaggcccatctattaggttggtgcaaaaataattataatagcaaataccccaattactttggcaccaaactaatacaaacactcattccattctaaaaatatcctaagacagagttagcttcaagggatcgtgaccagtgcagtcatatacctctcaccttcttgtgctgagaaggaccctgaacttgggttaatgctttgctgtcactgtcttgaagtatttgatactttttaatcaacagatgccacattttcattttatactgggcctcacaaattatgtagctggtcctgcccacagtgtcccttggagtgctcttcagctctgtcttagtgccgcttgctttcccaagacaagccatgagcttatctaacagtctccttgattgaaggacctcgccatggcgtgtccagcatcggaagccctcttcaatttcccttcaccaaaacccaagttctgaatgtattcctaatgccaggagttacactctctccagctaccacactgaaaagaacagatcacttcgtttagattgaagcgttaatagcatagtagatatgaagtgttatgccatctcccatctccagattcaataaactttagaaaaagataattcttttaaaagaatccatccaagattagctctttactagcagtattttagacattcgctatacattttagcatcctccatagatagatattttaagaagcagcaatgttttgtccctcaaattgtactcttaaggcagttgccgacaacgtcactccaactattcataaaggagctctcatttatactaaaaactgttttaaaaattatggtgtcccgttgtcattgcattttgtttttaagaggtggagttttgctatgttgcccagggtgggtggcctcgaactcctgggctcatttgtttaaaatggcagagtattatcaaagagatatgtttttgtcaagaagttttacaataaacatattccaaaagcctatttacttttctataagattgataaagatcagagaaataattagagatcaggcaaatgtcccagattccaataggtccattttgttacttcccaagctacttgactttggacaagttactcgctatctcgaattctttggttcctcattaaaaaaaaaaaaattaggccaagatgcttcttttccttcacttgggtttattttgggagttaaataagtcatgtgctttgaagaccatggtgaagagtccatgattaaatacattctgtatgtattaaatacatagtgcattctggaatctctggacagattcagagctgaaggtaaggatagccaggaaaatcggaatttggggacaaggtttgaacaagtgatgaagaaagatatgctgcaagtgcataacggtagacatttggattggctgagaccagttttccctttactgccatgagccaaaaacatggttaatggcagcagttagccacacattggaatttttaaaatgaggtatgataggaaaaagctgaaggactggaacaagaggcaagaataatgtgggagaaaaagaagtaagatgaggtgaaacgaaagggataggttttctgttctgcttttcataacaactagaagagtgtacaacagaaggaagagacaagaaaaggaaaacatatgttgatcctgtgaaggaaggaggctggaggaaagacctttcaaaggaaggttcaaggagaggatctgtttcataaacaacagaaacagctgctcagaaagaatgcagaaagggtcttgatgaagaaatcagaatgattttgatgcatatattggcagtcattcaaactcaagggggttgggtgcctataggcttcagatcagcagagaagttggatgtgttttcaagatcctatcagaagtgaaaagacaagacctctgggaagaccttggtggtgacggaaggccaaggctaaggtttctgaccatttgctttaggaaggaaggagcagatagaggaggcattgtgatgtggtttaaaaaaatgcatttgtaattccattcaaaactagaggacaatttgttagacctgaaaggggaatgtgactgggaagtggaacccaaggtggaggtcaggctatgaaagtgggcaggggaggtgggagatgggagggtgagcaggcaagaattaatggtaacataacaagagccaagaaaaagagcaaaccaagcctgtttttcagcacgttcttccaaataggatcagaacaggtgttgctggaggccagcttggtttggagtcactttagatccatgcatgtgtttggcattcatggagttctggcactaaacaagaacacaggactccaaggtatgaactggagtccccgggtgatttggggtctcaggtggcagccttgtctacagaagcacaaatcaggacagatgaaagtcaatgtgggagcagctctggctgactgagtgctgcttctccccctcagagttagggcccctttcctgtgtgaagacaggccctaaaatttgaagtgaagcaactgatcctattccagctgaggtggactacacaggatggaaggcaaaggaatatcaggagattaaggcagcaattataagaggagaagggataattggaactgatcttttttatgtaccaaaagaaaacatttttggaagcagttacatgtggggtgtggtaagagggaagcaggattggggggtaaagagaggataagcaatgtaggctgagtgttctactaaatacatttcaggtttaatgtcatttaaatgtggctgaagtcctgtgagttatacattactatttccagtttacaggcacatgttaggttccttgctacgtatagtgataacaactgtggaaacttgattgaatgcttattacacaccaggcatttcacataggtcatatcatcttttcatccttacaataataataggaaatatatactactattactccaattttccaaatgagaaaactgaggcatggagaagggtagtaacttgcccaaggccatacaaccaaaaaaatggtggaatctgggatgtaaactcaggcaggcaatctgtttccagagcccagaatgttaatcgccatgatgaactgcttctagagtttacatgctaacagaaagagaaaataataaagaaagaaacaaacatagtagaaaacaaacagggaagatacggttagaaagacttagaggctactgtctaaaaaggagacaagaatgttacagatgggaagggaaaaactaatctggatagggaaatttgaatgtttatttttttagaggtaagagaaacttcacagataattttaataataaagatgataataacataacaaacatttattgagggcttactatgtgccagactctattccaagtgttttacatatattatctcatttttcagaataatcttcttgtcttttttattgaaatgccaggacatagcacatagtgctcaaagcatatttgttgaaaaaaaaatctcgaaaggtaattatatggcctggcacggtggctcacacctacaatcccggcactttgggaggccaagatgtgaggattgtttgagtccaggagttcgagactggcctgggcaacatggcaaagccccagctctacaaaaaatacaaaactcagctgagtgtggcacacgcttgtactcccaggaggtcaaggctgcagtgggccatgatcacgccactgcactccagcttgggcaacagagcgagactctgtctccaggaaaaaaagaaaggttagtgtataattttatctttttagaaaactctaggtcatagggctgaagctcaagggaatcaatgcctgtgtccctctttgttttattacttcacagcatttatttctgtctgaaattatcttggtttattttgcttgtttattatctttttctgctagcatataaattctaagagagcagaaaattcttgtttaatgctgtatttgcagcatctagaccaatgcctaggcatatgaggtgattagtaaacatttgttgtttgctgtttgtttttagagacagggtctcactttgttgctcaggctggtcacaaactcctgaactcaagggatcctcctgttttggcctgccaaagtgctgagattacaggcgagagccaccatacctagccaacaaaactcttgttccactgtagtacactgaattactgagcagagacgcctgctgctcatcattttgtgccttctctgaagcagcatctgtccactttctccatcactaactcaatcgtccatttacccaggcaggcttagttgtggagcaaggaagaagagaagtttcttgtttatcttgttttcaaaacaaatggagattataacaaaggtgatcaaaccatatctctataaaaatgactcttccatctcaccctcataaggatggctactatcaaaaaaagcaaagcagaaaataaaatgtcagtgaagttgtggagaaactggaaccctcctgtgttgttggtgggaatgtaaaacagtgcagccactgcagaaaatactatgatggttttctcaaaaaattaaaaatagaattccgtatgatccatcaatcccactttttgggtatatactcaaaagaattgaaaacagggtcttgaacagatatttgcatacgcatgttcatagcagcagtattcacaatagtcaaaatatggaagcaactgaagtcttcatcaattgatgaatggataaacaaaatatgtgtcctaaaatggaatattattcagccttaaaaagcaaggaaattctgacacatgctacaacatagatgaaccttgaggatattatgctaagtgaaataagccagccacaaacagacaaatactgtatgactccacttacgtaaaaggtgcctagagcatttaaactgacagagacagaaaatagaatggcagttaccagttgggctgagagaggaatggggagttttttaatggatactgagtttttcaacatgaacagaattccagagattggttgtacaacaatgtgaatgtacttaaccctaataaattgtccacttacaaatggttaggatgataaattttgtcatgtgcattttgtcacaatttaataaaaggattaaaaaataactttgggagccagatgcagtgcctttcacctgtaatcccagcactttgggaggccaagaaaggaggatccctcgagcccaggcattctagaccaacctgggcaacatagtaagaccctgtctctacaaaaaaaaaaattacaaaaattagccatgtgtagtggtgctcgcctatagtcccagctacttggggggatgaggtaggaggaccacatgagcccaggaagtctaggctgtagtgagccataatcacaccactgcactccagcttgggtgacaaagtgagaccctgtctcaaaaaaataataaataaataaataacttcaggccaggcatggtggctcatgcctgtaatctcagcgctttgggaagcccaagtgggagattcacttgtggtcaggagttgaagaacaacctgagtaatgtaacaagaccccatctctacaaaaaactaaaaaaattagccaggcatggcgcacacctgtagtcctagctacgtgcgggggctgaggtgtgaggattgcttgagcccaggagtttgaggctgctgggagctgagattgcaccactgcactccagcctggatgacagagcaagaccttgtctcaaaaaagagagaaaaaaaggctttttaatataatgcatatacttaagcattttacaagcatctctacagagatttaggaccttggagcctgagatgtttatgcatgaagtcaggctgatgagatcaggctgtgaatgaaaacagtgctctgaaggcaagcctctgtgacactcacctatccatacgaagctggcagacaatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattataagtagtaggatgagaggggtggggggaagtggtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggagagaaagaagaatggtgatgccctgaggccaagtgcatgctggaatagggtgaatttgaaggaggcagggaaggggagttttgccttggacatactgatgttcagaagtctagtgaataattgagcaattgaagattggattcattttaggagagggtgcagctagaggcacatatttccaagagatttgtatagacatgataattgaacagaaatgatgtctgtcctggtgggtttatacattcaactgccttagacgatatgtccataaaatcaacctcacaagcacacgtgctctctctgtctctgtctgcagttttaaccactaacagtctctatgtaaaagattctttcaaatctacatctagactccctaaatttcctaaactctagattgtcattccatctcctccttactattttggacttgcttcagttcaatgtatctaaattcaatgtatctaaaacagaattaattatcttttccctcaatggcattaccagtctgccacaagttttccagcctagaagtcttggaaccatcttttacatctctccctttctcacctcccacatccaatctgttaccacttcttctattttccatctctgctgagcctgtgggattcatgctttcctttctatagactgtaatcacgttttcaacatctccttttttcatgattagcagtgatctcattatagtttccaagtctcaagtcttttccttgacaaattcgcacagctgctaagttcatctttctgaaatagggacttaattatatcattccctactcaaaacctatagatggctccattaactatagcataatgtctaacctccctaccatggtattcatgaccttgcaaaatctgaatgtgactaactttcaagccttatgtattttgctgtcttccctcccgtgtgccatgattttcacttacgtcaattgtttgggcttttggttttccaatttttctgtgttaacaatgttttcttggtcagaaatgccctccctccttttaaaaccacaacattgattatttcaaaaggctcagttcagcattattccaatttttagaggttttcttcagctcccatggttggaaataattgctcccctcttggcactcaaatagcacctatttctcacatttggcacttgttttctgttgaatgtgagtgcagaggaattcagaggagtggctctcttttagctgaagtgtccacagaaagttcatttcattgaagaaataggattggaactgtgccccatgaatggcaggtattttggctgttataactgagagagaatattctaggtacgacaatgatatacaatgaaagaagaaaagaattaatgagaaacagcaaatatgatttgcaacaataagtagaacagcttgtcttgaagagaaagttattttagtggaactatgggaaataaagatagagaggtaccctgggatcttatatggaaggctaagtggtttgaaatacatccttttttttttttttaagtaagaatttgatgaagactataagcttccactcttcagaaaaattcacataagtttacatactcaaatgtgtccaaataatttcaaggagttcactgacctctgcggtttatggataggttcaacgttagggacttttgctctagttttttttttttttttttttttttttttttttataagacagagtctttctctgtcgcacaggctgctgaaatacagtggcgggatcttgactcactgcaacctctgcctcctcggttcaagcgattctcctgcctccgcctcccaagtagctaggagtacaggcacattccaccacgcctggctaatttttgtatttttagtagagagggcgtttcatcatattggccaggctggacttgaactcctgacctcaagtgatctgcctgcctcggcctcccaaagtgctaggattgcaggtgtgagctaccgcacctggcccattgacaagctttgagcagagactccatgtaaggtgagacggagaaagggcacaggtaggccatggtggcggtgagagcatgggggaatgcggtatgtgtgtgcattttaccagctacttctaaaatacatggatgaggtcagaagggcctgaactatggtggctggacaggaaatggtgattatgggagaagctttgaagggaaagccaatctagtgactgattagatactgatgttggagttaaaaggaggaccagagataactgtcaacatgggatcctgagtgactggaaaaaagatagtctcattctcagaaatagtaatcagaaggggagctggttttataggggaagtgactagttcattttagatatcctgagtgtttaatgactttgggtgggggacagttccagccctaacgcatagtcagttaggctgtttttttgtttttgtttttttggctccaagttaagtttaggataaagccagtattatctacctttggataaatagacacatagtaaactttactcttaattaaaccacacaatctcaaaaaaggaggctaaaattatactctaaaataatatatttattaaatatatcatcaaaagctgacttaagagacctatgcggttaaacaaagcaacccaaattattttgagaaagcatgaagaataaatggctggctgggcatggtagctcacacttgtaatcccagcactttgggaggccaagacaggtggatcacgtttgaagtcaggagtttgagaccagcctggccaacatggtgaaacccccgcctctactaaaaatataaaaattagccaggcgtggtggtgcatgcctgtaattccagctactttggaggctgaggcaggggaatcacttgagccaaggaggcggaggttgcagtgagccgagatagcgccactgcactccagcctgggtgatagagtgagactctgtctcataataaataaataaataaataaataaataaataaatagttgttcatataaattactttaaaaatgctgccttcagtttggttacattaaaaggaaaattaggggaaggaggtatcagttttaggaagagagctttgaactagaaattagggacaggaaccagcacagaccctgctgctgttgttggcttggcctctagtgctccatgttctggtaacagcactttgttttcctttggtgacttgctcacttctcatttcataaatttgtttcaacctgtttttctggagataactcttaaaataattgactggttttcaccaaacttgaaatagtaatgttaccaagatacaagccaagcagagttcacatgtcatgttgaaacaacaaaaaagccactgataatttcaaaaagtgcatctttattcctggtgtgtacaagactgatgagactaaatcaatcaatataagtttcaaagcagataactgctgaataggtctcctgttcactgagccatttattacgaacttgtatttcgccgactgtgtaattgttgtttgtgaaaaatgacctaaaagcatgacttcacttctgtcagcataatcttgattcagactcaaatattacagacttaaccaatttcaataaatatttaatttgccaacaaagtcacatccaggaagcaaaacccacttgcacctgctctgtgactttacaaagaatgggccattgcttagacagaaaggaccatacacgtcttacctgcagtggacaaccacaggccctcggccctgggaagcaagtctgtcttcttctacatccagcatgagctgtaggaggggctgggcactgtctggagtcttgtgatcaggccatgaggtgtaccagtaatgcttcacatgttgggtgtggcttccttgctgaaaatagcaacagccaccaaatgcctcattcacttgtagaactaaaagtcatccaaaccacaatactgaatgccttttatcacccccatcttgctggcaatttatttctaggtgggaaaaaaatttagaagatttttgaagagtgcccttttactttgagaagactttactgtcagtaacctgtttgcaaagtgagaaagtcatacctttgttgagatttacatctctacctatagttataatatagatcatataagtaacatatgctaaatatatatttataatttattataataaacaagatggtaggtgaaaatgtagccaagaaagaatgagatatattttgtttcctgctctatgagcattcctgacaagttattataaacatgttaatcaatagaacacttaatttcatatcagtcatgctaatacttctacactcatccaaaactccagtatttaataggagtgaggaatcacagcaataaagaagctacatgagatccctctattggaaacacttgggtgagggcccacacacctcatctccaaacccagcacgggtgagggtgtggcatgaacctcgcactccagaacatgtgttgaaaaataagttttggtaaatgccttcctattccaaacttccccggcactccagaacatgtgttgaaaaacaggttttggtaaacgccttcctattccaaacttcccaacaaaagccatcactgtagctctgcccctgttttcttcctctttgtgatgattctatcccagcagtgaggctgcagataagatcgaaatttttgggtgattattctccagaagcaaaaataataccatggtaacatttctcagcatctgctgcccatgagttaaataagatagttttcctatgacataatctcgtctggggaaagtccctataaattactgtaactccacgcttctgaagatctcatcaacacttcaggcttgccttgcttcccactgccacccacaaatgcagattttctctttcacagcttccaggccttacgcaaagctgcttagatcaaaatgacattaaaaaaaatcatggtaaagtctccagcacagcctttagttaaaagctttcaaaaggttaaatcagagatattttattaacgcaaattagaggatcacaacatcctacataatgaattttcttaatgtctacttacattcatttaattatactgcatattaatagtagttgacaacaaaaaatacatgagggaatgattatagtttctctttgatcttaacattatttaatttgcttaaattgcatttgtagtacttaaataatttcaaagtagaaatgtaatcctctaacatcatctactttgtagatggctatagctacataatcttacctttaagacaaggtttcgaatggtgtagttatcacattcatttacactgataaccagaacctcaacttttccatatatccctctcttttccggccagtatagcacacatttctggaggaagggaaagagaatacagcaaatattaatggcttttattagccatggagtacttttcattcaagcatctcaagagttttatatcattagttttaaaatatcaaatatcaatttttatagttttgtaaatatactaaaaccattgaattgtaaatcttaagcagctagattttatggtatataaattatatctcaacagttttttttaaagtatcagtttcatatgtgcctattaaacactgtcactgctggctccatacaaaaaaaaaaggcagaattacccaaaactcctcagagaaattaagaactaattaagaagttaagaaatttaagagttaagaaattgagatccaaatattagaatttatcatgtgctgactagaaataaaagaatgttttcccacaataattgaggaaagttacattttcctgcttcaacaaacttatgtctaatgagaatatctaatatgttaggtggcatacaaccaagtttcctttatatgtaaggcagatataatgatcattaatacaactatggtattatattttcccggaccaacagtttttttcacttatggaactaatttacaaaaattacgttaaaaatatttttataatggatcctcctgaggagctttaaaagagtgacaataattatactgcaagcaaggcaacatagcatggtggttaaggcgcaggctttgaactcggaacctgagtccaaattttggttctaccattcattacctgtgaatccacgaacaagatacttaaaccctttggttatagtttctttattattggctatctggaaagtacttaggataaagccaggcatagagtaagcacttacaacatgttattattgctgttgttattttaaaactactgggtgataggtttttggcccaaagtgattagatcttcatgcattaaatattattttggtattattatagtcagttatcattattaaataaaaattgcaaaatgagattcaagcatacatataatctcattttgctttttaaacaactgtaaaataactattttttaccacaaattttgatgataaagaatgtaaaatgacaaatgtttatgttttattttgagtgctcttggaagcaatgttaattttagaaatgtttaaatagcacttattttctcccaaccatacatacatttacatagaaattctttcatttgttgccttcaatcagaaccttttaatacccaggacacttgtttcttcacatctttgtcaaaggcatatgaatacacttgataaaaatttaaatacttatagatttaaaagagcagcaaaagactcacaaaattatagaactgaaggaaaagtgacacaaagtatcagaaacacacctccagggctctattatgctaagtaccactactctacaagctagcacagcgaaggaagtcacttcacctagcagaatcagtttctttcatccattacaataaaaacacatttacatcctctacattttgaccctttttctaaatgaagtaaattgtttcagctttatttacatgccacctgagactctcaggctatcagaccaaaagacttactctggctgacttaatgttaacattaagagaagaaacctttttaaagtagagcaactcatttctctcgaaatctatgagttgccaaatgtctaaaattttcccactttgttaaaggtaatcatacaaaccaatttgcctggtttctttcaatgaagcatcaattatttcgctgtaagacccgagctactgtgtatcttaaaacccatgcctcccgatgagtccaagaagaatgacaaagaatcttggaaaaggtattgaacaaagaaagaggcattcattcagtagtccagcagtctggcgtacgtgccccattgtccacgatcagacctgagcagcagggccctctttaggaaggtggctctcaaaaccagtaagaaaagctgcaaagcaggagcttgccgcctgcaccctgactcttaatacttgcacaggcttctgcacctacttgataaatggaaatgctgctcgcttctctcccaagcttgccgggggccctcttgaatgttttttttgactcgttaccaaaaaagcaattggcagtcagctcccagtagacaatgcaatgtgacttgttcattcaaacaacccttaattagcatcccatctcctttctgagatacaatagcttatttttacacactgaatacatttttccctcatttagatgacagaaaaagagaccagataagtgtgggtacttttgaatatgaggtgggggacagctgcaaatgcagttgtttctaagagtacaagttcatgttcaaattattttcctgtacagctttttagggtttctttattgtggtgctaacaatgagataaaagaggcagaaaaggcagggaagaaaaatgctgccttacagataatactgtgaaaccacactaattgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgtgcaaacaagttattatcaaactctgactgaaaagattctggacattaaccagtgctttgtaactggtggtttacagcaaaagtaggatgtaacacaaagcaatgcaaattctttttttttttttttttttttttttttttttttttgtgatggagtctcattctatcactcaggttggagtgcagtggcacaatgtcagcttactgcaacctccacctcccgggttcaagcgattctcccgcctcagcctcccaagtagctgagattacaggtgtgcaccatcacgcccagctaatttttgtatttttagtagagacggggtttcaccatgttggccagactggtcttgaactcctgacctcaggtgatctgcccaccttggcctcccaaagtcctgggattataggcgtgagccactgcgcccggccgccagctcatatttttgtgatcttttttcttcccttgattctccttctggcccccaccaagttagggctatgtgaggaggcggtctagctagttgtttagttgcctgaaaaaaaaaaacctatttttaagttattttctttttagtttctatatatttaaatatcagagatattgctctataagctaaagatctgtatcatcacatagaatgtggctctaagtaaataaaatcttcatacttagcttcatttgggttatattaatacatgagagggatagaatgggtcaggttgtctaaaattattattactatagctacttttattcctggtgctccgatggaatattactgacataggctcagagatttaagtaccttcaccaacatcatatcatttagccccttccacaatcctttgaagtaggtagggtgggtagcaggtattattattatttaaattatttttcagatgaggacatgaaggctcaggtgttttggtaggggaaaattgccttggggggctagaattttccaagaaaatatcactttatgaatgaaactttccatctttgatttccacactgactcttaaccaatgctacttaaccacagcattgaccaatgacctgttccctctgtcaaatatgttgaggcacatgcaaccttgcatagtcttggttcactctcctactgagctcagtacttctgttaccatcttttgatctctgtgttcctcaagttgtttttataccaaaacacctttatggcaggtgtacttattattgaagtccagtaatttaattacatattacagaaatcaataaaatatgaggtttaaaagagaaaagagctttatgagataattgaataagttgcgtaagtttttcactggtgaaaaaagtaaaccagtaaagaaaactacagtcaaatcagggacaggtgagacaatgacagaaatttgtctctaagttaaaaaatctaaatagaaaactgcatttatattgtttcataggcttttctattttctctttcattttaaataaactaaaatggaaaattttgataatatataaacaatgtgattgacataaactatatgatctagaactccatcttcagaccaacactcataagactgaaccccataataaacaaacacatttgaatatgaacaaatgtacatgttttaaaataaaatactttttttatgattctcacattgaccatttttgattaactgtgtgtttttctgttttttttttttttttttttttttttttttttttttttgagacggagtctcgctctgtcactcaggctggagtgcagtggcacgatcttggctcactgcaagctccgcctcccaggttcaccccattctcctgcctcagcctcccgagtagctgggactacaggcgcccgccaccatgcctggctaattttttgtattttttagtagagacggagtttcaccgtgttagccaggatagtctcgatctcctgacgtcgtgatcctcctgccttggcctcccaaagtgctaggattgcaggcatgagccaccgtgcctggctgattaactgtgttaaacaagagggcttctaactatagttggaagtaaagcaggctaatgcagtttaaacataacactgtggattaaacattaaggtgcaaagttagatttggaatatatgcatgcctggaaggacaggagagtaattttgtttgggcgcagtcagcatctgaatttctagccacccttaattgcttggtcagcatacccatcaaccccctggttacccatgaaatgaaattaggctgcctgtcactgctggacagtggtggccaggttgcctctccaccaacatgatggccctaagtcagaggctaggtggccttggtcatgcttgtggtggctttggtctctttgcttcctgttgaatctatcttgaatggattcgtgtttcataagcaaagtcctgcatgagatcctaatttatcttgtgactccaatttatgctcatgaatccagttgaccagcgacagcattcataatatctaattctgatcctccaaaggaaagctgaataccagaaagggactctcttctgcttgcttgctaggttggactcccacaataataccttctctgaccttgtttggatagaccctctggttgtgggacttggtttgctcgtttcttttcattcattttcaaagcatgaatcctttagtctactccacagtgatctgcaaattgaggacgacttctccctcataatcctagtccacactttcaaaattgtccactagtttgaataaacagattcaacgttttttttaaaacctgatcaaaatgtcttgtctatctcctcttccaaaagagaatggttatagatttctaaccttgaatgtaagcaatcatacataccactttctggatgcaatcacttcttgcactgtagactatcctttcccaccataagtggattccaggcagcagcatagtgtaatggtgaggaggaggaagagaaggaagaggaggagaggaggataaggaagaggaggaggaggataaggatgaagaagaggaggaagaggaggaggaggaggagcagcagcagcttgggagtcagctgtttggctttgggcaagttgccttcctgtgcctcagtgttctcatttgtaatggggtttacaaatatgtttactataaagattaattttcaagcacactgttagtgctccataaacagttgttcttcagaagatccaacagtccaatttctgagctttccatgtatatttgttgaaccttctagattaccttttactctactttttaagctaattataaatgatagagaagatatattttcattttatgcatttagaatttaacatggcacacttaacattttcttattagtatcttaccagaataatttattttctcctcaaacatatagtttaataaagtccactttattttaaagtaaaatttacatatctattgagtagccaatctttctatctgaatgaatgcacatctgattttataatgaaatttaaggcaatgtactccattaatgtatacttactacatacccacaaaattaaaaataaaaatttaaataaagaaactcttttgtaaaggcaaacatgggctgtgctcagttgcttagtcaatatttatatttccaaaaaaactttcttggaatgtatttaattaatcaaagacatatatggtagctgcaatttgacttaatgaggtcttaaggtttttgtggacaataaattggaaacaatttaagtacctatcaataaggaaatgattacattttagcacatccacacaatgaaattctagtaatttaacattttgatgaattattaatgacatggagaatactcataatgttaaaagcagaatatacatcataatacaataccctcttttattgtctttacaccaatgctgtaccttctcatgacatctgatctctctcacctgtgcatttctccagagtacccttatttctaactgcttaatagacttaaaagactttaccagccagaagtctccaacatttatcaaacttaacaggttaaagatgaaactgatatcacatccactcaacctcccaaaccagaagtcctgaagtcaagctctcacttactcccattcgatgagaaactaagcactgtggtttctactgctggaacacttaaatatatcttccaaagctattttatatatatatgctatttatatatatatatatacacacaagctatgtgtgtgtgtgtatatatatacgagctatatatatatataagctatatatatacacacaagccatatatatatatgttatacacacacacacacacacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccacaagtgatcctttcaccttggttttctgaagtgctgggattacaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccgtttgcaaagtactgaataagtcaatgggcaaaatggggcttagagtacttaagtcaagtagtttaactcagatgaaagatgcatgtaaatgtagagaaagagtacagctgtgttaaactgagagcagtgtgttaggccaaattatccagtaattccttcacttcatgaaagataggttcagggtcttattgctctttgggaccaaaagtgggttgcttgccttctaatgtcttaattctttatttggctccttataatgttggggcaatgattaagtgcctgggctttggaattaaacaagcctggattgaaatttggactccatcaactcactaactttgaggctctcattctctctgagctttggttttctcatttataatataggaatagtaaaacctactttgtagagttagaggaaaataaactgaatttatgtgtgttcaaattgtgcttagcacatatgatcaataaatggtagtggctagaaaacatcttccactgtgtatgtaatatggtcaacatgtatacctacttcccttcttttctgaaaggggagagaaatgcagtaagtaacttccagaagtagtatgggggctttgtttcgctggaagtgtgcaaaaactacttgccattttggattgctcttgcagttccagctttataggtttaagccactatgtcttctctagcagtggaatttgaacactgtcatttcaatgtttccttctctgaagaggaattccctttctcttgagatttatctaaatgaaggaactcaaacttaccagcaataaaatctctttaattgcaacttaactgttttttcagctatgtatattttcatttttaatttattttcattttataaacattgaggtcatgagaatattggagttattaaataagagatggcaattattcatttatttatttgctagaaagtagaaagttgcatgaaactataaagcctgggaatttctaaagataactccatctccatatgttttttggaggaaatgatttttgtcttttccaaacaatgacgcttaacacaattgaaagttggcacatttttggtaaacagaattttcctggtagtgtgaagtctactgtgtatttcttttgtgccagacttctcagtatcattttgatctgtaaaacatcagcgtttcctgtattgtattatatttacgtctttggagagtctagacagaaatttttattttaaagagtaatgaataataaaaaataacaaaatttttattgtaatatttgggattatgactggctgtagggaaaaaaagcacaaagcagattacacataaaagacatataacataaatgtttgactttgatatccccagaaggtatatctcagacattaaaaaagacaggaggctaaaaattgtaacacgcaaacaaaaatcatttctccaatttctgaattatgtggtcaaagaaaaaaattaaaacttcaaccacccattggtgtaggaattgttaaaaaaaattctagctttccacagatccatttggctctcctgtaaagactgaaatctgagaatggtaacaacaggttatctctgaggacaattactgcacttgagaaagaaagaacaagatacgctttattcccttgcagatactgaatggagagctctgagcatcataggtaaaccaactctgtgtcactctgaaatacatatttgaggctgctgcatgcagttccccggctagctgcagtcattggtgccagtgctcaggcacctgctgtccttgacctctggccccacaagcactaacccagcgcaggaggaccagccaccgccgccaggctctgatgctggtctctggtagaagaaggttgctcacagctctgctgcaggctcagaagtggccctttcaaccctccagagacatgagactagtccagttccaggcaccccacctggtggggcctcacttgggcccagagatggagaatggtggaagggttatcaacctcaatgcctttgactctatgctccccaaaatgatgacacagttcctagagcagggagaggccatcctctcagtggcaagaagagccttgggtgcccagttgccagtcctaccatggttggaagtgacctccctggctccagccacatggccagataaggtggtgtgtgtgggcatgaattatgtggaccactgcaaagaacagaatgtgcccgtgcccacggaaccgatcaacttcagcaagtttgccaactccattgtggagccctatgatgagatggtcctcccatcagagagccaggaggtagactgggaagtggagcagctgtggtcattggaaagaaaggcaagcacatcaaggccacagatgccatggcccatgtggctggcttcactgcggctcataacgtgagtgctcatgactggcaaatgagacatgatgggaaacagtggctgctgggaaaaaccttcaacaccttctaccctctgggccttgccttggtgaccaaggacagtgtagcagatgcacacatcttaaagacctgctgccaagtgaatggggaagtggtccagagcaacaacaccaaccagatggtggtcaagacagaggagcggatagcgtgggtctcccagtttgtcaccttttacccaggggatgtcatcctgactgggacctccccaggtgttggtgtattcaggaaaccttctgtctttctcaagaagggagatgaagtccagtgtgaaattgaagaactaggtgtcatcatcagcaaggtggtgtgatggctcctgcacaggccctggtcataggatgggggcatctgctcccactcagcttagcccagggaaatgtcgaatgccaggtgtgggcaggtgccagccctgtaagcctcctcttctaggtagaagggagaaggatagagctctcttcaataaatacgtcgggccaaagcaaaaaaaaaaaaaaaaaagaaagaaagaaagaaatatatatttgacttatacagcagttctggtacaatgacatccttggtcttggagaaggaggatgagagcaaccgtctgctggggctttggcatattaataattgctcacatcatccctattggatttctttaaaatatgtcacatattacacaccctctaggaaatgtcttctgcctaaccagcaatcttagtttctgtcctgctaaaaccctgattcaagaatgaggtaaagcactaaaggcacattcctgactttttctataagagtgaacacagataaacatacattacaagattcaaagattgaaatgctcaaaagaacaaacaccgtaatgtatcttacacagttattacaatgtattctgtaatccttgtgagatattgtttcacatatcatttgccaagtgttaatccttagtacatatgcaacactaaattgcatgtaataagtaagtaatttttctggggaaaatattatttgttttaaaacatttacatacttatatttacaaatagtttcataaattatggtgctatgttgattttataagattttatttgtaatagaagaagaaatagaaataataagaaatatttaagggcatgaatgcactttgaaataatatttattttatgacaatttactcagaaaattcaaaccaaagtgggcaggggtaaggcattttgctcagatctacgaaatggtgctaaatattgcatgaagttgttcatagtgtcctcttttatttaaatctctgctttaattatagtcatttttaatggttttttttgcatttcctttaattctgctagttttgcctattttattagacttcaaaaaattgacttttgtttacatcaatcctttttaaaaattttttttaaggcagggtctcattttgttggccaggctgaagtgcagagtagcccaatcataactcaccacaacctcaatcttctgggctccagggatccttttgcctcagccttctgagtagctaagacaacaggtgcgcaccaccacccctggctaatttttaaattttttgttgagatataagtctcattacattgtctaggctggtctcaaactcctggcctcaagcaatcttcctgactcagcctcccaaagtgctgggattacagaaatgagccaccatgcctggcctcatcaatccttttatctttgttttatgtttaacatttattcttcattattccttccttttttctctcctgttcattttatagttcttttactaacttaagtctgttgcttagatcacaaattcttttataatatcatattcatgcctataaacttccttctatgagcatttttagcagcatctcacaagatttgatgtgtagtatttgcatcatccctgaattgcaggtaatttacagttatattataaattcattttcatccatgaattgtgtgtgtgttaaaactttttttaagcatcaaagtgtattttttaatcttatctttctgctttttatttctaacttaatgcactgtaatcgaagcatatatgtacagttattcctggaaatttgccaagacttgctatatagtcgtagttggtcacttttcacaaaatctcatgctttgaaaatttatattatgagattattgattggaaggttctatatatctttcttaaactaagcttgctaatttgaataaaggttatgtataaactttttctatatttttattttttgtctgcttaataaatactaatatctgatttttattgggttttctcccagtgtgatggtgatttatcaattccttctttaattctgcccattaatgcttcagatatttggggggaggttatgtatattatgcatttatatatttagaatcttacttgtgaatttcacattttagtgttatagattgacattccttatctctagtaagctctctgataatgattgttttgatttgaaattcattttcatctgacattctttatctctggtaacctctctagtaattattcttttgagaatattcttttgagaattattcttttgagagtcagttttatctaacttgacttttgattagtattagtttggtgtatttttttccatcctttccattttaacatttctgtgtcctcttgtaggcagcatttaactgaatttatttattttatcagtttggtaatctctgatatttaatttgcaagttatttgtttatatttagtatgatttggatttttttctatctcccaattaggtaaaagtttatcctgatttttctatattaccttttgttttcccttttattttggtttattttcgaaattctgtcttttctctcttctaccagattggaaattatacattctaattccatccttttagtggctaatcttaaaatttgaacatgcatatttacctaaaagtctaaccttggcttatatttctcttttcgtgaataacacagaaatattttaactttcctcatcttctcaaattttaaatactatcattatccagtattttagtttcaccttcatattttactttctttgctcactattatttcttgtatttgagtactttttttctggattgaattcttcttcattctgttttatcctcccttgtagttgttttggtaagattttttttggtggtgaattcttaccatttttgttagtttgaaaatgtctttcacacctggccctgtaggatagatttgttgggtataaagttctgggtagtcaagtattttctttcagttctttgtaggtaatattctactgatttttggcttctagttttgctatagaaaagcctttttttttttggttagttactctggtgggagtaattactttctttggtgctttttcagttccagagatgtgtctagctgtgatttacatttacctattcagcctaggatttattgtgctttttagatttttgaactcaagtcttccatcagttttggaaaatccctatctattatttcttcaaatattacttcttttctcatatcctcttctttctccttctaaaacacctgttatggtatattggatatcaaatactatcctctatgtctcttagacactcttttttatttttttgtcattttgatcttctaggtattttccttagctttatatttgaatccattagttattcatttagctgtgtcttgtttgatgctaaacctatctaataagatttttttaaactttaatgtctttataatgtttatttctagtatttgttgttttaaatcttcatagcctttttggatagtaacttgttcctgtgtcaaattttttatgctttttgtgcttaattatttaaaagagtagcctacatttattatttcagttattttaatttatgtgaatctatttaattgttgctgcttctgattttttctcatggtttttattggttgcttgtatgcctcataattttgattgtaggcttatgtttgctgagagttttttaattttattttaattgacacagaattgtacatattcatattaatgtgatacttcagtgcatgtatatatgggttaatgatcaaataaaggcaatcagtatatccatcactgcaaacatttattatttgttgtttgtagtgagaatattcaaaatcctttcttatttctgggctctatgttccatattccattccattggtctatgtatttgttttttttgccaatatcatgttgctttcgatactgtaactttggggtatattttgaagtcaggtagtatgatgcctccagcttttttttttttttgtctcaagaatgatttggctagtcaagatcttttgtcgcttcatacaaattttaggattaaaaatttttttccatgaagaatgttattggtattttgatagggaatgcattgaatctattgattgtttagcgtagtatggacattttaacaatattaattattccactccatgaacacaggatatatttctgtttatttgtgttctctacaatttccttcatcaatgatttatagttttcagtataaaagatatttcacctctttggttagatttatttttaggtatctctatttattggtagcaattgtaaatggaattgttttcttgattttgtttttagctagctcaccattagcatatacaaatgctactgatttttgaatgttaaatctgtatccttgaactttactaaatttgtctattagttctaacaagttttggtgcagtctttagggttttccatatatatgatcatatgatctgcaagcagggatagtttgacgccttcctttccgattttgccttttatttctttctcttgcctgattactctggctaggacccccagtactatgttgaatagaagtggtgaaagtggatatccttatcccagatcttaggagaaaagctttcaacttttccacattcaatatgatgtttgttgtgggcttgtcatatatggactttttagtgttgaggtacatactttctgtatctaatttgttgacagttcttatcatgaagggatgaattttgtcaaattatttttcttcgtctattgaaatgatgatatggattttatccttcattctgttaacgtgatgtatcatatttattagtttgtgtaaactgaaccattcttgcatccctgggatgaattcccttgatcatagcggatgatgtttttaatgtgctattgatttttactaatggtttactaatattttatgagcatttttgcatgtatatcagagtgacctgtagtttcttttttggttgagtccttgtctggtttgggtgctagggtaatgctggccttgtagaatgagtttggatatgttctctcctctttaattttcttgaatagtttgaggagaattggtattctttaaatgtttggtagaattcattggtgaagccatcaggtcctgggttttgtcttcaatgggatacttttttttttgagatggagttgcactctgtcacccaggctggagtacagtggcatgatcttggctcactgcaacctcccagtcccgggttcaagtgattctcctgcctcagcttcccaggtagctgggattataggcacgcaccaccaagcccagctaatttttgtatttttagtagagacagggtttcaccatgttggctgggctggtgtggaactcccaacctcaggtgatctggctgcctcggcctgccaaagtgctggggttacaggcgtgagccacagcacccggccaggataggttctgttactgatttaatttcctcactcattagcgttttcagattttctatttcttcattgttcaatcttggaaggttgcatgtgtccaggaatttattcatttttttttagattatccaatttgttcgtgtagtattgttcaccatagtcttttataattctttgcatttctgtggcatctaaagttttgtcagttttatgttttcaaacatgatcttttctttttattgatgttttgtatttttctgtctgtatttcatttatttctgctttgatctttcttatttacttccttctactaattttgggtttaatttgttcttgtccttttttattttttgagatggagtctctctctctgtctcccaactgcccaagatggagtgcagtggcatgatctcagctcactgcaacctctgtctccttagttcaattgattcttttgcctcagcctcccgagtacctgagattacaggtgtgtaccaccaggcccagttaatttttgtatttttagtagagacagggtttcaccatgttggccaggctggtctcgaactcctgacctcaagtgatctgcctgcctcggcctcccaaagtgctgggattacaagcgtaagccacgctgcccagcctgttcttgtttttctagttccttgaggtgtgtcattaagttatcatctttcacttacatttcaacaaatgtaagcatttattgatataaacttctcttttagaacagctttttctgtattccaaagactttgatatgctgtctttctatttgtctcaaggaatttttaagtgtcccttttaatgtcttcattgatccattggttgtttaggagcatattgtttaattttcattaaacaatatttgtaaagtttctgaatttcttcctgttgttgatttctagttttataacattgtggtcagaaaacatatttaaaatgattttgatcttttaaaatttgttaaggcttgtcttgtgctgttaagaaaaacgtgtattctgcagttgttgggtgaaatattctgtaaatatctgttaggtccaattggtctattgtgtggtttaaatccaatgtttgtttattttctgtctggatgatctgtccattgctgagagtggggtgttgaagttgaagttcatgattattactatatagcagtctatttctttctttaatctaataaataattgctctttatatttgggtactctagtgttaggtgcatacatatttacaatttttttttgttgaattaacccatgtatcattatataatgatcttctttgtgcttttttgtgatttttgatttgaagtctattttatctggtataagtgaagctactcctggtctcttttagtttccatttgcaagtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgacaggtaagaacttactcctgccattttgttaactgttttctagatactttgtttctttcttctacttttattgtttccctttgtgacttggtggttttccatagtgataagctttgattcatttctctttttgatttgtgtatctgctgtaatttttttctttgtggttattctggggcttatgtaaaaagaacttagaatattttaagctgataacaacttaactttggtcacatacaaatattctagactttcccttcccccatccacaattcataatttccttcaggtcattattttaaattccttttcaggcaatttataaatttccatttctttaggggtcagttactggaggattcttctgcttctttgatggtgtcatgtttctttgctttttcatgtatcttgtatccctgtattgatatttgtgcatctgatggaatggtcaactcttttaattttatggagtgacttttgaagggaatgactttcaccagcagatgtgtctgagggtattggttgggtagggtacattggcttttgctctatgtgtgtgcagtagtgtagtctctgcaggtttttaagctgtagtcaactttattgataacctctgaaggccttggtgtggctagtttgctggctcaggacaggtcacccctggaaacagcacacttggctggtgagcacaagaacaaatccactggttaaggtggggacccgctgtgagatgcatacatggctggtgagcatgcagcagccagtctgccagcttgggttagggattctctgggggcagtgtacttggctggcaagcatggggcttggcttgccaactcagagcagaagtcccctgaaaatgacatgcccagctggtgagcttactggtggtatatgcggacaggtctgccagctcaggttggggcatccttagaagtagtgcacccaactgttgagtgcaccagggacatgcaggggctggtccactggtttgggtgggactcgctttggaatggtgcattcgctggtgagcatgctgactgctcatgaggccagtttggacttggtttctctgctgatcaagattgtctgttcctttgagggcaaggtgctatatgggcttcatggatggggcactggatctaggctctgagagacagggttcagggtgctgcagtcactaggatgtgaaaggtggaacacctcctaggagcttgttcccagggggtagggagctgtagcaactcagcaagggaatggtgtactactgtgtgtgaaggtagtgtaatggcagtgtagccttaggaatgaaaagagatggtggctactggcccctggaacaggatgtactctagttgtggctctggtttcaaaatggcatcatatagctgcagcttgaatcacagggatgaggggatacaatgtgggctccttctctggggcattgcagccatgtggctgtcaggcagctccctaaactggactcagggtctgtagaaactgcaggattctcagcaacaaagagtgcagatgtctgtgacattaatgggggctgctggggcctcttgcttgcctagtccccactggggatgcatctccttgttctgagctaatactggctggggagatggcggtgtggcagaggcagagtgcttcattctcttctctatgtgaccctcactaaaggtctccttgtctcacaggatttctgtctctctcctactgtattccagtgtgctccctcaaacactccagttcaaacatactttcttatttgttgttttggctcttttttttggtgggaagtatgagcattcggcttctctagtcggctctcttgctttgccctggctgggcttttctatggaaatctgtgaggtatatgctgagagtatgtgcatcagaaagtttttgccttcgtttctgtaaagtatcatagggcgttaccaacctagtattactttttatgttaatgacttcacttggtgtttcttgatttttgaattctgtgatttctcagctttaaatactcaagagagccttttcgtttataccataagaaggccagacttaggcgaatttcttagcatcatcctatattagtaggcagatttatttttgttgttcactttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgttgttcacttttttactggaggtgttacctttgaaggtgctcactttatgtaaggtctcagttccaacacctggctcctgcaagatcaggctttgtctccagttcttgtattaccattacaatatgtttaattttctggttttatgccttttagtctctttttattaagcactgggatttcctttactttttttcaaagctcttctttgcatgctgtttcatattctgcacagtgtaactggttttgtagtgagaggtttttcaggttatctagtctgctgtattacataagttctatgtaggaatgcacaaatgtacacatacagagaatacacctcttaaacttgaaaaatcttttctatcataaaaatgtcatgcatattaaacaactgtgaaggaattgtcagtggcttaatatgttgatagattgacactgtgtgggaaacagctgagaatattaggggttatttttataatgccacctcaggctttaatatcagattcatagaagtgtgtttagttagtaagccatgtagtgaattgagtatataaccttatctactggccaaaaatatgctatttttccagaatatagtgtgtttagttagtaagccatgtagtgaattgagtatataaccttatctactggccaaaaatatgctatttttccagaatatagttcaggaaaaaaagttttatctattgtagcaaaaatataagaaaatcacaaactttaaaacacatataaattgctgttttgtgagcctagatgatgtccattagcagcaggattatgctgtactcaaggattataatcaccaaaggcttataaaggaatgcttagttttcttaaattcttactgtcatggtgaagctctggtacaatatttttgacaagaaaacaaacactgaaatgctgattaaaattagactgtaaataatcccagtaagttgtcctaaaatgaaagcggtacctcggatatcagccctcaggaatattacaattgtatttttataatgcaaaatacagaataagtattctgcaagctaaatccttagaaaagactactagtatggaaatgaaatcaaattctgtctttcttggatttcttattatgaagatattgagaaagttgattggtttctgtaactgtcctcaaatctcgttttcttaatgaggctcaccttgcccaccctctttgcattattaaatgtaatctgcaattccccatcaccccctccttactgcctggtatacccattccacttagcctgctctactttctttcctatagcatttaatctcttctcatatattacactatttataagtttattatgtgtagtgttgtttgtctgtcttctcccactagaaagttaaaatctaccaagggcagggatcttggtgtgttttgtttactattgtatccccaatgactacagtagtacctgtcacatagtaggtgttcaaaaatgacttgggtgtgaatgaataaggttttatttatctgcttataaattagggtgataattcatggccccttatttcttttgtgggtacaaattagatatgtatatgccaagtatattgacttgtctgaaagaaagttgacattcataggataatagcacttattatatttgggatgtattaagtgacttagcctttaaatgtctcagagtttccatcttaaatctaagtccatggcaattttactaacacagtatctcttctatagcaacagaacacatataacattcagaacttgattaaagatcatacctcatttttttctttgagttttgtgatcataacaatcacagggctgtcttcctgccaaaccatctgccagaaatcatccacggtgttgatcatggggccctgcgtggcaatgaaggctttctccttgccactgtagccctagatggagtaaagaaacaaaaatattggtttttaagttcatgccttgcagtgaaagtgtaggtgaaagatcttcaacgaaatagctgggctagtacaaaagcaacacaggttacggcttcactgactctagtacaacaatttccatgggtattttggcagcaagttaaggatagcacatggtactgagggttgtaatgcccagtccccagcagagtacccatatagagcactgttgccagagactcacagtgaaaggaaagtcatcataaaagacccattaacaatgttgattatgactaagataaaaaaccaaacaaaatgaaatcttgctggtaatcaagttaaaccaagcttaatctactctaggaaaaagaaaataaaaccaacaattccaaataggaagtcaccagaaagaaatttgtacttatttacttaccctaatataattagcattaatgtaggtgctcaatgaatcggttacattttttggtcttaaacacactctgctgaggggatctaatgaagaaaacaaaaaagaatatattaaacagatttaccctttttaaagttccttagaatgccaataaccagtaagtagaaacctgttatgtattgattatctggtgcatgtcaatgtttgtctttggtgtccattgcttgatccatatgtttattgagggacatttgggcctgtcttcactcctgacataaagctcatccataagcctaagctgatgagtttatatttcaggccatttctcatctgttccggttctcgacctcatttctcatttttgcgcccactcttatacttttgatctggaatttgtaccaggtctcctcactcccatctctctcctttccctatggaggtaaatcaggctatactctaccaattatttatattttactatctcatctcatttagaccctcaggtctgaacctcaccttgtctgaccattatgtcctggccagatctcctgatcttccgagatggatgagattaataatctattacgtgctatctgtgtgaggataggcaagccaggggaagagggaggttgcaaagataaagataaacatgattcatttcgaggctgggcacagtggcttacactgtaatctcagcactttgggaggctgaggcaggaggatcccttgagcctggggcttcaagcctaggcaacatagtgagacttcatctcaaaaaaaaaaaaaaaaaaaaaaaaaaattagccaggcatggtggcttatgtctgtggttccagctacttgggaggctgaggcatgagaattgcttgaacccgaaaggccaaggttgcagtgagctgagattgtgccactgcactccagcctggacaacagagggagagcctgtctcaaaaacaaaaacgaaacaaaacaaaacaaaacaaaaaactatgattcatttcagtgagttttcagtctgctcataaaataacaaacaacatacatttattgtttattagatgtcagagtctgttctcattgctttacagatattatatcatttaattttcttgtaactttaataaaagtacctaagataatgggtaagactccttccccatttttcagataggaaactaagataggttaaataatttgcccaaaggtacacagccaagaagtaggtaatggagtcaggctttgaatccacacgaacactagggtaccattagccactacgctgtgctgcagctctcatgcgaagatagctatgtaagctgacgattaaaatacaaaatgttatatcctagtggttgcttagttactttcttaaaaaacagcaaattcaatgcttttcagcttcctttctcagtggagtgtggtgtaaaaacaggggtgcagcaaagaaaaacttctcccattcccatatttttttagtaacacactatcattgaacatcttctgggtaaacacaatctcttacgttccccacgaaaactgagacaaagaggaggtgaggtaggaagtactagacgaagaaagtttcatagaatatatttaaatgggagctaaaaataattaaaaatttaacaggacttggcaagccaacatttgttttaaatttcactttatatataactggggttaaagataataaaggccataattagtttcagaaaaaggctaaccagcccatgaggacggtgatggtttaaaaatgtagtcatccaattatctgacactccttctaaaagaatgtagtagagactaattcctctcatcttgaatgtgggcagaaattaaatagaatatggcagtagggatggtgtgtgacttggtcataaaaggtattacagtttcctccttgcgctctttcttgagttgcttgctctggaggaagctaatggccatattttgagggcactcaagcagcccaatgaagagagaaatagtggggaactgaggcctccagctgatagcatatgaatgagccctcttagaagcagatccctcagtgccagccaagtgttcagctgaccaaaggcttggccaacaactcaattgaaatctcatgaaagaccttgagccagacactcaactaagccactccccaattcccggcacacagaaattgtgagatataaatgtgtattgttttaagccactaaattttggggtaatttgttccatagcaataaataggtaatatagggaccaataaggagtcagtcacaaaactctggagtgatatcatgatcactgttattgtcattgcactcattgttgactcctatatgtgtcaggtagagcaggtaacagcattttattcattaggtcacttaattattacaattctataacgtacatactgttaacagtctctttatttagattaggaaattgcagcacagagaggttaagtaactcacccaaggtcacacagtaagaaatgaagcagagagttgaaaccagattaccaaacttagaatttaacaaggccattatcaaagatgatgttgaaaatatatagtaaaattttgctaatttgtcactaggatatttgaaataaagatattttatatatatgttatatatataaataaaacaagtaataggagcttctatccaaggatggataaagtagatttgagctataagggatctggctttggcaggagaaagtcccattctgcttaaagctttagattgacttgtgaagaccaagatgcttatctgatcttataggccacaggtaaaatagctcctgatcatgccatatggaagcaatgtctagaagatgttaataaattctggaaatcagtgggaagacccttaggtggcatccaagaatcctgttgatcgaggcaggctttcattcagtttgaaccaaaacactttgcaaaagatcctagcatgtccttttgggtgacctaaaggaagtagggtgactacagagaaacttacagtggaacaggtaaggactgttcgaatcaggatataacctaactgtgaacaaggaattgtggtcctatgctcatcagcatggaaatctcttgagacatgggctttgaacttatcaaaattcctcctcaagagatatgttggggctactggtactgaagcaaactaccctctttaaagcattctggaaataagtccaatctcagtcttgtccttcagagctttcaaaatgtagaccctatggagatggaagctagcaccaaactttcaaaagcacttcattttcccccaaatctcatacagtcttaacagatctatctctacatttcctacaattgttggtcaggggcagactgaccctcacttgcatgagccattttcaataagaaccttgtatcttattttgtattcataatgttgtattcattttttaagagtgtcttccagggcaaagttccatgacattgatgtgggcaaaaatttcttggatatgaccctgaaagcacaatgaaagcaaaaatagacacaggggattgcatcaaactaaaaagcttctgcacagcaaatccacagattgggagaaaatatttataaatcataccttaagaaggggctaatatccaaaatatatcagaaactcaaactactcaataacaagaaaataatcgtattagaaaagggataaagatttgaatagacatttctaaaaacaagacatgcaaatgtccaacagatctacgaaaaaatgttccacatctcaaatcatcagagaaatgcaaattaaaaccacagtatcacttcatacctgttagaagggctattatcaaaaagataaaagataaatgttggcaaggttgtgaagaaaagggagctctggtaggctgttggtgagaatgtaaattagcatagccattttggaaaacagtatggagattcctcaaaaactatgaatgaactaccatatgatccagcaattccacttctgagtatatatccaaaggaactgaagtcagtatgttgaaggcatttctgcactcctatgttcttgcagcactatttacaatagccaaggtttgaaaacaactggagtgtccatcaacagatgaatggattttaaaagtatggtctatatacataatggagttctatctggcctttaaaaagcaggaaattctgtcatttgtgacaacatagatagacttcacagatattatgctaaatgaaataagccaggcacagagagacatgatcttctttatgtgtggaatctaaaaaagttgaactcatagaaatagagagtagaatggtggttaccaaaggctaggtgggtgggtgaatggggaaaggggagatggtggtcaaaggatacaaaatttcagttaggagaaataggttctggcgatctattatagaccatggtgactattgtttaataataatattatatatttcaaaatagctgaaataatgggattttaaatgttctcaccacaaaaaataaataaatatttgaggtaatggatacattaatattagcatgatatgatcattccacaatgtatacatgtatcaaaacatcacattttaccccataaatatatacaactgttattttcaattaaaaataaaataaaacctaaagagtaatctccaaataatataagctttagctcccctcccttccaaaaaactaaatctacccttgttggtaaaacctctcagtctgcataaaatctattacaccctttgtaatgtagaaagacttctgctagactgctttttgttaccttatctttttcctccaaggggtcttgaacacctgtggagctgaattttaacattgagagtgaaattattccattgtttatacgtatcttccgtcaatcctattgatcaaaactcttggcagatcacaaaataacaaacaaggaggagaagccacagtggagcaaacaacatttattgcacactctccaccaagaatctcatggaggaggttccctgctgggagcctttggctatacagcgccctaaaagcttcttgccaagcatgctccgtgctgtctggcatttttgctgtcaatagctggagcacacaatagtacgcatatccaaatatgtactttaagagctagtcgtctcctagtagtcaccatccctgtctttctttagcaataagatcccaattctggctgagaacttggtaggatgcacagcttaagacttcccttcttaccaccccttgcattagttgcggccatgtgactaagttttcacttatagcaggtgagaggaagtgatgcgcgtgacttttagatcatgaaattaaagtgaggagtgatgttcttcttctaccacttctgattccatcttgctgcctgggatgtggtcatggtgatcaggatcttagaccatgcaaaggtaataccctagggatggcgaggtaaccagagagattagtctggaggtataacatggcaaagctgccatatcaaccctggcaggtatacttgagagggaaaaacacttttaaattatttaaaccactgttatttgggttgtggttaatagtatatataagttttctggcaaaaatatttcagaaaagaatagtattatcacaaaatcagttctgcctagggaggcattaatagaataggtacatcccaaacatctggggtttgtatatattcagaagtcaaattcagggtttcttagagttggagttcgcatgtccaataattatcacgatctataaaaaataacgttttagcaacataacaaaaggtaatcatcattttagtctaaaactaagccctcaggccccataacattgccattagaatgcacgcagtgattagttcagtctggatagccctaaattgcttattgcactgatttcctttcttctgacctacaacaaacacatggcctggacagaagtctttttcactatttggaagaagctgtctttagttagcatatgtagcggtttgttcactgacagcacaagtatctgatattggttagattcgtttagtgctagcaacattgtcttaaattctaaaatcactttccatcaagagttgaaagactctttgtggactaaagtgttacggaaaatgtggaaattatttttaccatcatttgcatacattaatattactaattcgtctctttatgatttctttgacctggtacactctgagctttttgaaggcagggatggggatttttcaccatctttataagatctaatgtcttgcatagcagaccttcagtgaatgtctactgcactgatttaaagatctcttctattttttaaaaaaaggtcagttctatatatccttctctagcaattattctattgcttttcttttttagacaggcaaacttctgaaagagtttattatacacacacttcctccatgctcatctgcaactcaatcctcctcatgtacactgtgatctatcctaaccctagcactgtgcagagactgcccttgctaaggtcaccactgaccctcttgttgttaagcccagtgatcccattgtggtatttttgttcatgtcctctctgaagcattcaaaaactgttgactgtatatccttttttcgagttttctcttcccttagattctgggacacaacgttctggttttcctgctcccttttcggtggcctctttccaatctcctgctcatttaatctgccccttttcatgttgctaattctaggattcaacttgaccctcttttatcctcacttgatactgccttgttgagtgactcattcattcctgtgactttattacgcacatcctgagggctctcaaatacatacttcagaccagcccggtctcctcatttatagtccagctttttctatttattatttccttctgaatggaccacaggtttgtgaaactcctcatgcccttcatgtgttcctgacagctttctgctattgtttaggttaggtgtgctgccacagctctacagtccgtgtagagtttctgtgcatttgaatgttagcatattctgcctgttctgtctcctaaaatacgctggggtctgtcttgcctctctgtttgcatggctgtcttcttggactaggactcaagtatctcctggtctccctgccttcaatcttgcttttttccaatccatcctcctcatagctgtcaaggtgctctgtaaaacaaaatctgatcacatgattccattgtctaaatgtcatccatacttcccaattgcccatagcagtatttcccaaaatatttattacctgtaaatcattacctctataacatatagaattatactatatgacttataaattaagtcatcttttacaaaaagaggttagtacccaaataaatatgggaaacattgggttaaacaaatctgaaccatattctttttactgcaggacttctcagggtcttcagtatgttaatggaccctgtgaatttccaagaaggtattgtatataatcctatttgtccgttggactcaattttattatacctactgtatttacatacttaactattatatttatatacttattgataattcagtttagagcagccctgatcaatagaattttctgaggtgatgaaaatattatctatctgtgctgtccaaaaaatgtagcctctagctttcaagcacttgaaatgtggctagtaaaaactgagaaactaaagttttaattttatttaattttaattcatttaagtgtaaactgacctagccataagtgggttctggttgctctacttgacagtgcaggcctagaagatgaatgccaagaggggtacttagcaagatagagcagatccttaatgatcatcccaaggcctcaccaacagctgctttcccacgtgtatcatataatctagccccatggacctagggcaatctcccaaatgttctatgtttttgcagattttatgcttttgcacatattgtttcctttgccttctctgcatggtaaagtcttcctcattactcagggctcaattcagaaaatactgtctttctgaagttctccctgaccttcccaggcagaattaggcattctcttctttgcttgggtcccctgagttttattttagtatttatcatcttgtattttaagtgcttaaatttctgcctgccctcaatggagtgtggtgagcccctagagggcaaaggctgtatttaattcacttttgtatcctttgtgatttctatttgggatgtggctcacagagggtttaatgtcagaattaatttctatgagaaagagttaaagccctgtttttgactttctagatatttttttcttttcttagcaaagaggacaagaaatctttcatgcctttcagtatccactgattgttagaagtttccataaacatcctacaccattcaggcttgaaaagaggcctgcttccttcagtttttataatgcctatgatgtatatgatttactggtaaagctaaaaactgcttagaaacagtttccctgtaaagctaaattatgttggtaattagtaacttacagtattttccaagtatttagaagtttccaaatcctttttattaaaaattcagagaggggagtctcactttgttgcccaggctgaattgcagtggctactcccagatgtgatcacagctcactgcgacctcaacctcccgggctcaagtgatcctcctgcctcagcctcccaagtagctgggaccacacatgtgcaccaccatgcctggctacattttgtattttttggtagagatgaggttttgccatgttgcccaggctagtaattaaactttttttgtgtgtgtggaaatggggtcttattatattgcccaggctggtctcaaactccaggacatgagccactgtgtgtggctccaactacttccttttacaaatgcaagaatacaacatataactgagtatggggaaatgtaggtttccaagaaaaactcttgtaatatatagcttgtactaaaaaaaaaagccaagaattaaacaaaaaatgtataatcatcatcgttttcatcactactgttataaatgaatgaaaatggggctcttgagtactttgcttttaaaactgtaaacttctctatacatagatggtacccctatttcctggaattggttctgaggttagaaatggattcatcttcagttagatagggagggaaagagaaactaacattagctgagggcttactattagttggaactttgacagacattttacacatactatcatttaattttctcggtagccttgtaggagagtattgttatcactacttttgggaataaaggatggcatagggagattaaatatcctgccaaaaattataaatgtttttgttggggtaggaaatcaaatctaattccagtatcttgctttagctacataacttgttgctttaatgagtggttcacttatttgcatatctactctgtgctaggtactttatataataaaaaaggaaacataatttaagtaggaaacattattagatgttaaaattttaaatataaaatgatgacctgagtaaatggcattctttaagtgtatctatattatcttatatttgtatcaacacactgcataaaagaaatatgcatacaatttattattatagtgcagcactattcacaataacaaagacatggaaacaacctagatgcccatcaacagtggattggataaagaaaatgtggtacacatacaccatggaacaccatgaagtcataaaaaagaacaaaatcatgtcctttgcagcaacatggatgcagctggaggccattattctaagcaaattaacacaggaacagaaaaccaaatattgcatgttctcacttataagtgagagctaaattctggatacacatagacataaagatgaaaacaatagtaactgggactccaaaaaaagggagggagggaaagggagaagggctgaaaatcttcctattgggtactatgttcactctctgggtgtcatgccgtcagaagaagcccaaacggcagcatcacacaatatacccttgtaacaaacctgcacaggtaccccctgaatctaaagtaaaaataaaaaatttaaacttattattacagtattttattgtgtgctaataattttctattgatgtatgattattattacagtattatattttattgtctgctaataattttctattgatgtatgattgttttttcctactacttttgtgatttaggatgtagacatatttttatcactaatatttgtttacactgcaaaataatttgatataaacttgactttagcattttaatctcagccaagataacactgtcattagagaaatgactataatttaatttataattataaattgatttattcataattgattcttgcctatccatatatctgttgcaaggcattctcagaattgtataatgttgctattatgtacaagctgtcaagcttttagaactaagaagagtttagtgtaggttaaaactaaaaacaatcataatgtttaaattcttgatcatttaataatcatcattttatgtaatatttcaagtttatctcatattacagtctaaaaccataaagaacatctttgtgtattcattccaggctttttggatgctttcacccaatagtgtggcttttctaagctatatttcctaaattatattttgtgcaacagagggtggtgggtggggcattcagcctgcagacattttcaacagaaaatccatcatttgcaacatcagctgtcagcacaggtgccctgaatccagcggtccacccagttctgtgaacggaaaaactgacacaggactatgaagcagttgtctgatatcatctgggcaggaaatggagaaggctgaactttgaactaatgctaataatttccaaatccttctaaaattagatgatggtttgggtatatataattgtgatggaggtatattcccttattacttatgtttggtatattttagataaaaatttaacagagagagagagagggagagagaaaacacaaattctaacacgcagcactttcatcccctttggccaagtatagtcataaaataaccttcaatggtgactctaccttaggtaaataaatttaactatatagagcagttaaaaatatgttatagtttaacaatgtatttccaattccaccagaaggggaaggccaaagatagtattaacagtaattgtttaattactttattacatcaccattactatgaatataaagaatttggtgtcttatgaatgaattaatgaactaaattatgaagattgctatttcaatgtcaaaagttaaaaagactttgtggctccatctttcctgagctttgtcgtgagatgtttactgattttgccaaaactccaactatatctgtttgtttagtcatagaaaatattacttcctctccatttttttttttttgcctaatttctctggacagaattaattactcagtcctctctgaactcctacactgcttgggcagtatctttattctggcctatgcactgagcataattaccatttatatgactctcgtttctagtctgtgacctccttgattttatagactgtttcttatttcttactggtccctggcattcaggtcattgcttgacgttaataaattccatgaagctcaatctagtttcacatatagtagtggttctcaaagtggatcctggtttcatctggattggaatcacctaggtgtttgctaaaagtagttttctgtgctcaacagcagatctacttaaacaaaatccctggggttgggcacaggactaacaaggactccaggtcattgtcatgcacagcaacatttttttggtaatagttttattgagaaataattcacattccatacaatccccccatttcatgtgccatcacagcatttttttttaaattttcacagagctgtgcaacaatcactgtaaatcaattttataacattcaattagccccaaaataaatacaggtcctttagcagtcattctccatatcccctaatgctaagcaaccactaagatattttctgtctgtatagatttagctatctggacatttcatataaatggactacaaaatatgaggtcttttgtgcctggcttctttcacttagcatgatgttttcaaggttcattcaaggttcatcagtgccttgttcctttttattgattctattgtgtgactatactacattttatctatccatttctcagctgatggttgccactctttggctattatgaataatgctgttataaatatttttgtatcatttttgtgtgaacacatttcatttcttttaggtaatatttacctagaagtagagtgtccaggtcatatagcaactcagttttatcttttaaggaactgccaaactgttttcctaagtagctgtagctgtacttaaaactgtagtgttaagtttccaattctctacatccttgccagcattttttattgtctatttttaaaattatagttatcctcatggatataaagtactatcttgctgtagttttgatttcactgatggctagtgatgttaaacatcttttaatatgcttgttggtcatttgtacatcttctagggagaaatatccattgaaatcttttgtccattttttgggttgtttgtgtttctattattgagttgtaagatttgcgtattgtagctacatgtcccttattagatacatgatttgcaaatatttattttcttccattctatgagttgtcttttcacttccttgaaggtatcctttgaagcacaaaatttttagtattaatgaagttcaatttttttttgctgctgtttgtgcttttgttggcttatctaagaaaccactgactaattcaaggtcataaagatttacagctgttttcgtttatgagttttgtagttctagctcttatgtgtaggtctctggtccattttgagtcaatttttgtcttcaacttcatttttttgcatgtggatatctggttgtttctgctccatttgttgaaaagactctctttttcccattgaattgtttgacccttgacaaaaatcaggtagccataatgtgtggcacaacaaaattttagaatatgtgtctattggaattgtgacctggacattataataagagtaaaaaggtaaaatcattaacttcagatagttttaatgattattagtcttgacatgtgtttgtaattccaaatttgatatgaagtgggtgttgtaagaattggaaatgctgaggtaagggttaatgggaagacttgtcttgtgctttacaatgtaaattattattattatttatactttaagttctgggatacatgtgcagaatgtgcaggtttgttacataggtatacatgtgccattgtggtttgcttttgctgcatccatcaacccatcatctacattaggtatttctcctaatggctatccctccccttgccccccatacaatgcaaattataaaatcaagaagcttacttggtaaaatggtcttatagcgatttttagttccatgacgcggaatatcaatttctttgggatccacaaagttcattggtatttcctgcaaaaataaataatatcaaattagtgtatctaatactgccacaaagaaaatcttcacaggggggcatctgatccagagttctattggacttcaaagccacttaaaaacaacagatctagcacctctggtggaccaacacccttcctttcctaaacatatcagctgcatccggacaagctgacttctaagaaacagctctgtgtgttagaaaatattgcttaatatgtagtcagtaaggagacatataacactggttagattttaagaatcctgctgtgacataattgctagaaagattagacagatgctaaaaagtgaatttttttaaaaaacaatgtattcaaatatattccagtttttacataactttagtaccaaaaattttactataatagattatcttttcacactaatagtgactcttttaggattattaaaacctctttcccaaaatggtaaatataaagggcttttttgttaattcaagtgatgacatgacttttttttgaattaagaaatggtttataactggactgttccattttaagttataaatgcactgtttttagtgaagggcattcaaacactgtttctcccacttaagaacattactattcttattttatcagagtatacattatatgcctcaagtgattggacagggaacaataggaaaagagtggctgtatgtaagtgcattagatctaaaaaggtgtgtatctgtagctaaccaggacaaataaagcaacaagccaaagttttcaaaagggtccaaacaaacatttgtttaaagatttgattatacaaaatagtatgttctctaactttgataagattaacatgaacaaaataacttttatgttatttaatgactgataaacattaaatatttgatcaaataagatatttttactacttaaactttctccagtagaaaatttaacttaacagtctaatattgattgaaatagaagaaatcatctttaaattcattcaaattatcctagttttcagtcattctgaaaatttgagaaaagctggactatactatgaatttgaggcttgttctacagagagaaacagctattcgtttattaattaatttatttttagagatgggatctcactctgtcacctaggtcagtgtgcagtggcacaatcatagctcactgtaacctcaaactcctgggctcaaggcatcctcccatctcagcttcctgagtagctgggattacaagcatgagccacaacacctggccccaagttacttatttttaaaataatttttcctttacctgcattatgctagctatccatgatatttatccctattctctgctccaactaaatgttttaacctgtttgttccaagttataaaaataagcaaaattgttgaatattcaatggaaaacacatgttcatgtttggtaatttcaagcacgtcagtgtctttgggcaaagccacaaaggtaatatctttattcctccccttcttccttctcaccttctgttttctgacacacactgacagtctgtcatcttccagcattctctttctcctgtgtactccttctggccttcaatttcctttcaggaaagtgggctatggtaaggtcttatttcataaacaaagagctgtctgcagttctagaaaaaaaaagctctaggtgtgcctttggctagctgtgtgaccactgacttgttctttcattcctacaggtctcattttcttcacatgtaaaatatgatacaccacagagtctgattttcatgtttgtattttactttggacacttaataatagttgatggggctaatagtagatccaacccattgctgaatctgtcaccattaggatggctgcaaatgcctgaactaataatcaatttattgtactcaaccaatacggcttaagatgcaagaggtgatcaacaaagtcaatattctccttgggcaacaattagacctaagaaggtttaatcttacttcatgttctctgagttgatgtatgttatcatgctttaagctttcactagcaacactggtatgtctaaaactgaattcatcattctttttagcccacacttggtcttcctcctgtgttccttatttcgttaaagggcaccatatgcaccctgttggccaaaccaaaaacacgaatatcaatccctgacttttccattacttttggctgcctcattcaattaatcccacttcttgtagattcctacagattctttccattttcccttctactatattagtttaggccaccaacgcagttccacaggattaacactagagcctctaaactgctcccttttagtgcctactccactgcaaatagaatgatctatccaaaacataagataaagtccaagctcctaaacatatattaaggctagggtttcttttatacttctgaggctcaacttttgccacttcccaccttgatttcaatgttccagttaaactgaacagtttaattccccagacagtgacagcaaggctattctttgtcctggaatgccccttctctgcccagctccctataccacttatttgcctcaccaattcttgcatattctgccttaatttagctctacattccaattttaatacttatcaatagtggatgagactgagtgaatctaaaaccatttcactttgccatttgtttactgtagactgcttaagtataggacagtatcatttccatacgtctctagtgccccatgtatcaaaataccgactgaagagtgaacaataaatagaaggctcaccatgaattcactttggagtaaatgtgaacttgccacgacgtccctcagctgagaccttgtgagaattcggctggctgactgcagatactccattgctaccttctcccgtggtgttggtatagacacaaagggttcaatgttccccaagctactcatgtccaatgtaagagatacgttggaccctcttctacattggagaagaatgttatgtttaaacaccacatacttattttgattgcaaaaacttgtctttctgtacatgcacacaattcagtgagaacttttacagaaataacaaccaactatattttctcttttagtatcatggttggccatagcaactacccatagttccttcacaggaaaataacaattttgttgttggaaagaactctaaattgagaaaatatgctataatttatgaatgcatatacttattacagaaatcataggttggctaataatattaagtgaaaaattaagtaaaaaaaaattaggaaaagctatatctatatctatatcttctgagtgaatccctaaaaaatggcttctggggccagatgaggtagttcatgactgcaatcccagcactttgggaggctgaggtgggtggattgcctgagttcaggagttcaagaccaacctgggcaacatggtaaaaccctgtctctacaaaacatacaaaaagtagctggatgtggtgacccacacttgtagtctcagctactagggaggctgaggtgagagaatcatttgagcccggggggttgaggctgcagtgagccgtgatggtgccactgtactccagcctgggcagcagagagagaccttggctctaaaataaataaataaaacaatagataaaaataaaaaaagatggcttctgtatcctctatttatgtgtatatgtatgcacgcatatgtgaattgacacacgaattcatttaattttgtggtaaacttataaggggccatagaaatcacagacccttaaaatgagttacaatttatcttcctctcataattccccttttcccgctggggggcaaggggatgctcttacaacttacacagaccctgagtcctgagtaggaagtgaggatgccttttacaagtaatattagctgtgtggaccaaggggtaactatgaaatagcatgtgagagactgaggattgaagtcagagatggtgtttacaaaaactgttacatttaaaggggccgtaggtgtgtgtcagatcaaatatagtgccaagcagttggcggctcaaggaagtagagagcagggaaaaacaggccaaaatatgtgagagtaaagacagtaagagtagatgctaggcccagcaaattattccctctggtattttaatacttactctggaatgcgacattaagaaatattacagtggcttgagcttaatttcaaacagtggaaaattattggaatatacaacaacaacaacaaaatccattaacgaaaatctatcagttttcttctctgatgaatctgcctctggttgcatttttgttgtcattctataatttgatatgtaatgtcatttttgttaatttctaaatggtttgtaattgagattttaatttctactttaatttgatggatatctgtaagtttagacatttattttccttataatttctagttatagttgtggaaattagagaatggctggccttttaatggttgaaactacttgattttttttcgagataaacactacatcattttctaaatatttcacagatgttttgctggcatctagtttgattatctgtatatgttcataagtatctatctgcacatatatacatatatatcaccttatttattataccattattttattgaagatattactttattccaacctattctttccttcctttttttttttctactggatttgtcaaagcctgagatatgtatgtgagtcttccacaataattatgcttgttatttttccttctaacagtttttaccttgtacattgcagccattgtgttatttgaagggatttagtcatatcttcactataaatgttaccaatattactttctttcctgttaattttatatttgccctcacatctggctttaaaaaatgaatattgatatgcctatatgttttggggggtatgtttctgaaaactttttctcatcctattattcttcttaactcttttggatcactgggttagggattagggaatagcatttattctagatgctcataaaatcctgcctacctaatagagggatatttttcccactccactttttcttatttggtttttggtggtggttgatagggttcctgtgcttctgagtaggaggcaaatagttgaagaagagcaaagaatggttctactcatggaccaagaatttaatctatttttagtgggaaagtagtttttaaagtttttcagttcagttctggacttcaaattgatagaaaatccttacggattctgataatagtttgccgattggtcttaatatttagggcatttgtgagaattcagcttttgcaagctttatagatattttagtatgaaggtgagagaggccgcttaagggatggctagtcctatgccctttaaaatcaccatgccattcagtcaaattttcagcctcaagagacaaaattgtctgccctctgtcaatggagtgatgcttgtgctatagatggtgagatctcttccatctggagtggtcagagcagattcatgaggtagaagtcatttaagttgggctttgaaagcaaacgtttaataggtgagtttttggtctagagttaaagaatctggtaggaaaaaaagtgtaggagaataaattaatacaactttgaagaacagcatagaagcagtttgagctagagttctcttgtataaaaatgtattttgaaattggggagcaggcttatgtaagagagatgagagagaagcaacagtcatagacactataagactataaaaagcccaaaaatagtccagggatgttggctgacatctgtaatcccagcactttgggagactgaggcaggaggatcacttgaggccaggagtttgagactggcttgggcaacatagcaagaccctgtctctacaaaaaataaaatagctaagtgttgtggtgcttgcctgtagtctcagctattcgggaggatgaggccggaagattgcttgagcccaggagttcgaggctgcagtgaggtaagattgcaccactgtcgtactccaggttgggtgacagagtgagaccccatgtcaaaaataaataaataaataaatacataaataacgaaaaaaaaagccagataaaagaggatccagaacatcatcagggtgtattaatttctgttttgacttcccacagtatacgctgcctaaacctgggagattagaagcctttgacatcccgtgtctaaggtctatttgatttaatgagttaattttctaaggattctgtggtaagcagagagctgtggaagcattttcatgctaactgacttaaataataaccatttatatattacagtcagaaagacatttcaaaaacaagataaacatataaacttatgggaaaattctaattaagacgtataaaaaaattgacagaatttagaaaaaaaatcaacataaataataggagaactatacctttaataaaaaaggaatgtggaaagcaagaaaacgaactctactgaaagctttacttttattttgtcttggaactgtgggcaaactgtttagcctttttaatgcctcatgattgctgttggacaaaagggaacataataaaaagctttatcaagctcctgctgcagcaccaattattatttatgccaaaaaataaataagagggaggaaattcaaaagataccaatgcaaacaattgaaggaaaaagcaaattcttagggaaaggtaaaaggaatgcaataaacagcatgctaattataattaactaaaaaggaaaatatgtataaatattatgggccagggcgacacatccatttcagcaagagaatataaacaactttgggtcaaaattgttcaattctaatgacatcagtttctaatgacttagaggtgggaagaaaacgtagctaaaaatacagtaacattacaactgagtgttggaataactcagaaaccaggcatttattttcccggtagttggggaccataatgctagattttagaagctgaatttaggaagaaagggctaaaatttctagtatcatgtctacgggctctaattctcagacatgctactttttttgcagtactttggtcactgagaacagtgagacttcaagcagtatacctcatttagcaaccaataaagaatggaaatggaagaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtgaaaagtatatataatttgtctggagttgtcttcattagtgtacacgtcaaatcttatgtggtgagaagcaagaactttaatgttgatgttgtcttcagaactgaaaatgtgatcttgaatcctttagtccaactattcatccttgtgtgttacagtggccatgaatctgacaatcttggcttgatcataaaaggtgaccttaaaccctctcacccacaacttatttaattttgcacatacaatttttctacatagttttctagaataactctacttaaacagaatgaaaaaggaaaaaaaaaacaagtttttgctcatttgaataacaaaggagacaaaagtggagaaatggagagatggaattcttttactttgtgtggactgagtggcataggcagtttttgcaactcccaattctatgacttttaagttccgaggttaatggcatttaataatgttatgctgtttccatctctttatcttccagtaaattatacatagtaccaaccctctttctggatcacttgaaagatgataggataaaacagaaataaacacggaccactaggaaagttaaattgtgacataaatggagtgttaccaatttcgagaactgaaataaatgagtaggtattgtgaccattcataataaaatttcccaaaggaaatcctgaagggaagaaataataataaatataaaagatgccaggcatgaacccaggaagatgatatatgaatttcaccctaaagtaaaaagaaaatcttttaacatagagaacatttttagtgtaggaaatgatccattttcctacctgaaaggacctacacctcactaggtagaatgttgctatgccttttgattgaatctataaaagttttgaattcataaaaagatgtctgaccttttatatgtgtataggacaaggcaaaatttactacacccttattttacaaaaaaaattcaaaacaatcatttaaaagaaccagatacattgaacttgtcacattactcttgaaatattgaccttggaaaatgcgttcaatcattgttctgcatttcgcttaagcaacttggaccttagactgcataatctgcaaatgggaataataataaaactcacaaaattgactcacaccataaaagataaataagcaagaatatgtgaatacttccaccctaatgtctgggatataataaacatatatgaattattatcataattaataataacatggtgatttttgcttcactctctatttacacagctatgtgggagctacatgagtacacactgatgaacatttgagggaggtaaagttgagaaaattggttagtgattaagagttagcagcagtatcacacatgcaaaatcaatggtcgtctaagttgggactatttttcatacttcaagtccttaacatttatacctaatgtctttaaagttaacaatgttttcatgattcaaaaataatgcatgttaactaaagctaaaaatagagattttacaaatttcataatacccatatttagagtaactgctaagaacattttttgtgtatgtccttcaagtccttatatgtatgacaaaaatctagatttttattcaatatattcttttatgatttacttttaaaaaaaggaagtaggcacagaaccattgcatatgatttactttttaaaaaaactatatcatgaatgtcttttcatgtcctcaaatttttttaaacactgttttcaaacatttgatagtatcccattattgagatgtgtcatagttatttaaccaatactttatttttggacattgagtcattttcaattttttcaccattataaacaaaactgtaatgaacatccttgtacttcaatgtttgtgcatttccctaattacttttcagtcaagaagtcttaaaaactaactcaaaatctcttgagtttggagaagtcagtgggcactcgcagtgtggaagaggcatgaagacagactcttggagctcgctgatattgatgtagctcaaactctcttcctctttggttcagacctttgcagttgttccttagcaaggcttcctaactctaaaatctcctagttcagtagattttttccagatttcactggaatatctgagcactgaaaatatgataaaacctgcaagtagctacccttttgacgtaagatgcttcctaatctatctactgtgtatttctccatcctcatctcctgtcacattctcatccggacctgtgtcccaggcagacaatctacctgcagttctgttctctatgcctcaaatgtgcttgccccaacactttcaggttcaatcctccaaatgccaggggctctttcctctgagacttcctagcaattttcccaatatgtatccaatatatatcatattcactagaaatgatttgcagtaaagtgtgaacacattgaggccaaagactttgacttgagttctcctgttgtacccagtcatgaacagatggagagcaacacttttggcatctgcgtggatgaatagttgcaaatgaattggttagggggatgctatatgtaattactgtgctttgacggtttttccagtcctctgaaaatacaggaattggggggactatattaaacaggagtctgaaaatttggagtgtagaagccaagcttacataggtaaatgttacagttgtgattcagtttgaatcttgtttaagcatcaataaagtctgagcattaacatcctaaagttacatcctatgttaattttattcagaaaaaggaagaaaatgtactgctttgttttgtaaccaaggatgattaatttttactccttttttttttgtcatttggtattgttttgactgtcattcatggtgaggaggctgtttccctttcaacaaaataacaaaatgatagtagttctatttttagttcctaagttaatttttcctagtttatataattatttaagaaaaagatgctaaaaaaattaataaatctcaatgactaagccattccttgtgaaatgagaagtcttctttgaatttcagctgatttaaatataaatacaaatacaaacacacacacacacacacacacacacacacggcattttctaagtagcacaatacaatgaataacctcctgtctctttatgcaatcaactaccaaagaacccttttaatcctgatcattacaaataaattaaatatattcatttatttgtaaggccagaaatgacacctattgtcctgataccaaaacctggcagagattcaataaaaaaagaaaacttctggccagtatccttgatgaacattgatacactaatcctcaataaaatactggcaaacgaaatccagcagcacatcaaaaagcttacccactgtgatcaagtaggctttatcctgggatgcaaggttggttcaacatatacaaatcaataaatgtaattcatcacataagcagaactaaagacaaaatcacatgaccatctcaatagatacagaaaagaataaaattcaacatccattcatgttaaaaactcttaataaactaggtactaaaggagcatacctcaaaatactaagagccatatatgacaaacccacagtcaacatcatacttgaatgggcaaaagccggaagcattccccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagcgaataaacaacttcagcaaagtttcaggatacaaaatcaatgtgcaatgtgcaaaaatcactagcattcttgtacaccaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactacccaaaatgatttatagattcaatgatggcacttaatattaattaagccaagtttgtaagaaatggcttacctgaattatctcatttaactgttacaacaatttttgagaaagactattcacagaactagaaaaactattttaaaattcatatggaaccaaaaaggagcccaaatagccaagacaatcctgagcaaaaagaacaaagctggaggcatcatgctacctgacttcaaactatactacagggctacagtaaccaaaacagcatagtactgggacaaaaacagacacggagaccaatggaacagaatagagatgccagaaataaggctgcacgtctacaactatttgatcttcaacaaatctgacaaaaacaagcaatgggaaagtattccctattcagtaaatggtgctgggagaactgactagccatatgcagaaaattaaaactggactccttccttatatcatatacaaaaattaactcaagatggcttaaacgcttaaatgtaaaaacccaaactataaaaatcctttaagaaaatccagacaataccattcaagccataggcaaggacataggcatttcatgatgaagatgtcaaaaatgatttcaacaaaaggaaaaattgacaaatgggatttaattaaaccaaagagcttctgcacagcaaaagaaactatcaacagagtataacagacaacctacagaatgggggaaaatttttgccaactctgcatcagacaaaggtctaatatccagcatctataaggaaccttaacaaatttacaagaaaaaaaatctcattaaaaggtgatcaaaggacaggaacagacacttcccaaaagaagatataggtgcagtcaacaatcatatgaaaaaaatctcaacatcactgataattagagaaacgcaaatcaaaaccataatgagataccctctcacaccagttagaatggctactattaaaaagtcaaaaaatgacatatgctggcaaggttgtggagaaaaaggaatgcttatacactgttggtgggagtgtaaattaattcaaccattgtgaaagacacggtggcaattccttaaagacctatagacagaaatatcattcgacccagcaatcccatatacccaaaggaatataaattgctctattataaagacacattcacacatatgttcattgcagcgctattcacaacagcaaagacacggaatcaacataaatgcccagtaatgatggactggataaagaaaatgtgctacatatacaccatgtaatactatgcagccataaaaaaagaacgagattatgtcctttgcagggacatggatgggtctggaggccattagccttagcaaactaacacaggaacagaaaatcaaacactgtatattctcccttataagtgggtgctaaatgatgagaacacatggatatgtagaggggaaaaacacacactggagcctattggagggtagagagtgggaggaggaagaggatcaggaaaaataactaaggggtagtaggattatttagtatatttatatttagtatatttatttatatttaggggtagtaggataactaaggggtagtaggtattaacctgggtgatgaaataatgtatacaacaaacccccatgacacaagtttatctacgtaacaaacctgcacatgtacccctgaacttaacatagaagtcaaaaaagagccctttattttaattccaaatccttaaatttgtttttagtcattggaaagaaacatttataaagttaagtattcacaaagaaaatttttacatttatgccaaggattatgtatttttaaaagtaccctttaatatctatctgaaagattctagattccatctcagtcatttgatataaaaagcagatatcttaagtcattaagcagggtacatcaaggtctgcctttacctaaaatgaactctcaatcaaaattatgaaaatctactctctccagagtttctccaaatgtttacccaagaacagtaagttatttaaatatacatctctgtgtttgttcagtgttcatttaaaagtgtaccacccgccatgtaatcgtgggctttggtcagttaggtgctttgcaaataaaccaggatgacctttgctccctacaagtcactggcctttcaccttggaatttcagagtagggagtggcttctttttggccagtggagagtcaatgactttgctgggttactctgtggccacagattatatttaaagtatcatcagtcttcaggtggaaggaaggaaggcgccaattacctggaagggctgtgttagaattaaatgaagagaatgcacttgatttgatcaccgtgatcagattcttgccagtataaatacacaatcatgttatcggtgatgcctagtacatggatgaatgcctaaatataaattatttaacacagttgccaatagttaaaataaacctctccccataagtaactgggatttgttgatttgatgccattcataataattcatttttttctgggtccttcctcatccagtgtcagataaaataattgcaagataaccctgaaaatcaaatagccattcactcaagtgcagatattaggcataccagatgaagtaaagagtttttatttttgatactgtgttttattatctatattatgtccaaggagcagatagactggtaaaaaataagtatttctggaatgcaaaatatacacattttagagtgaactgaaatttgtcacgtaaaggacgtttttatgcttgctataagaaatatatccctttgcttttccagaaataaaaatgttctaaattagcatgctttaaccaaatcaaacaaaatgaaaaaatgcccagaagcaattcccaaccaattttatataatattaatgagtaatatttatgatagaaaactaaagttatatatactccctcctcttttttattgagatcaacttatgtacaataaaattcacatttccaaagtgtaaaattcaatggtttttattatagtcacttagttgtataagcatcactacaataaattttaaagcattttcctcactccccccaaaaaaattctccctgctcactggcagttactctgtatttctctctctctccaggctctagaaaccactaatatacatgctgtgtctgtagatttacctgctttggacatttcgtataaatggaatcatacaacgtatggcctcttgtgtcttgtctgacttcttttacgtagcataaatgttttcacggttcatccatgttgtagcatctatcagtactacattccttttcatggcacaatatagtccattgtatggatacacccacattttgtgtattcattcatcagttgatagacatttgggttgtttctacttttggctagtatgaattattttgctacgaacatttgtgtttaagttttgcatgaacatatgttttcatttcttttgggtatacacctaggaatggaatttctgggttatatggtaactacatttaactttttgagaaactaccaaattcttttccaaagtggctgtaccattttatgtttccatctgcaatgtctgagatttccaatttctccacattcttgctaatacttgctgctgcctttttttttttttaataatagccatcctagtaggtgtgaagtgtatctcattgtggctttggttacatttccctaatgactgacaatgttgagcatgttttctttggcttactggacatttatatatattctgtggataaatgcctaatgaaatccttggcccatttttaatttgggttgtctttttattttgcgttgtaaaattatgtatatattctggacactagacccttattacatatatgccttcccattctatgaattgtcttttcactttctgatagtatttgtgatgattaattttatatgtcaagttgagtgggccatggtttgcctgggtatttggtcaaaccttattgtgggtgtttctctgagcgtgttttggatgagagcaacatttacattggaagacggagtgaagcagagcaaccctcctaatgtagtaggtcttatcccatcagttatggagacacagcatagattaaaagtgaagttttggcactaagttattctgaagtagatacctgaaggtatctctgtggtcttcatgactgtgtctgcctacattattattcaaataatgtggttactgttctagtctcacttcattttatattgaatagacatatctatgatataaatatctattaattcaaagaaaacaatatcttgttttaattattaaaatgttaatttaattataaaattaatacatacttatactaaagttttcaaataatgcagaaggaagcaaatgaaaaagaaagccctcttcccctagttcttcccgcctcctgattttctggctctgcttctcacagctcaccacaatttgggttatgtacccttctttcaattgcccacgcacttacaaagacaaatataaattggatcataaaatttcatatagttttgcaactttttccctactttacattatatattggaaaatttgtcttattagaacaacaatgtggatttcataattaaatgcacaattatatatatatgttaatagatatttatttccaattctttttgctattaccaacaatgttgccatggaaagtcttctactgtatatttgtttattcatgcaaatgtatctgtacgaacataatataagtttctcctatagaccaggtgcagtggctctcacctttactcccagcactttgggaggctgaggcgggcagattgcatgagcccaggagtttgagaccagccaagggaacatggcaaaagcccatctctacaaaaaatacaaaaattcgctgggcatggtggtgtgttcctgtagttccagccacctgggaggctgagtgggaagatcgctggagcctagggaggttgaggctacagtgagccgtgatcacgctactgcactccagccttggtgacagagtgagaccctgtctccaaaaaaagtttcttctatatattgagtatgccaaaataattttttttttgttatttaagacattacgatatcagggaacctgccccgatagtcatgtaggttcttttctattttccctaagcatcggctggtttgagaaataaagggacagagtacaaaagagagaaattttaaagctgggcgtccgggggagatatcacatgtcagtaggttctgtgatgccccacaagccgtaaaaccagcaagtttttattagggagtttcaaaaggggagggagtatacgaacagggtatgggtcacagacatcaagtacttcacaaggtaatagaatatcacaaggcaaatggaggcagggtgaaatcacgagaccacaggactacaggaccggggcaaagttaaaattgctaatgaagtttccggcaccattgtcattgataacatcttatcaggagacagggttttgagagcaaccggtctgaccaaaatttattaggtgggaatttcttcttcccaataagcctgggagcgctatgcaagactggggtctatttcacccctacagtctacagaccataacagatggccacgcccaggggggccagttcagagacccacccccaggcgcgtattctctttcccagggatgttccttgctgagaaaaagaattcagcgatatttctcccatttgcttttgaaagaagagaaatatggctctgctccgcccggctcactggtggtcagagtttaaggttctctgtcttgttccctgaacattgctgttttcctgttctttcttcaaggtgcccagatttcatattgttcaaacacaggtactctacaatttgtgcagttaatgcaattatcatagggtcctgaggcgacatacatccttctcagctgacaggattaagagattaaagtaaagacaggcataggaaatcacaagggtattgattggggaagtgataagtgtccatgaaatctttacaatttatgtttagagattgcagtaaagacaggcataagaaattataaaagtattaatttgggggactaataaatgtccatgaaatcttcacaatccaggttcttctgccaaggcttcagccggtccctccgtttggggtccctgacttcccgcaaccttacataaagcagcctctttacctcttttatctatcagcttctaagtgtttataacaggataaaatcattaaaatactggaattctagacatgctagaaaacactcagattgggtccactatatatgtactctaactttatctcccatttttgggtagaattgttaataattttcaatttttttctattgtctgtcttctaagtaaaaaaaaaaaaaaagtttgcctctaatgaaatttatgtatttgtaaattatatacatgtactattatacttatgtattatgcaaattatgaaatatttacaaaatttgaagtaggaaagggcaagataaatgtactttttttgtaatatatatgttttacaccctaatggatcattttacacatttcttgggatgcacatgccccactttgagaccactctctcaattatctagacttacataggtaatggtaacttttttcagccactttggatatacaagacagtaagcacctaggacctatggtatctaccatatcagctacaagtactattcatcaaagattatttaaaatagcattttgctgggcgtggtggctcatggctgtaataccagctacttggaaggctgaggcaggaaggatcacttgagcccaggagttcaaggctgcagtgagctataattgtgccactgcactctagcctggggacagaacaagtccctgtcccataaaataaaatcattttgtgtatcacagaagacacttcagtcttccctatagatatgcaactggtaatcattaagttctcactgcaagaatatatcatccaaatcactactataaccataaagacaaaattaaaatgttctaaacttactatattcaacatttctctcaggcagatggcagtgaagaatatgtaaaaacagacttttaaacaacggctacaagaatattctttgtttctctaacatactattcttcctcaggtattgttttatgagttaattcattatttcttttcatcagagatcttttaatataaaaatcataatatttatctggacaactcttaatttctgatactcaataatgacatttttattatatctccaatatatgtttctgtgaatgacataataatgaacacagaaaatctttaaaaacattgagcactaacattcttttcaaataaagagagagtgttaggtgagaataacttctgataccagctaactctgtcatcttagcatattaagctgtcctaagctataccagtgacatttcattctgaaaatgatcatttctgatgaaaatgaactcaagaaatacacaaatgagtctaagtactgaaagactctaacaaaggattacaagggatagggtcaccaaattgagcaaacacaagcacaagactcgccccagttagattttgaaaaatagctctatcacatttttgtaatttaatgaaaaaatgcttagtacaggacatgcagcacatcctgacaaagtcaatacaagacacaggacaaaattgttaaatacagaacatgtcccatatctacagaatgcctggctaacctaacaagatggaacacaattgacctaattttaatttcttccatgcatccgggcatttcctgtgtgcatggcagggatttgtaggtgtgaaaaggaaaataagaatgaaatacaaaggagtttccaaactgactagaaatgaattatttcttctgtttatcataatgttttgcattgattccaaaggaaaaaaaatagtatttgcttttattacatattaaacaattatcatataaaacctgataattggtcagtaattttcctgtaataatgcttattgatttctggcatgaataggcatctatgctaagaaaagaaaaatacaatcttctttttaaaaatactatacagccatggtatttgaaaagtctctcaaatactaactgtctgaatcaggataaaatgacttttagaaaacccattactttgatttaaatgttatattttttatagaattggaattgcttcttgtctgccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcctcagcctcccgagtagctgggattacaggcgtgtgccaccatgctcagctaattttttgtatttttagtagagacggggtttcaccatgatggctgggctggtctcaaactcctgacctcgtgatccgcctgcctagcctcccaaaatgctgggattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttacaaaacaaggattcaattataatggggaaatactagaagaatacataaatttacagattgaaacatatttataccattttgcacatgcttgaaatattgtgtaaaacaatttgaagataagtcctttggacttttttgctttcgtatgtctgaattatcaatacgcacattttccaccaataattctccatgtcagatgaggacattcggagaagtgtgaatgagataaaaacgaggtgcttaagacattctgttcaaacggatagagttcatttactgaatactcctgaccggttcctggagttcagatccacacctaacaaattcccaaagttcttcagacctcagcaagtcaaaatacgctacggaaatcatttttgacaagaactctcgggctaagctttaagtaatcagtatctggttaggacaggaatcacccagtatcctgtggaggaaaacagccgacatgaaggccatttcagctttccctcttctaatcatgctttctaacctactgccaattcgctcctaggctgtcctcgataaggcatgccgtaggattacgggaacccaaagttcacgaatgcaaacttcacgaggctgcccggccccatcctttccagaagatcatatctacagcaaaacggtgctttatcctagaaatcccttttcaatccaaatcctaatggaactccttgacaaccccttgactaaattacattagtaatatagttcctaacaatttcctttgttaggaaggggagcaaaagggcaaaaaaaaaaatcatttttttaaaaaaataatgaaaattgcaaaggcttaaatactgaaagaattgcttgcctctacaacaaatctgtatcattactaacaagcgataaaaggccttccgatggataccaaatgagaaccttccagagggccacgggcgcccagctggaaacccctgctaagagcatctgcagtctgaacccacagtgactgcgcgtcttctctggatgccattaacagacctctgcgaagggaggcttcggctgctccacgtcagctttaggattggtacgtggccctttctttgtttatctgatttgcctttaaatcttacaatggcaacaagtgtctcaagtaggattgttgaggacagagaaacaatgctcaaatgtcctttgaacaaaaccaagagcccaccctgccgacgaccctgaaacctctcctgtctgtaagtggcgcacaagcgccacctggagggtgcaaggcgcaaccatcgctcttctcaaagtggaattggtctgtgttaggctgaagagattattttattttaaaatgcttccattcctccactgaaaaaatttaatatagtctaattatgaatatggagaaggtggaaaaagaaaaatcctcgggtgccttagtcattaggggaagcaggaaatagaaacaagcgtgagatctgggggcacattacctgggctcgaatcctatctctgcagtaatgtactctgcgaccatggaaatgtgcttgaatgcctgtgtctccgtttccttatcattaaatttgagatgatataatttacccacctgaggtggatatgaggaggaaatgattttatatatctgtgatgcatcttgtacagtacctggcatatagcaactgctccacaaatgttaggtataggcatagacttaccaagtcttttccagttttttcctctctatgtagaggtattgctctgttaccctggtaattttttttttttttttttttgagacagggtcttgctctgtcgcccaggctggagtgcagttgcatgacctcagctcactgcaacctccaactcccgggttcaagcgattctcctgcctcagtctccagagtagctggctaatttttgtatttttagtagagacagggtttctccatgttgcccaggctggtcttgaactggtctcaagtgatcccccaggcttggcctcccaaattgctaggacttacaggcgtgagccaccacacctggctcaggtacatttttcttattggtactaccactaggccctaggatattatcctatatttgaatatgcttgatacataatcttatttcaccccactccctcatcttcgactccaataactttttctatttggtttcagattaaagctcagatttggttcttcactgaatagggtttgcctatatagaggtgctccttaacagcactgctttctagtataagcatgtcaacacaggtttagttatttaaaatgcatatcttatataaaccagataatccacaaaaacactcgtgccatattcccctaaaagaaatgtgttgcaggcatatacccattgttacttctcttgcttggaagtcctgcaaaagctcttacttacacatggtactgccaaatatcctaaagttctccagttagaaataggttagaaatataccgaggagttagaaatatactgaggagaaccaagagaacagttttgattagagtctgagtcagtcaacattgcacatatataaaacttctgtctaagaataggtaatttatctatcctggcagagcatttcatgaggggcaccgctattgtgaataacaatggacagccacctcccttgggcacaaccctttcctcggctgatggaacagcaggtggaaagaagagcaggcacacggtggatagctcctgtccaaatagattatcacacaaatcaaaaggtggactattgtgggggaggaattataaaatatatttcaacacattttaggtatttggcaggattctgtttgggttcaccatcagctttcttatagggccttggcaaatgcagtttccctgactgcttagaaatatttatgatcttgggcttttttctactaggcaaaactggaattatgaattctgcacagtataggattcataacaccgcaaacttttctagcccgtttaatctttatttcacaggcctagcttttctatggaagataccgtagtgaacaaataaacaaagtggattgaaattcgccctgctaatatatccaggaaaggaatcgttgggaggatagttggatgattattggaactggcaggtcagtgagggcagcagactctcaaagagcatgaacatgctgaccaattcattagagactctacagcccaaattgaccccaatttaaaatgtatccaaattttggcatgggaagtattgtattaagaaataagaacaaactagcagagtttgttttcaaaatgagggaggcatagatgaaaaatggctaaaggcttttttaccctttgaaaaatctgtcccggctatgcgccccccgtggacgcttcctttcccacccactcctttcctgctttcttactaccagaacccagggtccttttaggtcttgtgcctaggacttgcaaatgcctcgggtgaataagaatgcttttcctgtgtaagagcacaagacattttaggaacaggaaaagcctatccggtccaacatacctgccctttttaggtttatctaaatcccaccttcctgcattgttaccttccttcatcttcctatatagagataacatttcttgtatgtttctcatgatctctcctgtcactagacctgataaaattagacctatattttagtaccactctcgttaaaacaaatgatttctgaaaagagttcgcaaggctagtaaacagtttgtaatttttcttttttaagagtcataaaccatgagtttgaaagaggagactccaaagaagcttgacttggagggacgcggaggtcatccggcttgactttgtgcttagcttttatttatgagttatcttatttgccagaatctgggtaccaacattttctctcagagtgttcagtgacgagggatatgtttatttgggataagactcattatgaagaaaatatgcaggtggctaaagattaattacaagcagcagaggcctgttaaaaagcttaacattctctgagcccttccttgccccctgtttcacagttcatatctggaatttacaatagagtgaggtaagccacccgccgtcataaagaaggtgagatatttattgaacagatgtttcattactcaagaaaattcacattttcaagtaaaaagccaaaagatgggccttccacccaagtccctgaaaaagattcttggcagcatttatatttagtgcctacaagttttacgcactgagtttttactgtttagatgtgcgggtcaacaaatcactgagaagacaccaaaactgtctgccagatgtcgaccactgattaatttgtcttaagttcagccaaaagggaagaaaatatgatgggtggagcatgaacagcaagcacaatcaacatctgaccaaccagggtttcctgtcaccttgggaacaaaattgattggcactggtttcctgtgtacaagttaaaaaccagtagcaactgcagtaacaagaataaactacagataagagacttggaaattaaatcaaggcacatcaccaaaatttcagcttgcaaccctaagcagaaaagttccaagagaactttttgagggcttttttttttccccttttaagctattttgtatgtaaacttaatttttctaattttgccacttctggcaatctgaaatcattaaaaaggacacaattcaaatttatgttagaggtcataaattttgcccaggactcaatattttctcatttttccaaagataaaatcttatttatgcattatagcgacttggttttcactttatcttgaattatagcttttaagaggcagaaagaatcctttttataaggacagtctcaagtgtacacacagattaaatattacaaatataggttgcaaataaaactttcaaaatgtgggattataggaagcaaaagagaaccaaccaaagcatcaacaaatttacctttttgttttttttaaagatttttcttatttccttagctgcttttgcattagcattaaataacattcttattggagtggtatgtgcatggcccaactcaattttatttgcttttagtgtgaatctgaagttttattttttattgctttattcatttatttacagaaacttgttaagcacctaaatatgtagaggcatgtctataaattaaggagcatggcaatttgctctttatttttaaaaattcacagtgagagactccccaaaattagacaaacacacaaaaaaagatacagatttttgaggaagaatgaaataggagagcaaaatgtttgcaaaatatgctttctttgatagtctaagttggaagttgtaaaaaatgaccattttggttataagaggttttttaagttacttcatatcctttcattctattcttccaatttcagaatcacttccaaaatgtattcattcattttataagtgtatataaattgcaaaatactcctcatactgaattttagaattcatgctacttctgctgtcactaccagtatagtggttaagagtggattatggagccagactgccgggggttcaaattcaggttctaccctttaagactgtgtcaccttgggcaacttaacctgtatgtgcccagttttctcatctgtaaaatggggatacaacttgtgcacgtgcttcactggaattctatgaggcttaattgagataatatgtgtgaaacacaacagggcttgataacgtaataaatgcaacagtgtaactcttaactggtattattaatgttttttattactactgcactgctattgctgctgtttctgctaccaagacaccttcagtgctactgctacccttgttgcagcttcctctgtgtttctggccattgtagtgatatattctcaggttgttgctattactgacccctattggtagttaccactgctactgctactgttacaagtagtgttggtgcgtgctcctgctgcaattgctatcattgctgttactattattagcagttactagaggtgtagtgtgtgtatatatatgtatgtgtatgtaagtctggatatatatatatacacacacacacacatatatatatttatataatgttaatggtggctattttggtggtgcaactggctaggaaataatctttatttttgtttttgcttaaatatgctttcaaaatttctataagatgtgttatttgcacagttcatttaaaattaaaaatattaataagggctggagaaatattgaaatctcatattcgtcaatattttgtactgcctcatggcctattccaccttcctgagaaagaaagggtgttgagtgcaccctgccccggtatgagaagggcatcttatattatatcctcctattataaaataagcatgaagagacagggctgggagacatgatttatttgccatctagctatgtactaagagcatacgagacattcagtcactgactgattttgttatttttatctcatgtcaaaattttcctcacttatctttatgtttaagaagaaatatttttgataagaggagagatttttgtatgttttagccaaactattctcaggagaatgcccttgggttggcccatagctcaattgtgaacaattaccctgacattatcctgaaaacaatcccacaagttctactaagaataaataaagcacaatagaataaaattatccaccaaatctaggaaaagcagctatattttagccaggaaatagaagtccccccacctccccaatgtattaagttcttgtacttctgtcagcaaagaatttagcacatggaaaaattcagattctccagttattgatttggggactgattattagggggaaaaagtaccgagagccaacttaggtgagttgttgtaccctgacaattgtccttgtggtacaaatggttttaatagaacagagaaaatgggggaaaagaattaaaaaaaattagaattggttatttctttagagtaatggtaaaacatcccttagtctatttattttttacctttaccaagtgttacaaaattttaaacgtcaaagagttaaatatctggctctctgagacatacaggccaatatttctagactctgtcaaattctaggatgaatgcacagccctggttgaaggtaaattcaatgatgtgtctctcttcgctaaggagggacattactgcgcctgttgaaccctaaatagtaaaatcattgtcaatactattgcttataatgtacacatcatagatagatgatgatcacaagtgatatttttcaacatcttctttgtatgacattacccagaagatccaagctaaaacccagtaaagaatgatgctttttttttttgcagtctgctttatgtttttgcaaaacattttacattacacttgtaaaatatatacatatgtatatattttagtcaacttaattcaagaaaattatacaaaaaatctaatttaatgcaacaaaaacctatcatatgcccagtttttagggcaaaatcaggcttaaaatttgggtagaaatttaaggccctagaaatgtatgtacagtggttgacaatttggggtctggagccaggccacctgtattctatatttattgcacacctctcatggccaattggatgcccttgagcaagtgacataacctcctgcagccatggttttcctttctgtaaaatggggaaaataatgatagggtagttttgactcttatgagttatacatgtaaagtatttataacagtgcctggaatgtagtaagtgcttgataaatgttatctgttatcagtatcatcatgggatagtctgcatttaatttttttttttttttttgagacagagtctcactctgtcacctaggctggagtgcagtggcgtgatcatagctcactgcaacctccacctcctgagttcaaacgattcttacatctcagcctcccaagtagctgggattacaggtgtatgccattatgccaggcttatttttgtatttttagtagagatgagattacaccatgtctctgctaaaaggtcttgaacacctggcctcaagtgattcaccagcctcgacctcccagagtgctgggattacaggcatgagccaccacgcctggctgcatttacaaaatgcatttcttcctacttattcccatttttttctctccaatatttctaagatttgtatatttacgcaggggatggctaggggagagaagggggaaagtggaataagcttttggaatttggaagaaagaacatgtatgttaaaattcctatctagtattaaacataagtcacatattcattattgtgtatttgatcatgtacagcatatattgtcagacttcggtatcgtggaagaagaaatcttgaaattgtctcacaaattttaagggttttgtgctgtcatggaaggatcctaattggatggaactaagttttggttcctagtcccgatttttttttttctctctcagcaaaataaaacactcaggcacttattaattcaaatgtcctcatggacagaggtttttgctaaacaactattgctttctctgggaaactatagtagtttccagaaaagggattgattgaagaccttaattataaagataaggtaaaacacagcctttaaaatgggttataagaattaaaaaaaccagaattaacttctaagcataaatgtacataacttatgagttaatttgttaaaaaattatcaaagaaaaattcataaaagaagctatcagatacttttgtattgtgatcaggttttccaagtggccagtaaaaagtgtgtctgagagtattttctagaaagaattgaaaattttatattagttatgaacagccctgggaaactctaaagatgtcttggatacattgaggggaatgataggtggcagagaatactgcctagctacatcactgcaccaatagaggactcagacccagagtctcatagaaaaatgcatccaaacggcacagaatggccaaaacgtgagaaagacacatgtacttgaacatcacatgatctacttcaccctcaggtctttgatttcacttgaacatgtttagcccgagcagactgtctgagtaaacaactgtatcagtggtaatcaaactcttttcaaagctgggggctcttggttaagaaagaaaataagatcatacctgtaagtctaataatcaaaacaagtgcatgcagagctcagctcattgaggcatcagagaagggcccaggccccactagcctacctcttccctaaggccccatagagcataattgaaaagtactgatttatcaaaatgtgaaataatccatagctagccatgaatccagctacagttctattgttgaataacccaatacaggttgagtatccctgtatcccttatccgaaatgcttgggaccagaagtgtttcagattttggattttttttttttcagattttggaatatttgccatacatatatacagagctcagctcattgaggcatcagagaagggcccaggccccttctctgatctctctctctctctctgtctctagatatatatatatggcaaatattccaaaatctgaaaaaaaaacaaaaaatccaaaatctgaaacacttctggtcccaagcatttcggataagggatacagggatactcaacctgtactgggttattcaattatatatatatacatatatgtgtatatatatatatatatatatgtatgtatgtatatggcaaatattccaaaatctgaatatatatatatatatatatatatatatatatatatgccagttgaggatccctaatccaaagattcaaaatctgaaattctacagtgatcctttcctttgagcatcatgtcaatgttcaataagttttgaattttggagcactttggattttggatttttggattagggatattcaacctgtactgacagatggcttccttcaattctcaaagttctttgtaaactaattagttaacttctttatctccattccttgtccacacaacactaaagaggatgccttctggcaccaacagcctgtgatcctaacaattttagtaatgaatatggctataggaacccagtataatagagtaggtaagagctgttggaatactacggggccaaaaatgaaactgattttagaaaattattagaaaagcttccaggtttgcaatccatgagttgtttcagttctagaactctgcttccaataagggttatggccactgctttcacatcagaggctctgcaacagctgtagagttatgggaacatccttgcgacctggaccagggagactgagattacagttcccaaataggaataatttaaatacagattatagaaatatatactaatataaatatattcaaatacaccatagacatttaaatatatgcatttaaacttaaatgtatttaaacacatgcatttaatgaatatatttaaatatgttatacatgtttgcatatatgtgtgtatatatagatctttatacagattacatgtagagatgatctatttgtatctatctgtctatctatctatctatctatctatctatctatctatctgagtatcatctttccccaaccctggaccagagctgttgaagctgaatttggattggactctagaatattttccatctggaaagtctgtttagataggaatatctagaaatattacaaagtttccctagaggactatgttaaatgagttttggggaccactactctaaggtttctcccaactgtaaaatgctatatttttggccttttgagaggcccccagctctaaaatattaacacttacttctagattataactatgcccaccataaccacttttaccaacagtgagtgggaatgaaggacgaaattaagcatttattaaggtctaatgtacaccaggcaccttaataggcaatacaaatacatggacatggcaataaaaaagagacatccttacctccaagcagcttacaatttagtttactgaattacacagtttactttcttatgaagaatcataatgatttaagaaaaaaaaaacctgaggagtccaataaccatgttcaagccatgttttaattattttacttgttatttctattttgaggattttgacgttctaatgtcatttgatatttttcataatgtcatttgatatttttatcctcttggggggatacaactagtggatgacaaaaaaacaatgaaaaaataataattccaagcaaactattattgacattgtgttaaagattttgtgagacaccctgcccacactagatttcactagtatcaccctagaggatgtaagttctaatgagaatttctgtcacacccaagcctcgatttttacttttacagtatagtgctgtttcactctgccacctgcaggtcatatatggaagaacatatttaaattagaaggcctggcttggtggctcactcctgtaatcccaacactttgggaggccaaggcaggtggatcacctcaggtcaggagttcaagacctgcctggccaacatggtgaaaccccgtctctactaaaaatacaaaaattagccgggcatggtgacgggcacctgtaaccccagctacttgggagactgaggcaggagaatagcttggaccctggaggaggaggttgcagtgagctgagatcatgccactgtgctccagcctgggtgacagagcaagaccccgtctcaaaagaataaatgaattaaaaaaaaaaggtagaaatcagaggccaggcacagtggctcatgcgtgtaattctagcactttgggaggctgagacaagaggatcacttgagaccaggagttggagatcagctagtgagacccccatctctgcaaaaaataaaagaattaactggacatggtggcatgtgcttatagtcctatttacttaggaggctggggcgagtggactacttgagcccaggagtttgaagttacagtgagctaggatcatgccacgccactccagcttgggggagagagagagagagacagagagaggaaggagagagaatgagagagagcagaaggaaggaggaaggagatagagaaagagagaggagggaggaaggagagagagagacagagaatgaaggagagagagagacagaaggaaggaaagagagaggaaagagagaggaagtgaggaggaaggagagaggaaggaaggaggaaggagagatagaggaaggagagagagaggaaggagagagaggaaggagacagagaggaaggaaggaggaaggcaagagagaggaaggaaggaggaaggagagagaggaaggaaggaggaaggagagagagaggaaggaaggaggaaggaaaagaaagaaaatatactttaaagtgaaataaacaactctcttctatgaaactgtgatggaaagttaaaccattggtcaagattataatgattacctggatcaaaaatttggatggaagaaaaatccctccccagaaatgaaaaaaaaatgttggagtttaaacatgtacaaataggaaagcaatggtaaggacagtcacccctctacacaatgttcaaagatgaggaagtattgcctcacctggagaaacttgcaatcgccttgtctgagacctctctctagatttctagaccattctttcactaatatggaaccactcaattgtaggatattttcttaagtgtcttgatgcatatttacgctgtattaacaggttcaggatagagtctcttaaagtttacaaagtttattcattaaacaggagcagaggggccacgaccacagaccttaaaaaccaattggccacatagggtggttggataatttaagcacccgtgaaggaggtggcaagtgagaatttctccctttctctgggctttctagaatcaactggatgttttagagctgaaatagacgaatatgtctaactcccatgagtaaggctaactctgtatcattcagtcaatttttagagaacctctattatgtgtgtggtattaggaagtaggaaaacaaaaacgaataagctctcaggagatcctactgtgtgcacgtgtgcctacacacacatgtgtgagttcttgatggggtcagggaacaagagaggtaatttaggatggtttattcctagattctgtatttttctatgtatcggatgggagaagagaatttaaggacagcaacactgattttaaaaagctgccttgggcaatgaaaaaaagagctgcctggaaaaacggacaggtgtttgagtagggctgaccatcctctggagactgacaagatgaaggatccacatctgaggtatattccttcaggcaaagtgggcctctgccatactttgaatgtattcattctcatagatcctttagtacttcatcatttttactcttatttttgattaaggtgggtttaaaattccaacttttttttcttagaaaccttaagtagactaaggattctgtcaggaaaaaatattcctctgaatagggatttggtaacaacatgctaagttaggagccaacgtaacaagagtaaaacaaatgattcagaagatcatattcacagcagggaccgtgagggttttaggagctcccctcagagccccaggtgcagcgtgacattgccaaggacatgcagggagcacagctccaaggggctccctctcgatgtctaatgaggccaggcaacctgccagcaccacaggcttctgtggggcaagggcgaggtggtggtgagcatccattttttttttgtttgttttcctccgaggcagagtcttgctctgttgcccaggctagagtgcagtggcatgatctcagctcattgcgacctccgcatcctgggttcaagcaattatactgcctcagcctcccaagtagctgggattacaggcgcacgtcaccacgcctggctaatttttgtatttttagtagagatggggtttcaccatgttggccaagctggtctcaaactcctgactttgtgatctgaccacctcagcctcccaaagtgctaggattacaggcatgagccactatgcccggcgcatcatctatttttatttttttaaaacatatttcttcctataaaattaacttgatgtccaagaacttgttccttttttcatattgagatttaacaaatatttatggaacacgtacaaggtggtaggcattgtgctacagacaccgccttgagggaaatcaaagccgagagggaaaacgcaggaaatgaaaagtaaggcaggtgggatggggagggcctggaaaaggggagaatccttgagggctgtgttttaatccatgatttggaaaaaaaggtttccttaaataaacaaatgtatacactataagacattattagggaacaataatttcatttgatacactgttgttaaaattacttaaaataatgagaaatgaaaatgattggatgccaagcattgttagaaagtatatcatatttaaaagtgttcacaagaatttgtcaattctcaagttaaagctgtttcatcactacactgagacctgttttctaaggtatataccaaaaaaagattatgccttacccgccagagaggacgctgtcataaaaaaaatacaaacaaacaacaacaaaaaaaaaaaaaaaaaagaaagaaaaaaagaaaaattatggcaaaaaaaaaaagaaaaaaaaagaaaaaaaaagatttcacctttcttttccttccatgagacaaggggctaacaactgtgtcaacatgaagttctccactagagggaactaattccacgtcctccaatcgtgagcttcatcaggatgtgtctgagaacagtgctctctccatgtttagattgtacccagataatcatgctgcattgctaaatgggaacgacactttaaagtggtttttataagatttccagaaaaagatagttttatatttatataaataaattgaagtgtatattttatgttacagaaaaaacccacatcagttgaaaaataattgtgttcaagtcgcctgccatgagtaacttgtgattcttcactgttctgctctagaggtcatgtgctaatatctgggtgaatttgatgagaggagagtggtgcctcacttcccaggaaaacaatgtttgggcagttcataaaatgcacatagtgggaccctgaactacatagctttatgacacatttccaaaaactcctaaggcaaaagtctctggctgcaaggaaaaacctcctgacacagtatctaagattcagaactggtcgctcttaaaataggaagcaaagcttatgctgggaattatctgtgcctgccctgattaaaacgcttcttcagaacaggccatttcacctaattctgtcaacctatacatcaagatttggaacatggtcccctagcaaaaataaaaaaaaatctcattttaaaaagcactgcatttagtaccctccaaagtgaaactctaattaatcacatgtagaggaatcagagaatttgaatctcaaaaaattgtaccacgaccacctcttctttagggtcaagacaaaaagaactttatagaaatgcacaccctactgaattgccaaaagagttcccagggtagttagattttgtcccccatggtatgagtgcaaatggagagtaccctgtaaagctggaagcagtgtcctggatggggttgcaggctaatggatgttgaaggattgttgggggtcagggtggaagggctgagaagtcctttctgcttgaacctcagggtgaagcagcctgtatgaggggtggtctgggggcagatacagcagttagaggactcagtgggacttattcctgctgctctgccagggaccacaagtagagaaagggaaggcaaggaaaggaaaggagcaattactgtgattcctcttagagccactgccaggtctacactttcaggactcattagactacaatggcttaaacatttcagggtctgcttggagagaaattatgccaggcctgtgctttccaatgagtagtggccaatttttacctttttaggcaaagctcctctacttttaattcttaaataatatatgttggctcctgttttactcaccctgggttgtatccactgtcatttctttcacttaacaagattacatttttgtctcatgacgtaccattaattttcaggcaggtttcaaaacttttgcctcctttttcttcattcctgtggggtcttttatttttttagaataaaaaaccctatgaaaattttgttcataaccctccagaattccaacctacctatataaaatctgacaaataaagagaacagcttgatgctcactgttcatgaagggcttgtgcatgtttccagtgcctccctcagctctggacatccccatacaagtataagaatatgaaaatattttataaaaatgttagaaggtgattagtccgttctcacactgctaataaagacatacctgagattgagttaatctataaggaaaaagaggtttaatggactcacagttccacatggctggggaggccccacaatcatggcagaaggtgaaggaggagcaaaggcatgtcttacatggcagcaggcaagagagtgtgtgcaagggacctgccctttataaaaccatcagatctcgtgagacttattcactatcatgagaacagcatgggaaaaacctgcccccatgattcagttacctcccactgggtccctcccatgacatgtggggattatgggagctacggttcaagatgagatttgggtggggacatagccaaaccatatcagaagattaaaattttgtcatctgtatcacctagaaaaaggtaagacatggtagttacgtgcagattttgtaagcaggttgtcaagattgtatctttggctagatttttatttctttgtgacattgagcatattacttatctctctaagtctctctgttagcataactgcaagatgggcatagaaatactgcctgcctccaggatgttgtgaaggttgtctgagatcatacataagcacagtggttggcaggtggcaggttagtgtccaacccatcagctgtgactctgcatccttctattacagcagcacgggcagcagcttagtgcaggcatgaccatgtgcttctctgctgttcctgccacctccactgacaatcacacacacaatgaagtgggcgagttattatgcaggatgtttgaacaatatggagaccactccatccttttctgacttgagtattctgaattattgccttatagccccctcactttggcttctttgctctattcgtgttcaccttcctcttggtcatttatgtcagattaccaccaggcctccagaatggcaaaaatcagattaaggaaaaaactgagacagacaatgtgcttctagaatggcagtgaaatggttatctgtcatgagtgttttgagtccacctcatgaaattgcactttgcttgatttaaaatctgaaaaatattctgaaagccaagcataaaatttgctaagaggaaaaacagtgtgacgctccataatatacctacttgctaaatatactgatttgtagtttattttaaaattgatttcccacagattataggtgtgtacgcctcctcccaacccccaaagcatgccaatttattattaattaggagtacagcctctggagcaatactgcttgggttcgcattctatttgtcaccctcacaatcctactgacttactattaagttattagggccataacttatactctctgagcatgagtttccactctaaggaggggataaaaagtcccttgggttggtgaaatgagataatgcatgtgaagggtcaacagggcatactgagttgttatttttattgatgttatttggagttaaactggaatttacttctacgtgtttgctatattttatgtttataagccctcatgttgtcaggctgagcaactgagtcatggttgatagactgtgttcaatggggctgggtcataggttccaatagaatgaatggtgtttatttgaaggaggccgtgtggtacgtgtataatggcctgggaaaatcaaaggaacctggagtgtaaacttagctctgctgcgacctttggcaagtacagtaatgctgttggtgccccacccaggtcgcctttctccagctggtgccccatcctctcctgccccactgctgggagggtagcctgttagtggtgcccagctgccacttcgctggagcagccccctcagctgatgggtgttgctgagccagaggtgcctaggaagttatgcctccaccatccctgggtggcctggagtcagtggttggctggcatgagggtgcagaggctcagccccctcacctcaaggtgagacaactgtccatgaggggccactcatgctcagagatccctgtgcaatcaggctgagggtagatggctgctaccaccacctctttgcttgtcctcttctctgttctgcttgccctgctttcctaataagcttcccctgagagcatcttctcaacacatcatttggacaagagcccttgtctcaggctgtgcttttacagaacctcaccaaagacctaagagaaagattctgggccccatttttatttgacagaaaatgagagagttggatccattttcgattatgggtctatttaatgaatatctatctatctatctatctatctatctatctatctatctatctatctttcgagacaaagtctcgctgttttgcccaggctggagtacagtggtgtgacacagctcactgcaaccttgagctcccaggttcaggatatcctcctgcctcagcctcctaagtagctgggagtacaggtaaacaccaccatgcctggctaatttgttaaaaaatttttgtagagacggggtctcactatgttgcccaggttggtctcaaactcctggcttcaagtgattctcctgccttaacctcccaaaatgctgggattacaggcgtgagccaccatttgcagccatgaatacagattttaacttccagggtattttttacactttatgctctgatatgcagtcatattaattctattcccttctctttactcatatgtcccaaaaagagatcagtggaggaatgattaaagattctccaagttaaaatctttaagcatcgaaatgtacctctactagggaaagcgaggcagatacatcaggacattctgccttgccaggaggaaattgtaatacacaaaatcttttgagtttgaatgtagaatggtcaacattttcatggcatgtactgtcttttcattgcttccaccattgcagacaaatttctagttctgataaaaatctcccaagctcagcaacccctaaggaaacctttagactcacaatcctgggtgttatatcattttcacagtatttattgtaaatcataacatgtataccctattatggtacagctgaagaaaagttagtgaatgtttgttcgttggatatcagcaacccttgggggcctactgagacctccgttttgatagaaaaaaacacccattaatatcatagtcctgatggcccaccaactgattactgagaaatgaagtcaggatggagagtgctatattacagtgtgccactcttccttcctggacagttttctacctctccttgcacagtgtttacttgtaatagaaaatcaagtgagaaaaatgaggaaataatgtgaacatatccaatttgcctgttgatttcctttccataaaattggccattagccgtacagtagcccaaagggaaaatgtgcagaatctttcagattcataagttctagaaaatgtactttctagagtttgaatgtgattcctcatttaatgggaatttggaactcagcatgtatacaatttcccttagagtgatcagtggagcattttgggagggcaaggatgggacaaaagacaagagggaacatgaactaactgtggcctcacactgtgccagccatgtgacatttgtcatgtagcttaactgtcccaagagctgtgcaaggcacatgctatgctcctcaatacaggtgaataaacaggttccaacttatatatgtggtagttacagagcaagtgtttgaatttgtacctggactcgccatgagaaatgaatgcatttgttagaccagaattgattaaattgatactgttatttattagataacatttactggccaatttataagtatgtacttataaattacatgtaactgtatatttacaaataggatgaacaaaactatgttaattgacagttaaaaatataatgttatatgacaggctcaactgtagcaattcagtagaaaattagcttcaactcctgagttcaaaagtataactgacctagtgtaggcttgtgaaatggaatcagagaacaaaaacaaaaagaatattagatttccttttccttctcaaagacaccatgccattttgtattgattgttaattttgtagtatcctttgaaggtggagcagatattattttatagattgggaaaactatactacagaggacttaattaatccgttgagccacttatttaataagtgtcagaggtagtattagctgagactcaggtctatagtttatcattaagctattggttcttatggaagattctttagaaacagacgagatcttcagatgtgaagcaacattaattaactccataatatttttgagtgtttactatgtaccagggtttacaggaaccacaggagacacagagtatcttgagccatagtacctgttcttaaaattcttgtcatctgctgaaaacacaagacaaaccacttaaaaaccagttcaagtccctttctgaatgattgttcaattaaagtcattgccagaggagtggtatatctgagaatttataggtgttatacatcactgtgggcacaaataggttacatggccagtggtagggggtaagttttgtgttgggctctggagactagagatcggtaggctgagggaagaggaaggaccaggcaaacagaaatgcaaatgtggacaggagcgcagcactcagagggggatggggatggaaacagagagcatggaatagaaggtttattttaggatgtagttgcaaatggatttggagcaaatgatcagggccagatggtataggacatctgaggcccaacaagatggtctatgccttattctgtaagaaaatggagccaaatggggatttttgcacagcaaagtatgataatgaaagattgttatagcaagataaacctgaagactattgaagggggaaagagaattagatgcagacagataagatgaaataaaataatatatatgaaacatattacatatattagtcctaatatcatttgtacaattatatgacacaacaatttaatcatgaagtaatgagagctgggtccaaggtgatgattacagaaagagataatcaataatgagaaagttggaggagcaagaatcaatatgatttggcgattagtttgaaaaagggagaaaagaagactgaattgctatgtttctcttttttttttttctttttgagacagggtctcactctgtcacccaggctggaatgcagtggcacaatctcagttcactgcaacctctgcttcccaggctcaagtgatcctcccacctcagcctcctgagtagctgggactacaggcatgcaccaccatgcctggctaatatgttcttctttttataagattctttaatcttcataatttcagagtgtattctttatactcagttaagcaatccatttagtctctagatcttatttgacttatcttttaattttaaaattatattttatgattaatgatatcaaagtgatagattctcccaatcagggatgagaaatttatatgacatgatccaaaagattgggacaagtgacttataatgcagtctttatggtctcctggtgattttaatgaagccatacttttatgcaataagtagaagattattacctcactccaggatcaaaagatggagagctattaaacatgagcctattttaaaggcaccattagaacacacatatatatatataaattaaattttaaggcttaaaactgccagaaaagctttctgcatggaacactgtacattcttcaaatttggtcactcttaaaactcttcattatgccatcttggcagggaattgtggtagaaaaatgggagtgagaatagaacaggaagggatggtggaataagcaaagtgtttcccagtaactgctgggagttaacctgaggttagtcataaaaaagaatcattaattggttaattcactcattcaggcatttatctccaggagctcctggtttccagaaattatgttctatatgtaacagataaggagacaattcaatcatatatgtgtcctcaagaagcttagagtctattggctacaacagattagtaaaccagaacttaaagacaacaaagaagtgctataaatactgtatgcacactgggttatggaactaaagcagcggggagcctccatacagaagagaggtagctgaatcagtagtgggctggaggaaggaggaggaggcagagggagcctcaaattggcttccaagaggaagtgatgcttgaatgcccctccctgtattcctactccctctttcacctttggacctttgctgtattcgggctgccagggttttttggtgttttattgcatttgaagaaatctgagagcagaaagcagggaaatttgagtcctgtcatgggctttgtgttctaaaggccaggactttggtggaaggtggcgtctcggggtgtggatgtcagataaggtagaatatgaaataagccagagtagggttttctattcccaaagcctaagaaaacgcccatgggctcaggggagggtgaagtgttagaacggctgctttgtgggtgcaggtgagacccctggatccttcaccgctgagccctgggaagtgggggaccctcaataggaggactgtgatccttggtagagccatgagaaatggctggaaagtgtttctgggggatcatgccttagatatgcccaggttttcctatgcctccatttggggtagaatagtgagatgattcttgggcatctaacagtggtttggatacaactgaaaaagaggaagagagagagaaaaggagaaagcaactgctggaaatgaaggggctgcatgaatagcaacagggaacaacatggtggtaactgtcctgggaatacttatgagaaccaaagagataatggacattttagcagatgacaatgtgcacagatgacatcaaggcagataggggccttactcttcatgttgagaaagtctccttaaaacgtagaggaaaccctaggaaaccagaagtaggttagatgaatcagaaaagggctgagattgagtttctaccatttaggtgaaatgacatctagcaaaaaagcttaggttgagttacagaaaaataaaattgcatttcttgtttttttgatttgtagacccagattcatgcccactatattggtggtaattttcaagggcaaggagtagggaaaaggacaggttctaggcaagtattaattcttaggcttaaaagagaatggcatggtacctggaaaaatgtccaagtagcaggatgagtccaagggggtgtttagcaggaaataggggtcaacataggctgccaaaggccagatcagaaagggcttcatatttcataagtagaagttatcagtttcttcctgaaggcagtgtggaaacactgaggaattttataaagagaaaaacactcaaatataatttagaaaaccagtttaagaggtctagagagtggactggaaaaaaacagaattcgaggtggggaccaggaggagactggctagaattagggagatcctgagttctcagtgggattggggttggacgggggaaacagttgggagaaggtgccaggtcttcataatgttcggctatatggggaggggaaaaacaacacggagaagctgaggatattactggtttcagagactcacaatttaaaaagaagagaaaggatttgatgaggaaggtcttgagttccatttctgaatgttgtaagttggtagtgtttaagaaaggtcagagtagtgacacagagttcagagctgaaatatgggtctggatttcaacagaaaggtagattgagctaaaggtactttttcaggaatcactaaaaggtggtaagataagaagtggccatggttgggtgattcaggaaggagagaagaggacacagaatgaaactctgaggttaacaagagaagggaatctggaggagaccgaaggtagccatgcaagaaacagaaaaatgatatatatgaggccaaaggaggagagaagtttaagaaggagatagttactagtgctagatgggaaatgaaacatgtgctttggatttggtagtgagaccattgataattaacttgataatcgaggatgtgagagaagcaatgagaatgaaaggtgggagaagaacaatgaggcagcaagtacactctgttcttttaagacatgtatttgagaaaggaaggaaaaacaataccagaggaggcactggattaagggagtttctttaatacaagaaagaacctatttgtatgctgagggaacagcattagaaaagagggtacagctgaaggtagaggaggaaaactgatgaagttactagggttgaggtgaatgacctggagcccttgtggagagaatagtcttttcctgctctgaggtggaacaaagtaggaggtgaagtgtgggatgcagtgaagttgtagataaggggacagaggatctatttaacactgattacacacttgctctgctagaatcccccacgtggaccaaagagatgggtatgattccgtccttgtattcgcccttctcaaagattcactttaatgaaatgaataagtgaatatttaaccttatactcctttaaactgtagaccaacatgtccagcagtggtctacagagggcaggatgctgggaatggctactttcctagacaattttattctgaccttgcttagaattggtagtgcatgatgataataaaaatttgtcttttaatcagtttcattatgacccttcattgttatctactatagataacatggcctcctattgcctgcagaccctttcttgccaccggcccttcgttcatcactgatgcccaggtctgtgcttcaaagttcctctttgaagcaaacataaaagcacaaaaataatgtggatgaccagagtaaaagaaccagaaagaagctaaaaaatcaagttaaacctctttatcttttagaagaaaatgaggtccagatgagtgaatgactcaggtgaggccaccaaacccaggaacggcagggctgggtctggaatccagttctcctgactcccagttagccttagggagaaagttccattttctctacctttccacactgaatcacaaaaagcaatttagtgatatctacgtaagtgaatgtcacatggagacctacattgcccatcaagaaaccacaggtattttaggggaggaggtggaaagaatgacttgatcaatctctgttttcttcctgttgtggagtcaaagggttcagtgtttaaggacttttagagataaacacattcctttatttttatgtcatccattgttccttggcaatactttcaaataattatgaaggatcaattttgtattctgcagttcttaaaatcccaagctatattttctgaagggtgtgtttgtgtgtgtaaaccataactatttgcatagggcattgtgatgtatcatgggaaatatattcaaaatttatatatgtgatttaaaaacctcaggcaacaaaatatatggggttagaaaatggagacatggaaaataagaggagaatgaacctgggatattactttgagaacttactctcccactaccctggtgttcaaagttggatacactacaagtcatgttttaaatataaaattaaagcttcttattttaagaaacgccatgggaaagctttacttaatatttttgagaggcaaagaattagtctctcatttatgtattttgcaaatccaagttttcttacattggatttgcgtttaatggaaatgtattggtataaagtgaatcacatgtataatacatcacaaaaaaggtaaggcaacaaaaataatgtcatggattttttttttctttagatagagtttcactctgttgccaaggctggagtgcagtgatgctatctcggctcactgcaacgtctgcctcccaggttcaagcaattctcacatcccagcctcccaagtagctgggattacaggcatgcgccacctcacctggctattggccaggctggtcttgaactcctggcctcaagtgatccacccacctcagcctcccaaagtacttggattataggcgtgagccactgcgcccgtccagtgtcatggatcttgatactgaatgtttgttgtggttaaaaaatgcagagctaaaactttaaaaaaaattaatctgtggcatcaactcctgcctaactccagacaacgtgggcttttgcaggaaacactctgagttcattctcagtcttctacctaccagagtttcatgacaattaaacaagatagcatcttgtgaggtcagtgaacctcaataagctagaaattgtcttgtagttgaagatgaactttgcttggatctataccatcttgaatctagacaagcttagcagaatcagacatacctaacagattttatctaacacagttggattcctttgggagacaagaaacactacttcatctgactgtccatttagtggtgaacaattctacccaattatgtcaatcattactagttctttcttttttagttgatgaatactctttttataaaaagccacacgtagggtatacagaacaagctcttacctctcttgaagtcctatgggcttcattttgaaaggagaagggcaaacagaggtagcggtggtagctttgatctcaggagcacctcggccttgagggtccacgacaacattcagtacctttggggcctgctcaggttggaccatgctgtggactgtctttgcctcggacagtgctggctgtaatgtgatgggcgataggtggatctcctggtttttctctttgtcttgtcttaaggaaagctgaaatctttcttttaatctgtaaagaatctatagaaggagatataaaaaactcctgtcacattttctcacactaaacaagagtatgatctcctccaccccaccctggccgacaaaccaaaataaaggcttaacgataaagtaaacaaagccctctgagagatgatttctcagtttcatggtattgagatttttctcaagacagtacacttggtatttccagttatgctgcacatatgtatcaaataattgtgcacatgaatctgttccacaaagatatattcaaaagtaaatttaaccaattttatgaaaaatgccagatgttagtttggtcacatggggaaatggtaggcttacagaaggaataaccgtaaaacacacgtctatgacatttatagaaatggagatatacatccaacatggcttagtagaaaaaagtagtcttgcaagtattaataaaataatagttatgccataaaccacagtttcttatgttggtaaatctctgcattagtcatatatcaacttgagtatctggtaaatacttgacaaattaaatttagggtatctatgaaagaataatttggacaaccagaatttttattcttaccactttgccctcttaaattttaatatttattttattttatttcgatacaggatctggctctgttgcccaagcgaaagtgcagtgctgtgatcatagctcactgtaacctcgagctctccttaagggaaaagactatgcacctacgagatagaactagaaatgcatattaaacattgaactcctaagaaaagaaagacattttattgttttttatgtcagtccacctccttgtaatctggaaacttttatactggtgatattcattgactctggtagggtaaagttaaagcttaaattttgaaaaaagggtggatttggaatattcacatgataaatatttatcacatgaatgagaaagaaaagatgtctgatattaagtaaaaggtcttcttacctttataataactactttcaagcaagtgtaatgtgtttttttaagctataggatggaaaagactgaagatgaatgcctttatcatgtgcatagtgtctaaggtttttaactcactgcttctcttcagtttccatgaccttcacggtgtaaaaacaaaacctgcactagaacagtatcaatcagatgatacatatattttaggcttattgtgttcagctaaacatttaattactaaacgatgaggcaacagaatttaaaatattgttttagttgcaagaaagttattttcccaaatgaagaaacaaatatatctgtacctttacaaaaatacacttagaagataaggcatatattatatattttaagctcttcacatctaaatataatatgcatatgagaacatttgcttgcctgtttacacttggattttggagaaatatgaatcaacaacgaaaatgggaaagccaaggaaatcttgaccttctcaattgttcttgacaggtcaattttatgatttatattagtgtaaaacaaagtctagtccaaagtccttccttaccattcatgagcttatgtttttgatgagaaacctttgtaacatattttccaatcagtcatctgtttacttcatgtctggttacaggtcaactttgcaacctgtctctgtgtggtacgtgtacaaactgatttctacatctttaattagggaaaagtagaacctggagaatgtatgatgtatataagatagtgtttaaaaatactcaagagattgggctgtctgaaaaaatatggaaaaaatggaagagattgctacttggcaatagggtagttgtcatgaaattaagctataaggcagtgattctcaactggcagggattttgccctcaggaaacgtttggcagtgtctggaggtatttttggttgtcatattttcagggtgtgggggaaggagaagggaaagggtgctactggcatctggtaggcagaggctaactacctttacaatgcattggaaaggctcaccacacacccccgccaacagaaatagtaactccgaaatgtcagtagtgttgtttgtaaaaccctgacgtaagggatcataaaatttttgtggtgtaatctcctcatttcacatttaagtcctgagctattggatgagttatggaggtttggaaagaaaacctagaatccaagttttgtgacttccaggtatgtgatcattcaactctattgtttcctccaaagtctcatgtccttctttgaaacctctttccgaaagcatctggaaaagtgtgtcagagatttttctctgcacagattgagatctggaatatagcatattcatatttctctatgggaattcactttgttgaaaaactcaacctaaaagcttaccgtagcaatggcaagtcaacattttgccttcatctccaagagcttgtttgactcttggactggaataaagtcatgtaataatttaaaaaaggaaaagagaacagattattgaatgagaggagctgtaaaactcaaactatagcaagagaaagaaaataatagtgggaataaaaaaaccagaggaacacagaaatgggaggaagctaaaaaaattcgatgaagcttttctgcagcttaaaattttcgttcaaaaatctcatgagtaacacaaaacattctgtcaaatgtgttcagatttcaaaacgatgccaccaaccactagtctttaacatttgttctttacagtgttttacaattagttctgaaagagttcattcactcttttaatttaataatcctgagtcaatccctactacattccataaacaagatattgtagatgcaaaagtaacacagaactctgtcttctgggaattcataggcttccagaaaagataaatgtgtaaaaattatgttcagtacaaagtactaagtgcaaaaatagaggtgtgcccacagcacagaggtataatgtggcacacatttaccagttccatctgggtagaatggctctgataaatacagccattcgcatctgctactactggagttatttgtggccagaaatatatgttcacaagacagagtgataagactaaaaacaacaacaacaacaacaaacaacaacaaccacagtttgactcctttatgaaaacaaatggaattatggtaaagaatgctgactttcaatttagatagacttgggtttgaatttttaccactttctactctgccacccccatatccacccattgcatgttcttggtcaagtcatttattttttctgaatcttagttttctcataagtaaaattaggaaactaaaacatgttaggcatttagcactacagtaaatttagtaccagtttagtaccaataagtgtgcaataaatggaagaaactaatttttaatgttattactattaagacaattgtattcttcttaatacagaaaaaaaattgaaaattaatttgagatatatgcctacctaaccaatcattccagttaggaatctggtcctagttcccttcatcccgagggattatatttaacaaatgagaaaattatgtccacctttgacatgtatttattacatgatgttaaggctatagcaggtggttcaatgtaggatttcttgctgcggctaccagactacaactagagaaactctttccctcccatatggatgactctcctatgggtctaacatgccagtgtttttattgatccaaacaactattttcatgtgatttctaaaactgctttccagaagcaatctggcctgtagacatctctagctatatttcataaatgtctttgtacttgttaataaacctgtaaggacatttggatgtctaatttagatgataaatggtgttctttctattatttgttcaagtttaagaactaattcttcttagtaagtttctttcatctaaaacagactgaatggattggaagttgcccacacattttttcttggaaaactgtatttttctatttgtcgctccacccactgcacattcacatttgtgaggtgctaaataagtcagcatatttgaaaatgtcatgcctgtctaattttatgcctggcaacattttttttttgtattttaaggaaagtaaacaatatgccacttttcaaaaattctgccaagtcttatgttgttgttacatagcacatacaaccttccattacagcaatttacctatataattttataataaaacccatgcttttcatttctacggcatgtaggaatgccaatgcaaatggaggcacttgatttgttataaatataatcaatgccagggggaaaattctgagttatatctttcctttgtcatggaatcaacaaaactatgggaaacagagttggaatacatgtgtttcagaatcacgaaagtgatagtacaagtatcactgagaaatgcacgtgaaacacttactttaaatcaagcttattatcaaaataatttgaacacttagaaagatgagcttattttagataatcgctttgacatgtccctaaacatgaactcttgactcctctgtggtaagttccatcagataaacttggctttgtgctaatcctattaggtagtacttcttttcttgtgaatatgaacttcccgtctgtgtgctgcgggttcctctgttacttttcagaatttgtttttatttatatatttttcagaggcagagaatctgaagcccaggctggagtaaagtggcatgatcatagctcactgtagcctcaaacccctgggctcaagtgctcctccccgtcagtctcctcagtagctgggactacaggcatgtgccatcagcctggatgattttttaaacccttttttttttttttgtaaagacagggtctcactgtgttgcttaggctagttttagacccctgggcttatgcaattcccctgcctctgcctcccaagtgcagggattacaggcgtgagccactgcacttggtccccctgttacttttaaaagtgactccttcaaattaaaatttaagacagtgtttgaaatccatctaattatttctttcatttctttaagaaccatctgaacacgctcatcctcattctgaacgtgtccctctcccaggaaatgagaacatttccacacagtcagggaagccaaataacctaggagtcatccttaattttacccctgttgctgaggattgggacacagcaagttttgtcggttctactttcaaatagatctcaatccttcacttctctccttccccaccacccacccctgttctatgccaccagcatcttcttcactgggatattgcagaagcctccagaaagatcctcctccttccacaactctccccatcctctgtccaccaccactttctaccagaagaaaatgtgatttttaaacacacacagcagatcatatcaaggctctgcctaaaacattcttcccctagagcctgaacaggctaagcttattctaactgcacccacagtaccctctgcctaggggtcctttactcacatattcacccataggtctcaaacatctcaggttgctctgctccactcactcattattatggtttcttcttcatagcacttatcaacatttgattttttaaattaatatactattttttagagtagttttaggtttacagaaaaactgagcagaaaataccaagttctcacatacccttcttccctatctcttcattttcccgttattaacatcttgcattggtgtgattcatttgttgcaactgatgaaccaatattgatgtattattattaaagtccatagtgtagatagtgtagattagagctcattcttcataccttgtacaggttttgacaaattcataatgtcatgtattcatcattacagaaaatagaatagtttcactgccctaaaatctgctgtcccctacctaatcgttccctttctctgaaatctctggcaaccactgatattttctataggcttgacttttcctgaatgtcatatagttggactcacatagcatgttcaccatttgattttttaaaattaacttaattattttctatgtctccctctagagtaaagacttcaagaaaatagggatcttatctgtcttgttttctcctttgcccacagcaccagcaacaaatagacccgcagagaatattctgcaggaatctgttgattgaatgaatagatgaatccacctgctaacccaatagagagcaatcacctatacttctgaaatgctcctttcttgatttgttctaataacgttagagtcgacttccctaagtttctgacctttacattgatgttttgcaaatattgggaaaagaagagtcatcctctggccccaagtggttgagggtgtgactactataggtccttttgccacaagaccaacataggcatttatctagttacattcagtacatgagcacgccctgagttagaaatgcagaatctgaaacacattctatatgttaatagcaagctctgctctgtttctgctgccctttagtactcaaaggctgggcatgactctgctttcccacttcccttcttctatccttgcctttgctcttctgaatcacatccattgatcccctgaatattttccacttttatcactttcaattcctttctattctcccccttctcttatcctttctcatctgcaaagcagaaaaataccctaattgtgactgacaagagagggaacagcacttgagatttcccatataaaggaagaatcacgtatattaaaatgcaattaaccataacaaggaactatgtcctttaaaacagagatgcccagaagacgctgccataatttcccaaaacctcccactttctctcattaaaattctttcctcttaatctctgccatgtgaaatataaaaatcagtttttactcaattctaaattattcttttgtttattgagtcacaattcttagaaattttttttttcttaatgcttgacccataggagctacctctgaattcattatggtggaagatttagggtactcttgttacttcacagattttaaactctagaaaacatgcttatcttcaccctgtttaagactgtgcttgttttatatcctctaagtttagcccatgcagcctgtctttccagagggagccccaatctttctaacagtaaccccttcccagtaggggaagcagaaataaacaaaatccaataaaacacttagcaacattgttgattgtggagagaaataagtaacataatgacttttggggggcacttaaaaactaaggaagaagtatttatttaaatgtacaaaattaaaaagaacatagctcacagggaaaaaggacattaaaacctatttgtaaactctaattattatattacatcttgaaattttcaaatgagtagaaacatcttattctaccctaaagataccgttagttcattcaatgccaaatagtactgcttaatttagtgggttaagtttgttttgggttctatttttaaaattagaaacatgcttttaaaggctacacattattacttacagagctattccagcatatacatttatacttttgtactatttatccaccttaaaaatgaattagtagtctacctaacttagcctttgagggtataatcatctccttttcatagaatgctttcaagtccttttaaaaataaggaaatcaaccattccttagggagtaatcttgtctcaaagacatatctctttttaaattttttcctgagttccataaagatgatataaaaggagaaataaagtaaacccaaagtgtgcccgtgagactttactgactttgagggcttcagtgacctcagtaaatcactgtctaaagcttcattctcagagttgatcaagttactaaaaactgcattgcaattacagccttattattcaggtcagcatccttaattccataagctctcctttagcaatcgctctgatgtcagatatgaaatattcctaatctagcaggatcatagtcttccttctgctcggaagcattttaacattcatttgaatggcaatgtacccactaatatcaagcagtgggctgagcaaaggataaaatatacaaagaagcaaacttaccatcaaacacgttactataataacaaagatgctgagaaaaatgacaacagcataaaatccttctttgctccagattttgtccgcttcatgctgcccttgtaaaacatttttctttaaaagcaaaacagaaagtccgacgttaaatgagagcttgagaaaactggcgttcttatcagacactaaacatatttttagccttattccattcagtgtagtgcaacacacctacaccccccgctgccagagctgcttctcaaactgatctaagacaacagactgccatccttatatatcgagattatttagtctcctatgcaggagcaagcgtgcctgacatggcatctgcaggtcccaggctttctaaacatccctcagcgtctctcttggaaactacctggttcataggtaagagagttctgttcttttctgtgtggaggaaattgtttctgatttccttactctgttttaagtcccctcccacaacatcagcaccctggattacgtgctgtactacctctttacttttaaacaaaagtgaaacaagtgcaaacaaaagcttgtggtgcatt

SEQ ID NO: 611 - DNA, 150858 bp, Homo sapiens
tcagtatttagtattaagagtttattggcagtatgaaacaaagtcaacattgctgcattaaaaattcatatatgagcagaacagctagtgtttgctgagggtagttattttaattttttttgtctcttgaagattgaaagctttcagaaatgtaaggacatacatggaaatgtccttataaggagcctcgaaaatgggacagattatatcattcctgaaggcatataccttttgttgagagagagattccaggtagatagcatattcaaaaatcccttcttagcaaaagagagacaagtagttaaaactcttgatacttcagagttgctacaaatttgtttttcccttttaaagtaaaatgactcacgatgtggaaatacagtggatagagttctggagcagaagccacctttatgcccaataatagagagtaaatacatatatacccaatgacaatcattgtgctctgtaattgtttgataggagggactataaatacacatttaataggtaatattatcaagacacatttccatataaaatagttactgtttttgatttttgtttttcaaaaacaaagacttctctgttaaaaatccattatcaatcacttgcaactttagcagcaagattctggtaactgagaaaggtaatagcacttcaaaacaggaacagtttaacagctgacagtccattcacaagacagattttgcaaacattaaagcatctaacacataatacgaatgtcttcagcagctcatccagtcatcacctgatgacatttattactgaatattacatacatacattctgtgtggcagatagagtcagtacagacaaaacaaaatctgccttaggctgtgtgataaacctatcatacctccatcatcaaaaaaccttcagaataatttgggggatgcttacaaatgcattcatatacacaaggagctggaaatcttaaatatgttgcccagtcttccacaatccatgccatacatgggcttcagagcttctccttccttccattgcaggaagctccttctagaagccttgggtgggtaatttgattaatcaccccaagagattgatggtctgacaagtcttcaatgactcactggacagtctctgctgaaagtctgctctcatacaggcacagagcatggtgcacaaattcatactgctcactggtttgcaccattccacctctgcaaggaagaaatcataaaataactgattttgctaaaatcttgcaatttcaagtaacacagagatttcatccaagctagggtattatgccaaagacacatagaacagtcgacctagtggttcttttgttatccctcttacctgtgtccaaatgtctcaactatcaaagttaacatggtaatgtatataaagggcttaacacagttcccagcacacactaggcacgtgattaatttttacctgtgtaacattactggggaggtggtacagcctaatgatcaagtacttggatttggcatcagccaaggtgagttcaaatccctcctctgccaattcttagctgtatgcatcttggacaaattcctcgaaaccccttgcactttagtttcttcctctgttaaagcaggatagtaacagtaactactgctgtgaaggttaaataaattcattgtagctggtatatttgtattacttctcaggtgcctcatgattcatctcttgttaaaatggtttatacatttggcttaaaattgattgacggagacaaaccaaacaaaactcatctgcaaaatgttgctttctacaagtaaaatgaagtctaccttggaatggtttatttgaatatgttgtacagaagcaaccttagccttttggtgtacggggtgtctaaacacaatagtgggtgggtccttaaatgagttggaaaaagggaattggctctgctgtgacattttcctcttggttatcaccattatcatcactagctgcccagcaccctccttgtcaatggattcatagaaagcacttgccttcatgagaaataacggtgcttctcattatgtttttatatacataatacctatatcacattttcccccttcataattatgatccttttttaattttagtttttgagaaaacgtctccttaattgcttaggctgttgtgcagtggcatgatcacagctcagtgcagcctcaacttcctgggatcaagcaattctcccacctcagcctctggtgtagctgggaccacaggcaccaccacacctggacaatttttaaattttttttttcttgtagagacaaggcctcactatgttgcccaggctggtctcctggactcaagtgatcctcttgtcttgggctcccaaagtgatggaatcacaggcttgaacgacggtgtccagtcctataattatgattttttagcttgacaaagttaccagacattaatatgttactattcctgctcactgtataaaagcatcactatcggtaactatttaaagtcttgtaaattctctgtaactctgcaatcatgcaactgatcttatcttttagtttaactctatgttttaaccagatttttccaagtggttgttagtatcattcaaaataactttcagattatttaggcacttcaacttaaaaacaagatatcttgtctcactgtaacaagacttctagttaatggtaataataaaaactgggcttctatgtttatttgtcaatctatgtcaatattagagcagtaaaacttccttgttttaaactaaacagtgattccccaggaaaattaacatgatgtcaaaatgatgtaattggcaaaaaataaagaggtaaattcacagtttttggtgacagcaacttattgacagaagtatttaattggtcttcctcccctagagctgtacattttgttgcattgaaggcaaccttctgggctaagtattccttggtcagaagtgaacaacagaaatggccagctgagaatgtggtaatggtttatcttcttagctgtgtgatgacatctgggctcatctaaaatcatagcaggtgttccgaagatgctggcttgaactgtgaagcttgggagacaccaccacagtaaatattagggtagctccagggagctgagaggtgcctcccttcctctggcatttgcacagctcagggcaccattactccctcttgagctgcagacagtatgtggaagcttctatgtgctccacctcttaggctctggtctgtcagcttcctctcaccatttacctcactttgaggcaagattttccccttcttgtatgttctggtcagcactggtatttacatgtccaactggtgaatgaatggagacacagtttagaatttaataactgtttcaccctaagtgggtcagtggtgtaatttaatggttggagtatatttactatgacattctgttcactaaatcaaggttgttttagccagtgaaagtggggaagatggagaagcatactcattaattgtgggctggcaaaattcttgcaggtctgaaggcttcaggaaagtatatgaaaagttctcttacctcccacttaatttggaaaataaaaatgaaaaaaactggcatcagaggaattcttagagatcatccattctagtcactgacaatatagcttttttagaaatcttgcaattttagaggcagccttttccaaggttggcaggaaaacttttaagacatcaacatgaatctgtcctttctaactttcaccgcattggtccaactgaaataacccaaaagacgtcttaaggctcccctgtagtcacacaacagctctccaaaggctggaaaacagccatcaaagtcctataatcttttcttctttagactaaacatcctgtggtcactcaatatttctgtacagcctggtttttctgtcactcaccactctagtctccctcttctacaggctattttatcaaatatgaccttcttagagagttgtgtctccttctgatgagatctatgaagcaggcttattttctcttccagctgcacgttagagaccaatagatctgtgtttgcaggtgcatcaggtggtgaggtcccccagtgcctacatggtgcctggttctcggtagtattttaagatactaactgacggtgtagattaaataaaaagtcaacaagactttttttgaatgtggacattatagctttctcccatcctgtaattatgctactggatttttgaaactaaatgcaaggctttctatttattcttgttaatttcaacttgttagtttcagcacaatgctcttgtttactggatcactatctatcgtcaatatattagtcttccatttctcactcccagcgttgtgtctcccaggtatttaacaaggatcccttacatctttttatctaaggcattattaaaaaatagaaaaagagacaaagtagggtctttaatatgagtaagttgatatcatgatatatactatctaatcccattctataattatttccaactaggttgtaggtcctttaaagacctacaagcataatggcatggtcttcttctacttgtaacaataaaaagcacttacgagtcctaggtaaatacttgtcaaatgaattacccaggtcatgctattttcatgtcatgtgaaaacagataaactctaggctaaaagaaagcaaaaggtattccaggatgcattcactggaggctggttcaaattcaggaactcatcataatcatctctgaaaatattaaataaatgtcctattgcatatattgatatatagaatagtctattggctggatgcagtggctcatgcctataaccccagcactttgggagtgctggatggatcactcgagcccaaagtgggaggatcacttgagcccaggagctcgagaccagcctgggtaacatagttagaccctgtctacaatttaaaagaaaaattagctggacatggtggtatatgcctgtggtcccaactacacaggaggttgaggccagaggatagcatttgctctataacaggtaatccattcttagaaaggtcaacagagtcttctttcttcttatttttgatatggggtcttgctttgttgcccaggctggagtgtagtcatgcaatcacagctcactgcagccttggcctcccaggctcaggtgattctcccacctcagcctcccaagtagctgggatgacaggtgcatgccaccatactgagctaattttttctgtgtgtgtgtgttttttgtgtttgttttgtttgttttgttttttaagagagagagagggttttgccatgttgcccaagctggtcttgaactcctaggctcaggcaatccatccacctcagcctcccaaagtgctgggattacaggcatgagccaccatgcctggcaaatgcagttttttagataggctggtcatagcaaaaaaagaaacacctaagaagctagtacagtgtctgtatacaaaatatatttatggaataaatgtataaagcttggttaactatggaactctcaagagagctctatagttattcatcctcaggagagctctgacttgactccaggaagctcttaggtcagataggtttcatggatttgctaaaatctggatctatattactgatataaagttcccaatacaaagtggttctgggaggtgagaaacaagggtactctttttcttactttttttttctttttctttttggggcagggtctcactgtgtcatcctggctggatcgtggctcactgcagcctcaacctcccaggtcaactgatctccttagcctcccaagtagctgggactacaggtgtgcaccaatatgcatgcaccttaaattgcaaacagaagtgaaacttacctcaggttcatatctgataaatgcttatgttagaactaaaacataaccccagccaatcataagcatccaactcacatattgttatgtcagtaaggactttccaatacagtacctgaaaaaaggcaattatgtaattgcaaaccaaccaaataaattgtttgtttctgtactttcccaataaatacttgcctctggcgttttgtcattggaacactaaacctcttttggtctggtgtttcccaatgtatgactggcttcttactaaataaactctttaaaattttattgtgcgtcagatatttcttttccagtacacgtttgttttcccaggaggtataatacattaagtgaaaatacctactgctaagcaggagttagtttaccaaaaaagagtaaggtcaaataaaaatgtcaagagaaccccagctagctgagagaatggtgccaagttcattaccaggggggaccagagtatgttaagagggaaaaagacagcatacactgttgtcaagacaaattctgtctccaccacttactagatattttacccaactacacaatctctgcagtgctcagttttttcatctgcaaatgatgcgacaataaaaacaatagttcctactttatagcattgttgtgagaaataaatgggactatcacttaacatgtttagcacatagccaagcacatatcaataccataaatgtcaactattattattgttattgttattgttactctttggtaccatctggtcaaataggactggttaggaggctctggagtgaggcccccaaagaccctggagaaccaagagcaaatctggcagaggacattagtttgcccattaagttccaaatatctttctaaatattgaccagcctagaagacaggcacagtggaggcagatgatgaaaatagtaggcttggagtctgacagattcaggtttgaatccttgtttttttaacttacttagctaaatgattttagacaagtcatttagtccttcccaacctggcttttctcacttgtaaaatggcataaatgacaaacgtcatcgggttgtgaggattaaatgaatcagagcatatcaatgtctggctgaaggctattcacagaatccccagaagcccagggttctacaaaggtggctgaggaccctgggcagggcagaggaggaggatgggtcattaggactagatgccaatcccagctttgaccagggaagttgtgttttttattggttttctgtgttggtgttctgtggaagattctgcctgcaaaaagttttccattgttcacaaagaagtttgaaaaccactggcctggctaataaggtatttaggtatttatctaataaggcttcaagttttacaaggtttaaatgagagaatccacaaaactcttggcacagtaactgcccttcagtgagtactaaataaatgctgtgtattatttttcttattcttagttaatacgacacctagggtaaccatgtttggaagagttgtggttcattggtgttgtcctggtgtcattatcaattgggtcacctttcactctcagaagtaccttggtttggatgataaattatttgttcatcctaatgatgccccattccatgctgtggaagaaagtcattccctttattgcaaaagtggtgttagccacgtggcttggatttctttgtgcccacagactatgaaatgctgtgtttggccaggccagagaggattcagatatactaccctcctataaatgtcagataatctcatatcacattagccctgccaaatacaaagatcagtgtcgtctcagtctccgtgcagaacagcacgtagctgtgtcagctgggggtaaactcaggttagaaagggaaaaaaaaatgtagttttttccctttgctactgggagggtgttttgaaaaaaacctctccagatgcccaggagagagatttggcttttaacatgttaaaattttgaccttttgtgactattcactcacacatacagagagcaacagcctttcctgtcgtaccgcccagcccgtatccggtctaatcagtagacagaagaaattctgcagtgatgactcacttctgggctaacaatgaaacttatgctcctttgctttttattattttcaaatctggaattcttttggtaaagtttggtacagtaaatttagaacaaaaggtgtggacgttaatgtgcctcctgggtaaagttccaagagcttgggcatgagtcaagtgaggctactgtctgctgtgcttagccggggtcagctgtaaggtgtgtctggccccttggacagaggatttcccatggctttacacagatgtcatatcaaggagggagaacttaaatgtaaatttggccaattctgaccaggtattttgaacatagacaccttctccaaaatagatgtgttctaaagtatttgtaggtcataaaaatcagcatatatcaaatgataattcaattgatgagtctaacatattttgagttccatttttttttcctctgaaaattagccgttttcctctgaacactcaagttaacacctaattaactccaagctaggaagaaggaaaatgtcctggcagccacttggaagattcagtcagcataatatgttttacaaagtagacctcttgttgtgatctcaggaattataatgtcaagtaaatccacaccaatttctagggctttatctccaagtgtccttaaaataagcaaatcaaaatgttgaattcctgatcttcaaatgagatctttgaagttcattaattagaggaatctttgtgattatttgggaatgcagagaaatatggataaatgtaaggttacagttgataaaccttagaccaacaagcagaaactttagttttgaaattatttcaaccaggttttggaaacaaaaaatatgttggggacatatattagccttggaaattgatggcatatatattcttctgagatggctgtagttaaaaaaaaaaagaaaagaaaatcatcgaactgaagtgactaatcaaaacatttaaacaatgatatgatgcacattggaagcatctttttatcctgtgtgggaagccacaagtgaggcctttggatgtcattccagtttaagccctctaaggtaaggatgtacaggcaactacaaattccatccttgactcttaaaaagaaggatttgacagataatttcctgctactcaggaagaaaaaaaagaggaaaaaaaaggccttggaataagatattattttatatgtttcacttcccaggttctgttttaaaattcttccagtgtccagttgccaatgggattaaaaggaaaacgatgaggaaaaagttatctgaggtcaatctgcaatggaatatgttcctttcctgcctgcttagatgtcttctgatagtcacgaattgatttgtagtcatacttctgtaatatctatatgcatgtgaagcactgtctgatgttaaaatataaacatcatctatagtaataaactgagacactgcatctctcatgctaaatgtgtaaatgaccttctgtcactatctcaaactgtagaaccttgacatacccaagcctaaatgaatcttttttagcaagagctacatgcagcgaagctggttggcttagctttatagcaattggtatttttaactaggtggtatagttgaacaatttagtgatatttgagattagaaggtttaagtattatatggaagggctttctaagtaataaaaaatgattatactgtgttcagtttagtactaatgttatggatctttttttcaactataattttaaaaaattgacctatacatttacggtaatctcctgttaataggaaaatgtgattgagcaaaatatcccttttgcaacaatgctggccaacagaaagttcattgtacttatcatattcagatattaataagtaatctaaactaaaataatcagagataaacaatttttcctggtttatatagcaactagttcagggtcattgctgaaggcaggattagaatgtgaacttcctctctcttcatcttgagtgtaacccacttaggcttcccactgcagaaaacaacagcagaacccccaaaatccagaatttagtcaatctaatttgagcaaaattgaaagttcagttcagagtgttttataaaaacttcaaaattggtcatgtggccttggagatgtccccttttttggttttggattcttcctttagaatgaaaactttgggcaatatattcctgaggctagattttaaaaaaaaacccacccttttcctaggagatgtttggcaaatgttatgactattgcggctatcccattgttctccacataaacaaatcttcaaagactcaaagaaagcaagagctgagagggatctcagaaagccagttggtcactctgcaatcactgaattccagcatggaaaagcatcttgttagaggagtcctgacatccacttaagctttgttgtgagtcacacaatgaatattaacttgcaagcattaaaatacaacaatcaggtggaggtccatgaaatatcttactcttgatagtaagatatttctggtttttataccagaaaaggttggagatcactgttacgccccacatctccttttactatgtagacagagaggcctagagtggacaaatggtcacacagaaaattagggggcagagccacgcaccaagctccttgacatctagtccagagatgtccggcacctcattcttttgctagtcttaccagtgttcagttgcaattgccataccacccacttcatcttttaattaaaagcgaatgcagtgggaatgaagggatgatcccttaatgcccttctaaataaaacattcgtgggtgccttgcactgaatttgaactcctacttggaaaaaaaaaaagaaatcttattttagttcaaaatatgctcaaaagtattagtaaaaggagaatcacagactcatgaatctgcaatgagaactgagcatctattaatagaagttgtcacaaagccaataaaaataatgtcttgccagagaatgaggaatctaccaaatggttttgtcattgttatactggaaatatccattcagcataacacattcgtctctgaaccagaccatttgaatttattactaaaatgcagatttttaacttgagtagaaattgcttgttcttttcatgttaaattacaatgaccaggcattgtaatttttggggtggtggtggtggaaatcaaaattttaatcctatccagtgttcaagctcttgactgatcggtcatgaaatgagccccatttcaagtatccaaatcactgccttgtctttttctttgctgttagccatacctggactcctcagaggaggcagctacaagtggagaggggtagattataagaataagatgcacagtatgcagccttcattgctagtggttggaggttgttaaaaaagagtagaaaaggatagaggaaggcctgtgaagctcgtattctgccgaatacaaaatatcagccttctgatatactggttctgtcttttctctctcttattacacttagctgcttttaattagttggttccaccattcctttcccaccacctttgtttttttgagtctcactctctcgcccagcctggagtgcagtggcgtgaagtcggctcaccacaactctgcctcctgggttccagcaattctcctgcctcagcctcctgagtagctgggactacaggtgtgcaccaccatgcctggctaatttttgtgttattagtagagatggggtttcaccatgttggccaggctggttttgaactcctgacctcaagtgatctgcctgcctcatcctcccaaagtctgggactacaggcctgagacaccgtgccgggcccttttcctctttttaggggtccaggttcaggcttaaattactatcctatctctagtcttctcttcaccacaaagcttcttgaaagaacagcttatctttattattacaacttctttccctctcatttagatggttcttgaggaaattcatctgtggtcaaataaatgtgaaagagtgcttaaataaaattaaaggagtttctacattggaagattttagattttttaatgcattaatgcttattgtgagtctccgagtggggaagacttcgaagaaatatagtgtagggctgggtgccatggctcatgcctgcagtcccagcactttggcagcccgaggcaggtggatcacctgaggtcaggagttcgagaccagcctggccaacatggtgaaatcctgcctctactaaaaatacaaaaattagccgggagtaatcccagcaactcgggaggctgaggcaggataatcgcttgaacccaggaggtggaggttgcagtgggcccagataatgctactgcactccagcctgggtgacaagaaagaaattccatctcaaaaaaacaaacaaaacaaaacaaaatatatatatatatataaacagcttttccccgaacttagtcaagaacctactttgtgcctgaacgccaccaagagggtttggcttaggaggctctcagtaaataattgttaattaaactatgtcctgagaaggacaatctgggaaactgggaaagctggttaagacacccatttttctacacccaggtgcctgattcatgctcagtagcagatgtctagtgatgcctgttgaatggatgaatgtatgcaggattcaggagcaccactctgtgcagaggtctcagatgcctgttccacagaacacaggatgcaggcccatctattaggttggtgcaaaaataattataatagcaaataccccaattactttggcaccaaactaatacaaacactcattccattctaaaaatatcctaagacagagttagcttcaagggatcgtgaccagtgcagtcatatacctctcaccttcttgtgctgagaaggaccctgaacttgggttaatgctttgctgtcactgtcttgaagtatttgatactttttaatcaacagatgccacattttcattttatactgggcctcacaaattatgtagctggtcctgcccacagtgtcccttggagtgctcttcagctctgtcttagtgccgcttgctttcccaagacaagccatgagcttatctaacagtctccttgattgaaggacctcgccatggcgtgtccagcatcggaagccctcttcaatttcccttcaccaaaacccaagttctgaatgtattcctaatgccaggagttacactctctccagctaccacactgaaaagaacagatcacttcgtttagattgaagcgttaatagcatagtagatatgaagtgttatgccatctcccatctccagattcaataaactttagaaaaagataattcttttaaaagaatccatccaagattagctctttactagcagtattttagacattcgctatacattttagcatcctccatagatagatattttaagaagcagcaatgttttgtccctcaaattgtactcttaaggcagttgccgacaacgtcactccaactattcataaaggagctctcatttatactaaaaactgttttaaaaattatggtgtcccgttgtcattgcattttgtttttaagaggtggagttttgctatgttgcccagggtgggtggcctcgaactcctgggctcatttgtttaaaatggcagagtattatcaaagagatatgtttttgtcaagaagttttacaataaacatattccaaaagcctatttacttttctataagattgataaagatcagagaaataattagagatcaggcaaatgtcccagattccaataggtccattttgttacttcccaagctacttgactttggacaagttactcgctatctcgaattctttggttcctcattaaaaaaaaaaaaattaggccaagatgcttcttttccttcacttgggtttattttgggagttaaataagtcatgtgctttgaagaccatggtgaagagtccatgattaaatacattctgtatgtattaaatacatagtgcattctggaatctctggacagattcagagctgaaggtaaggatagccaggaaaatcggaatttggggacaaggtttgaacaagtgatgaagaaagatatgctgcaagtgcataacggtagacatttggattggctgagaccagttttccctttactgccatgagccaaaaacatggttaatggcagcagttagccacacattggaatttttaaaatgaggtatgataggaaaaagctgaaggactggaacaagaggcaagaataatgtgggagaaaaagaagtaagatgaggtgaaacgaaagggataggttttctgttctgcttttcataacaactagaagagtgtacaacagaaggaagagacaagaaaaggaaaacatatgttgatcctgtgaaggaaggaggctggaggaaagacctttcaaaggaaggttcaaggagaggatctgtttcataaacaacagaaacagctgctcagaaagaatgcagaaagggtcttgatgaagaaatcagaatgattttgatgcatatattggcagtcattcaaactcaagggggttgggtgcctataggcttcagatcagcagagaagttggatgtgttttcaagatcctatcagaagtgaaaagacaagacctctgggaagaccttggtggtgacggaaggccaaggctaaggtttctgaccatttgctttaggaaggaaggagcagatagaggaggcattgtgatgtggtttaaaaaaatgcatttgtaattccattcaaaactagaggacaatttgttagacctgaaaggggaatgtgactgggaagtggaacccaaggtggaggtcaggctatgaaagtgggcaggggaggtgggagatgggagggtgagcaggcaagaattaatggtaacataacaagagccaagaaaaagagcaaaccaagcctgtttttcagcacgttcttccaaataggatcagaacaggtgttgctggaggccagcttggtttggagtcactttagatccatgcatgtgtttggcattcatggagttctggcactaaacaagaacacaggactccaaggtatgaactggagtccccgggtgatttggggtctcaggtggcagccttgtctacagaagcacaaatcaggacagatgaaagtcaatgtgggagcagctctggctgactgagtgctgcttctccccctcagagttagggcccctttcctgtgtgaagacaggccctaaaatttgaagtgaagcaactgatcctattccagctgaggtggactacacaggatggaaggcaaaggaatatcaggagattaaggcagcaattataagaggagaagggataattggaactgatcttttttatgtaccaaaagaaaacatttttggaagcagttacatgtggggtgtggtaagagggaagcaggattggggggtaaagagaggataagcaatgtaggctgagtgttctactaaatacatttcaggtttaatgtcatttaaatgtggctgaagtcctgtgagttatacattactatttccagtttacaggcacatgttaggttccttgctacgtatagtgataacaactgtggaaacttgattgaatgcttattacacaccaggcatttcacataggtcatatcatcttttcatccttacaataataataggaaatatatactactattactccaattttccaaatgagaaaactgaggcatggagaagggtagtaacttgcccaaggccatacaaccaaaaaaatggtggaatctgggatgtaaactcaggcaggcaatctgtttccagagcccagaatgttaatcgccatgatgaactgcttctagagtttacatgctaacagaaagagaaaataataaagaaagaaacaaacatagtagaaaacaaacagggaagatacggttagaaagacttagaggctactgtctaaaaaggagacaagaatgttacagatgggaagggaaaaactaatctggatagggaaatttgaatgtttatttttttagaggtaagagaaacttcacagataattttaataataaagatgataataacataacaaacatttattgagggcttactatgtgccagactctattccaagtgttttacatatattatctcatttttcagaataatcttcttgtcttttttattgaaatgccaggacatagcacatagtgctcaaagcatatttgttgaaaaaaaaatctcgaaaggtaattatatggcctggcacggtggctcacacctacaatcccggcactttgggaggccaagatgtgaggattgtttgagtccaggagttcgagactggcctgggcaacatggcaaagccccagctctacaaaaaatacaaaactcagctgagtgtggcacacgcttgtactcccaggaggtcaaggctgcagtgggccatgatcacgccactgcactccagcttgggcaacagagcgagactctgtctccaggaaaaaaagaaaggttagtgtataattttatctttttagaaaactctaggtcatagggctgaagctcaagggaatcaatgcctgtgtccctctttgttttattacttcacagcatttatttctgtctgaaattatcttggtttattttgcttgtttattatctttttctgctagcatataaattctaagagagcagaaaattcttgtttaatgctgtatttgcagcatctagaccaatgcctaggcatatgaggtgattagtaaacatttgttgtttgctgtttgtttttagagacagggtctcactttgttgctcaggctggtcacaaactcctgaactcaagggatcctcctgttttggcctgccaaagtgctgagattacaggcgagagccaccatacctagccaacaaaactcttgttccactgtagtacactgaattactgagcagagacgcctgctgctcatcattttgtgccttctctgaagcagcatctgtccactttctccatcactaactcaatcgtccatttacccaggcaggcttagttgtggagcaaggaagaagagaagtttcttgtttatcttgttttcaaaacaaatggagattataacaaaggtgatcaaaccatatctctataaaaatgactcttccatctcaccctcataaggatggctactatcaaaaaaagcaaagcagaaaataaaatgtcagtgaagttgtggagaaactggaaccctcctgtgttgttggtgggaatgtaaaacagtgcagccactgcagaaaatactatgatggttttctcaaaaaattaaaaatagaattccgtatgatccatcaatcccactttttgggtatatactcaaaagaattgaaaacagggtcttgaacagatatttgcatacgcatgttcatagcagcagtattcacaatagtcaaaatatggaagcaactgaagtcttcatcaattgatgaatggataaacaaaatatgtgtcctaaaatggaatattattcagccttaaaaagcaaggaaattctgacacatgctacaacatagatgaaccttgaggatattatgctaagtgaaataagccagccacaaacagacaaatactgtatgactccacttacgtaaaaggtgcctagagcatttaaactgacagagacagaaaatagaatggcagttaccagttgggctgagagaggaatggggagttttttaatggatactgagtttttcaacatgaacagaattccagagattggttgtacaacaatgtgaatgtacttaaccctaataaattgtccacttacaaatggttaggatgataaattttgtcatgtgcattttgtcacaatttaataaaaggattaaaaaataactttgggagccagatgcagtgcctttcacctgtaatcccagcactttgggaggccaagaaaggaggatccctcgagcccaggcattctagaccaacctgggcaacatagtaagaccctgtctctacaaaaaaaaaaattacaaaaattagccatgtgtagtggtgctcgcctatagtcccagctacttggggggatgaggtaggaggaccacatgagcccaggaagtctaggctgtagtgagccataatcacaccactgcactccagcttgggtgacaaagtgagaccctgtctcaaaaaaataataaataaataaataacttcaggccaggcatggtggctcatgcctgtaatctcagcgctttgggaagcccaagtgggagattcacttgtggtcaggagttgaagaacaacctgagtaatgtaacaagaccccatctctacaaaaaactaaaaaaattagccaggcatggcgcacacctgtagtcctagctacgtgcgggggctgaggtgtgaggattgcttgagcccaggagtttgaggctgctgggagctgagattgcaccactgcactccagcctggatgacagagcaagaccttgtctcaaaaaagagagaaaaaaaggctttttaatataatgcatatacttaagcattttacaagcatctctacagagatttaggaccttggagcctgagatgtttatgcatgaagtcaggctgatgagatcaggctgtgaatgaaaacagtgctctgaaggcaagcctctgtgacactcacctatccatacgaagctggcagacaatgcttagtgcatccacaactccttcttctttcagctgttgacagccaatggatgtagcaataaaacaccctgttctacctattcctgcactgaaaagaaaagaaaagaaatttaaaaagtgggggaaaatgacaaagataagaaacattcttttacaagggtacttttaaatctgaaaccacagttaaaagtagtattcacatattgagtattataaacctggccctgtgctaagtgcttaaaatatatttttacatttaattataagtagtaggatgagaggggtggggggaagtggtgagttgggggaacagtaaaaaggcattataattgttctagaaaaaataaaaaataattaaggtctgcacttaggcaagatacaggcagtagaaaggagggggaagatttaggcacattcccagtgtgaatctgaaggactggagctgaagagggagaaaagcaaaaagtcaaagatgactaggcctggagagaaagaagaatggtgatgccctgaggccaagtgcatgctggaatagggtgaatttgaaggaggcagggaaggggagttttgccttggacatactgatgttcagaagtctagtgaataattgagcaattgaagattggattcattttaggagagggtgcagctagaggcacatatttccaagagatttgtatagacatgataattgaacagaaatgatgtctgtcctggtgggtttatacattcaactgccttagacgatatgtccataaaatcaacctcacaagcacacgtgctctctctgtctctgtctgcagttttaaccactaacagtctctatgtaaaagattctttcaaatctacatctagactccctaaatttcctaaactctagattgtcattccatctcctccttactattttggacttgcttcagttcaatgtatctaaattcaatgtatctaaaacagaattaattatcttttccctcaatggcattaccagtctgccacaagttttccagcctagaagtcttggaaccatcttttacatctctccctttctcacctcccacatccaatctgttaccacttcttctattttccatctctgctgagcctgtgggattcatgctttcctttctatagactgtaatcacgttttcaacatctccttttttcatgattagcagtgatctcattatagtttccaagtctcaagtcttttccttgacaaattcgcacagctgctaagttcatctttctgaaatagggacttaattatatcattccctactcaaaacctatagatggctccattaactatagcataatgtctaacctccctaccatggtattcatgaccttgcaaaatctgaatgtgactaactttcaagccttatgtattttgctgtcttccctcccgtgtgccatgattttcacttacgtcaattgtttgggcttttggttttccaatttttctgtgttaacaatgttttcttggtcagaaatgccctccctccttttaaaaccacaacattgattatttcaaaaggctcagttcagcattattccaatttttagaggttttcttcagctcccatggttggaaataattgctcccctcttggcactcaaatagcacctatttctcacatttggcacttgttttctgttgaatgtgagtgcagaggaattcagaggagtggctctcttttagctgaagtgtccacagaaagttcatttcattgaagaaataggattggaactgtgccccatgaatggcaggtattttggctgttataactgagagagaatattctaggtacgacaatgatatacaatgaaagaagaaaagaattaatgagaaacagcaaatatgatttgcaacaataagtagaacagcttgtcttgaagagaaagttattttagtggaactatgggaaataaagatagagaggtaccctgggatcttatatggaaggctaagtggtttgaaatacatccttttttttttttttaagtaagaatttgatgaagactataagcttccactcttcagaaaaattcacataagtttacatactcaaatgtgtccaaataatttcaaggagttcactgacctctgcggtttatggataggttcaacgttagggacttttgctctagttttttttttttttttttttttttttttttttataagacagagtctttctctgtcgcacaggctgctgaaatacagtggcgggatcttgactcactgcaacctctgcctcctcggttcaagcgattctcctgcctccgcctcccaagtagctaggagtacaggcacattccaccacgcctggctaatttttgtatttttagtagagagggcgtttcatcatattggccaggctggacttgaactcctgacctcaagtgatctgcctgcctcggcctcccaaagtgctaggattgcaggtgtgagctaccgcacctggcccattgacaagctttgagcagagactccatgtaaggtgagacggagaaagggcacaggtaggccatggtggcggtgagagcatgggggaatgcggtatgtgtgtgcattttaccagctacttctaaaatacatggatgaggtcagaagggcctgaactatggtggctggacaggaaatggtgattatgggagaagctttgaagggaaagccaatctagtgactgattagatactgatgttggagttaaaaggaggaccagagataactgtcaacatgggatcctgagtgactggaaaaaagatagtctcattctcagaaatagtaatcagaaggggagctggttttataggggaagtgactagttcattttagatatcctgagtgtttaatgactttgggtgggggacagttccagccctaacgcatagtcagttaggctgtttttttgtttttgtttttttggctccaagttaagtttaggataaagccagtattatctacctttggataaatagacacatagtaaactttactcttaattaaaccacacaatctcaaaaaaggaggctaaaattatactctaaaataatatatttattaaatatatcatcaaaagctgacttaagagacctatgcggttaaacaaagcaacccaaattattttgagaaagcatgaagaataaatggctggctgggcatggtagctcacacttgtaatcccagcactttgggaggccaagacaggtggatcacgtttgaagtcaggagtttgagaccagcctggccaacatggtgaaacccccgcctctactaaaaatataaaaattagccaggcgtggtggtgcatgcctgtaattccagctactttggaggctgaggcaggggaatcacttgagccaaggaggcggaggttgcagtgagccgagatagcgccactgcactccagcctgggtgatagagtgagactctgtctcataataaataaataaataaataaataaataaataaatagttgttcatataaattactttaaaaatgctgccttcagtttggttacattaaaaggaaaattaggggaaggaggtatcagttttaggaagagagctttgaactagaaattagggacaggaaccagcacagaccctgctgctgttgttggcttggcctctagtgctccatgttctggtaacagcactttgttttcctttggtgacttgctcacttctcatttcataaatttgtttcaacctgtttttctggagataactcttaaaataattgactggttttcaccaaacttgaaatagtaatgttaccaagatacaagccaagcagagttcacatgtcatgttgaaacaacaaaaaagccactgataatttcaaaaagtgcatctttattcctggtgtgtacaagactgatgagactaaatcaatcaatataagtttcaaagcagataactgctgaataggtctcctgttcactgagccatttattacgaacttgtatttcgccgactgtgtaattgttgtttgtgaaaaatgacctaaaagcatgacttcacttctgtcagcataatcttgattcagactcaaatattacagacttaaccaatttcaataaatatttaatttgccaacaaagtcacatccaggaagcaaaacccacttgcacctgctctgtgactttacaaagaatgggccattgcttagacagaaaggaccatacacgtcttacctgcagtggacaaccacaggccctcggccctgggaagcaagtctgtcttcttctacatccagcatgagctgtaggaggggctgggcactgtctggagtcttgtgatcaggccatgaggtgtaccagtaatgcttcacatgttgggtgtggcttccttgctgaaaatagcaacagccaccaaatgcctcattcacttgtagaactaaaagtcatccaaaccacaatactgaatgccttttatcacccccatcttgctggcaatttatttctaggtgggaaaaaaatttagaagatttttgaagagtgcccttttactttgagaagactttactgtcagtaacctgtttgcaaagtgagaaagtcatacctttgttgagatttacatctctacctatagttataatatagatcatataagtaacatatgctaaatatatatttataatttattataataaacaagatggtaggtgaaaatgtagccaagaaagaatgagatatattttgtttcctgctctatgagcattcctgacaagttattataaacatgttaatcaatagaacacttaatttcatatcagtcatgctaatacttctacactcatccaaaactccagtatttaataggagtgaggaatcacagcaataaagaagctacatgagatccctctattggaaacacttgggtgagggcccacacacctcatctccaaacccagcacgggtgagggtgtggcatgaacctcgcactccagaacatgtgttgaaaaataagttttggtaaatgccttcctattccaaacttccccggcactccagaacatgtgttgaaaaacaggttttggtaaacgccttcctattccaaacttcccaacaaaagccatcactgtagctctgcccctgttttcttcctctttgtgatgattctatcccagcagtgaggctgcagataagatcgaaatttttgggtgattattctccagaagcaaaaataataccatggtaacatttctcagcatctgctgcccatgagttaaataagatagttttcctatgacataatctcgtctggggaaagtccctataaattactgtaactccacgcttctgaagatctcatcaacacttcaggcttgccttgcttcccactgccacccacaaatgcagattttctctttcacagcttccaggccttacgcaaagctgcttagatcaaaatgacattaaaaaaaatcatggtaaagtctccagcacagcctttagttaaaagctttcaaaaggttaaatcagagatattttattaacgcaaattagaggatcacaacatcctacataatgaattttcttaatgtctacttacattcatttaattatactgcatattaatagtagttgacaacaaaaaatacatgagggaatgattatagtttctctttgatcttaacattatttaatttgcttaaattgcatttgtagtacttaaataatttcaaagtagaaatgtaatcctctaacatcatctactttgtagatggctatagctacataatcttacctttaagacaaggtttcgaatggtgtagttatcacattcatttacactgataaccagaacctcaacttttccatatatccctctcttttccggccagtatagcacacatttctggaggaagggaaagagaatacagcaaatattaatggcttttattagccatggagtacttttcattcaagcatctcaagagttttatatcattagttttaaaatatcaaatatcaatttttatagttttgtaaatatactaaaaccattgaattgtaaatcttaagcagctagattttatggtatataaattatatctcaacagttttttttaaagtatcagtttcatatgtgcctattaaacactgtcactgctggctccatacaaaaaaaaaaggcagaattacccaaaactcctcagagaaattaagaactaattaagaagttaagaaatttaagagttaagaaattgagatccaaatattagaatttatcatgtgctgactagaaataaaagaatgttttcccacaataattgaggaaagttacattttcctgcttcaacaaacttatgtctaatgagaatatctaatatgttaggtggcatacaaccaagtttcctttatatgtaaggcagatataatgatcattaatacaactatggtattatattttcccggaccaacagtttttttcacttatggaactaatttacaaaaattacgttaaaaatatttttataatggatcctcctgaggagctttaaaagagtgacaataattatactgcaagcaaggcaacatagcatggtggttaaggcgcaggctttgaactcggaacctgagtccaaattttggttctaccattcattacctgtgaatccacgaacaagatacttaaaccctttggttatagtttctttattattggctatctggaaagtacttaggataaagccaggcatagagtaagcacttacaacatgttattattgctgttgttattttaaaactactgggtgataggtttttggcccaaagtgattagatcttcatgcattaaatattattttggtattattatagtcagttatcattattaaataaaaattgcaaaatgagattcaagcatacatataatctcattttgctttttaaacaactgtaaaataactattttttaccacaaattttgatgataaagaatgtaaaatgacaaatgtttatgttttattttgagtgctcttggaagcaatgttaattttagaaatgtttaaatagcacttattttctcccaaccatacatacatttacatagaaattctttcatttgttgccttcaatcagaaccttttaatacccaggacacttgtttcttcacatctttgtcaaaggcatatgaatacacttgataaaaatttaaatacttatagatttaaaagagcagcaaaagactcacaaaattatagaactgaaggaaaagtgacacaaagtatcagaaacacacctccagggctctattatgctaagtaccactactctacaagctagcacagcgaaggaagtcacttcacctagcagaatcagtttctttcatccattacaataaaaacacatttacatcctctacattttgaccctttttctaaatgaagtaaattgtttcagctttatttacatgccacctgagactctcaggctatcagaccaaaagacttactctggctgacttaatgttaacattaagagaagaaacctttttaaagtagagcaactcatttctctcgaaatctatgagttgccaaatgtctaaaattttcccactttgttaaaggtaatcatacaaaccaatttgcctggtttctttcaatgaagcatcaattatttcgctgtaagacccgagctactgtgtatcttaaaacccatgcctcccgatgagtccaagaagaatgacaaagaatcttggaaaaggtattgaacaaagaaagaggcattcattcagtagtccagcagtctggcgtacgtgccccattgtccacgatcagacctgagcagcagggccctctttaggaaggtggctctcaaaaccagtaagaaaagctgcaaagcaggagcttgccgcctgcaccctgactcttaatacttgcacaggcttctgcacctacttgataaatggaaatgctgctcgcttctctcccaagcttgccgggggccctcttgaatgttttttttgactcgttaccaaaaaagcaattggcagtcagctcccagtagacaatgcaatgtgacttgttcattcaaacaacccttaattagcatcccatctcctttctgagatacaatagcttatttttacacactgaatacatttttccctcatttagatgacagaaaaagagaccagataagtgtgggtacttttgaatatgaggtgggggacagctgcaaatgcagttgtttctaagagtacaagttcatgttcaaattattttcctgtacagctttttagggtttctttattgtggtgctaacaatgagataaaagaggcagaaaaggcagggaagaaaaatgctgccttacagataatactgtgaaaccacactaattgtaggtgattcaaaatagcatgctatttagcagaatataaccccaaatcatcactattcttttgctagctaggcttatcctttcagtaaaattatctattaattctaagaatccataatttggaagaaaaaaataggtttccagaggacagtgtctcttgtgcaaacaagttattatcaaactctgactgaaaagattctggacattaaccagtgctttgtaactggtggtttacagcaaaagtaggatgtaacacaaagcaatgcaaattctttttttttttttttttttttttttttttttttttgtgatggagtctcattctatcactcaggttggagtgcagtggcacaatgtcagcttactgcaacctccacctcccgggttcaagcgattctcccgcctcagcctcccaagtagctgagattacaggtgtgcaccatcacgcccagctaatttttgtatttttagtagagacggggtttcaccatgttggccagactggtcttgaactcctgacctcaggtgatctgcccaccttggcctcccaaagtcctgggattataggcgtgagccactgcgcccggccgccagctcatatttttgtgatcttttttcttcccttgattctccttctggcccccaccaagttagggctatgtgaggaggcggtctagctagttgtttagttgcctgaaaaaaaaaaacctatttttaagttattttctttttagtttctatatatttaaatatcagagatattgctctataagctaaagatctgtatcatcacatagaatgtggctctaagtaaataaaatcttcatacttagcttcatttgggttatattaatacatgagagggatagaatgggtcaggttgtctaaaattattattactatagctacttttattcctggtgctccgatggaatattactgacataggctcagagatttaagtaccttcaccaacatcatatcatttagccccttccacaatcctttgaagtaggtagggtgggtagcaggtattattattatttaaattatttttcagatgaggacatgaaggctcaggtgttttggtaggggaaaattgccttggggggctagaattttccaagaaaatatcactttatgaatgaaactttccatctttgatttccacactgactcttaaccaatgctacttaaccacagcattgaccaatgacctgttccctctgtcaaatatgttgaggcacatgcaaccttgcatagtcttggttcactctcctactgagctcagtacttctgttaccatcttttgatctctgtgttcctcaagttgtttttataccaaaacacctttatggcaggtgtacttattattgaagtccagtaatttaattacatattacagaaatcaataaaatatgaggtttaaaagagaaaagagctttatgagataattgaataagttgcgtaagtttttcactggtgaaaaaagtaaaccagtaaagaaaactacagtcaaatcagggacaggtgagacaatgacagaaatttgtctctaagttaaaaaatctaaatagaaaactgcatttatattgtttcataggcttttctattttctctttcattttaaataaactaaaatggaaaattttgataatatataaacaatgtgattgacataaactatatgatctagaactccatcttcagaccaacactcataagactgaaccccataataaacaaacacatttgaatatgaacaaatgtacatgttttaaaataaaatactttttttatgattctcacattgaccatttttgattaactgtgtgtttttctgttttttttttttttttttttttttttttttttttttttgagacggagtctcgctctgtcactcaggctggagtgcagtggcacgatcttggctcactgcaagctccgcctcccaggttcaccccattctcctgcctcagcctcccgagtagctgggactacaggcgcccgccaccatgcctggctaattttttgtattttttagtagagacggagtttcaccgtgttagccaggatagtctcgatctcctgacgtcgtgatcctcctgccttggcctcccaaagtgctaggattgcaggcatgagccaccgtgcctggctgattaactgtgttaaacaagagggcttctaactatagttggaagtaaagcaggctaatgcagtttaaacataacactgtggattaaacattaaggtgcaaagttagatttggaatatatgcatgcctggaaggacaggagagtaattttgtttgggcgcagtcagcatctgaatttctagccacccttaattgcttggtcagcatacccatcaaccccctggttacccatgaaatgaaattaggctgcctgtcactgctggacagtggtggccaggttgcctctccaccaacatgatggccctaagtcagaggctaggtggccttggtcatgcttgtggtggctttggtctctttgcttcctgttgaatctatcttgaatggattcgtgtttcataagcaaagtcctgcatgagatcctaatttatcttgtgactccaatttatgctcatgaatccagttgaccagcgacagcattcataatatctaattctgatcctccaaaggaaagctgaataccagaaagggactctcttctgcttgcttgctaggttggactcccacaataataccttctctgaccttgtttggatagaccctctggttgtgggacttggtttgctcgtttcttttcattcattttcaaagcatgaatcctttagtctactccacagtgatctgcaaattgaggacgacttctccctcataatcctagtccacactttcaaaattgtccactagtttgaataaacagattcaacgttttttttaaaacctgatcaaaatgtcttgtctatctcctcttccaaaagagaatggttatagatttctaaccttgaatgtaagcaatcatacataccactttctggatgcaatcacttcttgcactgtagactatcctttcccaccataagtggattccaggcagcagcatagtgtaatggtgaggaggaggaagagaaggaagaggaggagaggaggataaggaagaggaggaggaggataaggatgaagaagaggaggaagaggaggaggaggaggagcagcagcagcttgggagtcagctgtttggctttgggcaagttgccttcctgtgcctcagtgttctcatttgtaatggggtttacaaatatgtttactataaagattaattttcaagcacactgttagtgctccataaacagttgttcttcagaagatccaacagtccaatttctgagctttccatgtatatttgttgaaccttctagattaccttttactctactttttaagctaattataaatgatagagaagatatattttcattttatgcatttagaatttaacatggcacacttaacattttcttattagtatcttaccagaataatttattttctcctcaaacatatagtttaataaagtccactttattttaaagtaaaatttacatatctattgagtagccaatctttctatctgaatgaatgcacatctgattttataatgaaatttaaggcaatgtactccattaatgtatacttactacatacccacaaaattaaaaataaaaatttaaataaagaaactcttttgtaaaggcaaacatgggctgtgctcagttgcttagtcaatatttatatttccaaaaaaactttcttggaatgtatttaattaatcaaagacatatatggtagctgcaatttgacttaatgaggtcttaaggtttttgtggacaataaattggaaacaatttaagtacctatcaataaggaaatgattacattttagcacatccacacaatgaaattctagtaatttaacattttgatgaattattaatgacatggagaatactcataatgttaaaagcagaatatacatcataatacaataccctcttttattgtctttacaccaatgctgtaccttctcatgacatctgatctctctcacctgtgcatttctccagagtacccttatttctaactgcttaatagacttaaaagactttaccagccagaagtctccaacatttatcaaacttaacaggttaaagatgaaactgatatcacatccactcaacctcccaaaccagaagtcctgaagtcaagctctcacttactcccattcgatgagaaactaagcactgtggtttctactgctggaacacttaaatatatcttccaaagctattttatatatatatgctatttatatatatatatatacacacaagctatgtgtgtgtgtgtatatatatacgagctatatatatatataagctatatatatacacacaagccatatatatatatgttatacacacacacacacacacacacacacacaagcttgcacactgtcagccaggctggagtgcagtggcacgatcatagcttaccgcatcctcaaactcctgggctcaagcgatcctctggtctctgcctttcaagtagctggggctacatttgtacaccaccatgcctggcttgtttatttattcctatcatggcaatggctaattaaaaaaaaatttcatttgtagagacaaggtatccttatgttgcccaggctggtctcgaattcctggccacaagtgatcctttcaccttggttttctgaagtgctgggattacaatggaacatcttttaaatgtctcccccttgggcacctactcacttttcagacccataggtatcatatgagctttctggccaaacatgtgtaattaaaatgaatattttctataattttagcagatagaaaagggaagagaatgaaagaaggaaaaagttaatatatggctccttatgtggctttttgagattgaaccgtttgcaaagtactgaataagtcaatgggcaaaatggggcttagagtacttaagtcaagtagtttaactcagatgaaagatgcatgtaaatgtagagaaagagtacagctgtgttaaactgagagcagtgtgttaggccaaattatccagtaattccttcacttcatgaaagataggttcagggtcttattgctctttgggaccaaaagtgggttgcttgccttctaatgtcttaattctttatttggctccttataatgttggggcaatgattaagtgcctgggctttggaattaaacaagcctggattgaaatttggactccatcaactcactaactttgaggctctcattctctctgagctttggttttctcatttataatataggaatagtaaaacctactttgtagagttagaggaaaataaactgaatttatgtgtgttcaaattgtgcttagcacatatgatcaataaatggtagtggctagaaaacatcttccactgtgtatgtaatatggtcaacatgtatacctacttcccttcttttctgaaaggggagagaaatgcagtaagtaacttccagaagtagtatgggggctttgtttcgctggaagtgtgcaaaaactacttgccattttggattgctcttgcagttccagctttataggtttaagccactatgtcttctctagcagtggaatttgaacactgtcatttcaatgtttccttctctgaagaggaattccctttctcttgagatttatctaaatgaaggaactcaaacttaccagcaataaaatctctttaattgcaacttaactgttttttcagctatgtatattttcatttttaatttattttcattttataaacattgaggtcatgagaatattggagttattaaataagagatggcaattattcatttatttatttgctagaaagtagaaagttgcatgaaactataaagcctgggaatttctaaagataactccatctccatatgttttttggaggaaatgatttttgtcttttccaaacaatgacgcttaacacaattgaaagttggcacatttttggtaaacagaattttcctggtagtgtgaagtctactgtgtatttcttttgtgccagacttctcagtatcattttgatctgtaaaacatcagcgtttcctgtattgtattatatttacgtctttggagagtctagacagaaatttttattttaaagagtaatgaataataaaaaataacaaaatttttattgtaatatttgggattatgactggctgtagggaaaaaaagcacaaagcagattacacataaaagacatataacataaatgtttgactttgatatccccagaaggtatatctcagacattaaaaaagacaggaggctaaaaattgtaacacgcaaacaaaaatcatttctccaatttctgaattatgtggtcaaagaaaaaaattaaaacttcaaccacccattggtgtaggaattgttaaaaaaaattctagctttccacagatccatttggctctcctgtaaagactgaaatctgagaatggtaacaacaggttatctctgaggacaattactgcacttgagaaagaaagaacaagatacgctttattcccttgcagatactgaatggagagctctgagcatcataggtaaaccaactctgtgtcactctgaaatacatatttgaggctgctgcatgcagttccccggctagctgcagtcattggtgccagtgctcaggcacctgctgtccttgacctctggccccacaagcactaacccagcgcaggaggaccagccaccgccgccaggctctgatgctggtctctggtagaagaaggttgctcacagctctgctgcaggctcagaagtggccctttcaaccctccagagacatgagactagtccagttccaggcaccccacctggtggggcctcacttgggcccagagatggagaatggtggaagggttatcaacctcaatgcctttgactctatgctccccaaaatgatgacacagttcctagagcagggagaggccatcctctcagtggcaagaagagccttgggtgcccagttgccagtcctaccatggttggaagtgacctccctggctccagccacatggccagataaggtggtgtgtgtgggcatgaattatgtggaccactgcaaagaacagaatgtgcccgtgcccacggaaccgatcaacttcagcaagtttgccaactccattgtggagccctatgatgagatggtcctcccatcagagagccaggaggtagactgggaagtggagcagctgtggtcattggaaagaaaggcaagcacatcaaggccacagatgccatggcccatgtggctggcttcactgcggctcataacgtgagtgctcatgactggcaaatgagacatgatgggaaacagtggctgctgggaaaaaccttcaacaccttctaccctctgggccttgccttggtgaccaaggacagtgtagcagatgcacacatcttaaagacctgctgccaagtgaatggggaagtggtccagagcaacaacaccaaccagatggtggtcaagacagaggagcggatagcgtgggtctcccagtttgtcaccttttacccaggggatgtcatcctgactgggacctccccaggtgttggtgtattcaggaaaccttctgtctttctcaagaagggagatgaagtccagtgtgaaattgaagaactaggtgtcatcatcagcaaggtggtgtgatggctcctgcacaggccctggtcataggatgggggcatctgctcccactcagcttagcccagggaaatgtcgaatgccaggtgtgggcaggtgccagccctgtaagcctcctcttctaggtagaagggagaaggatagagctctcttcaataaatacgtcgggccaaagcaaaaaaaaaaaaaaaaaagaaagaaagaaagaaatatatatttgacttatacagcagttctggtacaatgacatccttggtcttggagaaggaggatgagagcaaccgtctgctggggctttggcatattaataattgctcacatcatccctattggatttctttaaaatatgtcacatattacacaccctctaggaaatgtcttctgcctaaccagcaatcttagtttctgtcctgctaaaaccctgattcaagaatgaggtaaagcactaaaggcacattcctgactttttctataagagtgaacacagataaacatacattacaagattcaaagattgaaatgctcaaaagaacaaacaccgtaatgtatcttacacagttattacaatgtattctgtaatccttgtgagatattgtttcacatatcatttgccaagtgttaatccttagtacatatgcaacactaaattgcatgtaataagtaagtaatttttctggggaaaatattatttgttttaaaacatttacatacttatatttacaaatagtttcataaattatggtgctatgttgattttataagattttatttgtaatagaagaagaaatagaaataataagaaatatttaagggcatgaatgcactttgaaataatatttattttatgacaatttactcagaaaattcaaaccaaagtgggcaggggtaaggcattttgctcagatctacgaaatggtgctaaatattgcatgaagttgttcatagtgtcctcttttatttaaatctctgctttaattatagtcatttttaatggttttttttgcatttcctttaattctgctagttttgcctattttattagacttcaaaaaattgacttttgtttacatcaatcctttttaaaaattttttttaaggcagggtctcattttgttggccaggctgaagtgcagagtagcccaatcataactcaccacaacctcaatcttctgggctccagggatccttttgcctcagccttctgagtagctaagacaacaggtgcgcaccaccacccctggctaatttttaaattttttgttgagatataagtctcattacattgtctaggctggtctcaaactcctggcctcaagcaatcttcctgactcagcctcccaaagtgctgggattacagaaatgagccaccatgcctggcctcatcaatccttttatctttgttttatgtttaacatttattcttcattattccttccttttttctctcctgttcattttatagttcttttactaacttaagtctgttgcttagatcacaaattcttttataatatcatattcatgcctataaacttccttctatgagcatttttagcagcatctcacaagatttgatgtgtagtatttgcatcatccctgaattgcaggtaatttacagttatattataaattcattttcatccatgaattgtgtgtgtgttaaaactttttttaagcatcaaagtgtattttttaatcttatctttctgctttttatttctaacttaatgcactgtaatcgaagcatatatgtacagttattcctggaaatttgccaagacttgctatatagtcgtagttggtcacttttcacaaaatctcatgctttgaaaatttatattatgagattattgattggaaggttctatatatctttcttaaactaagcttgctaatttgaataaaggttatgtataaactttttctatatttttattttttgtctgcttaataaatactaatatctgatttttattgggttttctcccagtgtgatggtgatttatcaattccttctttaattctgcccattaatgcttcagatatttggggggaggttatgtatattatgcatttatatatttagaatcttacttgtgaatttcacattttagtgttatagattgacattccttatctctagtaagctctctgataatgattgttttgatttgaaattcattttcatctgacattctttatctctggtaacctctctagtaattattcttttgagaatattcttttgagaattattcttttgagagtcagttttatctaacttgacttttgattagtattagtttggtgtatttttttccatcctttccattttaacatttctgtgtcctcttgtaggcagcatttaactgaatttatttattttatcagtttggtaatctctgatatttaatttgcaagttatttgtttatatttagtatgatttggatttttttctatctcccaattaggtaaaagtttatcctgatttttctatattaccttttgttttcccttttattttggtttattttcgaaattctgtcttttctctcttctaccagattggaaattatacattctaattccatccttttagtggctaatcttaaaatttgaacatgcatatttacctaaaagtctaaccttggcttatatttctcttttcgtgaataacacagaaatattttaactttcctcatcttctcaaattttaaatactatcattatccagtattttagtttcaccttcatattttactttctttgctcactattatttcttgtatttgagtactttttttctggattgaattcttcttcattctgttttatcctcccttgtagttgttttggtaagattttttttggtggtgaattcttaccatttttgttagtttgaaaatgtctttcacacctggccctgtaggatagatttgttgggtataaagttctgggtagtcaagtattttctttcagttctttgtaggtaatattctactgatttttggcttctagttttgctatagaaaagcctttttttttttggttagttactctggtgggagtaattactttctttggtgctttttcagttccagagatgtgtctagctgtgatttacatttacctattcagcctaggatttattgtgctttttagatttttgaactcaagtcttccatcagttttggaaaatccctatctattatttcttcaaatattacttcttttctcatatcctcttctttctccttctaaaacacctgttatggtatattggatatcaaatactatcctctatgtctcttagacactcttttttatttttttgtcattttgatcttctaggtattttccttagctttatatttgaatccattagttattcatttagctgtgtcttgtttgatgctaaacctatctaataagatttttttaaactttaatgtctttataatgtttatttctagtatttgttgttttaaatcttcatagcctttttggatagtaacttgttcctgtgtcaaattttttatgctttttgtgcttaattatttaaaagagtagcctacatttattatttcagttattttaatttatgtgaatctatttaattgttgctgcttctgattttttctcatggtttttattggttgcttgtatgcctcataattttgattgtaggcttatgtttgctgagagttttttaattttattttaattgacacagaattgtacatattcatattaatgtgatacttcagtgcatgtatatatgggttaatgatcaaataaaggcaatcagtatatccatcactgcaaacatttattatttgttgtttgtagtgagaatattcaaaatcctttcttatttctgggctctatgttccatattccattccattggtctatgtatttgttttttttgccaatatcatgttgctttcgatactgtaactttggggtatattttgaagtcaggtagtatgatgcctccagcttttttttttttttgtctcaagaatgatttggctagtcaagatcttttgtcgcttcatacaaattttaggattaaaaatttttttccatgaagaatgttattggtattttgatagggaatgcattgaatctattgattgtttagcgtagtatggacattttaacaatattaattattccactccatgaacacaggatatatttctgtttatttgtgttctctacaatttccttcatcaatgatttatagttttcagtataaaagatatttcacctctttggttagatttatttttaggtatctctatttattggtagcaattgtaaatggaattgttttcttgattttgtttttagctagctcaccattagcatatacaaatgctactgatttttgaatgttaaatctgtatccttgaactttactaaatttgtctattagttctaacaagttttggtgcagtctttagggttttccatatatatgatcatatgatctgcaagcagggatagtttgacgccttcctttccgattttgccttttatttctttctcttgcctgattactctggctaggacccccagtactatgttgaatagaagtggtgaaagtggatatccttatcccagatcttaggagaaaagctttcaacttttccacattcaatatgatgtttgttgtgggcttgtcatatatggactttttagtgttgaggtacatactttctgtatctaatttgttgacagttcttatcatgaagggatgaattttgtcaaattatttttcttcgtctattgaaatgatgatatggattttatccttcattctgttaacgtgatgtatcatatttattagtttgtgtaaactgaaccattcttgcatccctgggatgaattcccttgatcatagcggatgatgtttttaatgtgctattgatttttactaatggtttactaatattttatgagcatttttgcatgtatatcagagtgacctgtagtttcttttttggttgagtccttgtctggtttgggtgctagggtaatgctggccttgtagaatgagtttggatatgttctctcctctttaattttcttgaatagtttgaggagaattggtattctttaaatgtttggtagaattcattggtgaagccatcaggtcctgggttttgtcttcaatgggatacttttttttttgagatggagttgcactctgtcacccaggctggagtacagtggcatgatcttggctcactgcaacctcccagtcccgggttcaagtgattctcctgcctcagcttcccaggtagctgggattataggcacgcaccaccaagcccagctaatttttgtatttttagtagagacagggtttcaccatgttggctgggctggtgtggaactcccaacctcaggtgatctggctgcctcggcctgccaaagtgctggggttacaggcgtgagccacagcacccggccaggataggttctgttactgatttaatttcctcactcattagcgttttcagattttctatttcttcattgttcaatcttggaaggttgcatgtgtccaggaatttattcatttttttttagattatccaatttgttcgtgtagtattgttcaccatagtcttttataattctttgcatttctgtggcatctaaagttttgtcagttttatgttttcaaacatgatcttttctttttattgatgttttgtatttttctgtctgtatttcatttatttctgctttgatctttcttatttacttccttctactaattttgggtttaatttgttcttgtccttttttattttttgagatggagtctctctctctgtctcccaactgcccaagatggagtgcagtggcatgatctcagctcactgcaacctctgtctccttagttcaattgattcttttgcctcagcctcccgagtacctgagattacaggtgtgtaccaccaggcccagttaatttttgtatttttagtagagacagggtttcaccatgttggccaggctggtctcgaactcctgacctcaagtgatctgcctgcctcggcctcccaaagtgctgggattacaagcgtaagccacgctgcccagcctgttcttgtttttctagttccttgaggtgtgtcattaagttatcatctttcacttacatttcaacaaatgtaagcatttattgatataaacttctcttttagaacagctttttctgtattccaaagactttgatatgctgtctttctatttgtctcaaggaatttttaagtgtcccttttaatgtcttcattgatccattggttgtttaggagcatattgtttaattttcattaaacaatatttgtaaagtttctgaatttcttcctgttgttgatttctagttttataacattgtggtcagaaaacatatttaaaatgattttgatcttttaaaatttgttaaggcttgtcttgtgctgttaagaaaaacgtgtattctgcagttgttgggtgaaatattctgtaaatatctgttaggtccaattggtctattgtgtggtttaaatccaatgtttgtttattttctgtctggatgatctgtccattgctgagagtggggtgttgaagttgaagttcatgattattactatatagcagtctatttctttctttaatctaataaataattgctctttatatttgggtactctagtgttaggtgcatacatatttacaatttttttttgttgaattaacccatgtatcattatataatgatcttctttgtgcttttttgtgatttttgatttgaagtctattttatctggtataagtgaagctactcctggtctcttttagtttccatttgcaagtgatatcaatttttcatcccttcactttcagtctatatgtctttacatgtgaagtgagtttcttatagacgtcatataggtgagtcttgcgtttttttctttcccccatttggccactctatatcttttaattggaaaatttaatctatttccattcaagattattactgacaggtaagaacttactcctgccattttgttaactgttttctagatactttgtttctttcttctacttttattgtttccctttgtgacttggtggttttccatagtgataagctttgattcatttctctttttgatttgtgtatctgctgtaatttttttctttgtggttattctggggcttatgtaaaaagaacttagaatattttaagctgataacaacttaactttggtcacatacaaatattctagactttcccttcccccatccacaattcataatttccttcaggtcattattttaaattccttttcaggcaatttataaatttccatttctttaggggtcagttactggaggattcttctgcttctttgatggtgtcatgtttctttgctttttcatgtatcttgtatccctgtattgatatttgtgcatctgatggaatggtcaactcttttaattttatggagtgacttttgaagggaatgactttcaccagcagatgtgtctgagggtattggttgggtagggtacattggcttttgctctatgtgtgtgcagtagtgtagtctctgcaggtttttaagctgtagtcaactttattgataacctctgaaggccttggtgtggctagtttgctggctcaggacaggtcacccctggaaacagcacacttggctggtgagcacaagaacaaatccactggttaaggtggggacccgctgtgagatgcatacatggctggtgagcatgcagcagccagtctgccagcttgggttagggattctctgggggcagtgtacttggctggcaagcatggggcttggcttgccaactcagagcagaagtcccctgaaaatgacatgcccagctggtgagcttactggtggtatatgcggacaggtctgccagctcaggttggggcatccttagaagtagtgcacccaactgttgagtgcaccagggacatgcaggggctggtccactggtttgggtgggactcgctttggaatggtgcattcgctggtgagcatgctgactgctcatgaggccagtttggacttggtttctctgctgatcaagattgtctgttcctttgagggcaaggtgctatatgggcttcatggatggggcactggatctaggctctgagagacagggttcagggtgctgcagtcactaggatgtgaaaggtggaacacctcctaggagcttgttcccagggggtagggagctgtagcaactcagcaagggaatggtgtactactgtgtgtgaaggtagtgtaatggcagtgtagccttaggaatgaaaagagatggtggctactggcccctggaacaggatgtactctagttgtggctctggtttcaaaatggcatcatatagctgcagcttgaatcacagggatgaggggatacaatgtgggctccttctctggggcattgcagccatgtggctgtcaggcagctccctaaactggactcagggtctgtagaaactgcaggattctcagcaacaaagagtgcagatgtctgtgacattaatgggggctgctggggcctcttgcttgcctagtccccactggggatgcatctccttgttctgagctaatactggctggggagatggcggtgtggcagaggcagagtgcttcattctcttctctatgtgaccctcactaaaggtctccttgtctcacaggatttctgtctctctcctactgtattccagtgtgctccctcaaacactccagttcaaacatactttcttatttgttgttttggctcttttttttggtgggaagtatgagcattcggcttctctagtcggctctcttgctttgccctggctgggcttttctatggaaatctgtgaggtatatgctgagagtatgtgcatcagaaagtttttgccttcgtttctgtaaagtatcatagggcgttaccaacctagtattactttttatgttaatgacttcacttggtgtttcttgatttttgaattctgtgatttctcagctttaaatactcaagagagccttttcgtttataccataagaaggccagacttaggcgaatttcttagcatcatcctatattagtaggcagatttatttttgttgttcactttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgttgttcacttttttactggaggtgttacctttgaaggtgctcactttatgtaaggtctcagttccaacacctggctcctgcaagatcaggctttgtctccagttcttgtattaccattacaatatgtttaattttctggttttatgccttttagtctctttttattaagcactgggatttcctttactttttttcaaagctcttctttgcatgctgtttcatattctgcacagtgtaactggttttgtagtgagaggtttttcaggttatctagtctgctgtattacataagttctatgtaggaatgcacaaatgtacacatacagagaatacacctcttaaacttgaaaaatcttttctatcataaaaatgtcatgcatattaaacaactgtgaaggaattgtcagtggcttaatatgttgatagattgacactgtgtgggaaacagctgagaatattaggggttatttttataatgccacctcaggctttaatatcagattcatagaagtgtgtttagttagtaagccatgtagtgaattgagtatataaccttatctactggccaaaaatatgctatttttccagaatatagtgtgtttagttagtaagccatgtagtgaattgagtatataaccttatctactggccaaaaatatgctatttttccagaatatagttcaggaaaaaaagttttatctattgtagcaaaaatataagaaaatcacaaactttaaaacacatataaattgctgttttgtgagcctagatgatgtccattagcagcaggattatgctgtactcaaggattataatcaccaaaggcttataaaggaatgcttagttttcttaaattcttactgtcatggtgaagctctggtacaatatttttgacaagaaaacaaacactgaaatgctgattaaaattagactgtaaataatcccagtaagttgtcctaaaatgaaagcggtacctcggatatcagccctcaggaatattacaattgtatttttataatgcaaaatacagaataagtattctgcaagctaaatccttagaaaagactactagtatggaaatgaaatcaaattctgtctttcttggatttcttattatgaagatattgagaaagttgattggtttctgtaactgtcctcaaatctcgttttcttaatgaggctcaccttgcccaccctctttgcattattaaatgtaatctgcaattccccatcaccccctccttactgcctggtatacccattccacttagcctgctctactttctttcctatagcatttaatctcttctcatatattacactatttataagtttattatgtgtagtgttgtttgtctgtcttctcccactagaaagttaaaatctaccaagggcagggatcttggtgtgttttgtttactattgtatccccaatgactacagtagtacctgtcacatagtaggtgttcaaaaatgacttgggtgtgaatgaataaggttttatttatctgcttataaattagggtgataattcatggccccttatttcttttgtgggtacaaattagatatgtatatgccaagtatattgacttgtctgaaagaaagttgacattcataggataatagcacttattatatttgggatgtattaagtgacttagcctttaaatgtctcagagtttccatcttaaatctaagtccatggcaattttactaacacagtatctcttctatagcaacagaacacatataacattcagaacttgattaaagatcatacctcatttttttctttgagttttgtgatcataacaatcacagggctgtcttcctgccaaaccatctgccagaaatcatccacggtgttgatcatggggccctgcgtggcaatgaaggctttctccttgccactgtagccctagatggagtaaagaaacaaaaatattggtttttaagttcatgccttgcagtgaaagtgtaggtgaaagatcttcaacgaaatagctgggctagtacaaaagcaacacaggttacggcttcactgactctagtacaacaatttccatgggtattttggcagcaagttaaggatagcacatggtactgagggttgtaatgcccagtccccagcagagtacccatatagagcactgttgccagagactcacagtgaaaggaaagtcatcataaaagacccattaacaatgttgattatgactaagataaaaaaccaaacaaaatgaaatcttgctggtaatcaagttaaaccaagcttaatctactctaggaaaaagaaaataaaaccaacaattccaaataggaagtcaccagaaagaaatttgtacttatttacttaccctaatataattagcattaatgtaggtgctcaatgaatcggttacattttttggtcttaaacacactctgctgaggggatctaatgaagaaaacaaaaaagaatatattaaacagatttaccctttttaaagttccttagaatgccaataaccagtaagtagaaacctgttatgtattgattatctggtgcatgtcaatgtttgtctttggtgtccattgcttgatccatatgtttattgagggacatttgggcctgtcttcactcctgacataaagctcatccataagcctaagctgatgagtttatatttcaggccatttctcatctgttccggttctcgacctcatttctcatttttgcgcccactcttatacttttgatctggaatttgtaccaggtctcctcactcccatctctctcctttccctatggaggtaaatcaggctatactctaccaattatttatattttactatctcatctcatttagaccctcaggtctgaacctcaccttgtctgaccattatgtcctggccagatctcctgatcttccgagatggatgagattaataatctattacgtgctatctgtgtgaggataggcaagccaggggaagagggaggttgcaaagataaagataaacatgattcatttcgaggctgggcacagtggcttacactgtaatctcagcactttgggaggctgaggcaggaggatcccttgagcctggggcttcaagcctaggcaacatagtgagacttcatctcaaaaaaaaaaaaaaaaaaaaaaaaaaattagccaggcatggtggcttatgtctgtggttccagctacttgggaggctgaggcatgagaattgcttgaacccgaaaggccaaggttgcagtgagctgagattgtgccactgcactccagcctggacaacagagggagagcctgtctcaaaaacaaaaacgaaacaaaacaaaacaaaacaaaaaactatgattcatttcagtgagttttcagtctgctcataaaataacaaacaacatacatttattgtttattagatgtcagagtctgttctcattgctttacagatattatatcatttaattttcttgtaactttaataaaagtacctaagataatgggtaagactccttccccatttttcagataggaaactaagataggttaaataatttgcccaaaggtacacagccaagaagtaggtaatggagtcaggctttgaatccacacgaacactagggtaccattagccactacgctgtgctgcagctctcatgcgaagatagctatgtaagctgacgattaaaatacaaaatgttatatcctagtggttgcttagttactttcttaaaaaacagcaaattcaatgcttttcagcttcctttctcagtggagtgtggtgtaaaaacaggggtgcagcaaagaaaaacttctcccattcccatatttttttagtaacacactatcattgaacatcttctgggtaaacacaatctcttacgttccccacgaaaactgagacaaagaggaggtgaggtaggaagtactagacgaagaaagtttcatagaatatatttaaatgggagctaaaaataattaaaaatttaacaggacttggcaagccaacatttgttttaaatttcactttatatataactggggttaaagataataaaggccataattagtttcagaaaaaggctaaccagcccatgaggacggtgatggtttaaaaatgtagtcatccaattatctgacactccttctaaaagaatgtagtagagactaattcctctcatcttgaatgtgggcagaaattaaatagaatatggcagtagggatggtgtgtgacttggtcataaaaggtattacagtttcctccttgcgctctttcttgagttgcttgctctggaggaagctaatggccatattttgagggcactcaagcagcccaatgaagagagaaatagtggggaactgaggcctccagctgatagcatatgaatgagccctcttagaagcagatccctcagtgccagccaagtgttcagctgaccaaaggcttggccaacaactcaattgaaatctcatgaaagaccttgagccagacactcaactaagccactccccaattcccggcacacagaaattgtgagatataaatgtgtattgttttaagccactaaattttggggtaatttgttccatagcaataaataggtaatatagggaccaataaggagtcagtcacaaaactctggagtgatatcatgatcactgttattgtcattgcactcattgttgactcctatatgtgtcaggtagagcaggtaacagcattttattcattaggtcacttaattattacaattctataacgtacatactgttaacagtctctttatttagattaggaaattgcagcacagagaggttaagtaactcacccaaggtcacacagtaagaaatgaagcagagagttgaaaccagattaccaaacttagaatttaacaaggccattatcaaagatgatgttgaaaatatatagtaaaattttgctaatttgtcactaggatatttgaaataaagatattttatatatatgttatatatataaataaaacaagtaataggagcttctatccaaggatggataaagtagatttgagctataagggatctggctttggcaggagaaagtcccattctgcttaaagctttagattgacttgtgaagaccaagatgcttatctgatcttataggccacaggtaaaatagctcctgatcatgccatatggaagcaatgtctagaagatgttaataaattctggaaatcagtgggaagacccttaggtggcatccaagaatcctgttgatcgaggcaggctttcattcagtttgaaccaaaacactttgcaaaagatcctagcatgtccttttgggtgacctaaaggaagtagggtgactacagagaaacttacagtggaacaggtaaggactgttcgaatcaggatataacctaactgtgaacaaggaattgtggtcctatgctcatcagcatggaaatctcttgagacatgggctttgaacttatcaaaattcctcctcaagagatatgttggggctactggtactgaagcaaactaccctctttaaagcattctggaaataagtccaatctcagtcttgtccttcagagctttcaaaatgtagaccctatggagatggaagctagcaccaaactttcaaaagcacttcattttcccccaaatctcatacagtcttaacagatctatctctacatttcctacaattgttggtcaggggcagactgaccctcacttgcatgagccattttcaataagaaccttgtatcttattttgtattcataatgttgtattcattttttaagagtgtcttccagggcaaagttccatgacattgatgtgggcaaaaatttcttggatatgaccctgaaagcacaatgaaagcaaaaatagacacaggggattgcatcaaactaaaaagcttctgcacagcaaatccacagattgggagaaaatatttataaatcataccttaagaaggggctaatatccaaaatatatcagaaactcaaactactcaataacaagaaaataatcgtattagaaaagggataaagatttgaatagacatttctaaaaacaagacatgcaaatgtccaacagatctacgaaaaaatgttccacatctcaaatcatcagagaaatgcaaattaaaaccacagtatcacttcatacctgttagaagggctattatcaaaaagataaaagataaatgttggcaaggttgtgaagaaaagggagctctggtaggctgttggtgagaatgtaaattagcatagccattttggaaaacagtatggagattcctcaaaaactatgaatgaactaccatatgatccagcaattccacttctgagtatatatccaaaggaactgaagtcagtatgttgaaggcatttctgcactcctatgttcttgcagcactatttacaatagccaaggtttgaaaacaactggagtgtccatcaacagatgaatggattttaaaagtatggtctatatacataatggagttctatctggcctttaaaaagcaggaaattctgtcatttgtgacaacatagatagacttcacagatattatgctaaatgaaataagccaggcacagagagacatgatcttctttatgtgtggaatctaaaaaagttgaactcatagaaatagagagtagaatggtggttaccaaaggctaggtgggtgggtgaatggggaaaggggagatggtggtcaaaggatacaaaatttcagttaggagaaataggttctggcgatctattatagaccatggtgactattgtttaataataatattatatatttcaaaatagctgaaataatgggattttaaatgttctcaccacaaaaaataaataaatatttgaggtaatggatacattaatattagcatgatatgatcattccacaatgtatacatgtatcaaaacatcacattttaccccataaatatatacaactgttattttcaattaaaaataaaataaaacctaaagagtaatctccaaataatataagctttagctcccctcccttccaaaaaactaaatctacccttgttggtaaaacctctcagtctgcataaaatctattacaccctttgtaatgtagaaagacttctgctagactgctttttgttaccttatctttttcctccaaggggtcttgaacacctgtggagctgaattttaacattgagagtgaaattattccattgtttatacgtatcttccgtcaatcctattgatcaaaactcttggcagatcacaaaataacaaacaaggaggagaagccacagtggagcaaacaacatttattgcacactctccaccaagaatctcatggaggaggttccctgctgggagcctttggctatacagcgccctaaaagcttcttgccaagcatgctccgtgctgtctggcatttttgctgtcaatagctggagcacacaatagtacgcatatccaaatatgtactttaagagctagtcgtctcctagtagtcaccatccctgtctttctttagcaataagatcccaattctggctgagaacttggtaggatgcacagcttaagacttcccttcttaccaccccttgcattagttgcggccatgtgactaagttttcacttatagcaggtgagaggaagtgatgcgcgtgacttttagatcatgaaattaaagtgaggagtgatgttcttcttctaccacttctgattccatcttgctgcctgggatgtggtcatggtgatcaggatcttagaccatgcaaaggtaataccctagggatggcgaggtaaccagagagattagtctggaggtataacatggcaaagctgccatatcaaccctggcaggtatacttgagagggaaaaacacttttaaattatttaaaccactgttatttgggttgtggttaatagtatatataagttttctggcaaaaatatttcagaaaagaatagtattatcacaaaatcagttctgcctagggaggcattaatagaataggtacatcccaaacatctggggtttgtatatattcagaagtcaaattcagggtttcttagagttggagttcgcatgtccaataattatcacgatctataaaaaataacgttttagcaacataacaaaaggtaatcatcattttagtctaaaactaagccctcaggccccataacattgccattagaatgcacgcagtgattagttcagtctggatagccctaaattgcttattgcactgatttcctttcttctgacctacaacaaacacatggcctggacagaagtctttttcactatttggaagaagctgtctttagttagcatatgtagcggtttgttcactgacagcacaagtatctgatattggttagattcgtttagtgctagcaacattgtcttaaattctaaaatcactttccatcaagagttgaaagactctttgtggactaaagtgttacggaaaatgtggaaattatttttaccatcatttgcatacattaatattactaattcgtctctttatgatttctttgacctggtacactctgagctttttgaaggcagggatggggatttttcaccatctttataagatctaatgtcttgcatagcagaccttcagtgaatgtctactgcactgatttaaagatctcttctattttttaaaaaaaggtcagttctatatatccttctctagcaattattctattgcttttcttttttagacaggcaaacttctgaaagagtttattatacacacacttcctccatgctcatctgcaactcaatcctcctcatgtacactgtgatctatcctaaccctagcactgtgcagagactgcccttgctaaggtcaccactgaccctcttgttgttaagcccagtgatcccattgtggtatttttgttcatgtcctctctgaagcattcaaaaactgttgactgtatatccttttttcgagttttctcttcccttagattctgggacacaacgttctggttttcctgctcccttttcggtggcctctttccaatctcctgctcatttaatctgccccttttcatgttgctaattctaggattcaacttgaccctcttttatcctcacttgatactgccttgttgagtgactcattcattcctgtgactttattacgcacatcctgagggctctcaaatacatacttcagaccagcccggtctcctcatttatagtccagctttttctatttattatttccttctgaatggaccacaggtttgtgaaactcctcatgcccttcatgtgttcctgacagctttctgctattgtttaggttaggtgtgctgccacagctctacagtccgtgtagagtttctgtgcatttgaatgttagcatattctgcctgttctgtctcctaaaatacgctggggtctgtcttgcctctctgtttgcatggctgtcttcttggactaggactcaagtatctcctggtctccctgccttcaatcttgcttttttccaatccatcctcctcatagctgtcaaggtgctctgtaaaacaaaatctgatcacatgattccattgtctaaatgtcatccatacttcccaattgcccatagcagtatttcccaaaatatttattacctgtaaatcattacctctataacatatagaattatactatatgacttataaattaagtcatcttttacaaaaagaggttagtacccaaataaatatgggaaacattgggttaaacaaatctgaaccatattctttttactgcaggacttctcagggtcttcagtatgttaatggaccctgtgaatttccaagaaggtattgtatataatcctatttgtccgttggactcaattttattatacctactgtatttacatacttaactattatatttatatacttattgataattcagtttagagcagccctgatcaatagaattttctgaggtgatgaaaatattatctatctgtgctgtccaaaaaatgtagcctctagctttcaagcacttgaaatgtggctagtaaaaactgagaaactaaagttttaattttatttaattttaattcatttaagtgtaaactgacctagccataagtgggttctggttgctctacttgacagtgcaggcctagaagatgaatgccaagaggggtacttagcaagatagagcagatccttaatgatcatcccaaggcctcaccaacagctgctttcccacgtgtatcatataatctagccccatggacctagggcaatctcccaaatgttctatgtttttgcagattttatgcttttgcacatattgtttcctttgccttctctgcatggtaaagtcttcctcattactcagggctcaattcagaaaatactgtctttctgaagttctccctgaccttcccaggcagaattaggcattctcttctttgcttgggtcccctgagttttattttagtatttatcatcttgtattttaagtgcttaaatttctgcctgccctcaatggagtgtggtgagcccctagagggcaaaggctgtatttaattcacttttgtatcctttgtgatttctatttgggatgtggctcacagagggtttaatgtcagaattaatttctatgagaaagagttaaagccctgtttttgactttctagatatttttttcttttcttagcaaagaggacaagaaatctttcatgcctttcagtatccactgattgttagaagtttccataaacatcctacaccattcaggcttgaaaagaggcctgcttccttcagtttttataatgcctatgatgtatatgatttactggtaaagctaaaaactgcttagaaacagtttccctgtaaagctaaattatgttggtaattagtaacttacagtattttccaagtatttagaagtttccaaatcctttttattaaaaattcagagaggggagtctcactttgttgcccaggctgaattgcagtggctactcccagatgtgatcacagctcactgcgacctcaacctcccgggctcaagtgatcctcctgcctcagcctcccaagtagctgggaccacacatgtgcaccaccatgcctggctacattttgtattttttggtagagatgaggttttgccatgttgcccaggctagtaattaaactttttttgtgtgtgtggaaatggggtcttattatattgcccaggctggtctcaaactccaggacatgagccactgtgtgtggctccaactacttccttttacaaatgcaagaatacaacatataactgagtatggggaaatgtaggtttccaagaaaaactcttgtaatatatagcttgtactaaaaaaaaaagccaagaattaaacaaaaaatgtataatcatcatcgttttcatcactactgttataaatgaatgaaaatggggctcttgagtactttgcttttaaaactgtaaacttctctatacatagatggtacccctatttcctggaattggttctgaggttagaaatggattcatcttcagttagatagggagggaaagagaaactaacattagctgagggcttactattagttggaactttgacagacattttacacatactatcatttaattttctcggtagccttgtaggagagtattgttatcactacttttgggaataaaggatggcatagggagattaaatatcctgccaaaaattataaatgtttttgttggggtaggaaatcaaatctaattccagtatcttgctttagctacataacttgttgctttaatgagtggttcacttatttgcatatctactctgtgctaggtactttatataataaaaaaggaaacataatttaagtaggaaacattattagatgttaaaattttaaatataaaatgatgacctgagtaaatggcattctttaagtgtatctatattatcttatatttgtatcaacacactgcataaaagaaatatgcatacaatttattattatagtgcagcactattcacaataacaaagacatggaaacaacctagatgcccatcaacagtggattggataaagaaaatgtggtacacatacaccatggaacaccatgaagtcataaaaaagaacaaaatcatgtcctttgcagcaacatggatgcagctggaggccattattctaagcaaattaacacaggaacagaaaaccaaatattgcatgttctcacttataagtgagagctaaattctggatacacatagacataaagatgaaaacaatagtaactgggactccaaaaaaagggagggagggaaagggagaagggctgaaaatcttcctattgggtactatgttcactctctgggtgtcatgccgtcagaagaagcccaaacggcagcatcacacaatatacccttgtaacaaacctgcacaggtaccccctgaatctaaagtaaaaataaaaaatttaaacttattattacagtattttattgtgtgctaataattttctattgatgtatgattattattacagtattatattttattgtctgctaataattttctattgatgtatgattgttttttcctactacttttgtgatttaggatgtagacatatttttatcactaatatttgtttacactgcaaaataatttgatataaacttgactttagcattttaatctcagccaagataacactgtcattagagaaatgactataatttaatttataattataaattgatttattcataattgattcttgcctatccatatatctgttgcaaggcattctcagaattgtataatgttgctattatgtacaagctgtcaagcttttagaactaagaagagtttagtgtaggttaaaactaaaaacaatcataatgtttaaattcttgatcatttaataatcatcattttatgtaatatttcaagtttatctcatattacagtctaaaaccataaagaacatctttgtgtattcattccaggctttttggatgctttcacccaatagtgtggcttttctaagctatatttcctaaattatattttgtgcaacagagggtggtgggtggggcattcagcctgcagacattttcaacagaaaatccatcatttgcaacatcagctgtcagcacaggtgccctgaatccagcggtccacccagttctgtgaacggaaaaactgacacaggactatgaagcagttgtctgatatcatctgggcaggaaatggagaaggctgaactttgaactaatgctaataatttccaaatccttctaaaattagatgatggtttgggtatatataattgtgatggaggtatattcccttattacttatgtttggtatattttagataaaaatttaacagagagagagagagggagagagaaaacacaaattctaacacgcagcactttcatcccctttggccaagtatagtcataaaataaccttcaatggtgactctaccttaggtaaataaatttaactatatagagcagttaaaaatatgttatagtttaacaatgtatttccaattccaccagaaggggaaggccaaagatagtattaacagtaattgtttaattactttattacatcaccattactatgaatataaagaatttggtgtcttatgaatgaattaatgaactaaattatgaagattgctatttcaatgtcaaaagttaaaaagactttgtggctccatctttcctgagctttgtcgtgagatgtttactgattttgccaaaactccaactatatctgtttgtttagtcatagaaaatattacttcctctccatttttttttttttgcctaatttctctggacagaattaattactcagtcctctctgaactcctacactgcttgggcagtatctttattctggcctatgcactgagcataattaccatttatatgactctcgtttctagtctgtgacctccttgattttatagactgtttcttatttcttactggtccctggcattcaggtcattgcttgacgttaataaattccatgaagctcaatctagtttcacatatagtagtggttctcaaagtggatcctggtttcatctggattggaatcacctaggtgtttgctaaaagtagttttctgtgctcaacagcagatctacttaaacaaaatccctggggttgggcacaggactaacaaggactccaggtcattgtcatgcacagcaacatttttttggtaatagttttattgagaaataattcacattccatacaatccccccatttcatgtgccatcacagcatttttttttaaattttcacagagctgtgcaacaatcactgtaaatcaattttataacattcaattagccccaaaataaatacaggtcctttagcagtcattctccatatcccctaatgctaagcaaccactaagatattttctgtctgtatagatttagctatctggacatttcatataaatggactacaaaatatgaggtcttttgtgcctggcttctttcacttagcatgatgttttcaaggttcattcaaggttcatcagtgccttgttcctttttattgattctattgtgtgactatactacattttatctatccatttctcagctgatggttgccactctttggctattatgaataatgctgttataaatatttttgtatcatttttgtgtgaacacatttcatttcttttaggtaatatttacctagaagtagagtgtccaggtcatatagcaactcagttttatcttttaaggaactgccaaactgttttcctaagtagctgtagctgtacttaaaactgtagtgttaagtttccaattctctacatccttgccagcattttttattgtctatttttaaaattatagttatcctcatggatataaagtactatcttgctgtagttttgatttcactgatggctagtgatgttaaacatcttttaatatgcttgttggtcatttgtacatcttctagggagaaatatccattgaaatcttttgtccattttttgggttgtttgtgtttctattattgagttgtaagatttgcgtattgtagctacatgtcccttattagatacatgatttgcaaatatttattttcttccattctatgagttgtcttttcacttccttgaaggtatcctttgaagcacaaaatttttagtattaatgaagttcaatttttttttgctgctgtttgtgcttttgttggcttatctaagaaaccactgactaattcaaggtcataaagatttacagctgttttcgtttatgagttttgtagttctagctcttatgtgtaggtctctggtccattttgagtcaatttttgtcttcaacttcatttttttgcatgtggatatctggttgtttctgctccatttgttgaaaagactctctttttcccattgaattgtttgacccttgacaaaaatcaggtagccataatgtgtggcacaacaaaattttagaatatgtgtctattggaattgtgacctggacattataataagagtaaaaaggtaaaatcattaacttcagatagttttaatgattattagtcttgacatgtgtttgtaattccaaatttgatatgaagtgggtgttgtaagaattggaaatgctgaggtaagggttaatgggaagacttgtcttgtgctttacaatgtaaattattattattatttatactttaagttctgggatacatgtgcagaatgtgcaggtttgttacataggtatacatgtgccattgtggtttgcttttgctgcatccatcaacccatcatctacattaggtatttctcctaatggctatccctccccttgccccccatacaatgcaaattataaaatcaagaagcttacttggtaaaatggtcttatagcgatttttagttccatgacgcggaatatcaatttctttgggatccacaaagttcattggtatttcctgcaaaaataaataatatcaaattagtgtatctaatactgccacaaagaaaatcttcacaggggggcatctgatccagagttctattggacttcaaagccacttaaaaacaacagatctagcacctctggtggaccaacacccttcctttcctaaacatatcagctgcatccggacaagctgacttctaagaaacagctctgtgtgttagaaaatattgcttaatatgtagtcagtaaggagacatataacactggttagattttaagaatcctgctgtgacataattgctagaaagattagacagatgctaaaaagtgaatttttttaaaaaacaatgtattcaaatatattccagtttttacataactttagtaccaaaaattttactataatagattatcttttcacactaatagtgactcttttaggattattaaaacctctttcccaaaatggtaaatataaagggcttttttgttaattcaagtgatgacatgacttttttttgaattaagaaatggtttataactggactgttccattttaagttataaatgcactgtttttagtgaagggcattcaaacactgtttctcccacttaagaacattactattcttattttatcagagtatacattatatgcctcaagtgattggacagggaacaataggaaaagagtggctgtatgtaagtgcattagatctaaaaaggtgtgtatctgtagctaaccaggacaaataaagcaacaagccaaagttttcaaaagggtccaaacaaacatttgtttaaagatttgattatacaaaatagtatgttctctaactttgataagattaacatgaacaaaataacttttatgttatttaatgactgataaacattaaatatttgatcaaataagatatttttactacttaaactttctccagtagaaaatttaacttaacagtctaatattgattgaaatagaagaaatcatctttaaattcattcaaattatcctagttttcagtcattctgaaaatttgagaaaagctggactatactatgaatttgaggcttgttctacagagagaaacagctattcgtttattaattaatttatttttagagatgggatctcactctgtcacctaggtcagtgtgcagtggcacaatcatagctcactgtaacctcaaactcctgggctcaaggcatcctcccatctcagcttcctgagtagctgggattacaagcatgagccacaacacctggccccaagttacttatttttaaaataatttttcctttacctgcattatgctagctatccatgatatttatccctattctctgctccaactaaatgttttaacctgtttgttccaagttataaaaataagcaaaattgttgaatattcaatggaaaacacatgttcatgtttggtaatttcaagcacgtcagtgtctttgggcaaagccacaaaggtaatatctttattcctccccttcttccttctcaccttctgttttctgacacacactgacagtctgtcatcttccagcattctctttctcctgtgtactccttctggccttcaatttcctttcaggaaagtgggctatggtaaggtcttatttcataaacaaagagctgtctgcagttctagaaaaaaaaagctctaggtgtgcctttggctagctgtgtgaccactgacttgttctttcattcctacaggtctcattttcttcacatgtaaaatatgatacaccacagagtctgattttcatgtttgtattttactttggacacttaataatagttgatggggctaatagtagatccaacccattgctgaatctgtcaccattaggatggctgcaaatgcctgaactaataatcaatttattgtactcaaccaatacggcttaagatgcaagaggtgatcaacaaagtcaatattctccttgggcaacaattagacctaagaaggtttaatcttacttcatgttctctgagttgatgtatgttatcatgctttaagctttcactagcaacactggtatgtctaaaactgaattcatcattctttttagcccacacttggtcttcctcctgtgttccttatttcgttaaagggcaccatatgcaccctgttggccaaaccaaaaacacgaatatcaatccctgacttttccattacttttggctgcctcattcaattaatcccacttcttgtagattcctacagattctttccattttcccttctactatattagtttaggccaccaacgcagttccacaggattaacactagagcctctaaactgctcccttttagtgcctactccactgcaaatagaatgatctatccaaaacataagataaagtccaagctcctaaacatatattaaggctagggtttcttttatacttctgaggctcaacttttgccacttcccaccttgatttcaatgttccagttaaactgaacagtttaattccccagacagtgacagcaaggctattctttgtcctggaatgccccttctctgcccagctccctataccacttatttgcctcaccaattcttgcatattctgccttaatttagctctacattccaattttaatacttatcaatagtggatgagactgagtgaatctaaaaccatttcactttgccatttgtttactgtagactgcttaagtataggacagtatcatttccatacgtctctagtgccccatgtatcaaaataccgactgaagagtgaacaataaatagaaggctcaccatgaattcactttggagtaaatgtgaacttgccacgacgtccctcagctgagaccttgtgagaattcggctggctgactgcagatactccattgctaccttctcccgtggtgttggtatagacacaaagggttcaatgttccccaagctactcatgtccaatgtaagagatacgttggaccctcttctacattggagaagaatgttatgtttaaacaccacatacttattttgattgcaaaaacttgtctttctgtacatgcacacaattcagtgagaacttttacagaaataacaaccaactatattttctcttttagtatcatggttggccatagcaactacccatagttccttcacaggaaaataacaattttgttgttggaaagaactctaaattgagaaaatatgctataatttatgaatgcatatacttattacagaaatcataggttggctaataatattaagtgaaaaattaagtaaaaaaaaattaggaaaagctatatctatatctatatcttctgagtgaatccctaaaaaatggcttctggggccagatgaggtagttcatgactgcaatcccagcactttgggaggctgaggtgggtggattgcctgagttcaggagttcaagaccaacctgggcaacatggtaaaaccctgtctctacaaaacatacaaaaagtagctggatgtggtgacccacacttgtagtctcagctactagggaggctgaggtgagagaatcatttgagcccggggggttgaggctgcagtgagccgtgatggtgccactgtactccagcctgggcagcagagagagaccttggctctaaaataaataaataaaacaatagataaaaataaaaaaagatggcttctgtatcctctatttatgtgtatatgtatgcacgcatatgtgaattgacacacgaattcatttaattttgtggtaaacttataaggggccatagaaatcacagacccttaaaatgagttacaatttatcttcctctcataattccccttttcccgctggggggcaaggggatgctcttacaacttacacagaccctgagtcctgagtaggaagtgaggatgccttttacaagtaatattagctgtgtggaccaaggggtaactatgaaatagcatgtgagagactgaggattgaagtcagagatggtgtttacaaaaactgttacatttaaaggggccgtaggtgtgtgtcagatcaaatatagtgccaagcagttggcggctcaaggaagtagagagcagggaaaaacaggccaaaatatgtgagagtaaagacagtaagagtagatgctaggcccagcaaattattccctctggtattttaatacttactctggaatgcgacattaagaaatattacagtggcttgagcttaatttcaaacagtggaaaattattggaatatacaacaacaacaacaaaatccattaacgaaaatctatcagttttcttctctgatgaatctgcctctggttgcatttttgttgtcattctataatttgatatgtaatgtcatttttgttaatttctaaatggtttgtaattgagattttaatttctactttaatttgatggatatctgtaagtttagacatttattttccttataatttctagttatagttgtggaaattagagaatggctggccttttaatggttgaaactacttgattttttttcgagataaacactacatcattttctaaatatttcacagatgttttgctggcatctagtttgattatctgtatatgttcataagtatctatctgcacatatatacatatatatcaccttatttattataccattattttattgaagatattactttattccaacctattctttccttcctttttttttttctactggatttgtcaaagcctgagatatgtatgtgagtcttccacaataattatgcttgttatttttccttctaacagtttttaccttgtacattgcagccattgtgttatttgaagggatttagtcatatcttcactataaatgttaccaatattactttctttcctgttaattttatatttgccctcacatctggctttaaaaaatgaatattgatatgcctatatgttttggggggtatgtttctgaaaactttttctcatcctattattcttcttaactcttttggatcactgggttagggattagggaatagcatttattctagatgctcataaaatcctgcctacctaatagagggatatttttcccactccactttttcttatttggtttttggtggtggttgatagggttcctgtgcttctgagtaggaggcaaatagttgaagaagagcaaagaatggttctactcatggaccaagaatttaatctatttttagtgggaaagtagtttttaaagtttttcagttcagttctggacttcaaattgatagaaaatccttacggattctgataatagtttgccgattggtcttaatatttagggcatttgtgagaattcagcttttgcaagctttatagatattttagtatgaaggtgagagaggccgcttaagggatggctagtcctatgccctttaaaatcaccatgccattcagtcaaattttcagcctcaagagacaaaattgtctgccctctgtcaatggagtgatgcttgtgctatagatggtgagatctcttccatctggagtggtcagagcagattcatgaggtagaagtcatttaagttgggctttgaaagcaaacgtttaataggtgagtttttggtctagagttaaagaatctggtaggaaaaaaagtgtaggagaataaattaatacaactttgaagaacagcatagaagcagtttgagctagagttctcttgtataaaaatgtattttgaaattggggagcaggcttatgtaagagagatgagagagaagcaacagtcatagacactataagactataaaaagcccaaaaatagtccagggatgttggctgacatctgtaatcccagcactttgggagactgaggcaggaggatcacttgaggccaggagtttgagactggcttgggcaacatagcaagaccctgtctctacaaaaaataaaatagctaagtgttgtggtgcttgcctgtagtctcagctattcgggaggatgaggccggaagattgcttgagcccaggagttcgaggctgcagtgaggtaagattgcaccactgtcgtactccaggttgggtgacagagtgagaccccatgtcaaaaataaataaataaataaatacataaataacgaaaaaaaaagccagataaaagaggatccagaacatcatcagggtgtattaatttctgttttgacttcccacagtatacgctgcctaaacctgggagattagaagcctttgacatcccgtgtctaaggtctatttgatttaatgagttaattttctaaggattctgtggtaagcagagagctgtggaagcattttcatgctaactgacttaaataataaccatttatatattacagtcagaaagacatttcaaaaacaagataaacatataaacttatgggaaaattctaattaagacgtataaaaaaattgacagaatttagaaaaaaaatcaacataaataataggagaactatacctttaataaaaaaggaatgtggaaagcaagaaaacgaactctactgaaagctttacttttattttgtcttggaactgtgggcaaactgtttagcctttttaatgcctcatgattgctgttggacaaaagggaacataataaaaagctttatcaagctcctgctgcagcaccaattattatttatgccaaaaaataaataagagggaggaaattcaaaagataccaatgcaaacaattgaaggaaaaagcaaattcttagggaaaggtaaaaggaatgcaataaacagcatgctaattataattaactaaaaaggaaaatatgtataaatattatgggccagggcgacacatccatttcagcaagagaatataaacaactttgggtcaaaattgttcaattctaatgacatcagtttctaatgacttagaggtgggaagaaaacgtagctaaaaatacagtaacattacaactgagtgttggaataactcagaaaccaggcatttattttcccggtagttggggaccataatgctagattttagaagctgaatttaggaagaaagggctaaaatttctagtatcatgtctacgggctctaattctcagacatgctactttttttgcagtactttggtcactgagaacagtgagacttcaagcagtatacctcatttagcaaccaataaagaatggaaatggaagaggacaaaatgaaacagatgatcattttttcttgtagtcccggaagatgtacttttgaaactgttggattatgaaattaagtttcagtgggaaatggtggcagctgcttatcttgaaatacttgaaatgagaacggaaaaatatggattttaaagattataagaagaatttagtacagaatgaaagcaaacagatttgacttccgagatttttttttttggttctgtgaaaagtatatataatttgtctggagttgtcttcattagtgtacacgtcaaatcttatgtggtgagaagcaagaactttaatgttgatgttgtcttcagaactgaaaatgtgatcttgaatcctttagtccaactattcatccttgtgtgttacagtggccatgaatctgacaatcttggcttgatcataaaaggtgaccttaaaccctctcacccacaacttatttaattttgcacatacaatttttctacatagttttctagaataactctacttaaacagaatgaaaaaggaaaaaaaaaacaagtttttgctcatttgaataacaaaggagacaaaagtggagaaatggagagatggaattcttttactttgtgtggactgagtggcataggcagtttttgcaactcccaattctatgacttttaagttccgaggttaatggcatttaataatgttatgctgtttccatctctttatcttccagtaaattatacatagtaccaaccctctttctggatcacttgaaagatgataggataaaacagaaataaacacggaccactaggaaagttaaattgtgacataaatggagtgttaccaatttcgagaactgaaataaatgagtaggtattgtgaccattcataataaaatttcccaaaggaaatcctgaagggaagaaataataataaatataaaagatgccaggcatgaacccaggaagatgatatatgaatttcaccctaaagtaaaaagaaaatcttttaacatagagaacatttttagtgtaggaaatgatccattttcctacctgaaaggacctacacctcactaggtagaatgttgctatgccttttgattgaatctataaaagttttgaattcataaaaagatgtctgaccttttatatgtgtataggacaaggcaaaatttactacacccttattttacaaaaaaaattcaaaacaatcatttaaaagaaccagatacattgaacttgtcacattactcttgaaatattgaccttggaaaatgcgttcaatcattgttctgcatttcgcttaagcaacttggaccttagactgcataatctgcaaatgggaataataataaaactcacaaaattgactcacaccataaaagataaataagcaagaatatgtgaatacttccaccctaatgtctgggatataataaacatatatgaattattatcataattaataataacatggtgatttttgcttcactctctatttacacagctatgtgggagctacatgagtacacactgatgaacatttgagggaggtaaagttgagaaaattggttagtgattaagagttagcagcagtatcacacatgcaaaatcaatggtcgtctaagttgggactatttttcatacttcaagtccttaacatttatacctaatgtctttaaagttaacaatgttttcatgattcaaaaataatgcatgttaactaaagctaaaaatagagattttacaaatttcataatacccatatttagagtaactgctaagaacattttttgtgtatgtccttcaagtccttatatgtatgacaaaaatctagatttttattcaatatattcttttatgatttacttttaaaaaaaggaagtaggcacagaaccattgcatatgatttactttttaaaaaaactatatcatgaatgtcttttcatgtcctcaaatttttttaaacactgttttcaaacatttgatagtatcccattattgagatgtgtcatagttatttaaccaatactttatttttggacattgagtcattttcaattttttcaccattataaacaaaactgtaatgaacatccttgtacttcaatgtttgtgcatttccctaattacttttcagtcaagaagtcttaaaaactaactcaaaatctcttgagtttggagaagtcagtgggcactcgcagtgtggaagaggcatgaagacagactcttggagctcgctgatattgatgtagctcaaactctcttcctctttggttcagacctttgcagttgttccttagcaaggcttcctaactctaaaatctcctagttcagtagattttttccagatttcactggaatatctgagcactgaaaatatgataaaacctgcaagtagctacccttttgacgtaagatgcttcctaatctatctactgtgtatttctccatcctcatctcctgtcacattctcatccggacctgtgtcccaggcagacaatctacctgcagttctgttctctatgcctcaaatgtgcttgccccaacactttcaggttcaatcctccaaatgccaggggctctttcctctgagacttcctagcaattttcccaatatgtatccaatatatatcatattcactagaaatgatttgcagtaaagtgtgaacacattgaggccaaagactttgacttgagttctcctgttgtacccagtcatgaacagatggagagcaacacttttggcatctgcgtggatgaatagttgcaaatgaattggttagggggatgctatatgtaattactgtgctttgacggtttttccagtcctctgaaaatacaggaattggggggactatattaaacaggagtctgaaaatttggagtgtagaagccaagcttacataggtaaatgttacagttgtgattcagtttgaatcttgtttaagcatcaataaagtctgagcattaacatcctaaagttacatcctatgttaattttattcagaaaaaggaagaaaatgtactgctttgttttgtaaccaaggatgattaatttttactccttttttttttgtcatttggtattgttttgactgtcattcatggtgaggaggctgtttccctttcaacaaaataacaaaatgatagtagttctatttttagttcctaagttaatttttcctagtttatataattatttaagaaaaagatgctaaaaaaattaataaatctcaatgactaagccattccttgtgaaatgagaagtcttctttgaatttcagctgatttaaatataaatacaaatacaaacacacacacacacacacacacacacacacggcattttctaagtagcacaatacaatgaataacctcctgtctctttatgcaatcaactaccaaagaacccttttaatcctgatcattacaaataaattaaatatattcatttatttgtaaggccagaaatgacacctattgtcctgataccaaaacctggcagagattcaataaaaaaagaaaacttctggccagtatccttgatgaacattgatacactaatcctcaataaaatactggcaaacgaaatccagcagcacatcaaaaagcttacccactgtgatcaagtaggctttatcctgggatgcaaggttggttcaacatatacaaatcaataaatgtaattcatcacataagcagaactaaagacaaaatcacatgaccatctcaatagatacagaaaagaataaaattcaacatccattcatgttaaaaactcttaataaactaggtactaaaggagcatacctcaaaatactaagagccatatatgacaaacccacagtcaacatcatacttgaatgggcaaaagccggaagcattccccttgaaaatcagcacaagacaagaatgctttcaccacttgtagtcaacatagtattggatgtcctggccagagaaatcaggcaagaggaagaaataaagagcattcaaataggaaaagaggaagtaaactatccctgtttgcagatgacatgatcctgtttgcagatgacatgatcctatatctagaaaacccagagtttcagcccagaagcttctgaagcgaataaacaacttcagcaaagtttcaggatacaaaatcaatgtgcaatgtgcaaaaatcactagcattcttgtacaccaacaacagtcaagccaagaggcaaatcaggaatgaactcccattcacaattgccccaaaaggataaaatacctaggaatacagctaactagggagatgaaagacttctacaaggagaactgcaaaacactgctcaagtaaatcagagatgatacaaacaaatggaaaaacattccacgttcatgtataggaagaattaatattattaaaatggccatactacccaaaatgatttatagattcaatgatggcacttaatattaattaagccaagtttgtaagaaatggcttacctgaattatctcatttaactgttacaacaatttttgagaaagactattcacagaactagaaaaactattttaaaattcatatggaaccaaaaaggagcccaaatagccaagacaatcctgagcaaaaagaacaaagctggaggcatcatgctacctgacttcaaactatactacagggctacagtaaccaaaacagcatagtactgggacaaaaacagacacggagaccaatggaacagaatagagatgccagaaataaggctgcacgtctacaactatttgatcttcaacaaatctgacaaaaacaagcaatgggaaagtattccctattcagtaaatggtgctgggagaactgactagccatatgcagaaaattaaaactggactccttccttatatcatatacaaaaattaactcaagatggcttaaacgcttaaatgtaaaaacccaaactataaaaatcctttaagaaaatccagacaataccattcaagccataggcaaggacataggcatttcatgatgaagatgtcaaaaatgatttcaacaaaaggaaaaattgacaaatgggatttaattaaaccaaagagcttctgcacagcaaaagaaactatcaacagagtataacagacaacctacagaatgggggaaaatttttgccaactctgcatcagacaaaggtctaatatccagcatctataaggaaccttaacaaatttacaagaaaaaaaatctcattaaaaggtgatcaaaggacaggaacagacacttcccaaaagaagatataggtgcagtcaacaatcatatgaaaaaaatctcaacatcactgataattagagaaacgcaaatcaaaaccataatgagataccctctcacaccagttagaatggctactattaaaaagtcaaaaaatgacatatgctggcaaggttgtggagaaaaaggaatgcttatacactgttggtgggagtgtaaattaattcaaccattgtgaaagacacggtggcaattccttaaagacctatagacagaaatatcattcgacccagcaatcccatatacccaaaggaatataaattgctctattataaagacacattcacacatatgttcattgcagcgctattcacaacagcaaagacacggaatcaacataaatgcccagtaatgatggactggataaagaaaatgtgctacatatacaccatgtaatactatgcagccataaaaaaagaacgagattatgtcctttgcagggacatggatgggtctggaggccattagccttagcaaactaacacaggaacagaaaatcaaacactgtatattctcccttataagtgggtgctaaatgatgagaacacatggatatgtagaggggaaaaacacacactggagcctattggagggtagagagtgggaggaggaagaggatcaggaaaaataactaaggggtagtaggattatttagtatatttatatttagtatatttatttatatttaggggtagtaggataactaaggggtagtaggtattaacctgggtgatgaaataatgtatacaacaaacccccatgacacaagtttatctacgtaacaaacctgcacatgtacccctgaacttaacatagaagtcaaaaaagagccctttattttaattccaaatccttaaatttgtttttagtcattggaaagaaacatttataaagttaagtattcacaaagaaaatttttacatttatgccaaggattatgtatttttaaaagtaccctttaatatctatctgaaagattctagattccatctcagtcatttgatataaaaagcagatatcttaagtcattaagcagggtacatcaaggtctgcctttacctaaaatgaactctcaatcaaaattatgaaaatctactctctccagagtttctccaaatgtttacccaagaacagtaagttatttaaatatacatctctgtgtttgttcagtgttcatttaaaagtgtaccacccgccatgtaatcgtgggctttggtcagttaggtgctttgcaaataaaccaggatgacctttgctccctacaagtcactggcctttcaccttggaatttcagagtagggagtggcttctttttggccagtggagagtcaatgactttgctgggttactctgtggccacagattatatttaaagtatcatcagtcttcaggtggaaggaaggaaggcgccaattacctggaagggctgtgttagaattaaatgaagagaatgcacttgatttgatcaccgtgatcagattcttgccagtataaatacacaatcatgttatcggtgatgcctagtacatggatgaatgcctaaatataaattatttaacacagttgccaatagttaaaataaacctctccccataagtaactgggatttgttgatttgatgccattcataataattcatttttttctgggtccttcctcatccagtgtcagataaaataattgcaagataaccctgaaaatcaaatagccattcactcaagtgcagatattaggcataccagatgaagtaaagagtttttatttttgatactgtgttttattatctatattatgtccaaggagcagatagactggtaaaaaataagtatttctggaatgcaaaatatacacattttagagtgaactgaaatttgtcacgtaaaggacgtttttatgcttgctataagaaatatatccctttgcttttccagaaataaaaatgttctaaattagcatgctttaaccaaatcaaacaaaatgaaaaaatgcccagaagcaattcccaaccaattttatataatattaatgagtaatatttatgatagaaaactaaagttatatatactccctcctcttttttattgagatcaacttatgtacaataaaattcacatttccaaagtgtaaaattcaatggtttttattatagtcacttagttgtataagcatcactacaataaattttaaagcattttcctcactccccccaaaaaaattctccctgctcactggcagttactctgtatttctctctctctccaggctctagaaaccactaatatacatgctgtgtctgtagatttacctgctttggacatttcgtataaatggaatcatacaacgtatggcctcttgtgtcttgtctgacttcttttacgtagcataaatgttttcacggttcatccatgttgtagcatctatcagtactacattccttttcatggcacaatatagtccattgtatggatacacccacattttgtgtattcattcatcagttgatagacatttgggttgtttctacttttggctagtatgaattattttgctacgaacatttgtgtttaagttttgcatgaacatatgttttcatttcttttgggtatacacctaggaatggaatttctgggttatatggtaactacatttaactttttgagaaactaccaaattcttttccaaagtggctgtaccattttatgtttccatctgcaatgtctgagatttccaatttctccacattcttgctaatacttgctgctgcctttttttttttttaataatagccatcctagtaggtgtgaagtgtatctcattgtggctttggttacatttccctaatgactgacaatgttgagcatgttttctttggcttactggacatttatatatattctgtggataaatgcctaatgaaatccttggcccatttttaatttgggttgtctttttattttgcgttgtaaaattatgtatatattctggacactagacccttattacatatatgccttcccattctatgaattgtcttttcactttctgatagtatttgtgatgattaattttatatgtcaagttgagtgggccatggtttgcctgggtatttggtcaaaccttattgtgggtgtttctctgagcgtgttttggatgagagcaacatttacattggaagacggagtgaagcagagcaaccctcctaatgtagtaggtcttatcccatcagttatggagacacagcatagattaaaagtgaagttttggcactaagttattctgaagtagatacctgaaggtatctctgtggtcttcatgactgtgtctgcctacattattattcaaataatgtggttactgttctagtctcacttcattttatattgaatagacatatctatgatataaatatctattaattcaaagaaaacaatatcttgttttaattattaaaatgttaatttaattataaaattaatacatacttatactaaagttttcaaataatgcagaaggaagcaaatgaaaaagaaagccctcttcccctagttcttcccgcctcctgattttctggctctgcttctcacagctcaccacaatttgggttatgtacccttctttcaattgcccacgcacttacaaagacaaatataaattggatcataaaatttcatatagttttgcaactttttccctactttacattatatattggaaaatttgtcttattagaacaacaatgtggatttcataattaaatgcacaattatatatatatgttaatagatatttatttccaattctttttgctattaccaacaatgttgccatggaaagtcttctactgtatatttgtttattcatgcaaatgtatctgtacgaacataatataagtttctcctatagaccaggtgcagtggctctcacctttactcccagcactttgggaggctgaggcgggcagattgcatgagcccaggagtttgagaccagccaagggaacatggcaaaagcccatctctacaaaaaatacaaaaattcgctgggcatggtggtgtgttcctgtagttccagccacctgggaggctgagtgggaagatcgctggagcctagggaggttgaggctacagtgagccgtgatcacgctactgcactccagccttggtgacagagtgagaccctgtctccaaaaaaagtttcttctatatattgagtatgccaaaataattttttttttgttatttaagacattacgatatcagggaacctgccccgatagtcatgtaggttcttttctattttccctaagcatcggctggtttgagaaataaagggacagagtacaaaagagagaaattttaaagctgggcgtccgggggagatatcacatgtcagtaggttctgtgatgccccacaagccgtaaaaccagcaagtttttattagggagtttcaaaaggggagggagtatacgaacagggtatgggtcacagacatcaagtacttcacaaggtaatagaatatcacaaggcaaatggaggcagggtgaaatcacgagaccacaggactacaggaccggggcaaagttaaaattgctaatgaagtttccggcaccattgtcattgataacatcttatcaggagacagggttttgagagcaaccggtctgaccaaaatttattaggtgggaatttcttcttcccaataagcctgggagcgctatgcaagactggggtctatttcacccctacagtctacagaccataacagatggccacgcccaggggggccagttcagagacccacccccaggcgcgtattctctttcccagggatgttccttgctgagaaaaagaattcagcgatatttctcccatttgcttttgaaagaagagaaatatggctctgctccgcccggctcactggtggtcagagtttaaggttctctgtcttgttccctgaacattgctgttttcctgttctttcttcaaggtgcccagatttcatattgttcaaacacaggtactctacaatttgtgcagttaatgcaattatcatagggtcctgaggcgacatacatccttctcagctgacaggattaagagattaaagtaaagacaggcataggaaatcacaagggtattgattggggaagtgataagtgtccatgaaatctttacaatttatgtttagagattgcagtaaagacaggcataagaaattataaaagtattaatttgggggactaataaatgtccatgaaatcttcacaatccaggttcttctgccaaggcttcagccggtccctccgtttggggtccctgacttcccgcaaccttacataaagcagcctctttacctcttttatctatcagcttctaagtgtttataacaggataaaatcattaaaatactggaattctagacatgctagaaaacactcagattgggtccactatatatgtactctaactttatctcccatttttgggtagaattgttaataattttcaatttttttctattgtctgtcttctaagtaaaaaaaaaaaaaaagtttgcctctaatgaaatttatgtatttgtaaattatatacatgtactattatacttatgtattatgcaaattatgaaatatttacaaaatttgaagtaggaaagggcaagataaatgtactttttttgtaatatatatgttttacaccctaatggatcattttacacatttcttgggatgcacatgccccactttgagaccactctctcaattatctagacttacataggtaatggtaacttttttcagccactttggatatacaagacagtaagcacctaggacctatggtatctaccatatcagctacaagtactattcatcaaagattatttaaaatagcattttgctgggcgtggtggctcatggctgtaataccagctacttggaaggctgaggcaggaaggatcacttgagcccaggagttcaaggctgcagtgagctataattgtgccactgcactctagcctggggacagaacaagtccctgtcccataaaataaaatcattttgtgtatcacagaagacacttcagtcttccctatagatatgcaactggtaatcattaagttctcactgcaagaatatatcatccaaatcactactataaccataaagacaaaattaaaatgttctaaacttactatattcaacatttctctcaggcagatggcagtgaagaatatgtaaaaacagacttttaaacaacggctacaagaatattctttgtttctctaacatactattcttcctcaggtattgttttatgagttaattcattatttcttttcatcagagatcttttaatataaaaatcataatatttatctggacaactcttaatttctgatactcaataatgacatttttattatatctccaatatatgtttctgtgaatgacataataatgaacacagaaaatctttaaaaacattgagcactaacattcttttcaaataaagagagagtgttaggtgagaataacttctgataccagctaactctgtcatcttagcatattaagctgtcctaagctataccagtgacatttcattctgaaaatgatcatttctgatgaaaatgaactcaagaaatacacaaatgagtctaagtactgaaagactctaacaaaggattacaagggatagggtcaccaaattgagcaaacacaagcacaagactcgccccagttagattttgaaaaatagctctatcacatttttgtaatttaatgaaaaaatgcttagtacaggacatgcagcacatcctgacaaagtcaatacaagacacaggacaaaattgttaaatacagaacatgtcccatatctacagaatgcctggctaacctaacaagatggaacacaattgacctaattttaatttcttccatgcatccgggcatttcctgtgtgcatggcagggatttgtaggtgtgaaaaggaaaataagaatgaaatacaaaggagtttccaaactgactagaaatgaattatttcttctgtttatcataatgttttgcattgattccaaaggaaaaaaaatagtatttgcttttattacatattaaacaattatcatataaaacctgataattggtcagtaattttcctgtaataatgcttattgatttctggcatgaataggcatctatgctaagaaaagaaaaatacaatcttctttttaaaaatactatacagccatggtatttgaaaagtctctcaaatactaactgtctgaatcaggataaaatgacttttagaaaacccattactttgatttaaatgttatattttttatagaattggaattgcttcttgtctgccgaacatttgagacaacaaagtattgtatagatttaacactggaagctatacttctaagagagatttaaaataaatacctcatggtccactgttttttttttttcttgagatggagtcttgctctgctgctgaggttggagtgcaatagcacgatctcagctcactgcaatcgctgcctcctgggttcaagcgattctcctgcctcagcctcccgagtagctgggattacaggcgtgtgccaccatgctcagctaattttttgtatttttagtagagacggggtttcaccatgatggctgggctggtctcaaactcctgacctcgtgatccgcctgcctagcctcccaaaatgctgggattacaggtgtgagccactatgcctggccggtccactgttttaaacacaaatacacaccttttttgtgtcttaccattcagggttgaatatttggtggaatgttttaaagagttagatgttacattaatcctttgtattttatgtgaagaaaatgtattcatgctaaaaatagttttcaacaatttaaatattttgagtgtgtatattgtagatgaggtgaaatgtttacaaaacaaggattcaattataatggggaaatactagaagaatacataaatttacagattgaaacatatttataccattttgcacatgcttgaaatattgtgtaaaacaatttgaagataagtcctttggacttttttgctttcgtatgtctgaattatcaatacgcacattttccaccaataattctccatgtcagatgaggacattcggagaagtgtgaatgagataaaaacgaggtgcttaagacattctgttcaaacggatagagttcatttactgaatactcctgaccggttcctggagttcagatccacacctaacaaattcccaaagttcttcagacctcagcaagtcaaaatacgctacggaaatcatttttgacaagaactctcgggctaagctttaagtaatcagtatctggttaggacaggaatcacccagtatcctgtggaggaaaacagccgacatgaaggccatttcagctttccctcttctaatcatgctttctaacctactgccaattcgctcctaggctgtcctcgataaggcatgccgtaggattacgggaacccaaagttcacgaatgcaaacttcacgaggctgcccggccccatcctttccagaagatcatatctacagcaaaacggtgctttatcctagaaatcccttttcaatccaaatcctaatggaactccttgacaaccccttgactaaattacattagtaatatagttcctaacaatttcctttgttaggaaggggagcaaaagggcaaaaaaaaaaatcatttttttaaaaaaataatgaaaattgcaaaggcttaaatactgaaagaattgcttgcctctacaacaaatctgtatcattactaacaagcgataaaaggccttccgatggataccaaatgagaaccttccagagggccacgggcgcccagctggaaacccctgctaagagcatctgcagtctgaacccacagtgactgcgcgtcttctctggatgccattaacagacctctgcgaagggaggcttcggctgctccacgtcagctttaggattggtacgtggccctttctttgtttatctgatttgcctttaaatcttacaatggcaacaagtgtctcaagtaggattgttgaggacagagaaacaatgctcaaatgtcctttgaacaaaaccaagagcccaccctgccgacgaccctgaaacctctcctgtctgtaagtggcgcacaagcgccacctggagggtgcaaggcgcaaccatcgctcttctcaaagtggaattggtctgtgttaggctgaagagattattttattttaaaatgcttccattcctccactgaaaaaatttaatatagtctaattatgaatatggagaaggtggaaaaagaaaaatcctcgggtgccttagtcattaggggaagcaggaaatagaaacaagcgtgagatctgggggcacattacctgggctcgaatcctatctctgcagtaatgtactctgcgaccatggaaatgtgcttgaatgcctgtgtctccgtttccttatcattaaatttgagatgatataatttacccacctgaggtggatatgaggaggaaatgattttatatatctgtgatgcatcttgtacagtacctggcatatagcaactgctccacaaatgttaggtataggcatagacttaccaagtcttttccagttttttcctctctatgtagaggtattgctctgttaccctggtaattttttttttttttttttttgagacagggtcttgctctgtcgcccaggctggagtgcagttgcatgacctcagctcactgcaacctccaactcccgggttcaagcgattctcctgcctcagtctccagagtagctggctaatttttgtatttttagtagagacagggtttctccatgttgcccaggctggtcttgaactggtctcaagtgatcccccaggcttggcctcccaaattgctaggacttacaggcgtgagccaccacacctggctcaggtacatttttcttattggtactaccactaggccctaggatattatcctatatttgaatatgcttgatacataatcttatttcaccccactccctcatcttcgactccaataactttttctatttggtttcagattaaagctcagatttggttcttcactgaatagggtttgcctatatagaggtgctccttaacagcactgctttctagtataagcatgtcaacacaggtttagttatttaaaatgcatatcttatataaaccagataatccacaaaaacactcgtgccatattcccctaaaagaaatgtgttgcaggcatatacccattgttacttctcttgcttggaagtcctgcaaaagctcttacttacacatggtactgccaaatatcctaaagttctccagttagaaataggttagaaatataccgaggagttagaaatatactgaggagaaccaagagaacagttttgattagagtctgagtcagtcaacattgcacatatataaaacttctgtctaagaataggtaatttatctatcctggcagagcatttcatgaggggcaccgctattgtgaataacaatggacagccacctcccttgggcacaaccctttcctcggctgatggaacagcaggtggaaagaagagcaggcacacggtggatagctcctgtccaaatagattatcacacaaatcaaaaggtggactattgtgggggaggaattataaaatatatttcaacacattttaggtatttggcaggattctgtttgggttcaccatcagctttcttatagggccttggcaaatgcagtttccctgactgcttagaaatatttatgatcttgggcttttttctactaggcaaaactggaattatgaattctgcacagtataggattcataacaccgcaaacttttctagcccgtttaatctttatttcacaggcctagcttttctatggaagataccgtagtgaacaaataaacaaagtggattgaaattcgccctgctaatatatccaggaaaggaatcgttgggaggatagttggatgattattggaactggcaggtcagtgagggcagcagactctcaaagagcatgaacatgctgaccaattcattagagactctacagcccaaattgaccccaatttaaaatgtatccaaattttggcatgggaagtattgtattaagaaataagaacaaactagcagagtttgttttcaaaatgagggaggcatagatgaaaaatggctaaaggcttttttaccctttgaaaaatctgtcccggctatgcgccccccgtggacgcttcctttcccacccactcctttcctgctttcttactaccagaacccagggtccttttaggtcttgtgcctaggacttgcaaatgcctcgggtgaataagaatgcttttcctgtgtaagagcacaagacattttaggaacaggaaaagcctatccggtccaacatacctgccctttttaggtttatctaaatcccaccttcctgcattgttaccttccttcatcttcctatatagagataacatttcttgtatgtttctcatgatctctcctgtcactagacctgataaaattagacctatattttagtaccactctcgttaaaacaaatgatttctgaaaagagttcgcaaggctagtaaacagtttgtaatttttcttttttaagagtcataaaccatgagtttgaaagaggagactccaaagaagcttgacttggagggacgcggaggtcatccggcttgactttgtgcttagcttttatttatgagttatcttatttgccagaatctgggtaccaacattttctctcagagtgttcagtgacgagggatatgtttatttgggataagactcattatgaagaaaatatgcaggtggctaaagattaattacaagcagcagaggcctgttaaaaagcttaacattctctgagcccttccttgccccctgtttcacagttcatatctggaatttacaatagagtgaggtaagccacccgccgtcataaagaaggtgagatatttattgaacagatgtttcattactcaagaaaattcacattttcaagtaaaaagccaaaagatgggccttccacccaagtccctgaaaaagattcttggcagcatttatatttagtgcctacaagttttacgcactgagtttttactgtttagatgtgcgggtcaacaaatcactgagaagacaccaaaactgtctgccagatgtcgaccactgattaatttgtcttaagttcagccaaaagggaagaaaatatgatgggtggagcatgaacagcaagcacaatcaacatctgaccaaccagggtttcctgtcaccttgggaacaaaattgattggcactggtttcctgtgtacaagttaaaaaccagtagcaactgcagtaacaagaataaactacagataagagacttggaaattaaatcaaggcacatcaccaaaatttcagcttgcaaccctaagcagaaaagttccaagagaactttttgagggcttttttttttccccttttaagctattttgtatgtaaacttaatttttctaattttgccacttctggcaatctgaaatcattaaaaaggacacaattcaaatttatgttagaggtcataaattttgcccaggactcaatattttctcatttttccaaagataaaatcttatttatgcattatagcgacttggttttcactttatcttgaattatagcttttaagaggcagaaagaatcctttttataaggacagtctcaagtgtacacacagattaaatattacaaatataggttgcaaataaaactttcaaaatgtgggattataggaagcaaaagagaaccaaccaaagcatcaacaaatttacctttttgttttttttaaagatttttcttatttccttagctgcttttgcattagcattaaataacattcttattggagtggtatgtgcatggcccaactcaattttatttgcttttagtgtgaatctgaagttttattttttattgctttattcatttatttacagaaacttgttaagcacctaaatatgtagaggcatgtctataaattaaggagcatggcaatttgctctttatttttaaaaattcacagtgagagactccccaaaattagacaaacacacaaaaaaagatacagatttttgaggaagaatgaaataggagagcaaaatgtttgcaaaatatgctttctttgatagtctaagttggaagttgtaaaaaatgaccattttggttataagaggttttttaagttacttcatatcctttcattctattcttccaatttcagaatcacttccaaaatgtattcattcattttataagtgtatataaattgcaaaatactcctcatactgaattttagaattcatgctacttctgctgtcactaccagtatagtggttaagagtggattatggagccagactgccgggggttcaaattcaggttctaccctttaagactgtgtcaccttgggcaacttaacctgtatgtgcccagttttctcatctgtaaaatggggatacaacttgtgcacgtgcttcactggaattctatgaggcttaattgagataatatgtgtgaaacacaacagggcttgataacgtaataaatgcaacagtgtaactcttaactggtattattaatgttttttattactactgcactgctattgctgctgtttctgctaccaagacaccttcagtgctactgctacccttgttgcagcttcctctgtgtttctggccattgtagtgatatattctcaggttgttgctattactgacccctattggtagttaccactgctactgctactgttacaagtagtgttggtgcgtgctcctgctgcaattgctatcattgctgttactattattagcagttactagaggtgtagtgtgtgtatatatatgtatgtgtatgtaagtctggatatatatatatacacacacacacacatatatatatttatataatgttaatggtggctattttggtggtgcaactggctaggaaataatctttatttttgtttttgcttaaatatgctttcaaaatttctataagatgtgttatttgcacagttcatttaaaattaaaaatattaataagggctggagaaatattgaaatctcatattcgtcaatattttgtactgcctcatggcctattccaccttcctgagaaagaaagggtgttgagtgcaccctgccccggtatgagaagggcatcttatattatatcctcctattataaaataagcatgaagagacagggctgggagacatgatttatttgccatctagctatgtactaagagcatacgagacattcagtcactgactgattttgttatttttatctcatgtcaaaattttcctcacttatctttatgtttaagaagaaatatttttgataagaggagagatttttgtatgttttagccaaactattctcaggagaatgcccttgggttggcccatagctcaattgtgaacaattaccctgacattatcctgaaaacaatcccacaagttctactaagaataaataaagcacaatagaataaaattatccaccaaatctaggaaaagcagctatattttagccaggaaatagaagtccccccacctccccaatgtattaagttcttgtacttctgtcagcaaagaatttagcacatggaaaaattcagattctccagttattgatttggggactgattattagggggaaaaagtaccgagagccaacttaggtgagttgttgtaccctgacaattgtccttgtggtacaaatggttttaatagaacagagaaaatgggggaaaagaattaaaaaaaattagaattggttatttctttagagtaatggtaaaacatcccttagtctatttattttttacctttaccaagtgttacaaaattttaaacgtcaaagagttaaatatctggctctctgagacatacaggccaatatttctagactctgtcaaattctaggatgaatgcacagccctggttgaaggtaaattcaatgatgtgtctctcttcgctaaggagggacattactgcgcctgttgaaccctaaatagtaaaatcattgtcaatactattgcttataatgtacacatcatagatagatgatgatcacaagtgatatttttcaacatcttctttgtatgacattacccagaagatccaagctaaaacccagtaaagaatgatgctttttttttttgcagtctgctttatgtttttgcaaaacattttacattacacttgtaaaatatatacatatgtatatattttagtcaacttaattcaagaaaattatacaaaaaatctaatttaatgcaacaaaaacctatcatatgcccagtttttagggcaaaatcaggcttaaaatttgggtagaaatttaaggccctagaaatgtatgtacagtggttgacaatttggggtctggagccaggccacctgtattctatatttattgcacacctctcatggccaattggatgcccttgagcaagtgacataacctcctgcagccatggttttcctttctgtaaaatggggaaaataatgatagggtagttttgactcttatgagttatacatgtaaagtatttataacagtgcctggaatgtagtaagtgcttgataaatgttatctgttatcagtatcatcatgggatagtctgcatttaatttttttttttttttttgagacagagtctcactctgtcacctaggctggagtgcagtggcgtgatcatagctcactgcaacctccacctcctgagttcaaacgattcttacatctcagcctcccaagtagctgggattacaggtgtatgccattatgccaggcttatttttgtatttttagtagagatgagattacaccatgtctctgctaaaaggtcttgaacacctggcctcaagtgattcaccagcctcgacctcccagagtgctgggattacaggcatgagccaccacgcctggctgcatttacaaaatgcatttcttcctacttattcccatttttttctctccaatatttctaagatttgtatatttacgcaggggatggctaggggagagaagggggaaagtggaataagcttttggaatttggaagaaagaacatgtatgttaaaattcctatctagtattaaacataagtcacatattcattattgtgtatttgatcatgtacagcatatattgtcagacttcggtatcgtggaagaagaaatcttgaaattgtctcacaaattttaagggttttgtgctgtcatggaaggatcctaattggatggaactaagttttggttcctagtcccgatttttttttttctctctcagcaaaataaaacactcaggcacttattaattcaaatgtcctcatggacagaggtttttgctaaacaactattgctttctctgggaaactatagtagtttccagaaaagggattgattgaagaccttaattataaagataaggtaaaacacagcctttaaaatgggttataagaattaaaaaaaccagaattaacttctaagcataaatgtacataacttatgagttaatttgttaaaaaattatcaaagaaaaattcataaaagaagctatcagatacttttgtattgtgatcaggttttccaagtggccagtaaaaagtgtgtctgagagtattttctagaaagaattgaaaattttatattagttatgaacagccctgggaaactctaaagatgtcttggatacattgaggggaatgataggtggcagagaatactgcctagctacatcactgcaccaatagaggactcagacccagagtctcatagaaaaatgcatccaaacggcacagaatggccaaaacgtgagaaagacacatgtacttgaacatcacatgatctacttcaccctcaggtctttgatttcacttgaacatgtttagcccgagcagactgtctgagtaaacaactgtatcagtggtaatcaaactcttttcaaagctgggggctcttggttaagaaagaaaataagatcatacctgtaagtctaataatcaaaacaagtgcatgcagagctcagctcattgaggcatcagagaagggcccaggccccactagcctacctcttccctaaggccccatagagcataattgaaaagtactgatttatcaaaatgtgaaataatccatagctagccatgaatccagctacagttctattgttgaataacccaatacaggttgagtatccctgtatcccttatccgaaatgcttgggaccagaagtgtttcagattttggattttttttttttcagattttggaatatttgccatacatatatacagagctcagctcattgaggcatcagagaagggcccaggccccttctctgatctctctctctctctctgtctctagatatatatatatggcaaatattccaaaatctgaaaaaaaaacaaaaaatccaaaatctgaaacacttctggtcccaagcatttcggataagggatacagggatactcaacctgtactgggttattcaattatatatatatacatatatgtgtatatatatatatatatatatgtatgtatgtatatggcaaatattccaaaatctgaatatatatatatatatatatatatatatatatatatgccagttgaggatccctaatccaaagattcaaaatctgaaattctacagtgatcctttcctttgagcatcatgtcaatgttcaataagttttgaattttggagcactttggattttggatttttggattagggatattcaacctgtactgacagatggcttccttcaattctcaaagttctttgtaaactaattagttaacttctttatctccattccttgtccacacaacactaaagaggatgccttctggcaccaacagcctgtgatcctaacaattttagtaatgaatatggctataggaacccagtataatagagtaggtaagagctgttggaatactacggggccaaaaatgaaactgattttagaaaattattagaaaagcttccaggtttgcaatccatgagttgtttcagttctagaactctgcttccaataagggttatggccactgctttcacatcagaggctctgcaacagctgtagagttatgggaacatccttgcgacctggaccagggagactgagattacagttcccaaataggaataatttaaatacagattatagaaatatatactaatataaatatattcaaatacaccatagacatttaaatatatgcatttaaacttaaatgtatttaaacacatgcatttaatgaatatatttaaatatgttatacatgtttgcatatatgtgtgtatatatagatctttatacagattacatgtagagatgatctatttgtatctatctgtctatctatctatctatctatctatctatctatctatctgagtatcatctttccccaaccctggaccagagctgttgaagctgaatttggattggactctagaatattttccatctggaaagtctgtttagataggaatatctagaaatattacaaagtttccctagaggactatgttaaatgagttttggggaccactactctaaggtttctcccaactgtaaaatgctatatttttggccttttgagaggcccccagctctaaaatattaacacttacttctagattataactatgcccaccataaccacttttaccaacagtgagtgggaatgaaggacgaaattaagcatttattaaggtctaatgtacaccaggcaccttaataggcaatacaaatacatggacatggcaataaaaaagagacatccttacctccaagcagcttacaatttagtttactgaattacacagtttactttcttatgaagaatcataatgatttaagaaaaaaaaaacctgaggagtccaataaccatgttcaagccatgttttaattattttacttgttatttctattttgaggattttgacgttctaatgtcatttgatatttttcataatgtcatttgatatttttatcctcttggggggatacaactagtggatgacaaaaaaacaatgaaaaaataataattccaagcaaactattattgacattgtgttaaagattttgtgagacaccctgcccacactagatttcactagtatcaccctagaggatgtaagttctaatgagaatttctgtcacacccaagcctcgatttttacttttacagtatagtgctgtttcactctgccacctgcaggtcatatatggaagaacatatttaaattagaaggcctggcttggtggctcactcctgtaatcccaacactttgggaggccaaggcaggtggatcacctcaggtcaggagttcaagacctgcctggccaacatggtgaaaccccgtctctactaaaaatacaaaaattagccgggcatggtgacgggcacctgtaaccccagctacttgggagactgaggcaggagaatagcttggaccctggaggaggaggttgcagtgagctgagatcatgccactgtgctccagcctgggtgacagagcaagaccccgtctcaaaagaataaatgaattaaaaaaaaaaggtagaaatcagaggccaggcacagtggctcatgcgtgtaattctagcactttgggaggctgagacaagaggatcacttgagaccaggagttggagatcagctagtgagacccccatctctgcaaaaaataaaagaattaactggacatggtggcatgtgcttatagtcctatttacttaggaggctggggcgagtggactacttgagcccaggagtttgaagttacagtgagctaggatcatgccacgccactccagcttgggggagagagagagagagacagagagaggaaggagagagaatgagagagagcagaaggaaggaggaaggagatagagaaagagagaggagggaggaaggagagagagagacagagaatgaaggagagagagagacagaaggaaggaaagagagaggaaagagagaggaagtgaggaggaaggagagaggaaggaaggaggaaggagagatagaggaaggagagagagaggaaggagagagaggaaggagacagagaggaaggaaggaggaaggcaagagagaggaaggaaggaggaaggagagagaggaaggaaggaggaaggagagagagaggaaggaaggaggaaggaaaagaaagaaaatatactttaaagtgaaataaacaactctcttctatgaaactgtgatggaaagttaaaccattggtcaagattataatgattacctggatcaaaaatttggatggaagaaaaatccctccccagaaatgaaaaaaaaatgttggagtttaaacatgtacaaataggaaagcaatggtaaggacagtcacccctctacacaatgttcaaagatgaggaagtattgcctcacctggagaaacttgcaatcgccttgtctgagacctctctctagatttctagaccattctttcactaatatggaaccactcaattgtaggatattttcttaagtgtcttgatgcatatttacgctgtattaacaggttcaggatagagtctcttaaagtttacaaagtttattcattaaacaggagcagaggggccacgaccacagaccttaaaaaccaattggccacatagggtggttggataatttaagcacccgtgaaggaggtggcaagtgagaatttctccctttctctgggctttctagaatcaactggatgttttagagctgaaatagacgaatatgtctaactcccatgagtaaggctaactctgtatcattcagtcaatttttagagaacctctattatgtgtgtggtattaggaagtaggaaaacaaaaacgaataagctctcaggagatcctactgtgtgcacgtgtgcctacacacacatgtgtgagttcttgatggggtcagggaacaagagaggtaatttaggatggtttattcctagattctgtatttttctatgtatcggatgggagaagagaatttaaggacagcaacactgattttaaaaagctgccttgggcaatgaaaaaaagagctgcctggaaaaacggacaggtgtttgagtagggctgaccatcctctggagactgacaagatgaaggatccacatctgaggtatattccttcaggcaaagtgggcctctgccatactttgaatgtattcattctcatagatcctttagtacttcatcatttttactcttatttttgattaaggtgggtttaaaattccaacttttttttcttagaaaccttaagtagactaaggattctgtcaggaaaaaatattcctctgaatagggatttggtaacaacatgctaagttaggagccaacgtaacaagagtaaaacaaatgattcagaagatcatattcacagcagggaccgtgagggttttaggagctcccctcagagccccaggtgcagcgtgacattgccaaggacatgcagggagcacagctccaaggggctccctctcgatgtctaatgaggccaggcaacctgccagcaccacaggcttctgtggggcaagggcgaggtggtggtgagcatccattttttttttgtttgttttcctccgaggcagagtcttgctctgttgcccaggctagagtgcagtggcatgatctcagctcattgcgacctccgcatcctgggttcaagcaattatactgcctcagcctcccaagtagctgggattacaggcgcacgtcaccacgcctggctaatttttgtatttttagtagagatggggtttcaccatgttggccaagctggtctcaaactcctgactttgtgatctgaccacctcagcctcccaaagtgctaggattacaggcatgagccactatgcccggcgcatcatctatttttatttttttaaaacatatttcttcctataaaattaacttgatgtccaagaacttgttccttttttcatattgagatttaacaaatatttatggaacacgtacaaggtggtaggcattgtgctacagacaccgccttgagggaaatcaaagccgagagggaaaacgcaggaaatgaaaagtaaggcaggtgggatggggagggcctggaaaaggggagaatccttgagggctgtgttttaatccatgatttggaaaaaaaggtttccttaaataaacaaatgtatacactataagacattattagggaacaataatttcatttgatacactgttgttaaaattacttaaaataatgagaaatgaaaatgattggatgccaagcattgttagaaagtatatcatatttaaaagtgttcacaagaatttgtcaattctcaagttaaagctgtttcatcactacactgagacctgttttctaaggtatataccaaaaaaagattatgccttacccgccagagaggacgctgtcataaaaaaaatacaaacaaacaacaacaaaaaaaaaaaaaaaaaagaaagaaaaaaagaaaaattatggcaaaaaaaaaaagaaaaaaaaagaaaaaaaaagatttcacctttcttttccttccatgagacaaggggctaacaactgtgtcaacatgaagttctccactagagggaactaattccacgtcctccaatcgtgagcttcatcaggatgtgtctgagaacagtgctctctccatgtttagattgtacccagataatcatgctgcattgctaaatgggaacgacactttaaagtggtttttataagatttccagaaaaagatagttttatatttatataaataaattgaagtgtatattttatgttacagaaaaaacccacatcagttgaaaaataattgtgttcaagtcgcctgccatgagtaacttgtgattcttcactgttctgctctagaggtcatgtgctaatatctgggtgaatttgatgagaggagagtggtgcctcacttcccaggaaaacaatgtttgggcagttcataaaatgcacatagtgggaccctgaactacatagctttatgacacatttccaaaaactcctaaggcaaaagtctctggctgcaaggaaaaacctcctgacacagtatctaagattcagaactggtcgctcttaaaataggaagcaaagcttatgctgggaattatctgtgcctgccctgattaaaacgcttcttcagaacaggccatttcacctaattctgtcaacctatacatcaagatttggaacatggtcccctagcaaaaataaaaaaaaatctcattttaaaaagcactgcatttagtaccctccaaagtgaaactctaattaatcacatgtagaggaatcagagaatttgaatctcaaaaaattgtaccacgaccacctcttctttagggtcaagacaaaaagaactttatagaaatgcacaccctactgaattgccaaaagagttcccagggtagttagattttgtcccccatggtatgagtgcaaatggagagtaccctgtaaagctggaagcagtgtcctggatggggttgcaggctaatggatgttgaaggattgttgggggtcagggtggaagggctgagaagtcctttctgcttgaacctcagggtgaagcagcctgtatgaggggtggtctgggggcagatacagcagttagaggactcagtgggacttattcctgctgctctgccagggaccacaagtagagaaagggaaggcaaggaaaggaaaggagcaattactgtgattcctcttagagccactgccaggtctacactttcaggactcattagactacaatggcttaaacatttcagggtctgcttggagagaaattatgccaggcctgtgctttccaatgagtagtggccaatttttacctttttaggcaaagctcctctacttttaattcttaaataatatatgttggctcctgttttactcaccctgggttgtatccactgtcatttctttcacttaacaagattacatttttgtctcatgacgtaccattaattttcaggcaggtttcaaaacttttgcctcctttttcttcattcctgtggggtcttttatttttttagaataaaaaaccctatgaaaattttgttcataaccctccagaattccaacctacctatataaaatctgacaaataaagagaacagcttgatgctcactgttcatgaagggcttgtgcatgtttccagtgcctccctcagctctggacatccccatacaagtataagaatatgaaaatattttataaaaatgttagaaggtgattagtccgttctcacactgctaataaagacatacctgagattgagttaatctataaggaaaaagaggtttaatggactcacagttccacatggctggggaggccccacaatcatggcagaaggtgaaggaggagcaaaggcatgtcttacatggcagcaggcaagagagtgtgtgcaagggacctgccctttataaaaccatcagatctcgtgagacttattcactatcatgagaacagcatgggaaaaacctgcccccatgattcagttacctcccactgggtccctcccatgacatgtggggattatgggagctacggttcaagatgagatttgggtggggacatagccaaaccatatcagaagattaaaattttgtcatctgtatcacctagaaaaaggtaagacatggtagttacgtgcagattttgtaagcaggttgtcaagattgtatctttggctagatttttatttctttgtgacattgagcatattacttatctctctaagtctctctgttagcataactgcaagatgggcatagaaatactgcctgcctccaggatgttgtgaaggttgtctgagatcatacataagcacagtggttggcaggtggcaggttagtgtccaacccatcagctgtgactctgcatccttctattacagcagcacgggcagcagcttagtgcaggcatgaccatgtgcttctctgctgttcctgccacctccactgacaatcacacacacaatgaagtgggcgagttattatgcaggatgtttgaacaatatggagaccactccatccttttctgacttgagtattctgaattattgccttatagccccctcactttggcttctttgctctattcgtgttcaccttcctcttggtcatttatgtcagattaccaccaggcctccagaatggcaaaaatcagattaaggaaaaaactgagacagacaatgtgcttctagaatggcagtgaaatggttatctgtcatgagtgttttgagtccacctcatgaaattgcactttgcttgatttaaaatctgaaaaatattctgaaagccaagcataaaatttgctaagaggaaaaacagtgtgacgctccataatatacctacttgctaaatatactgatttgtagtttattttaaaattgatttcccacagattataggtgtgtacgcctcctcccaacccccaaagcatgccaatttattattaattaggagtacagcctctggagcaatactgcttgggttcgcattctatttgtcaccctcacaatcctactgacttactattaagttattagggccataacttatactctctgagcatgagtttccactctaaggaggggataaaaagtcccttgggttggtgaaatgagataatgcatgtgaagggtcaacagggcatactgagttgttatttttattgatgttatttggagttaaactggaatttacttctacgtgtttgctatattttatgtttataagccctcatgttgtcaggctgagcaactgagtcatggttgatagactgtgttcaatggggctgggtcataggttccaatagaatgaatggtgtttatttgaaggaggccgtgtggtacgtgtataatggcctgggaaaatcaaaggaacctggagtgtaaacttagctctgctgcgacctttggcaagtacagtaatgctgttggtgccccacccaggtcgcctttctccagctggtgccccatcctctcctgccccactgctgggagggtagcctgttagtggtgcccagctgccacttcgctggagcagccccctcagctgatgggtgttgctgagccagaggtgcctaggaagttatgcctccaccatccctgggtggcctggagtcagtggttggctggcatgagggtgcagaggctcagccccctcacctcaaggtgagacaactgtccatgaggggccactcatgctcagagatccctgtgcaatcaggctgagggtagatggctgctaccaccacctctttgcttgtcctcttctctgttctgcttgccctgctttcctaataagcttcccctgagagcatcttctcaacacatcatttggacaagagcccttgtctcaggctgtgcttttacagaacctcaccaaagacctaagagaaagattctgggccccatttttatttgacagaaaatgagagagttggatccattttcgattatgggtctatttaatgaatatctatctatctatctatctatctatctatctatctatctatctatctttcgagacaaagtctcgctgttttgcccaggctggagtacagtggtgtgacacagctcactgcaaccttgagctcccaggttcaggatatcctcctgcctcagcctcctaagtagctgggagtacaggtaaacaccaccatgcctggctaatttgttaaaaaatttttgtagagacggggtctcactatgttgcccaggttggtctcaaactcctggcttcaagtgattctcctgccttaacctcccaaaatgctgggattacaggcgtgagccaccatttgcagccatgaatacagattttaacttccagggtattttttacactttatgctctgatatgcagtcatattaattctattcccttctctttactcatatgtcccaaaaagagatcagtggaggaatgattaaagattctccaagttaaaatctttaagcatcgaaatgtacctctactagggaaagcgaggcagatacatcaggacattctgccttgccaggaggaaattgtaatacacaaaatcttttgagtttgaatgtagaatggtcaacattttcatggcatgtactgtcttttcattgcttccaccattgcagacaaatttctagttctgataaaaatctcccaagctcagcaacccctaaggaaacctttagactcacaatcctgggtgttatatcattttcacagtatttattgtaaatcataacatgtataccctattatggtacagctgaagaaaagttagtgaatgtttgttcgttggatatcagcaacccttgggggcctactgagacctccgttttgatagaaaaaaacacccattaatatcatagtcctgatggcccaccaactgattactgagaaatgaagtcaggatggagagtgctatattacagtgtgccactcttccttcctggacagttttctacctctccttgcacagtgtttacttgtaatagaaaatcaagtgagaaaaatgaggaaataatgtgaacatatccaatttgcctgttgatttcctttccataaaattggccattagccgtacagtagcccaaagggaaaatgtgcagaatctttcagattcataagttctagaaaatgtactttctagagtttgaatgtgattcctcatttaatgggaatttggaactcagcatgtatacaatttcccttagagtgatcagtggagcattttgggagggcaaggatgggacaaaagacaagagggaacatgaactaactgtggcctcacactgtgccagccatgtgacatttgtcatgtagcttaactgtcccaagagctgtgcaaggcacatgctatgctcctcaatacaggtgaataaacaggttccaacttatatatgtggtagttacagagcaagtgtttgaatttgtacctggactcgccatgagaaatgaatgcatttgttagaccagaattgattaaattgatactgttatttattagataacatttactggccaatttataagtatgtacttataaattacatgtaactgtatatttacaaataggatgaacaaaactatgttaattgacagttaaaaatataatgttatatgacaggctcaactgtagcaattcagtagaaaattagcttcaactcctgagttcaaaagtataactgacctagtgtaggcttgtgaaatggaatcagagaacaaaaacaaaaagaatattagatttccttttccttctcaaagacaccatgccattttgtattgattgttaattttgtagtatcctttgaaggtggagcagatattattttatagattgggaaaactatactacagaggacttaattaatccgttgagccacttatttaataagtgtcagaggtagtattagctgagactcaggtctatagtttatcattaagctattggttcttatggaagattctttagaaacagacgagatcttcagatgtgaagcaacattaattaactccataatatttttgagtgtttactatgtaccagggtttacaggaaccacaggagacacagagtatcttgagccatagtacctgttcttaaaattcttgtcatctgctgaaaacacaagacaaaccacttaaaaaccagttcaagtccctttctgaatgattgttcaattaaagtcattgccagaggagtggtatatctgagaatttataggtgttatacatcactgtgggcacaaataggttacatggccagtggtagggggtaagttttgtgttgggctctggagactagagatcggtaggctgagggaagaggaaggaccaggcaaacagaaatgcaaatgtggacaggagcgcagcactcagagggggatggggatggaaacagagagcatggaatagaaggtttattttaggatgtagttgcaaatggatttggagcaaatgatcagggccagatggtataggacatctgaggcccaacaagatggtctatgccttattctgtaagaaaatggagccaaatggggatttttgcacagcaaagtatgataatgaaagattgttatagcaagataaacctgaagactattgaagggggaaagagaattagatgcagacagataagatgaaataaaataatatatatgaaacatattacatatattagtcctaatatcatttgtacaattatatgacacaacaatttaatcatgaagtaatgagagctgggtccaaggtgatgattacagaaagagataatcaataatgagaaagttggaggagcaagaatcaatatgatttggcgattagtttgaaaaagggagaaaagaagactgaattgctatgtttctcttttttttttttctttttgagacagggtctcactctgtcacccaggctggaatgcagtggcacaatctcagttcactgcaacctctgcttcccaggctcaagtgatcctcccacctcagcctcctgagtagctgggactacaggcatgcaccaccatgcctggctaatatgttcttctttttataagattctttaatcttcataatttcagagtgtattctttatactcagttaagcaatccatttagtctctagatcttatttgacttatcttttaattttaaaattatattttatgattaatgatatcaaagtgatagattctcccaatcagggatgagaaatttatatgacatgatccaaaagattgggacaagtgacttataatgcagtctttatggtctcctggtgattttaatgaagccatacttttatgcaataagtagaagattattacctcactccaggatcaaaagatggagagctattaaacatgagcctattttaaaggcaccattagaacacacatatatatatataaattaaattttaaggcttaaaactgccagaaaagctttctgcatggaacactgtacattcttcaaatttggtcactcttaaaactcttcattatgccatcttggcagggaattgtggtagaaaaatgggagtgagaatagaacaggaagggatggtggaataagcaaagtgtttcccagtaactgctgggagttaacctgaggttagtcataaaaaagaatcattaattggttaattcactcattcaggcatttatctccaggagctcctggtttccagaaattatgttctatatgtaacagataaggagacaattcaatcatatatgtgtcctcaagaagcttagagtctattggctacaacagattagtaaaccagaacttaaagacaacaaagaagtgctataaatactgtatgcacactgggttatggaactaaagcagcggggagcctccatacagaagagaggtagctgaatcagtagtgggctggaggaaggaggaggaggcagagggagcctcaaattggcttccaagaggaagtgatgcttgaatgcccctccctgtattcctactccctctttcacctttggacctttgctgtattcgggctgccagggttttttggtgttttattgcatttgaagaaatctgagagcagaaagcagggaaatttgagtcctgtcatgggctttgtgttctaaaggccaggactttggtggaaggtggcgtctcggggtgtggatgtcagataaggtagaatatgaaataagccagagtagggttttctattcccaaagcctaagaaaacgcccatgggctcaggggagggtgaagtgttagaacggctgctttgtgggtgcaggtgagacccctggatccttcaccgctgagccctgggaagtgggggaccctcaataggaggactgtgatccttggtagagccatgagaaatggctggaaagtgtttctgggggatcatgccttagatatgcccaggttttcctatgcctccatttggggtagaatagtgagatgattcttgggcatctaacagtggtttggatacaactgaaaaagaggaagagagagagaaaaggagaaagcaactgctggaaatgaaggggctgcatgaatagcaacagggaacaacatggtggtaactgtcctgggaatacttatgagaaccaaagagataatggacattttagcagatgacaatgtgcacagatgacatcaaggcagataggggccttactcttcatgttgagaaagtctccttaaaacgtagaggaaaccctaggaaaccagaagtaggttagatgaatcagaaaagggctgagattgagtttctaccatttaggtgaaatgacatctagcaaaaaagcttaggttgagttacagaaaaataaaattgcatttcttgtttttttgatttgtagacccagattcatgcccactatattggtggtaattttcaagggcaaggagtagggaaaaggacaggttctaggcaagtattaattcttaggcttaaaagagaatggcatggtacctggaaaaatgtccaagtagcaggatgagtccaagggggtgtttagcaggaaataggggtcaacataggctgccaaaggccagatcagaaagggcttcatatttcataagtagaagttatcagtttcttcctgaaggcagtgtggaaacactgaggaattttataaagagaaaaacactcaaatataatttagaaaaccagtttaagaggtctagagagtggactggaaaaaaacagaattcgaggtggggaccaggaggagactggctagaattagggagatcctgagttctcagtgggattggggttggacgggggaaacagttgggagaaggtgccaggtcttcataatgttcggctatatggggaggggaaaaacaacacggagaagctgaggatattactggtttcagagactcacaatttaaaaagaagagaaaggatttgatgaggaaggtcttgagttccatttctgaatgttgtaagttggtagtgtttaagaaaggtcagagtagtgacacagagttcagagctgaaatatgggtctggatttcaacagaaaggtagattgagctaaaggtactttttcaggaatcactaaaaggtggtaagataagaagtggccatggttgggtgattcaggaaggagagaagaggacacagaatgaaactctgaggttaacaagagaagggaatctggaggagaccgaaggtagccatgcaagaaacagaaaaatgatatatatgaggccaaaggaggagagaagtttaagaaggagatagttactagtgctagatgggaaatgaaacatgtgctttggatttggtagtgagaccattgataattaacttgataatcgaggatgtgagagaagcaatgagaatgaaaggtgggagaagaacaatgaggcagcaagtacactctgttcttttaagacatgtatttgagaaaggaaggaaaaacaataccagaggaggcactggattaagggagtttctttaatacaagaaagaacctatttgtatgctgagggaacagcattagaaaagagggtacagctgaaggtagaggaggaaaactgatgaagttactagggttgaggtgaatgacctggagcccttgtggagagaatagtcttttcctgctctgaggtggaacaaagtaggaggtgaagtgtgggatgcagtgaagttgtagataaggggacagaggatctatttaacactgattacacacttgctctgctagaatcccccacgtggaccaaagagatgggtatgattccgtccttgtattcgcccttctcaaagattcactttaatgaaatgaataagtgaatatttaaccttatactcctttaaactgtagaccaacatgtccagcagtggtctacagagggcaggatgctgggaatggctactttcctagacaattttattctgaccttgcttagaattggtagtgcatgatgataataaaaatttgtcttttaatcagtttcattatgacccttcattgttatctactatagataacatggcctcctattgcctgcagaccctttcttgccaccggcccttcgttcatcactgatgcccaggtctgtgcttcaaagttcctctttgaagcaaacataaaagcacaaaaataatgtggatgaccagagtaaaagaaccagaaagaagctaaaaaatcaagttaaacctctttatcttttagaagaaaatgaggtccagatgagtgaatgactcaggtgaggccaccaaacccaggaacggcagggctgggtctggaatccagttctcctgactcccagttagccttagggagaaagttccattttctctacctttccacactgaatcacaaaaagcaatttagtgatatctacgtaagtgaatgtcacatggagacctacattgcccatcaagaaaccacaggtattttaggggaggaggtggaaagaatgacttgatcaatctctgttttcttcctgttgtggagtcaaagggttcagtgtttaaggacttttagagataaacacattcctttatttttatgtcatccattgttccttggcaatactttcaaataattatgaaggatcaattttgtattctgcagttcttaaaatcccaagctatattttctgaagggtgtgtttgtgtgtgtaaaccataactatttgcatagggcattgtgatgtatcatgggaaatatattcaaaatttatatatgtgatttaaaaacctcaggcaacaaaatatatggggttagaaaatggagacatggaaaataagaggagaatgaacctgggatattactttgagaacttactctcccactaccctggtgttcaaagttggatacactacaagtcatgttttaaatataaaattaaagcttcttattttaagaaacgccatgggaaagctttacttaatatttttgagaggcaaagaattagtctctcatttatgtattttgcaaatccaagttttcttacattggatttgcgtttaatggaaatgtattggtataaagtgaatcacatgtataatacatcacaaaaaaggtaaggcaacaaaaataatgtcatggattttttttttctttagatagagtttcactctgttgccaaggctggagtgcagtgatgctatctcggctcactgcaacgtctgcctcccaggttcaagcaattctcacatcccagcctcccaagtagctgggattacaggcatgcgccacctcacctggctattggccaggctggtcttgaactcctggcctcaagtgatccacccacctcagcctcccaaagtacttggattataggcgtgagccactgcgcccgtccagtgtcatggatcttgatactgaatgtttgttgtggttaaaaaatgcagagctaaaactttaaaaaaaattaatctgtggcatcaactcctgcctaactccagacaacgtgggcttttgcaggaaacactctgagttcattctcagtcttctacctaccagagtttcatgacaattaaacaagatagcatcttgtgaggtcagtgaacctcaataagctagaaattgtcttgtagttgaagatgaactttgcttggatctataccatcttgaatctagacaagcttagcagaatcagacatacctaacagattttatctaacacagttggattcctttgggagacaagaaacactacttcatctgactgtccatttagtggtgaacaattctacccaattatgtcaatcattactagttctttcttttttagttgatgaatactctttttataaaaagccacacgtagggtatacagaacaagctcttacctctcttgaagtcctatgggcttcattttgaaaggagaagggcaaacagaggtagcggtggtagctttgatctcaggagcacctcggccttgagggtccacgacaacattcagtacctttggggcctgctcaggttggaccatgctgtggactgtctttgcctcggacagtgctggctgtaatgtgatgggcgataggtggatctcctggtttttctctttgtcttgtcttaaggaaagctgaaatctttcttttaatctgtaaagaatctatagaaggagatataaaaaactcctgtcacattttctcacactaaacaagagtatgatctcctccaccccaccctggccgacaaaccaaaataaaggcttaacgataaagtaaacaaagccctctgagagatgatttctcagtttcatggtattgagatttttctcaagacagtacacttggtatttccagttatgctgcacatatgtatcaaataattgtgcacatgaatctgttccacaaagatatattcaaaagtaaatttaaccaattttatgaaaaatgccagatgttagtttggtcacatggggaaatggtaggcttacagaaggaataaccgtaaaacacacgtctatgacatttatagaaatggagatatacatccaacatggcttagtagaaaaaagtagtcttgcaagtattaataaaataatagttatgccataaaccacagtttcttatgttggtaaatctctgcattagtcatatatcaacttgagtatctggtaaatacttgacaaattaaatttagggtatctatgaaagaataatttggacaaccagaatttttattcttaccactttgccctcttaaattttaatatttattttattttatttcgatacaggatctggctctgttgcccaagcgaaagtgcagtgctgtgatcatagctcactgtaacctcgagctctccttaagggaaaagactatgcacctacgagatagaactagaaatgcatattaaacattgaactcctaagaaaagaaagacattttattgttttttatgtcagtccacctccttgtaatctggaaacttttatactggtgatattcattgactctggtagggtaaagttaaagcttaaattttgaaaaaagggtggatttggaatattcacatgataaatatttatcacatgaatgagaaagaaaagatgtctgatattaagtaaaaggtcttcttacctttataataactactttcaagcaagtgtaatgtgtttttttaagctataggatggaaaagactgaagatgaatgcctttatcatgtgcatagtgtctaaggtttttaactcactgcttctcttcagtttccatgaccttcacggtgtaaaaacaaaacctgcactagaacagtatcaatcagatgatacatatattttaggcttattgtgttcagctaaacatttaattactaaacgatgaggcaacagaatttaaaatattgttttagttgcaagaaagttattttcccaaatgaagaaacaaatatatctgtacctttacaaaaatacacttagaagataaggcatatattatatattttaagctcttcacatctaaatataatatgcatatgagaacatttgcttgcctgtttacacttggattttggagaaatatgaatcaacaacgaaaatgggaaagccaaggaaatcttgaccttctcaattgttcttgacaggtcaattttatgatttatattagtgtaaaacaaagtctagtccaaagtccttccttaccattcatgagcttatgtttttgatgagaaacctttgtaacatattttccaatcagtcatctgtttacttcatgtctggttacaggtcaactttgcaacctgtctctgtgtggtacgtgtacaaactgatttctacatctttaattagggaaaagtagaacctggagaatgtatgatgtatataagatagtgtttaaaaatactcaagagattgggctgtctgaaaaaatatggaaaaaatggaagagattgctacttggcaatagggtagttgtcatgaaattaagctataaggcagtgattctcaactggcagggattttgccctcaggaaacgtttggcagtgtctggaggtatttttggttgtcatattttcagggtgtgggggaaggagaagggaaagggtgctactggcatctggtaggcagaggctaactacctttacaatgcattggaaaggctcaccacacacccccgccaacagaaatagtaactccgaaatgtcagtagtgttgtttgtaaaaccctgacgtaagggatcataaaatttttgtggtgtaatctcctcatttcacatttaagtcctgagctattggatgagttatggaggtttggaaagaaaacctagaatccaagttttgtgacttccaggtatgtgatcattcaactctattgtttcctccaaagtctcatgtccttctttgaaacctctttccgaaagcatctggaaaagtgtgtcagagatttttctctgcacagattgagatctggaatatagcatattcatatttctctatgggaattcactttgttgaaaaactcaacctaaaagcttaccgtagcaatggcaagtcaacattttgccttcatctccaagagcttgtttgactcttggactggaataaagtcatgtaataatttaaaaaaggaaaagagaacagattattgaatgagaggagctgtaaaactcaaactatagcaagagaaagaaaataatagtgggaataaaaaaaccagaggaacacagaaatgggaggaagctaaaaaaattcgatgaagcttttctgcagcttaaaattttcgttcaaaaatctcatgagtaacacaaaacattctgtcaaatgtgttcagatttcaaaacgatgccaccaaccactagtctttaacatttgttctttacagtgttttacaattagttctgaaagagttcattcactcttttaatttaataatcctgagtcaatccctactacattccataaacaagatattgtagatgcaaaagtaacacagaactctgtcttctgggaattcataggcttccagaaaagataaatgtgtaaaaattatgttcagtacaaagtactaagtgcaaaaatagaggtgtgcccacagcacagaggtataatgtggcacacatttaccagttccatctgggtagaatggctctgataaatacagccattcgcatctgctactactggagttatttgtggccagaaatatatgttcacaagacagagtgataagactaaaaacaacaacaacaacaacaaacaacaacaaccacagtttgactcctttatgaaaacaaatggaattatggtaaagaatgctgactttcaatttagatagacttgggtttgaatttttaccactttctactctgccacccccatatccacccattgcatgttcttggtcaagtcatttattttttctgaatcttagttttctcataagtaaaattaggaaactaaaacatgttaggcatttagcactacagtaaatttagtaccagtttagtaccaataagtgtgcaataaatggaagaaactaatttttaatgttattactattaagacaattgtattcttcttaatacagaaaaaaaattgaaaattaatttgagatatatgcctacctaaccaatcattccagttaggaatctggtcctagttcccttcatcccgagggattatatttaacaaatgagaaaattatgtccacctttgacatgtatttattacatgatgttaaggctatagcaggtggttcaatgtaggatttcttgctgcggctaccagactacaactagagaaactctttccctcccatatggatgactctcctatgggtctaacatgccagtgtttttattgatccaaacaactattttcatgtgatttctaaaactgctttccagaagcaatctggcctgtagacatctctagctatatttcataaatgtctttgtacttgttaataaacctgtaaggacatttggatgtctaatttagatgataaatggtgttctttctattatttgttcaagtttaagaactaattcttcttagtaagtttctttcatctaaaacagactgaatggattggaagttgcccacacattttttcttggaaaactgtatttttctatttgtcgctccacccactgcacattcacatttgtgaggtgctaaataagtcagcatatttgaaaatgtcatgcctgtctaattttatgcctggcaacattttttttttgtattttaaggaaagtaaacaatatgccacttttcaaaaattctgccaagtcttatgttgttgttacatagcacatacaaccttccattacagcaatttacctatataattttataataaaacccatgcttttcatttctacggcatgtaggaatgccaatgcaaatggaggcacttgatttgttataaatataatcaatgccagggggaaaattctgagttatatctttcctttgtcatggaatcaacaaaactatgggaaacagagttggaatacatgtgtttcagaatcacgaaagtgatagtacaagtatcactgagaaatgcacgtgaaacacttactttaaatcaagcttattatcaaaataatttgaacacttagaaagatgagcttattttagataatcgctttgacatgtccctaaacatgaactcttgactcctctgtggtaagttccatcagataaacttggctttgtgctaatcctattaggtagtacttcttttcttgtgaatatgaacttcccgtctgtgtgctgcgggttcctctgttacttttcagaatttgtttttatttatatatttttcagaggcagagaatctgaagcccaggctggagtaaagtggcatgatcatagctcactgtagcctcaaacccctgggctcaagtgctcctccccgtcagtctcctcagtagctgggactacaggcatgtgccatcagcctggatgattttttaaacccttttttttttttttgtaaagacagggtctcactgtgttgcttaggctagttttagacccctgggcttatgcaattcccctgcctctgcctcccaagtgcagggattacaggcgtgagccactgcacttggtccccctgttacttttaaaagtgactccttcaaattaaaatttaagacagtgtttgaaatccatctaattatttctttcatttctttaagaaccatctgaacacgctcatcctcattctgaacgtgtccctctcccaggaaatgagaacatttccacacagtcagggaagccaaataacctaggagtcatccttaattttacccctgttgctgaggattgggacacagcaagttttgtcggttctactttcaaatagatctcaatccttcacttctctccttccccaccacccacccctgttctatgccaccagcatcttcttcactgggatattgcagaagcctccagaaagatcctcctccttccacaactctccccatcctctgtccaccaccactttctaccagaagaaaatgtgatttttaaacacacacagcagatcatatcaaggctctgcctaaaacattcttcccctagagcctgaacaggctaagcttattctaactgcacccacagtaccctctgcctaggggtcctttactcacatattcacccataggtctcaaacatctcaggttgctctgctccactcactcattattatggtttcttcttcatagcacttatcaacatttgattttttaaattaatatactattttttagagtagttttaggtttacagaaaaactgagcagaaaataccaagttctcacatacccttcttccctatctcttcattttcccgttattaacatcttgcattggtgtgattcatttgttgcaactgatgaaccaatattgatgtattattattaaagtccatagtgtagatagtgtagattagagctcattcttcataccttgtacaggttttgacaaattcataatgtcatgtattcatcattacagaaaatagaatagtttcactgccctaaaatctgctgtcccctacctaatcgttccctttctctgaaatctctggcaaccactgatattttctataggcttgacttttcctgaatgtcatatagttggactcacatagcatgttcaccatttgattttttaaaattaacttaattattttctatgtctccctctagagtaaagacttcaagaaaatagggatcttatctgtcttgttttctcctttgcccacagcaccagcaacaaatagacccgcagagaatattctgcaggaatctgttgattgaatgaatagatgaatccacctgctaacccaatagagagcaatcacctatacttctgaaatgctcctttcttgatttgttctaataacgttagagtcgacttccctaagtttctgacctttacattgatgttttgcaaatattgggaaaagaagagtcatcctctggccccaagtggttgagggtgtgactactataggtccttttgccacaagaccaacataggcatttatctagttacattcagtacatgagcacgccctgagttagaaatgcagaatctgaaacacattctatatgttaatagcaagctctgctctgtttctgctgccctttagtactcaaaggctgggcatgactctgctttcccacttcccttcttctatccttgcctttgctcttctgaatcacatccattgatcccctgaatattttccacttttatcactttcaattcctttctattctcccccttctcttatcctttctcatctgcaaagcagaaaaataccctaattgtgactgacaagagagggaacagcacttgagatttcccatataaaggaagaatcacgtatattaaaatgcaattaaccataacaaggaactatgtcctttaaaacagagatgcccagaagacgctgccataatttcccaaaacctcccactttctctcattaaaattctttcctcttaatctctgccatgtgaaatataaaaatcagtttttactcaattctaaattattcttttgtttattgagtcacaattcttagaaattttttttttcttaatgcttgacccataggagctacctctgaattcattatggtggaagatttagggtactcttgttacttcacagattttaaactctagaaaacatgcttatcttcaccctgtttaagactgtgcttgttttatatcctctaagtttagcccatgcagcctgtctttccagagggagccccaatctttctaacagtaaccccttcccagtaggggaagcagaaataaacaaaatccaataaaacacttagcaacattgttgattgtggagagaaataagtaacataatgacttttggggggcacttaaaaactaaggaagaagtatttatttaaatgtacaaaattaaaaagaacatagctcacagggaaaaaggacattaaaacctatttgtaaactctaattattatattacatcttgaaattttcaaatgagtagaaacatcttattctaccctaaagataccgttagttcattcaatgccaaatagtactgcttaatttagtgggttaagtttgttttgggttctatttttaaaattagaaacatgcttttaaaggctacacattattacttacagagctattccagcatatacatttatacttttgtactatttatccaccttaaaaatgaattagtagtctacctaacttagcctttgagggtataatcatctccttttcatagaatgctttcaagtccttttaaaaataaggaaatcaaccattccttagggagtaatcttgtctcaaagacatatctctttttaaattttttcctgagttccataaagatgatataaaaggagaaataaagtaaacccaaagtgtgcccgtgagactttactgactttgagggcttcagtgacctcagtaaatcactgtctaaagcttcattctcagagttgatcaagttactaaaaactgcattgcaattacagccttattattcaggtcagcatccttaattccataagctctcctttagcaatcgctctgatgtcagatatgaaatattcctaatctagcaggatcatagtcttccttctgctcggaagcattttaacattcatttgaatggcaatgtacccactaatatcaagcagtgggctgagcaaaggataaaatatacaaagaagcaaacttaccatcaaacacgttactataataacaaagatgctgagaaaaatgacaacagcataaaatccttctttgctccagattttgtccgcttcatgctgcccttgtaaaacatttttctttaaaagcaaaacagaaagtccgacgttaaatgagagcttgagaaaactggcgttcttatcagacactaaacatatttttagccttattccattcagtgtagtgcaacacacctacaccccccgctgccagagctgcttctcaaactgatctaagacaacagactgccatccttatatatcgagattatttagtctcctatgcaggagcaagcgtgcctgacatggcatctgcaggtcccaggctttctaaacatccctcagcgtctctcttggaaactacctggttcataggtaagagagttctgttcttttctgtgtggaggaaattgtttctgatttccttactctgttttaagtcccctcccacaacatcagcaccctggattacgtgctgtactacctctttacttttaaacaaaagtgaaacaagtgcaaacaaaagcttgtggtgcattaataaatacagcaacaatgccagcattatttccttctttcttttaatcacatcttttttttttttcaaatagagtctctgctgtcaaaacctgactaaaatatcatctcaagaatacatattgttagaatatcacatatttttctaaagtaatacggaacattaaaaagttcagaattatttgtcaataaaaggtagaatacacaggtttatctttatttgtatcatttttgttccactttgggggtggaagagcagagaagaagcatgaataaagtgtgcatgactctattaattttattttattaatttttttaaagaagcacattgactaaaatccattcttagattaaaattcagttgtataatttagtgacagtatagatttatagttaacgaaactaacttgaaaccaaatagtccatgattgggaaaaacatataaaggctaaatcaagtcaaatgctttaactcatctaaaatttcattttgttgaagggtgcctttttattccctttagtgagagtacatgtctgtccttggttattgtttccagtgattaagaaggcctggagtaaaacacgtcttgtaggtgtctgaactttgaaatcattgctaatttatttttaaggcttttaaaaaataaaatatacccaacatttataaatcagacaaaaaatttaccttgaaaaatattttatgagaactttcattctggaatgcaagtgtgttttggtgggaagataagcaaggctgaacagaaaagatttttgagttcaattgtgattacaaaaattatttggagaaagcctttattaaatgctaacgtaatcaggattctattttctttacttgtaaaacagcgatgtgctcactaattatagtagaatagtatctggcctactttctaagacatagatagatgcatagatacaagaaatgatttagatatgtattttaaagatatataaatgataaatcgatggagaatctgaaaacacttgattgataaatgattagaaaccaagtaccctgctgcaaaacaactttgggttcaagcgacaaattttctttcacctctttgacgtcagccatatcgtttttttaaattccaatgtctctataagcatagctggaaactaatagaaaactcttgcagaaatcaggtataaatatggaaatgaattttttacaggcaacaaaatagcatccattgtttgctataaaagcaaactagttaagccttcaagtaggcagcataaatttgtcaaatttaagtataaggagttgagcttaagcccatgtaaaatttggataaaaaggggtggttaggtgggtggaaagagattttgtgttcctaacccgatttggttcatttttttttcttgctgtagttctacaactcctagaatatcaacatgttcctttctgcttaagacaaacctgttttgttttcttttttaactgaagcagtaatgatgaaagaattaactcccaccctcccatcccccactcccagttagaaagacacgttttaaactcctagaacttagtcactgcactttcttggtaaatagatttctttctgagtcatgctactcctgctgaacactactatatttgtacagagatctaaaaaacttgataagggcagggtaataaatggacaagtttgtagttaagagctcacaaatcaaaagactataattcacaagaatcttcaatctaacctttgcatagggttaaccccatgctttttatattttgtcaggtggccgagagttgaataattcagaggctctgttgttgggtcaagccaatgccactatatcatctttatgttttattatttcatagctacatttctttgccctttaacttagttgcagtgaaagaagctgatgggttttgttctattatttaaaatttggtcagttttctgtatagttaacaatggcttctctatatcctgtttaataatttgatgcactatagctcattcttctttcttttgtcctttctttttaaatattttaatcaattctgatctcagatgcagaaggagatcccaaatgctaggagagacgattcagagatacagaggatctaggagatacacctctttaagagagaggaagtacacagaataagaatgaagtgcaaatgttacaaagtatctggttaatttgattgacttggcagataaatgagatgtatcctataacaatatggctttgttggataaatgccaagcttccactgtactgtgcacaatgtgagcaattgttctgaatggtcgaatacaggttaatattgattgtatgtctcctcagcactgtatggctaggtctacactaatttagacaagactacctgctagtgttcctagtttgaaggaataatcattaaactcacacattattgtttacatttgtatgtaatggctttttttctttgtaaatatttcatgaaggtatcagttagcacattggacttttatttaaagaaggtcactttctcctttgaaatataagatttggaaactggagtaatttgcaattgaacaacaacaaaattcctgaatcatttttaaaaatgtcaacacagaacttaccgttttaataggtatttaattcattttgtaaaaacatttaattttattttcctgggattttacttattaggcaagaggaggtctagttttatctatatgagtgcctataatgttctagatatcatatacaaatatataaaggaaataatgtcttttcctttaagaaacagattacaaatgaaaacaaatgactaaacaagaacagttttctagttgggtttttttgtttctgaagagtcattttcaatttaaaaaatcaagcatatgaaaaaacaataaaaaaccatatccttccatgaaagtaattaacgtaagtttaggaatagatgctttgagacatcattcacgatgttctataattcatgcaaaggatgaaaagccaaaataccagtgatcctttttttctgttaatgaatatgttgccataacatgttataattttaagattaaaatgtgaaaaaatgggttgaggtataagttgttataaaagattaaccacagaaaaaatgaataaagttgtaagaaaactcacagaatagcatttaccagttttaagcaactatcaatcaatatttttgcagggcttctttaggttgtatctgtaccaagcacctccccactggggtgcctgctcactacagacagcttttccctgtttctgcatttagagattctggtcaaaggtcaaagggtaatgcctggccccttctaggagtactcaaacaaaaggttcaaataatccctctgtccttcatgatatgctccttatatctgattcaaatacttcctcatcttctgtaatgcatattttctaaattctagatttctagattccaacaattttatgagaatctatcacatttatcatcaaaacactttccttattcaaatgtagtctattgtgagctagtagctctgtgagaggccattaagctaagtacctcaccttcactggactggggtatattggaggatgcccaggtacttgctttaaagccagctctttttgtatagggagcttcttttggtttgcaaatctgagtgactcagtaagttgctctattcttaaagccttcagaatggcttttaaactgagaataaagcaacagggaaggccgtttacatgattctctaaaagcttatgggaagcaggatacatttatccaacggtctttctaaaatttaaagaattgtcctaggcaagatgtgtaccagtcagtccgtgtagggccttgactgtgggaatggggtttggctttgtgcacaagcggaactgcttcagattcagacgtgggcaaggctgggaggggcctggtggttcacctcctcctgaccctctcctctggcctctctaaagcataaggggtctcttctccaaggcacccatggcacagtgtagtaactttattcatagaactatattcttattatctctttgtgtcgtatttgccctattagtgcataaattcattgagaacaaacatcatttattgtttgttttcttgtttatttatttttctggctttagatattagctagcacagtacttggctatttgctcttgttgttgttgttgttgttgtctgtttgttttgggactccacccaggctggagtgcagtggcctcatcatagctcattacaaccgtaaattcctgggctcaggtgatcctcctgcctcagcctcccaagtagctgggaccacagttacacaccaccatgcccagctaatttttaactttttttgtaaagtcagagtcttgctatgttgctcaggttggtctcaaactcctggcctcaaccaatcctcttctcttgacctcccaaagtgctgggattacaggcttgagccaacgcgcccagcatgactatttgttgactcagttttgttgtgtgcccattgcatgccaggcactaaatgaaggcaatgaagacacagatcaaatgacatgtcacaagctctcaaaaaacccacagtgtagagatgagcctaaagactaatatggaataaggagtttttgttttaagcttgacgggaacacagggtaaggagcatcttcgtctgtggaggtacaagggatactttgctacacagtagactgatcttaagaaatgaaaggtatgcatggtgaaatcccatctctactaaaaatacaaaaaattagctgggcgtggtggcaggcgcctgtagtcccagctactcagaaggttgaggcaggagaatggcatgaactcgggaggcagagcttgcagtgagccgagatgcaccactgcactccagcctgggagacagagcaagactccgtcttaaaaaaaaaaaaaaaaaaaaaaaaaaacaaacgaaaggtatgtagatgaaacaacacatacaaaagcatgaaggaaggagagaatatggtgtatcatagatctatcgagtttagaattgctgaaatgtaaactaggaaagtgttgttcaacaattataaagcccagcatacaaaggaccatataccatattaagaaatctagacttcattccgtagtattttgaaagccagagaagaatcacgaaattaggagggcatggccaaatttatgttgagaaagattactttggtggcaggaaagaaaacacattgggtatgtttggaaacagaacagagagaggcgcaaaaccaaatgcaggaagaccagttgggggtggttgtgacagtgatggttcaatgatgacatatattctcattgtgccaagtcatcctgcattcaaattacatttgtctgctacctaggctgtgtgagaatttctgcatatactttaaaaattcaatccatatttcaagtttataagtgctatacccattttggatttgaagaaactaaggctcagggaggttgataccatgcaaaggcagacaacctcacagagattaaatggcctgcccatggtcacacacattttacgtgtggctttgggatacaaactccatctgggtgcaagtgatcctgctgcctcagcctccccagtagttaggattacaaacataagccaccatgcccacccagagctttttataccacacctgtgatactaaaatgagaggcagtgtgatttactgtaaaggtgaatagaccagggatcaggacatctagattttggacagggaagatggctcactcacatctgtaatcccagcacttttggaggccaaggtgggagaattgcttgaggccaggcattcaagaccagcctgggcaacatagtaaaaccctgcctctataagagagaaaaaaaagacacctagatcttaggtggtgctttacgcctctcttgttctgtcaccttgagggagtcacttaatttctatgggccatactttctgtatctacaaggtgttacacatattccctccagtttaatttcatgattccatgaattgaattacacgtatttaggatgatgatcctttcagtaggtttgttagagcgggatggagtaatagaattggaaaggaaattaaatccattcaggagtgagatggtggaggtggtagaggaaattttttaaaagcgacaaatttggaaaatactatgaagaaacatctatagttcttaagacttaagttctttaaaaaactatagtttcttcagaaaaagaaaaatcacatttcaaattaatttcaaagttatgggaaaaggcgaatatctggtgaccattttgacaatgacgacaatgaggggaggggtgcacctgtagagaaagaaaggtttaaatgtatttttgtttatttgacatatcagtttcaagcgatcaattgacaaaatacatctaaatcttctttcttctagaaaatttactggataagtcaaaataagttataaggccacaaaggtttgaagaagaaaaatgccaaaaagtgaaaaccttaatgtgaaagtgcatttccttaagaagtaaacatatacaatgtaaagatcagagaattctgacactcagggaaatttttattatcaaataacatacaataaacaacttccatctcaaagcctcttggggttgaattaccatagcatgctaactgttcacatttttaaatgaattgtttcgtgcaacaacatacctcaggagagacttctgtaattccaaactgggataaactttgatgcaaaacattgatattaagtgaacgaagaacttcctcagagggcagagcatcagaaattcctgtttttcggtttatgggagacacaaacagttcaatactgttcttctttccctaataaaagcagaatatttgtatttgttatagacattttaaacaactttggataatatttttacctgtcctttagaaacattaaaggaagtcagaattctagaatcctaaaaggctttgtggagattatatttattagttattctctgatagacttaatgttaccagtccaaagtctaaaatcttcaaatagctttcttgccattagttgccaccccccaagatttgtaattttatatttcagtgcatgcttgcatgctgattcatttaccattccatattgtaattttttgatgtagattgttcagatgttccctgagtaattatgtttaaagaagcattttaaaatcaaatgaattaaagtccaaagtaatagtaaaattacaaaattacatattagacatcaccactctctctattatttttataacttgtgttaatgtgaaggcttggctagctaaagaagatggtgccagatgatctttgaagtccttttcctgatactgttcttcacgtcaaatatgtcacacatttaaaattggtcatttggtggaaatgcatatcttatgtagtgatgtcatgagacttttcctattagtattacctcattagctgaaatggagtcagagaatttcttaccataaatgtctgatatcctacacacacatacacacacacacacacacagagagcagacaaaaccatggcgattgataatattatctttcacaacttacacaacacactaatagaaggaaattattcttagctttctttctgacacatggagagctctcatgctagaaagttttcttttaatgtgctttatcagaattttagctggtataaaatgaagtatcagtttactactagcaagccagtaaaagttttttcatgtttgcagagaacaacagacaataactaaatactgatgtgaaacatgtttataacaatttaaatagtttgtgacccaataacaactactgtaggtacagagcacttgtgttgtgcctaacatgctatttaccttaaatcttttatctcatttattgctcaaaacaccgctaagcgataggtattatggttatctctattttacaaataaaacgtaagaggcttgcccacattcacatacatggaatatggccacactggaaatgaagtatggttttgtctgtctccaaaacacatgatgctaatcaacatgctttgctatgtcaggtattgtaactctagctattataataactactttgaaccatgctactaacattctctgaggatatgataagcatattccttcctcagtctggcaaatccctccttcacccttgcaaacagctattatgctcattaaacctaatatgtataaaagtatatctaagatatctatatcatctctctatatatcttagcaaaatatatatgcacaggttgatgcatatatatttttatatgtatatattgtatatatataaaaaatctagatctagatccaagactttttttctttttttttgagatggagtttcgctcttgttgtccaggctggagtgccatggagtgatctctgctcactgcaacttccacctcctgggttcaagtgattctcctgcctcagcctcctgagtagctgggattacagatgcctgccaccatgcccggccaattttttgtattttaagtagtagagatggggttttaccatgttggccaggctggtctcaaactcctgacctccagttatccaccctcctggcctcccaaagttctgggattacaggcgtgagccaccgggtaaccttcactcattcaggggaatgttgtatttcttcttctgtggtatgagttaaaactttttaacagcttgtttacttctagaacattgttgattcacagaatacaaatttttatgaagaaatgaaacaactcactctctacacacagaaaaaataaaaagaaacataaaccccaaaccaaaacaaaaagcaaattccctccatagtgaatgcagatgggtgcaatagaaagctgagctccatgcagcagaagcacagcaatttaaggctgggggaacatggagtccttgcttagactcccattgcagtggacattaagagcaatttaaaacctgtacagtgatcccaaagttccttttcacataaaactgaggtgactagctttttacagaaagacagtcatctgatctgaatttactttttttttggcctttgctcacgcccactttccagtgcagatgggaacatgtagttgcatgaaatccaggttcccaaacaccgaggaaagagaggaaataatggatgtgggtgattgacatataggcctagactgggccctatacaacagatcctttgggtttactttttttttttttttttttactttacccactcagatgcccattcaagttttctcttggttttcctggactaccaattcctgcattccacctgggctgcagtcctcagggtcagttctttattctttatttaaaatgccctgccttgtgcactcaatgtccattgttctactgatatacttgaaagtatatcaataatgtctggaaactgcctcacctgatatacttgaaagtatatcaataatgtctggaaactgccttacctgatatagaagctttcactctaatggagaatattttcggagtagtgtcaggttggtaaggcaagtgttttgggctctttcatatttaccacaggacctagacttgaactatgacagagttaacaaacttcctctataaagggccagatgataaacagtttaggcttcatgagccaatcttttgcaactactgaactctgccactgtaatacaaaaggcatcatgggcaatgggtagatgagcagatatagcttgtttcataaaattttatttgcaaaaacatgacgtgccggatttggctcattagccatacaactatagcatgagccctttagtgattaaaaaaaccacacacacggcttgaattttggaaatgcgaaatgtgggtatcttacaatgaggcgattgatgtgcacttgctggggtaagagtcctaaagctgcagccactccttggcggaagatccgaagcaaggttatgttcagcttgtttacatccatttgcagtgtctagaaaataaggacaaaaataaatccaaattatagtattaatttgtatagatgtatagaatacatccaaataagtattaataagttcacgacattcagttcttgactcatgactgaccacagtttctgtgactctgctaagtttacactaataatgctttattgcatttttgatagaaataaaattataggaacattgcatgtgaaattttaaatggtattagttaaaaagatgtattataggggtggagccaagatggccaaataggaacagctccagtctacagctcccagtgtgagtgatgcagaagatgggtgatttctgcatttccatctgaggtaccaggttcatctcactagggagtgccagacagtgggcgcaggacagtgggtgcagtgcaccgtgcacgagccgaagcagggtgaggcattgcctcactcgggaagtgcaagggctcagggagttccctttcctattcaaagaaaggggtgacagacggcacctggaaaatcgggtcactcccaccccaatactgcgcttttccgacgggcttaaaaaatggcacaccaggagattatatccctcacctggcttggagggtcctatgcccatggagtcttgctgattgctagcacagcagtctgagatcaaactgcaaggcagcagtgaggctgggggaggggtgcccgccattgcccaggctcacttaggtaaacaaagcagccgggaagctccaactgggtggagcccaccacagctcaaggaggcctgcctgcctctgtaggctccacctctgggggcagggcacagacaaacaaaaagacagcagtaacctctgcagacttaaatgtccctgtctgagagctttgaagagagcagtggttctcccagcatgcagctggagatctgagaacgggtagactgcctcctcaagtgggtccctgacccctgacccctgagcaggctaactgggaggcacccccccagaaggggcagactgacacctcacacagccgggtactcctctgagacaaaacttcaagaggaacgatcagacagcagcattcgcagttcacaaacatctggtgttctgcagccaccgctgctattacccaagaaaacagggtctggagtagacctctagaaaactccaacagacctgcagctgagggtcctgtctgttagaaggaaaactaacaaacagaaaggacatccacaccaaaaacccatgtgcacatcaccatcatcaaagaccaaaagtagataaaaccacaaagatggggaaaaaacagagcagaaaaactggaaactctaaaaagcagagcgcctctcctcctccaaaggaacacagctcctcaccagcaacggaacaaagctggacagagaatgactttgacgagttgagagaagaaggcttcagacaatgaaactactccgagctacaggaggaaattcaaaccaaaggcaaagaagttgaaaactttgaaaaaaatttagacaaatgtataactagaataaccaatacagagaagtgcttaaaggagctgatggagctgaaagccaaggcttgagaactacgtgaagaatgcagaagcctcaggagctgatgcaatcaactggaagaaagggtatcagtgatggaagatgaaatgaatgaaattaagcgagaagggaagtttagagaaaaaagaataaaaagaagtgaacaaagcctccaagaaatatgggactatgtgaaaagaccaaatctacgtctgattggtgtacttgaacgtgacggggagaatggaaccaagttggaaaacactctgcaggatattatccaggagaacttccccaatctagcaaggcaggccagcattcagattcaggaaatacagagaatgccacaaagatactcctcgagaagagcaactccaagacacataattgtcagattcaccaaagttgaaaagaaggaaaaaatgttaagggcagccagagagaaaggtcgggttacccacaacgggaagcccatcagactaacagcggatctctcaacagaaactctacaagccagaagagagtgggggccaatattcaacattcttaaagaaaagaattttcaacccggaattttatatccagccaagctaagcttcataagtgaaggagaaataaaatactttacagacaagcaaatgctgagagattttgtcaccaccaggcctgccctaaaagaacttctgaaggaagcgctaaacatggaaaggaacaaccggtaccagccactgcaaaatcacgccaaaatgtaaagaccatcgagactaggaagaaactacatcaactaatgagcaaaataatcagctaacatcataatgacaggatcaaattcacacataacaatattaactttaaatgtaaatggactaaatgctccagttaaaagacacagactggcaaattggataaagagtcaagacccatcagtgtgctgtattcaggaaacccatctcatgtgcagagacacacataggctcaaaataaagggatggaggaagatctaccaagaaaatggaaaacaaaaaattacaggggttgcaatcctagtctctgataaaacagactttaaaccaacaaagatcaaaagagacaaaggcggccattacataatggtaaagggatcaattcaacaagaagagctaactatcctaaatatatatgcacccaatacaggagcacccagattcataaagccagtcctgagtgacctacaaagagacttagactcctacacaataataatgggagacgttaacaccccactgtcaacattagacagatcaacgagatagaaagttaacaaggatacccaggaattgaattcagctctgcaccaagcagacctaatagacatctacagaattctccatcccaaatcaacagaatatacatttttttcagcaccacaccacacctgttccaaaattgaccacatacttggaagtaaagctctcctcagcaaatgtaaaagaacagaaattgtaacaattgtctctcagaccacagtgcaatcaaagtagaactcaggattaagaaactcactcaaaaccactcaactacatggaaaatgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaactgacaccctaacatcacaattaaaagaactagaaaagcaacagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagcaagagaagaatcaaatagacgcaataaaaaatgataaaggggatatcaccatcgatcccacagaaatacaaactaccatcagagaatactacaaacacctctacgcaaataaactagaaaatctagaagaaatggataaattccttgacacatgcactttcccaagactaaaccaggaagaagttgaatctctgaatagaccaaaaataggatctgaaattgtggcaataatcaataacttaccaaccaaaaagagtccaggaccagatggattcatagctgaattctaacagaggtacaaggaggaactggtaccattccttctgaaactattccaatcaatagaaaaagagggaatcctccctaactcattttatgaggccagcatcatcctgataccaaagccgggcagagatacaacaaaaaaagagaattttagaccaatatccttgatgaacattgatgcaaaaatcctcaataaaatacgggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaacagatgcagaaaaagcctttgacaaaattcaacaacccttcatgctaaaaactctcaatgaattaggtattgatgggacatatctcaaaataataagaggtatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacgtgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagaatataaaatacttaggaatccaacttacaagggacgtgaaggacttcttcaaggagaactacaaaccactgctcaatgaaataaaagaggatacaaacaaatggaagaacattccatgctcatgggtaggaagaatcaatatcatgaaaatggccaactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctcacttcaaactatactacaaggctacagtaaacaaaacagcatggtactggtaccaaaacagagatatagatcaatggaacagaacagagacctcagaaataacgccgcatatctacaactatctgatctttgacaaacctgacaaaaacaagcaatggggaaagattccctatttaataaatggtgctgggaaaactggctagccatatgtagaaagctgaaactggatcccttccttacaccttatacaaaaattaattcaagatggaataaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaagaaatttacaagaaaaaaacaaacaaccccatcaaaaagtgggcaaaggatatgaacagacacttctcgaaagaagacatttatgcagccaaaagacacatgaaaaaatgctcaccatcactggccatcagagaaatgcaaatcataaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtgattcctcagggatctagaactagaaataccatttgacccagccatcccattactgggtatatacccaaaggactataaatcatgctgctataaagacacatgcacacataggtttattgcggcacaattcacaatagcaaagacttggaaccacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaactcatgaacacaggaaggggaacatcacactctggggactgttgtggggtggggggaggggggaggtatagttttaggagatatacctaatgctaaatgacgagtcaacgggtgcagcacaccagcatggcacatgtatacatatgtaactaacctgcacattgtgcacatgtaccctaaaacttaaagtataataataataaattaaaaaaaaataaaaataaaaagatgtattatatacaccatggaacattatgcagccataaaaaatgaaattatgttctttgcagcacatggttgcagccagaccattatcccaagcaaagtaatgcaggaacaggaaaccatatactgcatgttctcacttataagtgggagctgaacattgagtacccatggacataaagatgagagcaatggacactggagactgctagaggagagagggagggaagggggtgagggactgcttaatgtgtgctgtgctcactgcctgggtgatgggatcatctgcactctaaatctcagtgttatgatccagtgttcccatgtcgcaaacctgcacatgtaccccctgaatctaaaataaaagttgattttttaaaaagatggtatattatataataaagcaatttgtctagttataataaaaagcacaaattaatggtcaattcataaagaatttcattgaaatgtgccttgaataattttgctttagtttagttccagatgacagaatggaatctgtggccaagtgtatttcagttatccatcttcaatttgtgttcatacaagtcacagagagaaagatgctgtgtaagttccataaggcctgtcttggcagtttctatacatagtgatttgctgccagtgcaaggcaaaagaatgaggtgcaagaatacattttcaaactctggtaaaaatgccagtggtactgatgatttggtctaagataaacaattcttattcagttgtttgggcaaacactcagctttcaggtttgcttaggaaaaaatctaaatattaaagaattcctaaaataaaatcaaattatgataatatcataattatcatagtagtaataataaccctcattgaagccccagcatgattactacactgaaaccatgaagtagtttactgtatgtattttcaaaaatgcatcattaatcatttgagagatactcaaggtagggaaaccaaatctttatgcatttcttttattcttataatacttaattcactaatttgaacatagtaggctatcaataactattgaatggctgcaacatcacctgttctgtaaagctaggcatacttctgagtacacacttctctaataacgagattggtttacatgtgcaatctcctatagagtaggaactctttaggggaacttccctcagcttgctttaaaaagagattaatactgtttcaaggatttatagtctcaaaaggaaataccataatatatcctctattttttacctgcaagtatattctctattttgtacctgcaagtaggtaataaataagtgattggaaactggattaaatgctcaatgctataggaatcagagagaatttggaaagtcaaaagaggtatagggttcccagtcaagatgatgggcccagctaaagctccagcctgcatttccaccttagggtctctcaatgcttgcatggaggtaggggccctaagatttggttaatttaggttaactggactccttgtgaaaaattaagatccagaaaagggcagaatcattgaaaaaaactacctaagagagcccagtaataggcaacaatttgcttctggggaggagaaataagaatgatgttggagtatatagaaagctatatcaaacacaatcagtaacactttaaaatttcttaaaatttatcttactttatttttttttaagcttaaaacaacagaaatttcttgtcttgtcatactagaggctggaagtctgaatcaaagtgtcagtggggccatgttccctcttaaatttgtaggggagaatccttccttgcttcttctagcttctggtgtttgccagcaatccttgggattccttggattacagatatattactctaatctttgcatctgtcatcacttggctttctcctccctgtgtcttcacgtcttccctctgagtgtctgtgtccaaattttccctttttataagggcctccttatattggattaggagcccaccctactccaataagacctcttgttaacttttgttacacctacaacaaccttattttcaaataaggtcacattcttaggtactggaaggctagaacttcaacatatgaattctggggtggtggtgaggtgggatgtaattccacctttaacgaggagaaagtcagaattctgaggaaagaagctgctaacttgtagccagagaattgaccaagaaccttagtaattttgcacattttcttctgttttcttttaggctctgagtcaatacaagtaggaagttcaactggttccctgggtgttcattcctggttggagagctgtttgggaggctgggaaggtccattagaagcataattctattccagaggtggcttggcagatggagcatatcatgggtaaaggcagtggtaaagtcttggtgaggcaaaaataaaagaggtacatgaatccagacacaatttgaaatagatctttctgttccaggttaatttctcagcatgtcacagaaagcaattcctactagacctgaagaaagtggcttctctcttaacagaatgttatcttcttctagagagtaatatgtttttattaaataaaaagcatctaatagtacacaagtgtttgctacattattttctgtatttttaatagcctaaatatgcatccattatataacagaatgttttaatgcagaaagtaagacttgaagccaaccttaaaggacaagtaggatttggaaatgcagtgatcaggaaagtagcattatactgttaagcacaatatacgcatctacctggcatacctgggagactagaaaaactcagtacacctggtcatcctgagaaacagaggcttcctttcatccgtggcctgttttcatctctgccagactacagaagctgccattaaagatgagacactgtattggagactctgtctactacccttcccttgcaaggccaaagatggattccttagttttctcaaatggtgaatgagtaacctctgtctcaccagcagtgtttgtcaggcagggtgagctggcacacagtgtgcctgaatccccagaggcaggatttggagccaattgtctatgctgggaacccacaagccccctcaagggggttgtgtacacactgcagaactcaattcccagaggcatgattaacttgaggcttgtaactgtggaaacagtattacagtttcagactgaaatggtaaatgggaagtgaaatgggaactaaagatttaaaaatcactgaaaaaggcaactttgcaaaaatatgaaagctgtacaaaagctgtacatttgaaacagaaatttagactacccaactatagtgaagaagtgagttgaagtaattagttgaaattgaaatcatctggttcattgcatcaaaacatttgaatgattttcctcagttctctgcttgtctgagaaaagctggattttgtagagcatgcacagatttctgactcttccccataaaaatagtgatgctaaaatatagtacaaacagatatctatgtatttgaaggcctaatatatgccaggcattatatatgagtgcaatttgagaaaaagaaaggattctagataaaaatgggaattttatttcagacaaaataaaaaatatatgactttatatagttagaagatatatgctacctccttctgtctggatagatgctagaaatgcacagcctctcctcatcctattatgtgaaaccataacaagtatgacaggatataaattttcacagcagtaacaaggcaacagctttcaagttgctgtacaacattctgcgatatatttttgtttggatgctaaacccatttggtcatttttaacatttaacatacaaatgatttaacattttaatttcaaagagattaaaatgttctttccaaatgcaaatggtaagccactttacaacagtacataatttcatagagttactacataagaacaattgagtatttttattgttattacaaatatataaacatacagaaaaaacatacaaaattcaaagtcttccaattctacctatatttaaatataccaggcctctgtcttgttagattcctttgtcagttccccactactgttcccctccacaaaggaaataatattttatgacaagactttctttctttggttcccagactgtccaccaaagtagttaaagcctatgggccttaggtacaagttgaggtgataggattgatgaaatgtagcactttcaggtaccagcattatgtttgaattataagtatgtgattagcttttagctatttattttgtaaaggataattgaattatttttgcctagcagggaggcagttagtcccctcctgaagttattaggcagcctggactttcatttggtcatacccagtaagagtcaggaccacacccagtggtccagttagtgggcaaaggacaaatgtccatctttcttcctaagagatgcctcaaggctccttagagaagtgctgtctcaattcccaacagccacaaaaggaccaaagcttccttttggaccaaaagcttgctagaagaaatccatccacttctaactcaaatgtgccccccaacccttttttttttaacctggaatctttaactccattcttggccaaggagttggaatggcaagagatttccaggaataaaagcaaaaggttctctgtttatgcctttgaactgagtagagaacgctgacctgttagagacattttatgctttcaccccttcccttctcacaattctctgcacttgtcctctgctattagttacagattaattatttttatttctatattacacatttccacctttctcatggtcttacacctgcttccctcttcctgaatgtcccacttacacttcaaactcaacattacccaaactgaacttacctttctccttcttcctatccacaatcaaatttgcttctctttctacattcacataatggaatgagctatcatatttgggtatcatcccgactcttctttctttattctttacaccaccaccacgacatccagtgaatagtcaagttctgtctattctacctgctaaatagtccttgaatgttgaacccatattttctttatctatatttccatcattttagttcagatcatcaccatgactaactggactatttggctagaatcctaatgggttgccagttttctgtggtctctaattaattccccatatggacatcatagttatctgtgtaaaatgctatcccaatcaagctactattctgttcaaaatactctgaaaaaatctcattttctaatgaatgatcttaactcctccattcaccaaatttgccctgtccttccagtcttaacctcttacacctttccaccacacatgtcatactccaggcatccctaaggtttattaaacatgccatgtccttttcacattgttagcgcacaccgggatcagtgctaggggctctttcttctccttggagactcagcctttttgctacctggaatctttaactccaggtagaagagttaaagattccaattcaagatccatggttggcaaagaccattctgccagccttccctgacttctcccccttcttttgttgttcctttcagttctccagtagtactgtgttggactttaggattttttgtttacatttttataaaaatgtcatgcttattacaacaaaatttaaggtacagatggatatatggtaaaaagtgaaaatatgcttccccttcctagcccttcatcctaatccgcagaaataatcctgctaaccatatcttgtgtatacttccaaatattttctatgtgtacatggtataaaacaatatgtatatatcatacataatatatattactattaaatacaaataggattgaactatacattttgttccacaacttgcttttttcactaatatatctgagatagagttctatatttataatatataccatcatcaaatatcatgctttgattcttataatttcttatttttaacagattagtttattccattcacttctgttatttcaacagatttagatgtgttttattgctttgctattttatgtttttttgtttttattcttccttggttttctgtcttttgctatattgtctgtttttagttgttattctacattttttcttcccatgtctatattataacataaaataaggcatgaaaatatatttaagccattatttcttgatttataaaatttaggaagtatttattaacttctgctatgaaagatgagaaaatatgccactcttcccaccaattctcataacctcccagtttttgtaattatattattatttctatattgttatatctaatgctattgacattatattctgtgtattagagactacccagaattctccatgatcaagataagtaaaagtaaagtgataccttcagtcttacgcagttaacaatgaggatgccttctccaccctctctttcttccttctgtctgcaagctggatgggtccagggtcaccctaaaactgcattaaaaatggtggagctacacaaaggaagacatctgagcccccagatcactgcgtggagaagagggtcccactcagaaacccacattaaatagtgacatgagttaaaaacaaatttttattgtgttaagccactaagatatgggtatgtgttaacactgtttatgccaatgaatatatgctgaaaccataatttctacagttctatagtgatagttatatattcaaatggattcaatgctcatgaccagtcttttatttttagaaggatgtcaccattcttgaattctatattttgatttatctgtttttcagttgggtttcatttcaaatcgcttctttcaagtgaggctcatgagtgctctatttcctgaggcattatatgtttgtgaatatatttgtggtgcttttaacaataaataacagcttggctggatattaaacccctgattcaatctttatttctatttttttttctctttgaactctgctgctattttccaatgccttctggcattgagagttgctgtgaaaaatactgtggcctgaggctagtctgtcttgcctttcccacccctcatctcatagaagtctttatctttaaagttagaaaacttcaccaggatatttctttgggttgatagtgcctgtaatgtggtatgccgttatagtctacagattccagagcctatttcagtaatattttctcctattatgcatttgaatgatttttcatctaaacattttggtctcatcttcaaagacactaattatgcaactatatattcttcatctttctatctcagcacattattttatgtgcttattttctctaatcacttgtatgtttttattcagctaaaattctctgaggtctgcactctgtccttatgttttttcagcagaatcttttctatttcttttgttttaaatgtgatttcaatttctctaatgtttttttttactgccatcatttcacttctgaattctgtcaatttattctttgtgattgttgtagacaagacatggactgtcttgattgcatcagacaggagatgacacaaaacttgtgtttatagtttcttggtcttttgcattcatttttgtttttgtttgttttttagacagagttttcactcttgttgcctaggctggagtgcagtggcacgatctcagctcactgcaacctccacctcccaggttcaagtgattctcccgcctcagcctcccaagtagctgggattacaggcatgcaccaccacacccagctaatttttttgtatttttagtagagacagggtttcaaccacgttggccacttggtcttgaactcctgacctcaggtgatccgcccacctcagcctcccaaagtgctgggtttacaggcgtgagccaccctgcccaaccctccattcatttttaaatctttttttttttttttctttcaggagttcagcttctgtttctctcttaaaatcctgcaacaactttctatcctgtttagagttaaattccatcatgtgggctctcaaggccctgctttatctggctcctattaactgtgagcttcatctcatagacctttttcaaggcactctgtcctttttccagttcctcaagccagctatgctcatttttaccttatgggcttggcatgcacctgcctgctgcctggggaagtgttcaagattattgggtggtgcctccttctggttgttcagctcggtcttaacatcacttcctcagagaggccttcccagcctgaccactctctatcagatcaccctgctttcttttcctcatagcatttatcactatctgacagtttcttgtttacttgtttattgtatattctcactttacaaaatgtgggctccattggtgcgggtccatgtcagtctggttctctgctgtctcctcaagacccaaaacagtgcctggcacatagtaggtatttaataaattcttgtaaaatgaaggaacacatgagtcatgataaccaacactgtagttaccaagtgaaagcatctgagttatatgataggcttggaaagggtaacaaacccaggcctcgtgcttgaggaaggtatgttcaatttagtttacctgtaatacctaatcattaaaaaacacacagaattgatttagcataatttgtattctatttagaattaacatgtctctgacactttgactactataacatttaagagggagcaaaatcaaaagttagtctcatcaactttttgaaactcactttttttttttttaagacagagtctcgctctgttgccaggctgaagtgcagtggtgcaatcttggctcactgcaacctccgcctactgggtttaagtgattctcctgcctcagcctcccgagtagatgggactgcaggtgcccgccaccatgcccagctagttttcgtatttttagtagagacggggtttcaccatgttggccaggatggtcttgatctcttgaccttgtgatccacctgccttggcctcccaaagcgctgggattacaggcgtgagccactgcacctggctgaaactcacttttagtaggcaatatcaatatatattttatgctatattggttgtaaattaaattcaaatgtatccagtgttagtgcccatttcttggtaatttgagagttttaaaatttacctttctaattatatagttaatgcatatgatagaaaatttataaaatataatgattagaaaaaagaaataaggattatttattttgggataatcatgtatcccatcacgctgggataaggttgtggtatttttagtgttagtttttttcctgatacataggttatatatatcatataatgtacatatgcatatatgaatatatatgcatatacctacacatatcatacaaatatttatccattttcatgtgatgctataactaccacatttctatggctttcccctttacatgatattgggaggaaatgctttattccccagccctgatgttttattctgtgtggtagcagttttaatataataatattcctggattcttcctcttgtcagtctccctagaagaggaaaagtgacttgtgtaactggtgcatttggaataagatagtggggcatgtgcaggtctgtgctttcctttaggattctgcctacctgtaaagaccatataatctggtctgttctttgcaagtggtaaagtaagcccaaaggcattgtccctgcaggagagtgctgtggtttaccattgctgcctgtgactggtgagaaaatttgcttgaaggaggtgcagtcataaaagaatatcactttcgtgatttgaagtcacaaatgcagcagctctatcagcaatataattgacattttgatctctgtaggcccagttcctacgtctttttcaggcaggagagacagctgctatgtcttggtccactaaaacaccaacatatggcaccaaaaagtcagacaaaaaaatgggctgacaactttacaacttttcttgttaggtagccttatttcagcacagatatctatgcttgtagacaggtcagagaaacatcatggtaaatggtgttatggaagaagtcaggagtagagaggttccaaaagaggtttctcaacagagccagatactgctggaggttaagaaaaatgtgaacagaaaaaggctgtttgatgtgttaatgagtagataattggaagccttcaagtcctgattctcaaaatgtggttcaaggtgcattgggagggcatgtgatcctcactgcaactcacatgaaaagtgcaagttccctgtgcagccatataggtgcattctgtacaactgcagacttttttatgccaaagcgttattgagtaagtttttaagggttggtacaatttggtcttagtaaactaaaattagtatgttgtcagtatattgacccttttaagaggtgaaagagtgaggtataatgaagaaataggcagaacacgaagaccaattttgatcagaacaaaaggataaagacaggatggtaaacagagagaattcattttttccccatagttttaaataactatgacctttatactacagcaatagtgtcttagatgacttactcttccttcttaagctccctgcattactgatgagctactccttttaacacatgaaataacaatactaacagtattggtaagaatatgttgagacatttcataaacagttgcaataccaacttcatgagtttttcatatccttgctcagttgttgttatgatcaattgataagctaattaaaacaattaacaaagagctaaatgggtattgatagtgagtgagaaaagatacccaaatttcttgtttaaaaagggtaagatcttgtagacaaggacaatattcaggagcttcttgaattttgtgttcacacatttaaaagtgcttgcctgttttctcagttgctagggagcctgagcacagcttaacaaaataaatgtgtttgtgtgttcagatgttgcaggtaggtgagcgaataccaatcaaaaactgccacattcgattcctcaaggatctagaactagaaataccatttgacccagccatcccattactgggtatatacccaaaggattaaatatcatgctgctataaagacacatgcacacgtatgtttattgtggcactattcacaatagcaaagacttggaaccaagccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctcactcatagtgggaattgaacaatgagaacacttggacacaggaagggaaacatcacacaccggggccgttgtggggtggggggagtggggagggatagcattaggagacacacctaatgtaaatgacgagttaataggtgcagcacaccaacatggcacatgtatacatatgtaacaaagctgtacgttgtgaacatgtaccctagaacttaaagtataataaaaaaataaacaaataaaaaactaccacattatcaaataatagttaagataggggttagtaaggcagacttgggttcaaacctgggttgagtggccttggtcaaatttcttctcagttgaagaaaatgaggctcagtttcttcacctggcacatgggaatggtaactgcatccctttcatagtctttaatgtgggccctacatgagctattgataagggatcattggggtccgattttccggccagaaacctctgtggctggtggcacctttgcctgagttcttgtcctgcattcaggaagaatgaggtatgcagacaagtgaagggtgaacaagacaaagatgagctttattaagtgttagaacagctcagaggagacccactgttgatagctcttctctgtaggctggtcatctgtggagtgttcagctctcagcagagaggaggctctggagagggtagctcctctctgctactggttgtgcagacatctactgctctcagcagagaggaggccctggagaagattgttcctctctgtagctggtagtcccatcttcccaggtctctgaaactctcagcagagagggtagctcctctctgtagctgatcattctgtcctcctactttcagcagagaggatagctcctgtctgcagctggttgttgcctctccctcttcatctcttcaccctctgtctgctctggctgaggcctttatgggcctcagagggtggggaagtgcatgctgactggttcatgggcagccatgggtgggcccaagaaaaagcaccatgagctcctgctctgggtctgcaggactggcggccccggaccccaggctttactggagacctgcccttttctgcccaggagcctgtctgcctcccatggctatccatggtgcccaggctgctggcaccaagagacacctgcagttcagcacccagctgcccttagtccccttttagcttcccttctttttggcacccaaagtctggagggtctaaggctgtgtgggggggacggggggggggggcggggggcgggggttggcacgtcagcactgccctgagcctgtgcacacagctggggctgtgacagaacctgggctcagccccaaccctgctcccagattagagcgggtgcccggagtagggagaagcccggcaacagagacaggcactccaagcttgcaaaggtaagaatgcagggatgcctgggtctgcggtttgggtggctgcagctgagggcagagggagcagggttcctgcttgctcggtggagcgggaggcctagatccgcagccctgacttgggcagctgcagcctggcccaggagggcggggcttctgcctactcctgtctccggagagcacaggggtacccaggttgcagtggtggcctggacaccttgcagttgcacctggggagctcccacctgccaacttggaaggggcagggctcccgcttatcccagttccgcaggctccatggagcaaggcacctggccatgccccctggcagcctggggtgggggctccagatccttgctgggcctgggctagtagcggggttgggtcgatgctgccgagagctctccctgtctctccggagctccccctgtggcccgggagctcaggggctagccagagctcccccttgtccggagcacaacctagccccgctccaatgggcggtgcccagggcagcaggctgctgttgggggttctgtctgcctcctcccagtaccctccctgcagcggccggcatgatggcagcagccgcaccagatggccgccgctgccatcactattagctataaaacagctagaagtggcagataaaaagtaacagtaaactaggcttaaagatacgtgtttactgcacatcaatgttgaaaatgaatagtttagtgacttgcttctttggatattcagtacaaggggaagtggagtaacagctttgttgatgaaatgaaggtcttgaacatagtaaccaggatagtaataatatcaacattaaaaagtggcctgattggatttgcagtgtttacagttactgattattacacttgtcaaggagctttcaccaaaagtcaatcaaaaactctaggccccaggaaaaagcaatggtcaaaacaatttggttttgctgaaatgctatcatttgtttctggagagaatatatatattcgaggttgaaggtcaaaacggcacattttaagaacagtttttgaattcaaaatctctgcttccattcactctccatcctgtcccttcacattatggcttctgtgaacatgcaactcaaatcctaaatcatgtagaagactctttaaggacatctaattaaattcatattcatctttcttttcttcatttttaccactaccaattaaatattaatattgaaacaaagccaaatttaatgatttagaatagaatctcttatcctactcatttgaaatgctttttataacctagtttttccttcattagtctctgccctctattttaatattacctcttaattagtgtcccctttcacatcccctaataacattcttgtgataaaaacttttctttcatgtgcagagacctaaaatttagaaattacatgaagaacttttgtatattgttctggaaactttaaattctatacaattttgagtaagcccctatccttataagctgtttttaaaaattatgaaatggtgaaggtctccactcttccaagtacaaattcactggaggagataaagcttccataaaatataaaataatactctatatactttttatgatagtatcatttctatgctttgtgacttcatgtccatttatgcttgtaaaaatatttttataaaagttacagacaggtctatggatgaaatagaagaaaacagatttaacgcaaagttcctcagagacaggagaaaaatcacgatttaaccacaaatagatattatcctgggtacagtaaacaaacataatagcaagttacttgtttttaacagagttttcaattctcattattatatgtttgagtcaacagaactttccaccttccactcccctgattatgttttctatcttttattgggatgttatttttcccagttattcttgttccttgttctctttcagcctcccctccccttccttcagtatttctcatgctgatggcagaacccagcagccaaagcttgagttgaaaatgactggaatcagggtcaggcagaaaccctgtgtggccaaaagctcaacactcaggcaaatgtctgaaaaacgaggtcagacaaattcaggtttctacatccagccctatcaaaataacaaaactctaatcatcacagccctgacctcttcattcatggagcttttctgaaaggacagagacttctcactacagtgttcagtaagaattgagaccatgattacttcgaagaggcttttagggatgcttagaagtagatatccatgggcaaaataataatccttcagcccccaacgactttgcattctagtcataaactgatactttcctgagccattgaatatataaatactactcttttttaaaaaaattaagaaattaaaagtccttacaggtcattggagctttatttcagatgtgggtgaaataaggagatgggtaccttttatgtgcttatattcaatcaataggaatagactcttttgggactttcaactgatcacatgcaaaagcttaagctctgaaggggcacagagaccacacaagctctgaaacatcagtctgatcacaagagtagtttgaagtctaatgctccgtggaagtgtgttatacatttcctttcatttttattccctccatgaagtagtttatgtttcacttcaatggctgtaatgggattctgtgttttcacttttctggtgaactatacaattctccaagaaacacggtaaaatgaaatgaggtttattggcatgtggttttaacatgcaaataaaaactctatgatttaatgtctttcaacttttttcttagtaatcctgattttttctgtcatgggggaattaataattttctgcatggttaaaatgaataaaggcagagtgtggaataagttttagctagtgtttttgtggttctttcaactgaagaaggatatggaaaaataacaataagcatataattttccacaatgtgttattttagtgattagcaccttgagaactgtctcatttctagaaaagaaagattctgagtgatgttgtctgcagcataactttgatgcacaacatgactctgcctatttcatcctgttattacttctcaattaccacaataagagtcttctttttcttttaggaagattgaggtcctggtatttattaggactgcactatgtctgatctaattattaactgttagaagtatatatattgatcagaaaaacaagggaaactatttatagcttattcctttttgtgacagccaaatatagacatggctaatttgatacaacacaatccagcatcaattatcaactgagtaattcgcaatagcaatttttaaaattaacttgaagagtatgaatgctgtagggcaaggtattttagtgtacaaggctaagaagccacatcttctttaaagcttaatttcttttaaatgaaagatttaaacaggttagtcctcctcatattaaaagctatataagcaataaacattacaagaaaatcactaaaaaaactttcctttccctttagtctaaaatcttgctgctgagccctaaatcctgctggaaattcttgccaagccatcatttggcattattacctgctcatgtctcacaccagagttgcacttaaaaaaataacatcaaatctggcagccctatattttgtgggaaacagagcttgacttcttgaatcaaataatttatttgggccatcttgatgactgttttctgcaatattgaatcagacagaaagttaatccaattttattattaagatggatgtaaacaccagatgcattattttttgacattgttattcatcatcaaggaccacagataaaattaaaattatctatgactttgtaccaacactagaaccattatattgtttttaaatattgaaactaaattcttatttttaatctttgttgtccagaacttcgtacaatgcctagaacacagtggaaactaaatacatactttttgaaataaagttaagtggaataaacattgggcgaggtttttcacctcaggatagcactttctatacagattaataaatttatacatcattttaaataagagccatatttaagccaacattaaagagtaaggttcttggtttactgataaaaaacaacaaagctgagttccccagctgggaatttagctgatgatgtctcatagcactgactttcactcactggaccctacatgcaattataacagaagatactgactagtcttttagtgaagtctgcacacaaacacagggtatccgagatgtcattattataaaaatgtctagatttagtgaattaacccactgtaaccctctctcaattttcgtttctagttgtagtcatcttttccctgatgtcagtgtgggaaccacactaaacaaaacaaagaaaatatctgctccactcaatgtcttttaagaacttttgagttctgttcaagtgaacatatttataattctactctccttaggatgattatgaactttacaagaaactccttatgattatggtagatatttactgttaagatattttgaatgactgcatagcattttcttttaatttcagacttttaggctaaagatatttccctagatatcacataagttctatgctgactcatttttctacatttacatgaacagatatagacataaatcttaatatttaccctcctaagctcttaacattacaccgaggaccctctgcctatcatgagagattatctcacctgtttggaaattgactgcatgttgtgatgaagtcgacttccatttgcactcttctttgtgttatttccttaccatagcaagcaggactaatcgtaaagctttctaagcttgtgt

SEQ ID NO: 612 - DNA, 20692 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaataggggtaagttctgtgaaaagggatttaggtttaaaagaaagggcacaccctttatcatcacttactaccagatcgtgctaaaatgttcactctgtgtatcaaaaagaatggttaggtgtgtaattcagttcagatggtcgattgctgatatttaaaaagtgacattcttgttttttttcccccaaggatttttgatcattgagagaaagttgcaggattttccaacttcagcactattgacattttggattagataatttttgttaggggaagacgaaatgctgttctgtgaattgtgggatgtttagcgggatgtctgtcttttacccactagatgctggtagcatctctcagttgtgacaattaaaaatgtctccggatattgccagcttactgtatttggaacaggtagtacgttgggagggacaaaaactctacccctccacccttgttttagagtaaggttgtagagggacaagggagaccagtgcattttctacatgaatctgtagatgaagaagtatgacagaacattagaaataggcttcaaatgatgactgcatattcactaatttgggaaacagatttgctgcttggccatgtcatacttttgggacagtaaatttttttttgtatgagtaaattgagaagccagagtggaataattgagaagttgttgatgttttggtggttgaaataaagggattttgaatgagattttaatagctctgccacataatcaggaattccattgtgaaaaataagctgaatgtaaagcattttattttaaatttatgtgcctaatttatatggtacttcctagtacttggagacaagctaataaaattaatatacgttgcttttaatagtttatggtttcttaaaaaaagtgcttggagaagaaaaccactaacaaaagtaatatgtgtgcctcttaatcgctgataaactttggagaagttatttttgttggtagcaaattaatggcaatacatgtacttacatttaaaaagctacagtgatttttttctgattgtaaaactggctttccaagatctcaaatgtagctgattttgtaagtatatggaagagtttgtatatggactttttttcaccccttttcttttcttttccttttttttttttttttttgagatggagtctccctctgtcgcccaggctggagtgcagtggcgcgatcttggctcactgcaagctctgcctcccgggttcacgccattctcctgcctcagcttcccgagtagctgggactacaggcgcccgccaccacacctggctaattttttgtattttttagtagagacgggatttcaccgtgttagccaggatggtctcgatctcctgccctcgtgatccgcccgcctcggcctcccaaagtggtgggatggcaggcgtgagccactgcactcggccttttcaccgcttaacaagaaaaactgttgcctgttttcagagtcagatagacctgagtttgagtgctgttccacccctactacatctgtaaacttgggctgcttgtttgatttccctaagcttcagttttatatatataaagtgggaacgtatttctccttggattatttagggatttttaaaaagtgaagctctttatgtaggcctagcacagtgcgggtaacatgccacttcttcatctaatgatagttgtcatatcattggtctgcctcctaattggtaatcatgccatataaattcagctagaaacacttataagaatattctaatgaagaaatatagaagatcattgtgttaggagatctaatgggatagtttgtttgaaaacaatttctttagccgactggtgtttgttagctaactgtagttttaagttttaaaaacattttatgagattaaattatagtggttacttgtgaggccagttattctaaataataagacttaaggaaaaaaacacgctgaattctagttatatatagcagaagtagacttaccagcttaagtatctggtttatttttacatttggtttggctgcacagtatcaagaaaattctgatttacccaataaaggggttgcccatactaacattttttaaaatagttcagcttaaaatgatgatcataatattaacaaatattttttgaatgcttactgtgtgtcagacactgatacaagtgttttgtatgttttaatttatttaattcttcctacacctctatgacttaggatctgtgtgaggataccgaggaacagaatgttaatttgatccaggtcactcagctgttaagcaagagttaagatgtaaagcctggcatttttgtgtgtgcgatggctcacgcctgtaatcccagcattttgggaggccgaggcgggtggataacgaggtcaggagatcgagaccatcctagctaacacggtgaaacccccccccccccgccccacgtctctactaaaaatacaaaaaaattagccaggtgtggtggcgggcgcctgtagtcccagctactcgggaagctgaggcaggagaatgggtgaacccgggaggcggagcttgcagtgagccgagattgcgccactgcactccagcctgggccacaaagtgagactccctctcaaaaaaaatacacctgtcatttttgccttcaggagcctactctcttaagcacttactatactatactgtcttttcagcttacaatatttgtaaattaattggagccaggtgcttgaaagggaattagtaaaattttgttactgtgttgcgtcattgacaatgctgagtggtttttattgtaaatataaagttaaatataatgctcataaaacataaatacttcttggttgataacttgtgacatcaaaaaaagtacttcagcattcacagagcagatgcatgtaaactaaattaacatgtgagattatgcatacccacttaagtttgaataaccagacatttacaggcttgaatttacctttcagtgctgtggaaagcgacacatttttaagaggttcgaatgcatgcacaaagatagtggcagattctttattcttcagtgtgcaaaaacattcaagttaaccaacacacagctttactcttgggatcttcagtgtattaaaatttgaatgtgaggttttaaaaatgggtttccagctagttaaatgaagtttgacttaaatatttgcacactcctgccttgcttactgcagggcatggtttgaaaagcactcttctatagaaggtggaaaatgtattaggtataaaaataacttcttctgatgtaattttaggaagactcaatgaatgacaggaattagtgttttgcttttcaattgacttagtcttttgtgtaagtatttataaggtgaccaaaagaaagtatctagtaagtatttataaggtcattaaagcaacctatagtattttggggtaaatgttagtgttttggaccaaattctgttttaagaatttactgactaaccactaaccaaattgactttatgatcagattggaaacttgagtttactagattatttgaggggaatgacattatcttggccatctttgtactcccagcactcagcatactgtctaatatagtaattatttgttatcaaatgcacttgaaatgattatttttgtcttgatagatagtttatcatttatttctgatttttttttaatttcctgagttctttaatttgcctaaagtttaagaaaactgatattatgcctaatatttgtgttagagtaactgaatttgtcattttagggtaaaatatttggagtaccttttaatgcactgccccattctgctgtaccagaatatggacacattccaaggtaagcagagtttgaaatgaagaaggccgggtgcagtggcatatgcctgtaaccccagcattttgagaggccgaggtgggcaaatcacttgagtccaggagcttaagaccagcctgggcaacatggtgagaccttgtcgcaaaagatagaaaaattagcttggcggagcacacttgtagtcccagctactcaggggcctggggtgggaggattgcttgagcccaggaggtggaggctgcagtgagccttctagccagggaaatgaagaagaagagagtaagcatttcaaactggttttagagagtttaaaagaaatagttgattaaaacataattgtttcaaaccagcaaatgatttaatctctcataatgttaaaaatatttttttaacttttacatattttaaatttataatttgtactcattcccaggattgaattttaaagtccagtaatgagtaaatgttagaaatcacaaaaaatttttgttctgttaagtcagttttcagttctatgtgaattcttttgccacaactcagattaagtaatatactgacttaccaattcagtaataattttgacttttttttgtttgttaaaaaaatattggccaggcacagtagctcatgcctataatcccagcattttgagggccgaggcaggaggatcgcttgagcccaggattttgagaccagtctgggcaacaaagcaagactccatgtataaaaaaaattttaaagaaaaatcagctgggcaaggtggtgtgcacctgtagtcccagctacctctgaagctgaggcagaggattgtttgaccctaggagtttgaggctgcagtgagctatgctcattgccactgcactccagcattggcaacagagtgagaccatgtctcttgaaaacaaatattggataaaagaatatttaagctaagatattagagtgtttgtgaaaatgtatcacttagcttttctatgccacttactatttataaataaccttttattctttttttttttttttttttttttgagacaagagtttcactcttgtcgcccaggctggagtgcaatggcgtgagctcggctcaccgcaaccttcacctcctgggttcaagtgattctcctgcctcagcctccggagtagctgggattacaggtgtccaccaccacacttagctaatttttgtattttagtagagatggggtttcaccatgttggccaggctggtctcaaactcctgacctcaggtgatctacctgcttcagcctcccaaagtgctaggattacaggcgtgagccactgtgctggcctattctaactgcatcagaacttactaggaaagtttatgttttaagaatataatttagccgggcgccggggctcacgcctgtaatcccagcactttgggaggccgaggcgggcagattacgaggtcaggagatccagaccttcctggctaacacagtgaaaccccgtctctactaaaaatacaaaacattagctgagtgtggtagcacgcacctgtagttccagctactcgggaggctgaggcaggggaatggcatgccaggaggcggagcttgcagtgagccaaaattgtaccactgcactccagcctgggcgacagagtgagactccgtctcaaaaaaaaaaaaaaaaaagaaaaaaaaagaatgtaatctaaaaatgcatatggtgaaacttatccttaattcatttcccctccatctaaagtagggttcatttgggctactatagaccaataatctaggttttaattgacatgtcatccaaaagcaattatcgaacacctggttgccttaggacagtttccccccattcatcctataggtgtagattcactgtcttcttaggtaaccgcttaaccattttgctctttaaatgacctatgaaaggcttgattttcttataatgaacacctataatgattttcaacaggccgggcacaggagctcatgcctgttatgccagcacttagggaggcccaggtggtggattgcttgagcccaggagttcaagacaagcctgggcaacatggtgaaatcttgtctctacaaaaaatagaaaaattagctgggcgtagtgatgtgtgcctatagtcccagctagtcgggaggctgaggtgggaggatcacttgcgcccaggaggcaaaggttgcagtgagcagtgatcgcaccactccagcctgggtgacagagcgagaccctgtctcaaaataaaaactaaaagaaaaaaaaaagcagattttcggcgtctggaattgcaaagtcatattcccaggaatcatgactatatcttcattgtaatttcatgacctactttttatttaattaaaaagactgttttgtcagttaccttctgtaaataaggctgacattcagccactgtgcaccaatacagctgtatcaattgttggtagccgatattcattctaatttgtgggtcccagctgttcaatatctaggtatctaaagccaacattgagatttatttgaacattgttcaaaataaagaaattgagcacattccccttaatatgaaaaggcttgtaaggactgggatatatcctacttttctgagggataatgttggggtgaggaaaaaaaaacctcgccctgtttttgggtgatgtaggagatgagaaaatcacccatgaagagatagtagataaaagaaggtggccttggacagagccctgggttgttccagcatgtagaggtttcacataagaggagtgagaaaaggaatttgagaaggagcaggcagggagatagcaggaaaactaaaagagtagtgaaaaagtatttttgagatgaacagggaagggatcaggtgtgtcaaatggtgatagatcgagcaatacgaggacaacacactgaccatggatttggcaaggcagaggctgttagtgagcttgaagagagctatttctttggagtaatgaggtatgagaatgattggataggggtgagtagagactgagatatgaagaagtagaggcagaaaaaaaagacaagtcttacgctctgaagggaagcagaaatgaagtaggattgagaaagataaaatttagtgtgcacattggagttgttagaagtaaaaagatgggccttggagaagaatttgggaagccagtagacaactaaaagtaacatttcatctcaaagactacagagatttgtggctttagagcctctgaaaggtacgtagtgcttggcctgctcatgtatgttagcagaggaataggatgtgatatgtatgtctagccacctgaaaaaatctctctttcagctttcttgtcgatgcttgcacatctttagaagaccatattcataccgaagggctttttcggaaatcaggatctgtgattcgcctaaaagcactaaaggtgagcatattgttgaactattaatttttcatttgagccattttctgatttggtttttaaaactgaaatatttagaactattaatatgaatagttgacagaaattgaatttgcatttttttcatggcagaagattttttttttccaaaagaaatggtatattatttctatcatgctttaaaaatttaatagggtacttttaaattcatggtccttatttctatcaagtattatgtaaaatgaaaaaaatgtgttaagttatattgttgttagccttctagaaggagtgatagagctgagtgtggtggcacatgcttgtagtcccagctacttgggaggctaaggcaggaagattgcttgagcctgggagtttgaagccagcccaggccacatagtctgtgccacatttctataaaaataaaaataaattcaaaaatcattaaaaataaagtagtgacatatattaaaataagagttaagagaaatttattaaagaaaagtgtaattagagtataacaaaagatactttatttgcaataaactcttaagttgccaaaatactcaagattattatatttatttcagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttaggtaagtggtaattaaaactcttggcaaataatagttgaatttttcaactaacgttttatgcttgtagatatgtacaatttcatttggaatggaaatttttctttaaaaattccatatttcattactatgaggagtatactccaatttaagaaacagcataccaaatgatttaatatttccttatcttaaagtcatcatcatgaatgccttaatggttcattggtgtttataagattcattgtccactgaaagcctttgtttactgggtttttaaaatatttctgttttgcttttcaaaatttccctctccctgctgtcagtgagcctgcttattctagacatacttgctgccttctgatacttccaactttttatgtgtaggtctgaaaatcagataaagatgttcaatttgtgtggaaaagcaaagtatgaactctaagattagcatggtttttagaatacatatttaaatatagagaggctatatatttctggttctttcttgtgttcaagccaatcatgtagatgaagggtaactattttgacttgtgtatgactgataataaggtcttcaaaatgtactacatacgttattttaactcttctgtattttcacgtttggctccatctaataaagcgtttattcacttaagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggaggtaagtggcggtcccattttatggaggtacagtgatttgctttaatcgaaagtacatttcacataaagaagcatgaactgtggtatgtgcctttttggtgcttaaagcacagctggaaagataggacgtatgcgtgtaaaaagttaaagcgatagtacaatctaatgttaagtgctacatctttagcacaaacataaaatgtgttaaaaggagaaaagttccctggattgtaattatcagggacttgtcaaagaggagccaaactgaaccttcttgaataatggatagaatttagtgggattgggtggaggatcagaatacttgtatcctattctagatgagaaggatgctatgaagaaaggtttgtgtagggaagaagtaacctatgtctaatgtagatagtgcagtatgacttgagtgaagtgttcagcataaggataaaggatggtattatggtaaacttaatgccaggctaaagaattagaatattaacctgggtgttggtgaatcattgaagatttatgatgtgaggcatgatatgatttaaaaattttagaaaattacctgatttgaagaattgagacttggaagtagggagaatggtcagcaatgtgtgtcagtagtccaggcatcagattattgtttgaacttgttagtgacatggattagttaggagtacgaactaaataatgaaggaaatattatcaaggaagaatcagaaagaccaaaagaccatcataagatggtagagttggtaataaaacttgcaatctccttgatcaagaagtcagaggccattattcttccaattactttaggaaatttattatcttttgaatatcagaaccaaatgttactaactatcccaatccctttttcatcttttggtttatttgttattgcatacttgtgtttcttctttacctcctttgtagataggataatactgatgacttatgtatgattttcctagggctactgtagcaaagtactacaaactaggtggcttaaatcaacagaaatttgtctcaccgttctggaggctagaagtctgaaatcaaggtgttggcagaatgcctgaaacctgcaggggagaatcctttcttgcctcttcctggctcctggtagtggctgtcagtccttagcattccttggcttgcagccgcgtcactccaatccctgcctatgtcatcctatgatgttgctctgtgtcagaacttccctcttacagggcacattggattagggcccacccaaatgacctcattttaactcgagtacatctgtaaagacacgaattccaagtatggtcaccttcataggaactgggggttaggacttaaacataggttttttggagaacacaatgcaacccataaaacttcctatccccaatggagatatttctcagatgcagatcatctttattgccctctttcccagtcctgtagtttcagttatcaccagtcctgtagtttcagttatcacatctaaatagataaccaccacatctgtaccaccgttatcttgaaaatgtcagttccactttactaatggcttgctagggagacctcatcacatctgcttttcattggtgctttaagcttaacgttttgaaatgaccatctttatcctctttatcctggttctgtgtgaattccattttcttctaacagcaccactattccctagatactcaggctttaaccatgggttctacctcttcctctaccatctataatcagacagttttcatgtcgtataagattctatctccgtagtgtttattgcattgttactgtaagaatcttcttggccgggcgcgatggctcacgcctgtaattccagcactttgggaggccaaggtgggcggatcatgaggtcaggagatcgagaccatcctagctaacacagtgaaaccccgtctctactaagaatataaaaaattagctgggcgtggtggcgggcgcctgtagtcccagctacttgggaggctgaggcaggagaatggtgtgaacctgggaggcggaggttgtagttggctgagatcgggccactgcactccagcctgggcaacatagcgagactccgtctcaaaaataaaaattaaaaaaagaatcttcttggtctttatgcctcctccttgaatctaccctacatattgctattaaggctcacttttttttttttttttgagacggagtctgtctttgtcacccaggctggggtgcagtgatgctaccttggttcactgcaatctccacctcctgggttcaagcgattctcttgcctcagtctcccaagtagctgggattacaggtgcacgctaccacgcctggctaatttttgtatatttagtagaaagggggtttcactgtgttggccaggctggtctctaactcctgacatcaagtaatctgcttgccttggcctcccaaaatgctaggattacaggtgtgagccactgcacctggccaaggcttacattttaaatgtataactctactcaagtatctcacacacatacccttcagaaattttaattggtaatagggatatttatagcttggcattaaaggtctttcataggattgctctagcatacctgtctactatttcctgtctttgagcaactttagtcaaactatgttatttattttccagacacttttattcatttgcttacactatttattgatataatgtttttacttccatctctactgatcttttaaatacttttattcgtgcctccatttccatggttcttgcctcagttcagaccttcatcttttgccttaacatgtaatgatttctttttccctacccttactgtacattatatgtatttgtattacatttctttctgtattgtgtcttttttattttagggatatggaagtataagtggggaatggaataaaaatatatcctttagtatttttcctattttgaaataattcctcttaaataacttaaaatttataagccgatgtaaagttacatgttgaaagaagactgcaaatattaatatgaattattggtgaaagacaagtaaatgtgaagttgtaattgcttatgccttgcatttcagattttgttagtggagcactaaataaatttaaacctaacagaacaccttctattacacctcaagaagaaagaattggtaggtatttattatatgcatttatttaaattaaaatttgtatagtattctataaaatacaattacaataataattacctaacttagtaatcaaatttagtttaatcaaatcaaatattatttttaatagtcatactgtactatacacactatgttgtgacattgctaattacataggctataatgaacccaaaattgtaggcaaaaatttttttagtctcctgtctttaatcttcttaatcatgcttttctgtttgtaatttagatgctattaagcgtgtgaaaatagttcaacctcatttttatcttaggactagaagttcattattgtatatttcaattttttattctaatttgcttgtggctgaaattattcagccagtaagagtcaacatgatcttctgttttctagagtgaagaaatgaactggttaatactcacttatgatgaaaagcaaaaataatatttagattagtttttgtttcaactccttgattgtaatttcttccttacattaatattctttaatgtatatcatatgcatcttttagtctgttagatttaagtaactgctgtctcttaagagtcttgcctctgcgacttccttattttcatttaagtaattgcagagtgttttagttaaacaacatctacttaactgatgatgtaaatatattctcattttttgtttagctctaagtaatagctttataagaagaaattatgtaaagcttttatatgttgtcaactctgcagtagaaacaagttggttttgttttgatattttttcagcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtagcaaatagaatttatataaatggattgtaaagattaaaatgagtgcctattctgggcacagtgcaatttcatattaataataccacccttaggaactagaactttattctgttttatccaacctatgaatttttataaaaccccctgccttttaaaatagacactgtttcaatatagtgtgtgtgtgtgtgtgtgtgtgtgtgtgtgtgttatgacaacatctattgaaagttgtgataacccagagtagtagtttgggcttctggtgatagcattgatgcttaggttttatgtgattagacatcctgaatcctgctatagttacatctgggtctatagctgtggctttattgctgtcatttgttgaattgaggttgccagatgtttgatcatgtctgattcccaagtgggagcgttactattgcaggttatggtttgaaaatgagggtatttttaaagttttagactcaagtaccttttgtaaaagctttagaactttgttgacgctgttccttgtgccatggcttccagatcccttaccagcccagccattttcttccatattaactacaagttctaatgtggccaaccagagccttcagagagtaatagagtatgatcatgctaatccggagattagtctgggtcttagattcaattggctcttttagcatatacagaattcaagttggctcatattaaccttacgatcaaccaaaaatgaaatgaaactctaagcccagggtcctccatctcatttatcttacatttagtcaaaatgtgagtgatctctgattattttagattttttattttgttggtttcagacaatgttaagtttcatttttgattcattatctgagttatatgagttccttcccaaagcctgtctcttttttctgttgtccaaaagggttcttatttgttttattgagaagttgaacagaatagcaacttgaggttttccagaaaaaaacacttcttcacaggttctctagggctcattgaaatgtgatgatagtaactctgaagcttatgtctgtagcttttgcagtgttcacaggttggagacttaaacttttttaagtaacatagttcagttgtttttttttttgaatatatcctttgcagtttggaggactttttccaaatggcaaatgggagttgtagttctacctgcctttgcttattagcattacattttccccaaggaatgaacatactgattccttcttctcctcctccaagctcccaaaacagaggttaaacagtcttgtgctatttttagtttgagcttgcctaatcaatgaatttttttataaaaaaatttaaaagttcaacaatagtaatcgtattatttttacaccacttttctttgaccctactttctcagccacaattcaacaaattccatttgcaaaattgaaaatagattgatttctaagtttagattataacaaatatgatgcttttaaaaatatataaaggcaacattagtctgtagtccatagagtatctattcataattgtctcttttttttttttttgagacagagttttgctcttgttgcccaggctagagtgcaatggcacaatctcggctcactgcagccaccacctctcaggttcaagcgattttcctgcctcagcctcccaggtagctgggattataggtggccaccaccacacctggctaattttcttttgcatttttagtagagacggggtttcaccacgttggccaggctggtcttgaactcccgacattagctgatcaacctgccttggtcttccaaagtgctgggattacaggtgtgagccaccatgcctggccataattttcttacagatgtgataaatttgcattgttccatatattctgactgtgcctcctgcgaccattgacacattttttatttttattttttgagacggagtctcgctctgtctcccaggctggagtacagtggcatgatcttggctcactacaacatccacctccgatgttcaagtgattcttgtgcctcagcctcctgagtagttgggattacaggcatgcaccaccacacccagctaatttttgtatttttagtagagatgggatttcaccatgttggccaggctggtttgaactcctggcctcaagcaatccgcccacctcagcctcccaaaatactgggattacagacgtgagtcacggtgcctggccggacacatttttaaagtgactagactgcagccctagaataaagctacttatgtcactttagatgtataatattggcttccaaaattttctttagctaaatgcacccaaaagtttctaaggtggttgtattttttccgttttcataattgaaaaaatgtgaatgtctctgggaaactttgtgaattctttattaataactcagatgaattgagagggttcatgtttgttgaatgtgtcctgggcgtgattcaaacataaatgtatatggagcctttgttcataactattttacttctttcgtaattgtttactatagttgatttcataatataaatggtgttaaataattgagcttctgttgtaccagtaattatttgcatggaacacagcagcagccaagggattaggaatgtgttatagaataattagtttttgtttacttgccaaaaatattgaacaaattacattccggagtcaggtgggtagcagttggccagcaggtatatctcaaatactcagattccaacttgtttgccaatagcttattttttataataccattaattggtattatgtactagatactgactaaatattttatatagataacagtaatattcatcatagaagtccgttttcagagcctaaagccatttagtaagtgatggagcaaactcaagcctgtctccaaatcttgttctttttccagtctgcaatggtgcctatccctgccttgtattattaacagagtttaaagaaaagctctaatataaaagtaatgcttaagctgacctttaattggcaagtcaaaagtaaaaaatgaatgctttttcttagctgagttgggttatttgacacttgaagtttctaaccagaaattaagtgatttcggttgttgcttgggatagaaattaaggctttgaatctaattgctgctattactattttatactttaaaaggaaaatagatatgtgtggtatattacatgtggttatttttgtagttcacatcgatacaagctcagaagggtcatctcagagttcactctctcctgtactcattggtggaaaccatttgatcactgcaggtgtgccaaggcgaagtaaaagaattgcaggcaaaaaagtttgcaggtactttatccaggacattttgttttcatcggataaatatttggtgtacacataattaataaaatgttttgtctttctgtcaagcatcatatttgagtcataattttttaaaatcccttctgcctttatagtcttattaatcaattgccttttcaatacccaccagagaaaaattactaatttgagtccgctttgcttgcttaaaatcctattttatgttgatggtgtaattttaaaatttcctgttagaggctgggcacggtggcttatgcctgtaatcctagcacttagggaggctgaggtgggtggagcacttgagctcaggagttcaagaccagcctgggcaacatggcaaaacctcatctctactaaaaagtacaaaaattagccaggcatggtgccacatgcctgtagtcccagctacctgggaggctgaggtgagaggatcatctgagcccagggatgtcaaggctacagtgagcagtgattatgccattatactccagcctgggccgcagagtgagaccctgtctcaaaaaataaaaaacaaagaaaaaaattcctgttaggttaaaaagctagcctattctaacaattctgagttataactgactgactaacttttaagattagcagatcattttttatgcaaatgcagtgtgttcatgtatggtatcttaaagttgaactgtttttaaagaattattaatccatccaattattatcaatatgatttgctgtggactttatttcaaatttcgtatttcaagtatttctctggtgtttatactataaactgacatttttaattccacttcttctagagtggaatcaggaaaagcaggctgcttttctcctaaaatcagccataaagaaaaggttcgaagatctctgcgtttgaaattcaatctagggaaaaatggcagagaagtagtaagtttcttaccattttattgatctttatattagcataacgctataaacttgatactaaaaaacactcatagccctaccttccttccagtgactgtctcattctgttctttttatccaaaactcttatacttgagttgatatcaaatttccttgcattggagtacccaaagcttagtccttggacttctcttttttctctccactcactcaaggtgatcatcagttttaaacattatatacaggttgagtagcacttatccagaatgcttgagaccagaagtatttcagattccccatttttgggggggattttggaatatttacattatttttactagttcagcatccctaatctgaaagtctggaatgctccagtgagcattttctttgaacatcatgtcaaatacttaaaagctttggatttttggagcatccagaactttggcttttcagatttggaatgcccaacctgtatttacttaaaacttccaagtttatgttctctagtcccaaatgctcttctgaatgactccgctgtctcttaacatctgcttttttgactctcctacttggatatctaatccaataggcatttcaaatgtaacctgtcccaagcagatggatttctttgctgctgctatgccctgcaccaaacaacacttttacctgtggttttccctatctcagttatggcaaatcgttcttccagtcacttaagccaaaaaccatggtcaaatccttgattcctcactttctctgagacaccatgtctaatccattagagaatcttgtctaacttctgcttttagagtatctccaaactgaccagttctcactattactacttttcccactttctctaagttctgtcatctctcagctggattactctagtaaactcctgttaatagttcttccttctcctacccttgctgcagttctgtagttgaaatttatcttttaaaatctgttaggttatgtagttttctgctcagaactctccagtgactcctcgtttcactctgaataaaagccagagttctcatgttgacctgcaaaggcctcacgtgatctgttctcaggctgcatttctgagctctcctccagtcccccttgctcactctgctccagtctcagagactgcactggcattctgctctttctgtagtgttcttcccccttaaatcttcatggctctcacctttgttttgttttactcacaaattatctcctcatcaccctattttaaactaaacctccattcttcaccactccatatcctttttactctgttttacttttctccgtagcacttttcaccttgtatattgtatttatgcaatataatttactgtttatcttaagtctaaatttccccatctaaatagaatgtaaattacataaggataagattttggtctaggtaccccactgccccaactatttgtgaacaggccctagcacagagtcagagcacacacagaaattattttaattaatatgtgagactgttttaaaaatagatcataaaatatcaactaatagcaaaatcaaatgattacagttttcattagcaggcaagaatgtttgtcattgttaagaattgtttctcaattatatatccctttttaaatcagctaaagattttgataactacaaaaaattattctgtctttatattttgaattaactaggcttatttcttaactaaaacttttttttttctgtacagaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgactta

SEQ ID NO: 613 - DNA, 24178 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaataggggtaagttctgtgaaaagggatttaggtttaaaagaaagggcacaccctttatcatcacttactaccagatcgtgctaaaatgttcactctgtgtatcaaaaagaatggttaggtgtgtaattcagttcagatggtcgattgctgatatttaaaaagtgacattcttgttttttttcccccaaggatttttgatcattgagagaaagttgcaggattttccaacttcagcactattgacattttggattagataatttttgttaggggaagacgaaatgctgttctgtgaattgtgggatgtttagcgggatgtctgtcttttacccactagatgctggtagcatctctcagttgtgacaattaaaaatgtctccggatattgccagcttactgtatttggaacaggtagtacgttgggagggacaaaaactctacccctccacccttgttttagagtaaggttgtagagggacaagggagaccagtgcattttctacatgaatctgtagatgaagaagtatgacagaacattagaaataggcttcaaatgatgactgcatattcactaatttgggaaacagatttgctgcttggccatgtcatacttttgggacagtaaatttttttttgtatgagtaaattgagaagccagagtggaataattgagaagttgttgatgttttggtggttgaaataaagggattttgaatgagattttaatagctctgccacataatcaggaattccattgtgaaaaataagctgaatgtaaagcattttattttaaatttatgtgcctaatttatatggtacttcctagtacttggagacaagctaataaaattaatatacgttgcttttaatagtttatggtttcttaaaaaaagtgcttggagaagaaaaccactaacaaaagtaatatgtgtgcctcttaatcgctgataaactttggagaagttatttttgttggtagcaaattaatggcaatacatgtacttacatttaaaaagctacagtgatttttttctgattgtaaaactggctttccaagatctcaaatgtagctgattttgtaagtatatggaagagtttgtatatggactttttttcaccccttttcttttcttttccttttttttttttttttttgagatggagtctccctctgtcgcccaggctggagtgcagtggcgcgatcttggctcactgcaagctctgcctcccgggttcacgccattctcctgcctcagcttcccgagtagctgggactacaggcgcccgccaccacacctggctaattttttgtattttttagtagagacgggatttcaccgtgttagccaggatggtctcgatctcctgccctcgtgatccgcccgcctcggcctcccaaagtggtgggatggcaggcgtgagccactgcactcggccttttcaccgcttaacaagaaaaactgttgcctgttttcagagtcagatagacctgagtttgagtgctgttccacccctactacatctgtaaacttgggctgcttgtttgatttccctaagcttcagttttatatatataaagtgggaacgtatttctccttggattatttagggatttttaaaaagtgaagctctttatgtaggcctagcacagtgcgggtaacatgccacttcttcatctaatgatagttgtcatatcattggtctgcctcctaattggtaatcatgccatataaattcagctagaaacacttataagaatattctaatgaagaaatatagaagatcattgtgttaggagatctaatgggatagtttgtttgaaaacaatttctttagccgactggtgtttgttagctaactgtagttttaagttttaaaaacattttatgagattaaattatagtggttacttgtgaggccagttattctaaataataagacttaaggaaaaaaacacgctgaattctagttatatatagcagaagtagacttaccagcttaagtatctggtttatttttacatttggtttggctgcacagtatcaagaaaattctgatttacccaataaaggggttgcccatactaacattttttaaaatagttcagcttaaaatgatgatcataatattaacaaatattttttgaatgcttactgtgtgtcagacactgatacaagtgttttgtatgttttaatttatttaattcttcctacacctctatgacttaggatctgtgtgaggataccgaggaacagaatgttaatttgatccaggtcactcagctgttaagcaagagttaagatgtaaagcctggcatttttgtgtgtgcgatggctcacgcctgtaatcccagcattttgggaggccgaggcgggtggataacgaggtcaggagatcgagaccatcctagctaacacggtgaaacccccccccccccgccccacgtctctactaaaaatacaaaaaaattagccaggtgtggtggcgggcgcctgtagtcccagctactcgggaagctgaggcaggagaatgggtgaacccgggaggcggagcttgcagtgagccgagattgcgccactgcactccagcctgggccacaaagtgagactccctctcaaaaaaaatacacctgtcatttttgccttcaggagcctactctcttaagcacttactatactatactgtcttttcagcttacaatatttgtaaattaattggagccaggtgcttgaaagggaattagtaaaattttgttactgtgttgcgtcattgacaatgctgagtggtttttattgtaaatataaagttaaatataatgctcataaaacataaatacttcttggttgataacttgtgacatcaaaaaaagtacttcagcattcacagagcagatgcatgtaaactaaattaacatgtgagattatgcatacccacttaagtttgaataaccagacatttacaggcttgaatttacctttcagtgctgtggaaagcgacacatttttaagaggttcgaatgcatgcacaaagatagtggcagattctttattcttcagtgtgcaaaaacattcaagttaaccaacacacagctttactcttgggatcttcagtgtattaaaatttgaatgtgaggttttaaaaatgggtttccagctagttaaatgaagtttgacttaaatatttgcacactcctgccttgcttactgcagggcatggtttgaaaagcactcttctatagaaggtggaaaatgtattaggtataaaaataacttcttctgatgtaattttaggaagactcaatgaatgacaggaattagtgttttgcttttcaattgacttagtcttttgtgtaagtatttataaggtgaccaaaagaaagtatctagtaagtatttataaggtcattaaagcaacctatagtattttggggtaaatgttagtgttttggaccaaattctgttttaagaatttactgactaaccactaaccaaattgactttatgatcagattggaaacttgagtttactagattatttgaggggaatgacattatcttggccatctttgtactcccagcactcagcatactgtctaatatagtaattatttgttatcaaatgcacttgaaatgattatttttgtcttgatagatagtttatcatttatttctgatttttttttaatttcctgagttctttaatttgcctaaagtttaagaaaactgatattatgcctaatatttgtgttagagtaactgaatttgtcattttagggtaaaatatttggagtaccttttaatgcactgccccattctgctgtaccagaatatggacacattccaaggtaagcagagtttgaaatgaagaaggccgggtgcagtggcatatgcctgtaaccccagcattttgagaggccgaggtgggcaaatcacttgagtccaggagcttaagaccagcctgggcaacatggtgagaccttgtcgcaaaagatagaaaaattagcttggcggagcacacttgtagtcccagctactcaggggcctggggtgggaggattgcttgagcccaggaggtggaggctgcagtgagccttctagccagggaaatgaagaagaagagagtaagcatttcaaactggttttagagagtttaaaagaaatagttgattaaaacataattgtttcaaaccagcaaatgatttaatctctcataatgttaaaaatatttttttaacttttacatattttaaatttataatttgtactcattcccaggattgaattttaaagtccagtaatgagtaaatgttagaaatcacaaaaaatttttgttctgttaagtcagttttcagttctatgtgaattcttttgccacaactcagattaagtaatatactgacttaccaattcagtaataattttgacttttttttgtttgttaaaaaaatattggccaggcacagtagctcatgcctataatcccagcattttgagggccgaggcaggaggatcgcttgagcccaggattttgagaccagtctgggcaacaaagcaagactccatgtataaaaaaaattttaaagaaaaatcagctgggcaaggtggtgtgcacctgtagtcccagctacctctgaagctgaggcagaggattgtttgaccctaggagtttgaggctgcagtgagctatgctcattgccactgcactccagcattggcaacagagtgagaccatgtctcttgaaaacaaatattggataaaagaatatttaagctaagatattagagtgtttgtgaaaatgtatcacttagcttttctatgccacttactatttataaataaccttttattctttttttttttttttttttttttgagacaagagtttcactcttgtcgcccaggctggagtgcaatggcgtgagctcggctcaccgcaaccttcacctcctgggttcaagtgattctcctgcctcagcctccggagtagctgggattacaggtgtccaccaccacacttagctaatttttgtattttagtagagatggggtttcaccatgttggccaggctggtctcaaactcctgacctcaggtgatctacctgcttcagcctcccaaagtgctaggattacaggcgtgagccactgtgctggcctattctaactgcatcagaacttactaggaaagtttatgttttaagaatataatttagccgggcgccggggctcacgcctgtaatcccagcactttgggaggccgaggcgggcagattacgaggtcaggagatccagaccttcctggctaacacagtgaaaccccgtctctactaaaaatacaaaacattagctgagtgtggtagcacgcacctgtagttccagctactcgggaggctgaggcaggggaatggcatgccaggaggcggagcttgcagtgagccaaaattgtaccactgcactccagcctgggcgacagagtgagactccgtctcaaaaaaaaaaaaaaaaaagaaaaaaaaagaatgtaatctaaaaatgcatatggtgaaacttatccttaattcatttcccctccatctaaagtagggttcatttgggctactatagaccaataatctaggttttaattgacatgtcatccaaaagcaattatcgaacacctggttgccttaggacagtttccccccattcatcctataggtgtagattcactgtcttcttaggtaaccgcttaaccattttgctctttaaatgacctatgaaaggcttgattttcttataatgaacacctataatgattttcaacaggccgggcacaggagctcatgcctgttatgccagcacttagggaggcccaggtggtggattgcttgagcccaggagttcaagacaagcctgggcaacatggtgaaatcttgtctctacaaaaaatagaaaaattagctgggcgtagtgatgtgtgcctatagtcccagctagtcgggaggctgaggtgggaggatcacttgcgcccaggaggcaaaggttgcagtgagcagtgatcgcaccactccagcctgggtgacagagcgagaccctgtctcaaaataaaaactaaaagaaaaaaaaaagcagattttcggcgtctggaattgcaaagtcatattcccaggaatcatgactatatcttcattgtaatttcatgacctactttttatttaattaaaaagactgttttgtcagttaccttctgtaaataaggctgacattcagccactgtgcaccaatacagctgtatcaattgttggtagccgatattcattctaatttgtgggtcccagctgttcaatatctaggtatctaaagccaacattgagatttatttgaacattgttcaaaataaagaaattgagcacattccccttaatatgaaaaggcttgtaaggactgggatatatcctacttttctgagggataatgttggggtgaggaaaaaaaaacctcgccctgtttttgggtgatgtaggagatgagaaaatcacccatgaagagatagtagataaaagaaggtggccttggacagagccctgggttgttccagcatgtagaggtttcacataagaggagtgagaaaaggaatttgagaaggagcaggcagggagatagcaggaaaactaaaagagtagtgaaaaagtatttttgagatgaacagggaagggatcaggtgtgtcaaatggtgatagatcgagcaatacgaggacaacacactgaccatggatttggcaaggcagaggctgttagtgagcttgaagagagctatttctttggagtaatgaggtatgagaatgattggataggggtgagtagagactgagatatgaagaagtagaggcagaaaaaaaagacaagtcttacgctctgaagggaagcagaaatgaagtaggattgagaaagataaaatttagtgtgcacattggagttgttagaagtaaaaagatgggccttggagaagaatttgggaagccagtagacaactaaaagtaacatttcatctcaaagactacagagatttgtggctttagagcctctgaaaggtacgtagtgcttggcctgctcatgtatgttagcagaggaataggatgtgatatgtatgtctagccacctgaaaaaatctctctttcagctttcttgtcgatgcttgcacatctttagaagaccatattcataccgaagggctttttcggaaatcaggatctgtgattcgcctaaaagcactaaaggtgagcatattgttgaactattaatttttcatttgagccattttctgatttggtttttaaaactgaaatatttagaactattaatatgaatagttgacagaaattgaatttgcatttttttcatggcagaagattttttttttccaaaagaaatggtatattatttctatcatgctttaaaaatttaatagggtacttttaaattcatggtccttatttctatcaagtattatgtaaaatgaaaaaaatgtgttaagttatattgttgttagccttctagaaggagtgatagagctgagtgtggtggcacatgcttgtagtcccagctacttgggaggctaaggcaggaagattgcttgagcctgggagtttgaagccagcccaggccacatagtctgtgccacatttctataaaaataaaaataaattcaaaaatcattaaaaataaagtagtgacatatattaaaataagagttaagagaaatttattaaagaaaagtgtaattagagtataacaaaagatactttatttgcaataaactcttaagttgccaaaatactcaagattattatatttatttcagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttaggtaagtggtaattaaaactcttggcaaataatagttgaatttttcaactaacgttttatgcttgtagatatgtacaatttcatttggaatggaaatttttctttaaaaattccatatttcattactatgaggagtatactccaatttaagaaacagcataccaaatgatttaatatttccttatcttaaagtcatcatcatgaatgccttaatggttcattggtgtttataagattcattgtccactgaaagcctttgtttactgggtttttaaaatatttctgttttgcttttcaaaatttccctctccctgctgtcagtgagcctgcttattctagacatacttgctgccttctgatacttccaactttttatgtgtaggtctgaaaatcagataaagatgttcaatttgtgtggaaaagcaaagtatgaactctaagattagcatggtttttagaatacatatttaaatatagagaggctatatatttctggttctttcttgtgttcaagccaatcatgtagatgaagggtaactattttgacttgtgtatgactgataataaggtcttcaaaatgtactacatacgttattttaactcttctgtattttcacgtttggctccatctaataaagcgtttattcacttaagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggaggtaagtggcggtcccattttatggaggtacagtgatttgctttaatcgaaagtacatttcacataaagaagcatgaactgtggtatgtgcctttttggtgcttaaagcacagctggaaagataggacgtatgcgtgtaaaaagttaaagcgatagtacaatctaatgttaagtgctacatctttagcacaaacataaaatgtgttaaaaggagaaaagttccctggattgtaattatcagggacttgtcaaagaggagccaaactgaaccttcttgaataatggatagaatttagtgggattgggtggaggatcagaatacttgtatcctattctagatgagaaggatgctatgaagaaaggtttgtgtagggaagaagtaacctatgtctaatgtagatagtgcagtatgacttgagtgaagtgttcagcataaggataaaggatggtattatggtaaacttaatgccaggctaaagaattagaatattaacctgggtgttggtgaatcattgaagatttatgatgtgaggcatgatatgatttaaaaattttagaaaattacctgatttgaagaattgagacttggaagtagggagaatggtcagcaatgtgtgtcagtagtccaggcatcagattattgtttgaacttgttagtgacatggattagttaggagtacgaactaaataatgaaggaaatattatcaaggaagaatcagaaagaccaaaagaccatcataagatggtagagttggtaataaaacttgcaatctccttgatcaagaagtcagaggccattattcttccaattactttaggaaatttattatcttttgaatatcagaaccaaatgttactaactatcccaatccctttttcatcttttggtttatttgttattgcatacttgtgtttcttctttacctcctttgtagataggataatactgatgacttatgtatgattttcctagggctactgtagcaaagtactacaaactaggtggcttaaatcaacagaaatttgtctcaccgttctggaggctagaagtctgaaatcaaggtgttggcagaatgcctgaaacctgcaggggagaatcctttcttgcctcttcctggctcctggtagtggctgtcagtccttagcattccttggcttgcagccgcgtcactccaatccctgcctatgtcatcctatgatgttgctctgtgtcagaacttccctcttacagggcacattggattagggcccacccaaatgacctcattttaactcgagtacatctgtaaagacacgaattccaagtatggtcaccttcataggaactgggggttaggacttaaacataggttttttggagaacacaatgcaacccataaaacttcctatccccaatggagatatttctcagatgcagatcatctttattgccctctttcccagtcctgtagtttcagttatcaccagtcctgtagtttcagttatcacatctaaatagataaccaccacatctgtaccaccgttatcttgaaaatgtcagttccactttactaatggcttgctagggagacctcatcacatctgcttttcattggtgctttaagcttaacgttttgaaatgaccatctttatcctctttatcctggttctgtgtgaattccattttcttctaacagcaccactattccctagatactcaggctttaaccatgggttctacctcttcctctaccatctataatcagacagttttcatgtcgtataagattctatctccgtagtgtttattgcattgttactgtaagaatcttcttggccgggcgcgatggctcacgcctgtaattccagcactttgggaggccaaggtgggcggatcatgaggtcaggagatcgagaccatcctagctaacacagtgaaaccccgtctctactaagaatataaaaaattagctgggcgtggtggcgggcgcctgtagtcccagctacttgggaggctgaggcaggagaatggtgtgaacctgggaggcggaggttgtagttggctgagatcgggccactgcactccagcctgggcaacatagcgagactccgtctcaaaaataaaaattaaaaaaagaatcttcttggtctttatgcctcctccttgaatctaccctacatattgctattaaggctcacttttttttttttttttgagacggagtctgtctttgtcacccaggctggggtgcagtgatgctaccttggttcactgcaatctccacctcctgggttcaagcgattctcttgcctcagtctcccaagtagctgggattacaggtgcacgctaccacgcctggctaatttttgtatatttagtagaaagggggtttcactgtgttggccaggctggtctctaactcctgacatcaagtaatctgcttgccttggcctcccaaaatgctaggattacaggtgtgagccactgcacctggccaaggcttacattttaaatgtataactctactcaagtatctcacacacatacccttcagaaattttaattggtaatagggatatttatagcttggcattaaaggtctttcataggattgctctagcatacctgtctactatttcctgtctttgagcaactttagtcaaactatgttatttattttccagacacttttattcatttgcttacactatttattgatataatgtttttacttccatctctactgatcttttaaatacttttattcgtgcctccatttccatggttcttgcctcagttcagaccttcatcttttgccttaacatgtaatgatttctttttccctacccttactgtacattatatgtatttgtattacatttctttctgtattgtgtcttttttattttagggatatggaagtataagtggggaatggaataaaaatatatcctttagtatttttcctattttgaaataattcctcttaaataacttaaaatttataagccgatgtaaagttacatgttgaaagaagactgcaaatattaatatgaattattggtgaaagacaagtaaatgtgaagttgtaattgcttatgccttgcatttcagattttgttagtggagcactaaataaatttaaacctaacagaacaccttctattacacctcaagaagaaagaattggtaggtatttattatatgcatttatttaaattaaaatttgtatagtattctataaaatacaattacaataataattacctaacttagtaatcaaatttagtttaatcaaatcaaatattatttttaatagtcatactgtactatacacactatgttgtgacattgctaattacataggctataatgaacccaaaattgtaggcaaaaatttttttagtctcctgtctttaatcttcttaatcatgcttttctgtttgtaatttagatgctattaagcgtgtgaaaatagttcaacctcatttttatcttaggactagaagttcattattgtatatttcaattttttattctaatttgcttgtggctgaaattattcagccagtaagagtcaacatgatcttctgttttctagagtgaagaaatgaactggttaatactcacttatgatgaaaagcaaaaataatatttagattagtttttgtttcaactccttgattgtaatttcttccttacattaatattctttaatgtatatcatatgcatcttttagtctgttagatttaagtaactgctgtctcttaagagtcttgcctctgcgacttccttattttcatttaagtaattgcagagtgttttagttaaacaacatctacttaactgatgatgtaaatatattctcattttttgtttagctctaagtaatagctttataagaagaaattatgtaaagcttttatatgttgtcaactctgcagtagaaacaagttggttttgttttgatattttttcagcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtagcaaatagaatttatataaatggattgtaaagattaaaatgagtgcctattctgggcacagtgcaatttcatattaataataccacccttaggaactagaactttattctgttttatccaacctatgaatttttataaaaccccctgccttttaaaatagacactgtttcaatatagtgtgtgtgtgtgtgtgtgtgtgtgtgtgtgtgttatgacaacatctattgaaagttgtgataacccagagtagtagtttgggcttctggtgatagcattgatgcttaggttttatgtgattagacatcctgaatcctgctatagttacatctgggtctatagctgtggctttattgctgtcatttgttgaattgaggttgccagatgtttgatcatgtctgattcccaagtgggagcgttactattgcaggttatggtttgaaaatgagggtatttttaaagttttagactcaagtaccttttgtaaaagctttagaactttgttgacgctgttccttgtgccatggcttccagatcccttaccagcccagccattttcttccatattaactacaagttctaatgtggccaaccagagccttcagagagtaatagagtatgatcatgctaatccggagattagtctgggtcttagattcaattggctcttttagcatatacagaattcaagttggctcatattaaccttacgatcaaccaaaaatgaaatgaaactctaagcccagggtcctccatctcatttatcttacatttagtcaaaatgtgagtgatctctgattattttagattttttattttgttggtttcagacaatgttaagtttcatttttgattcattatctgagttatatgagttccttcccaaagcctgtctcttttttctgttgtccaaaagggttcttatttgttttattgagaagttgaacagaatagcaacttgaggttttccagaaaaaaacacttcttcacaggttctctagggctcattgaaatgtgatgatagtaactctgaagcttatgtctgtagcttttgcagtgttcacaggttggagacttaaacttttttaagtaacatagttcagttgtttttttttttgaatatatcctttgcagtttggaggactttttccaaatggcaaatgggagttgtagttctacctgcctttgcttattagcattacattttccccaaggaatgaacatactgattccttcttctcctcctccaagctcccaaaacagaggttaaacagtcttgtgctatttttagtttgagcttgcctaatcaatgaatttttttataaaaaaatttaaaagttcaacaatagtaatcgtattatttttacaccacttttctttgaccctactttctcagccacaattcaacaaattccatttgcaaaattgaaaatagattgatttctaagtttagattataacaaatatgatgcttttaaaaatatataaaggcaacattagtctgtagtccatagagtatctattcataattgtctcttttttttttttttgagacagagttttgctcttgttgcccaggctagagtgcaatggcacaatctcggctcactgcagccaccacctctcaggttcaagcgattttcctgcctcagcctcccaggtagctgggattataggtggccaccaccacacctggctaattttcttttgcatttttagtagagacggggtttcaccacgttggccaggctggtcttgaactcccgacattagctgatcaacctgccttggtcttccaaagtgctgggattacaggtgtgagccaccatgcctggccataattttcttacagatgtgataaatttgcattgttccatatattctgactgtgcctcctgcgaccattgacacattttttatttttattttttgagacggagtctcgctctgtctcccaggctggagtacagtggcatgatcttggctcactacaacatccacctccgatgttcaagtgattcttgtgcctcagcctcctgagtagttgggattacaggcatgcaccaccacacccagctaatttttgtatttttagtagagatgggatttcaccatgttggccaggctggtttgaactcctggcctcaagcaatccgcccacctcagcctcccaaaatactgggattacagacgtgagtcacggtgcctggccggacacatttttaaagtgactagactgcagccctagaataaagctacttatgtcactttagatgtataatattggcttccaaaattttctttagctaaatgcacccaaaagtttctaaggtggttgtattttttccgttttcataattgaaaaaatgtgaatgtctctgggaaactttgtgaattctttattaataactcagatgaattgagagggttcatgtttgttgaatgtgtcctgggcgtgattcaaacataaatgtatatggagcctttgttcataactattttacttctttcgtaattgtttactatagttgatttcataatataaatggtgttaaataattgagcttctgttgtaccagtaattatttgcatggaacacagcagcagccaagggattaggaatgtgttatagaataattagtttttgtttacttgccaaaaatattgaacaaattacattccggagtcaggtgggtagcagttggccagcaggtatatctcaaatactcagattccaacttgtttgccaatagcttattttttataataccattaattggtattatgtactagatactgactaaatattttatatagataacagtaatattcatcatagaagtccgttttcagagcctaaagccatttagtaagtgatggagcaaactcaagcctgtctccaaatcttgttctttttccagtctgcaatggtgcctatccctgccttgtattattaacagagtttaaagaaaagctctaatataaaagtaatgcttaagctgacctttaattggcaagtcaaaagtaaaaaatgaatgctttttcttagctgagttgggttatttgacacttgaagtttctaaccagaaattaagtgatttcggttgttgcttgggatagaaattaaggctttgaatctaattgctgctattactattttatactttaaaaggaaaatagatatgtgtggtatattacatgtggttatttttgtagttcacatcgatacaagctcagaagggtcatctcagagttcactctctcctgtactcattggtggaaaccatttgatcactgcaggtgtgccaaggcgaagtaaaagaattgcaggcaaaaaagtttgcaggtactttatccaggacattttgttttcatcggataaatatttggtgtacacataattaataaaatgttttgtctttctgtcaagcatcatatttgagtcataattttttaaaatcccttctgcctttatagtcttattaatcaattgccttttcaatacccaccagagaaaaattactaatttgagtccgctttgcttgcttaaaatcctattttatgttgatggtgtaattttaaaatttcctgttagaggctgggcacggtggcttatgcctgtaatcctagcacttagggaggctgaggtgggtggagcacttgagctcaggagttcaagaccagcctgggcaacatggcaaaacctcatctctactaaaaagtacaaaaattagccaggcatggtgccacatgcctgtagtcccagctacctgggaggctgaggtgagaggatcatctgagcccagggatgtcaaggctacagtgagcagtgattatgccattatactccagcctgggccgcagagtgagaccctgtctcaaaaaataaaaaacaaagaaaaaaattcctgttaggttaaaaagctagcctattctaacaattctgagttataactgactgactaacttttaagattagcagatcattttttatgcaaatgcagtgtgttcatgtatggtatcttaaagttgaactgtttttaaagaattattaatccatccaattattatcaatatgatttgctgtggactttatttcaaatttcgtatttcaagtatttctctggtgtttatactataaactgacatttttaattccacttcttctagagtggaatcaggaaaagcaggctgcttttctcctaaaatcagccataaagaaaaggttcgaagatctctgcgtttgaaattcaatctagggaaaaatggcagagaagtagtaagtttcttaccattttattgatctttatattagcataacgctataaacttgatactaaaaaacactcatagccctaccttccttccagtgactgtctcattctgttctttttatccaaaactcttatacttgagttgatatcaaatttccttgcattggagtacccaaagcttagtccttggacttctcttttttctctccactcactcaaggtgatcatcagttttaaacattatatacaggttgagtagcacttatccagaatgcttgagaccagaagtatttcagattccccatttttgggggggattttggaatatttacattatttttactagttcagcatccctaatctgaaagtctggaatgctccagtgagcattttctttgaacatcatgtcaaatacttaaaagctttggatttttggagcatccagaactttggcttttcagatttggaatgcccaacctgtatttacttaaaacttccaagtttatgttctctagtcccaaatgctcttctgaatgactccgctgtctcttaacatctgcttttttgactctcctacttggatatctaatccaataggcatttcaaatgtaacctgtcccaagcagatggatttctttgctgctgctatgccctgcaccaaacaacacttttacctgtggttttccctatctcagttatggcaaatcgttcttccagtcacttaagccaaaaaccatggtcaaatccttgattcctcactttctctgagacaccatgtctaatccattagagaatcttgtctaacttctgcttttagagtatctccaaactgaccagttctcactattactacttttcccactttctctaagttctgtcatctctcagctggattactctagtaaactcctgttaatagttcttccttctcctacccttgctgcagttctgtagttgaaatttatcttttaaaatctgttaggttatgtagttttctgctcagaactctccagtgactcctcgtttcactctgaataaaagccagagttctcatgttgacctgcaaaggcctcacgtgatctgttctcaggctgcatttctgagctctcctccagtcccccttgctcactctgctccagtctcagagactgcactggcattctgctctttctgtagtgttcttcccccttaaatcttcatggctctcacctttgttttgttttactcacaaattatctcctcatcaccctattttaaactaaacctccattcttcaccactccatatcctttttactctgttttacttttctccgtagcacttttcaccttgtatattgtatttatgcaatataatttactgtttatcttaagtctaaatttccccatctaaatagaatgtaaattacataaggataagattttggtctaggtaccccactgccccaactatttgtgaacaggccctagcacagagtcagagcacacacagaaattattttaattaatatgtgagactgttttaaaaatagatcataaaatatcaactaatagcaaaatcaaatgattacagttttcattagcaggcaagaatgtttgtcattgttaagaattgtttctcaattatatatccctttttaaatcagctaaagattttgataactacaaaaaattattctgtctttatattttgaattaactaggcttatttcttaactaaaacttttttttttctgtacagaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgacttatttgccatgtgcttgggtattatttcaaaacaaggttaaatacaaaggattaagcactgaactgctttattttaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 614 - DNA, 55429 bp, Homo sapiens
gcggagctaagatgcggaggagggtgacgcactagctctccagttcgcccgttcctggcctgacccccaccaaggcccataccgcagtaggctcctcgggctgcccctcggtgagtacagttttgatgtcggctcggccgcctgccgccaacccgagatttggtattgccagttgtgggagggcgtcctgctaaaatccttgaggtggaggctggggtcagacgaaggatgcgtaggggattagaatgtttggctatcagtaaggggaagggagtactgagggaggagattgtgtagttcatcaaatcagagcggcgtttgctgggatgacatcctgcattcagagtggacaagggaaagatggagatggagagcctcgtgtctgcctccagccttttccatcagaattgcagattttgctgttaaacagctactctcagctctttggagagcaaggttttatatctagtggctagaaaaggccttttctttgcagaaaaagaaattggagggtataaaaatttttgtttcagtaaaggaaatgcacgattttgcctcctcccacctctccatcccccatcctcagtagaagaatgattagaaggagggtttgcgccggtcctggtggctcacgcctgtaatcctagcgctttgggaggctgaggggagggggtggatcacctgaggtcaggagttcgagaccagcctgaccaatatggtgaaaccctgcctctattaaaaatacaaaaattagccgggtttggttgtgggcgcctgtaattccagctactcgggaggctgaggcaggagaatcacttgaacctgggaggtggaggttgcagtgagtcgagatggcgccactgcactccagcctgggcaacaagagtgaaactccgtctcaaaaaaaaaaaaaaaaaaaaaaaaaaagggtttgcaaggccgctgcctgaagcatgcatccaaacacgttaagcagctgtggggtaagctgcaaggataatgttcacttgttttgcagacatacccatagaaaccaacattttggacaggttgaccctcccacccccaggctagttaactccctctcaccaccactgcctccccatattctaacctccagaactgttaaggcaatgttagcaacataataatagcaatataggggctcattctgtgcctggcattgtcctaaacactcttaacatgtatttgcacacaccctcacaacaaccctaaaaggtaaatgctttaattatctccgttttgcagaggaggaaactgagggacttgcctacgatcactcagcatgtggctgagcaaacaaacctcaaactaccccagcagattgcagggctggatctaaggaacattttccttcctttcaggatcgcaaacgtattggatgtttgctaaactgaaatgtttccctgccaccactcccaaccttcctgagcttcttgatttgtgtcttcctgactccctcctgttagacttttattcccagagactgggaaaacccaagatgccactatctctttctcaaaatgtaagcaagtttggtttatttgttttagtaagagagggagagagtgatgaagttaggagtaatgcagaactttcagggagctacaaggaggataaaaattatgagtgagaaccgccattccagcctagctttctcaagaatgcaaacagagggaattggatacctgcaactgttttgtttaatacctttctgcaatgatgctctgcctagcatggaaacttaagacaaaagcaacctcctaaggattctttgttacaacccctttctgggtggtcctcgaaccacaacctggagtggttgcatcattataattgtattatcacaattgccgattgtagcctatcagtatacatttggtcttttatctgcaggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtatttactgtgttctgatggtttgaagtttccgttagcattttaaataatatatttgcacacttctcacaacaaccttataagtagatgcctttattatcctatttttttcagaggaggaagctaatttttaagagactctactttctcatggttttccctttcttcttctacacagtgtctacatacttacatatacacacccacatgagactataagtcctgtgagagcagggaccttatctatctaattcatagctgtagccctagcacctagcacaatgtctggtacataataggtgctcaattaatgtttgttgaatgaatgaaggagcatctagtgttatcactaaagaaagattagaacccagacatgatgttttctcctcactgctgatcttcaggaaattgtgtcatcagatagctgccttttgagtcaatgccagccagtacttgtaaaagagcttcaaaatgtagaacctacaggatctgacttgattcctaggaatgactccagtatacccaagaggagacaaaagaggtactgacattaagagtttacgtgaaagcttttgaaaatatttaaaaatataacaattttattaaataataaattaagaataattaaatcgttttaaggtggcaagaccattttccccctgaagttttccaagtttctggcaatgtggtcataatacttgtattagaaagcagtacttcatttgtttgttgtttaatgatttgtttataaagagaatctagcttctatgagctggtgatgcagcgttagacagattccttatttccatgctttgctttttatcctctgattctaatgatctccttctccactaaggcagaatcctaaagaagtagcatggttaatttcagttaaatgcaagggagcatttccttatagttcaaggatttgcccatggagtgggtccgaaggaaaatgagaattatctctaaaagcataccaaccaaatgctgtttgttccctacagattgattatgcactattttgccagagtctgtgattttctaaaaatgctatctgccctagggttctgtgaatgccatgaatattgttgatagatgattcttatttctgttttgttacccatagttttaagccattgagtaaaactaattcggtgagattgtagtctgtttaggttgacatttgatttcaggagtggattaacacaaatgcgttgaatcggcaagcatgcaaacctagcacatggcttgaattagaacaaatccgacagagcttcctgtcatcccttttagggagaatctcagtccttctcagcatctgtcaccgttacttcaagcacacctatatatttcaggccagctcttttgagacaaacaataaatatctacctttttaaggcaggaagtgcttggttattcacctaagctgttgtcatggagttctctgagtttccactaatacctgaggcctgatcagctgtgctggaaaagaaacagccactcccggggcatcaaaagcctctttatccagagactccattccctccagtatccaactatttagtacccactatataccaggcactaggcaggagactggtgcagctctgccctaaagattcacagtctgagtggagagggaagtggggacacacatcaaaagttatgacagtgcatcccagcaggtgttttgatagatgtacacacaagctgccgccgtggaagcaaacaggagtaatttagtctgcttaggagtggatggggtggctataaggaaatgctgctttgaagaagcaacatttgacctgggttttgaagtttgagtaagagttcatcagggaaccataagtgtaaaggcatggaggtacaactattatgtacccacaaaaactaaaaaaataaaaggcatggagacatgaaagatcatggattaggacaattcagaattaaaaactctgtttcccttattacccttggaataatgtgcttaacatagcaatttttttttcttctttttgagacagagtctcactctgtcacccaggctggagtgcagtggtgcaatcttggctcactgcaagctctgcctcccgggttcacaccattctcctgcctcagcctcctgagtagctgtttacaggcgcccgccaccacgcccggctaattttttgtatttttagtagagatggggtttcaccgtgttagccaggatggtctccatctgacctcatgatccgcctgcctcggcctcccagagtgctgggatcacaggcgtgagccaccacacccggcctaacatagcaatcttaagtctcccctatcagtatctgtggaagggatgaatactgacttgaattttagttttctattactgtataacaaattaccacaaatttagcagtttcacacagcattcatttattatttgagttttccactgctcaggagtttggtgcggattagtgttcaggtgctgaccagaggtgtcgtcttggctgcagcttgcgtcctcttccaagctcgttaaggctgttggcagaattccatttgaattatattgtaggactgagttccctttctcttgctggctgtcagccaaccaaagcccctctcagctcttagaggccgcctcaggttgtaagccacatgccttctcatagctggaaggagaatatctctttagtcttctaattataatgtaatatgatcctgggagtgactatcccatgacctttttcggataacaagggactgatatctcattatattcccagcaggtgggaatcttgggagtcttcctagaattgtatactatagctaggatgaaaactaacaaagaaaatagtccaaagatacttggggcaaaaacaacaaaataaaaagcctgggtttttcccagtctgggaccttggcattgaatttgttgggtggtctgatcatttattcatgtgagttagttattgtttcacctcatccatttatttgcattatctttgctcacactccctgatgctaattccctctgacagacacatggagtatcttccatacccttccaacattgattttaggattttattgtgaagaaccaagttgggaaagtttatttttaattgttacagaaagaatatacataatatattatcatattttatagtaatactgtattctggtgtgaatttcaaatacacttaacatggtgcttatgagcacaaaccattgtcagagacacccgaatttgaatgccagcttcatcatttattactaatatgaccttgggcaagttacttaactcctataaccttctgtttagcttaggggtaggatttaaattcacttacttgtaagcaggtaatgttccagtccacagaagcaaaaataaagttttagcatggataactgtgctacgatgaaataatttctaaacaaatcatcatcatcatcactttagataattactggatgttaagttccttgcaggcagagttgttcactgcccaacacatggtacatagaagacaaatatctatcttgtctacttaaataaattaattgtatgatcaatggatcttaacaaatgtgtatatttgctctcaaatatagaattataaattggccttttagtataggaatatagtatcagtataaattaatgttaggtcagtgaggtatcatatatcccattaaaaaaaacatatcttctttgattccatatcccttctagttactgttccaattttctgctgcctttcacagcaacctttcacagctgcctttcacagcctttcctcacatgccaattgtacttcttcacctctcattctctcctggtccattgtagcccactgttctcaccgctcattcattaaacctactagtatttattgagtgccaggcactgttttaggtactgaggaaataaacgtgaacagcaaagtagcagggcgaggaaatgtagtccttaaataaacaaataagtattgggctttccttttttcctttttttctttacccatttgttagtttcgtttacaggtttctctggcggcctttaaaagttaagttctccagggctcagtgctgggtccacttctcttatttccctcaattctctatctacttgatctcattcattctcttgactctcaatccatttcttggctggtgactccggtgtttgtatttcagcccacatttctttcttgcatatccataggcttacactaattgctaaattgccaggtttcgatcctgatttctcaaaccaccaccttccccagcctgtttatatcagtcttttctgtctaaatgagtagtgcccctgcttagccatatatgcaaactaaatacctacagtaacccttgattttctccatcacacttcatgcctcaattttaagtaatttatttcatttttatctctaaaatccatgtgcaatttcctgtctgcttctctctagctctactccaaacaccctggtccaagataccatcatgtctggcatggagttttgaaatcgcctcctaactcatcttcctgcttctattcttgatcccttttcgattgttcttcacaggaagaacaggagttaaacttttttcaggagttaaacttgaaaagtttaaaccatattagtgtcatctccgtagttacaattccattggtggcttcccatcgtaccctgaataaaaataacccttcttgccatgacctacgaggatccacagctccagtcaatcgtactccctactttgttccacgcattctggccctgagtcacaccggcctcttcccacctcaaggctatcaacacattggatgggatcaacaatgggaggctatcaacctcccattccttgtgtagcgagtttcaaagtcacccactcagagagggctgcctgactgccctgtctgagtagcacccccctacattctctgttgcagtctccttttttttttttaaaaaaaaaacagagtctcactctgtcccccaggctggagtgcaatggtgcgatctcggctcactgcaagctccgcctcccgggttctcgccattctcctgcctcagcctccccagtagctgggactacaggcgcccgccaccacgcccggctaattttttgtgtttttagtagagacggggtttcaccgtgttagcctcctgacctcgtgatcctcccgccttggcctcccaaagtgctgggattacaggcgtgagccgccatgtccagcctttttttttaaagctccatagcattttttgtcatttataatcattgtttgttttcttgcttattgtttatctctccactggaatgtaagctccatgaggctatatctgcttattaactgcattatattccaggcacatagtaagcattcagtaaatatttgaggaattaatgtataatatcagggggaaataaatatacctaatggcaataagtatgtaaatactgttttacatctggatctgtcaagactttctgccttttagttcaaggaaaatattccatttctattctgtttttaaaaatctctgcctagaggttcttgccatgagcttagtgataatgtggtgagcaaaaatgtctgttatctagaattgactatgactgtgatcaccatggtgcaaggtttgtgccctttgtacagcgcctaccaaggagctagaaggactttttgcagtcctgggactaaaccagcagagggccaactagactagaagtttattttggaagattcctgaaccctggtagccagcctcctggtcgttaatagctttaagtggtcgctggggtagaagcatttgccaaaacatccagagaggattgggggttatgtttaacttctccgtgggcgccttaaaaacagcttggtaaggagcatctttcaaatgtgtaaattcttagtccaaagcaaataaaaacacaaagacaaacagggacctacttggcattacatgaaaaaaaagagtgtgtatgtttatggcagagaactcgggttaacccgtagccgtactattttctagctatgtgtaatcctggcaactttctaagcctagttctctcaaataaaatcggcccaaataaaatgggcttgtctggttcgagttggtgtttgaaaaataaaaataaaataaaatggggtttccagcccactcttacatgcaatcagtgggtgccattagtaactgaattgcaggccttcctcctctcactttgtggattatcaacaacatgttttcagtctttaatggcttaccccaatcttatttatttatttattttttgagacggagtcttgctctttcgcccaggctggagtgcagtggcgggatctcagctcactgcaagctctgccctcccaggttcatgccattctcctgcctcagcctcgcgagtagctgggactacaggtgcccgccaccacacctggctaatttttttttcgtatttttagtagagacggggtttcaccatgttagccaggatggtctcgatctcctgacctcgtgatccgcccatctcggcctcccaaagtgctgggattacaggcgtgagccaccacgcccggcgccccagtcttatttttgattactcatcagttagcaatacagttcagatatgcttcagtgcaccatatatttcagcagtaaccatcttctcccaagcccacggttgctcactggtctccaagacatagctaaatggctactgttgtattatccccagaaacaaataaagccaccaactgtccaggggactgattcggagaaccatgtgctgtgagatgggagctcttgggagttagaactggttgtgccagctgacactgatgatggccttggatggccttggatgaatccaaccagaaaatgtgctttcgttttcagaacattaacagcttcaggtaaaagataggctgctcagtgccagctgttcattttccccacagttctaggccaccagctatctagcactgtgataacaccagttatctagccattaagatagaaatgtataaacattagcatttgatggctctgagtaattttaaatccatattgccaaacattaaaatacccacgttctgccgggcgcgatggctcacgcctgtaatcccagcactttgggaggccgaggcgggcggatcacctgaggtcagaagttcgagaccagcctggctaacatggtgaaaccccgtttctactaaaaatacaaaaaattagctgggcatggtggcacgtgcctgtaatcccagctactcgggaggctgaggcaggagaatcgcttgaaccctaaaggcagagattgcagtgagccaagatcgcccattgcactccagcgtgggcaacaagagcgaaactctgtctcagaaaaataaaataaaataaaatacgttcttttttataacactgactgttggacttcaaatttttcacttagaaatagagacccaaggttattttcttaataaatatcaagtggagaaagagtcctgtggatgataggctacttgaagaggcagatcctaggagcctctactctgccaagctttggccttggtaaaggagctgcagtgcctccgctttgccacagggtggcaacagttgcttcccatttgaggatggcggggtgaagcaaaccttgaactgtaggggacactccgtttctggctagtctctctctgcagttggagaaagcagtgcagctgactcttatgtgtcttgactaaaatctgtttctaggttatcctcaccctggaggaaccaatgagaacattgggcttgtaggccatctatgaatggactgggaccgcccaatgggcccatgcctttggggttgcattttgtccaccttgaacttcaatccttaaagtctctggatgattttcagtttttctctgttgagcaattgcatggatagtaatgagaaattcaaaagaaacggggaggttctttttgggaggggaaaaggataggaaagatgaacacgatgacatgtttgtgtatgtttacagtgtcctgggtatccagaaggcacttagatgtatatggcacaggagagaagtctgggagaaggaagggtttcagagtcatccccgtgttagtggtggctgatactgtaggggtggatggggtcaccctgggtgggtattgagaacaacagggcacctaagacaaaggccaggtagatgaagaagaatccacaaaggaaactgggataaatcggccagaaaggagaagaaccagaaagatagagtgtaatgaaaacaaggaaatagtgttctgagaaggggcagtggttaccactgtcaggatcagcagagaggtcacatgaaatagtaaaaaccactgggtgtcaagtgttcactgggggtagcaacacagaagttactgctttgtgggggctttgggcagagccggctctggggagtagtgggggcccaccatacctgcagggcattgaggggataaacaaggaagaaatgcaacgtataaatgtgttcccagaatgtcaggtaaaggggagatgagtaatagctgtggaaggattgggggaagggtgaatgatttagagctgaggacggtttctgttaaggttgttttaggatgtgagaaattgaacttgctgaagtgctaattgctaagaaccagcagagagggagagttgaagatgtgggatggggagcagcaactgaggaggtgggagaggatgaggactggagcacaggtgttggcctgtgtcttaggtctttccttcctccattggggaaaaaggaaagtggcaaaggtgtgctgggatacagagctttggaggttttggcctcaggtgtttgcaagcactgtactaattctagccaccttctcaattaaaataagaatacaagaatgaaatgcagtctcccaaatctcttttctttgccagcttatacatttatacacctcactgatatgtcttttgatgttttaaaattttggacagcactatttttaacttttacaactataactattagttatttactagttatagtataaacttttaatatttactttttataactcctagatgtcttgtagatcaaaagatctaaagtgtcatctttgtctattttatatcttgtttaatagtaataaatgttttagtgaagcataaacctagaacaaaaatagaaaataatcttaatagggtgttggggaattttatgtgaacacttcatgtgtctttggaacagtacaatgtaaaaaattagcacagccttattgcatgcacaaaatgtgaaataatgtgaatcttccccaaataacaatttgtcaagaatcacaatttcaaagtagtaggcttagtaattctaaacagtgatcggtagaatctgtcatcatcctcaattaggattgttcttgaattttgtgaattttcaatcacgagtgagatctttagtccattccttaaataacatgtgactatcttagaatgtcaaagagggacacagaaaactagataacaactcctgaaattaagtttgctgtatggcaactactaattgctctgccagttgtctgactgtagaataatccttgtgaaatattcacttctatatgggttggagcctgggtaagtctgagccccagtgtattttcatggaagtcactagaaccagatgtaaatcctgggttctctagagaaacagacaaacagaaccaatagaatgtatagagagacagacagttattttaaagagttggctcatataaacgtgggggctggcaagttgaaaatttgtaagacagactggagacttgggcaagagttgataattttgagtctgaagacagtccagaggccgaattatttccttttcagaggacctcagtcttttctcttaacgtcttcagtgattagatgaagtccacccgtattatagagagtaatctgcttttcttaaagttcactgatttaaatattactcactttaataccttcacagaaaaatctagtgttggcttatgatcacacaactgggtactataacttaggcagtctgacacatgaaattaatagggtgttggggaataaaattaacacagctgtcatcaagcctccatttcctaaggaaaattattataatccacataaatatggtattttgcttttgaatctctctaacagagtctgggtctcaaattgtcttcatgcacagtgtcatgcttaccctcacaatcacttactggaggcaggcaaggagggtgagtattccttgccaccttttacagatgtggaaaaagaaactcagagatgagacttatctagggatacagcttgtcttctggtctgttcaggctgctataacaaaaattccacagactaggtggcttaaataacaaaggtttatttcacagttctggaggctgggaagtcaaaaccaaggtgctggcagattccgtgcctggggagagactgcttcctgattcataggtggctgtctttcattgtattcacatggcagaagagatgagagagctctctggggcttcttttattaccatcacattggggattaggcttcaacatgtaaattttaagaggaacacaaacattccatccatagcccagctagtatttgtgggatcagagcctgagctggaccccggtgttttcctcttctgtctgtccagcacatcacactgcttctttggctagttgatctagttaattataggtactgtacagatgcagaaagtgttaaaccttgaccacaaggtttatccttaaggatgatcctcactcctgggctcattgttgatacttctttgtatttgcttctttagcctcattgtgaattggcattgatgatgaggaagagcttgccttcctcactagactgagatttgcaaatgcgcacacagtatctgcctcgctttttgtgtctgtagtgcctagacaaggccaggcaaataacacccactaaatatttgttgaaacaaccttgccatatttgctcccttgaaatagccattgacctctgagacaccagcaagtgggactcgtgttattccagtcaagattatccagccttcgcaacatgtaaatatatctggagcattttgacggtaataacctaaaagtcaccggcatttctcacacttggtcacttaggactgcaatttcctggaaagtgctttaaatatttctggagattgccgggcatggtagctcatgcctgtaatcccagcactttgggaggccgaggcgggcggatcacagggtcaggagatcgagaccatcctggctaacacggtgaaaccccgtctctactaacaatacaaaaaattagctggacgtggtggcgggcacctgtagtcccagctactcaggaggctgaggcaggagaatggcatgaacccaggaggcggagcttgcagtgagccgagatcgtgccactgcactccagcctgggcaacagagcgagactctgtctgaacaaaaaaaaaaaaaattctggagatcatagagcaaacaccatatatgatcctaagcaaaatgaattggtccacttccgtgggacagttacccattttccccttttcctccccttgtccccttaagttcggcaccaccatgcccttcagctatgattgtctcccattacagctggtgggtgcccccaagctatgcagcctcagggtgttctgttgtagtgggtgctgacttgggagggcaacgggaaatcccctcagtgtatgctatggtctgaatgtttgtgtctcccccagatttatatgttgatgcctaatccccactgcaatagtaataaaagatagggtctttgggggtgattagaccttgaggacttcacccttacaaatgggatccatgcccttatgaaagaggccagaggaagctcatttgccctttccaccgtgggagaacacaggagacggagccactgtgaggaacaggccctcaccagacacagaatctacaggcactttaatcttggacttcccagccccacaactgtgagcaataaatttcagctgtttgcatatcacttggtctaaagtattttttacagcagcctgaatggaccaagacagtgtgccttgatatccctaaatactagagattttttagggaaacatagctttattttttttgcccctctgccccacaactttctgtaggattcacatgggggtgttggacatggagacaaagctaagcactgggaaccataggttctaaaaatcccaacctttccattgaccactaaggcattatttattgtctggtgccttgcagttggcaagccgactcctctttccttcagtctgagctttctcctggaggtttctaagttcctcatgcaaataggcttctggcagatgtcctctcagacatatctgttcaaaactcagagtgttcaagctgggaccttgtttcacgtcatctggaaaaagagggaggcaacaggaagtgtgctgagtcgccagggaagccacaatcaacaatttcccacaggtaattgacaaagtggatcaggcacatgtaggaagtggaattgtggtaactaaattttatatattttatggcttgcagaaatacttttctatattctgtctcatttgatacagcctttaaaaaggttaaaaacgtttatcattgcccacaatcacaccgcttaagctttacgagttaaatgtcctgttggcaggacagctgtgttaggtttaaatgtatctccccatccagctgtcttctatcctggtagactagtacaatcctgtgatatttagctgagaaactataatgtgctgggagtcgtggtaaaccacatgtggatttgggtggatggtgtttcagagatgtgccgcttctggaagcaaatgttctgacaaactgccttcttggaaccaattggtgcaaataccttgggcaccacagttcgtaaagagaactgtcgaaggcggctggaagggtttagcagaccacaatttcgcaccgcaaatataactgagcatgcacttttgaccatggtgtgctgtgtgatgttagtagaggaaggggcactggcggtggaggctgggggggacttggtttgtacagcatagcaggaagagcactgaggcaggatgcccaggggttctagtcctagctcagaccagctgcatggcactgaacaagtcccttcagttccgcaaagtttagcttcccaatctaaaaatagagataaactgtccagtccatctcacaggtttgacagggcagtcaaattaaataatatatataaacgtattttggaaagtataaaatggtacacaggtgcaaagcatcattctcatggtccttaattctttctttcatcctcctgtatatatatatatgtatgtatttccaggtgtaagtggctttgggattggaagatagtcatatctttcaatcttaagtttccttcacgtggcctcagaaaactgcccccagtagttgcatgttaaactttgccagaatcagtttcccacctggccttaagtgctctgctctgtattggtgttgaccttaggcgtgagaaacatgtgactgtaatgaggatggatgctttctaaaagctcataaatagcaactttttcatactgaaatttgctctgttccattcttgcccttgtgactttacagatgttgtattctgccatgaaataggttatagaagcaggtttaaagtgaaggagactatgattcagctgccaaaccaaaagtgaaacctgtccatgtggatatagcagatgtcagtggaagaaaggtgtgcagaattgaaaagcttgctctccgtggtttgagaacacactgtcctcttgtgggcgtctctggcagcccatgatcggtacacttccttgaaccaaatagcctatcaaaatattatctaatacatttctacttttatttactcaatgagtaattactgagtgcctactacatgccaggaactgtggccctgatatgtttcaaaacccataaacatgcatctaacttatttatgtaggatctccatcaggcactatcttcttttaacctttccagtgaaggttaaactctgaccagaggaattgagcgtgtttacagaaaatcaggaatggaacagaattagactgcttttccccttacttcccactcccttacagcatgttccattggtacttgagtctagaggcatccagaggtgtaagaataaccaaacacaacaaagattaggagtaacgaagtgttttcatgcagtgccgcaccccagtgaggtgggctggctaaaaggatgtgatacaaactgatatccagggaatggcaaagaggagtagctgggcctgtccatcatctcttatcatgactcacagcccttgtttaaggaatttgaagtctaggtggatgaaagggacatcaaacttaaaatgcatagctgcaacctactagatagaagctgagaaccctatatgtggatcaggcagtcactactggagttcaggaggggaataaggcattggcccctagagaagacatcacagatcaaacttgagctagacttccttgaggacgggtaggatgtagatgataaagattcagcttcaggcagtaagaagtgaaaagaaacatactttttaaccagtatgtgttgagtggagggtggttatggggaagggagggtggcagggaaggctggatgcatttaaggctgtcgccaagtttttctgcttaaagagcatctgggcacagtggcacatggtctatattactcagggccctaagctcacctgagaagctccagcctcccttctgcaccttgcccacagaatgttctgtaacacttctctgtccttgcagataaataggctgccccaaatctagcgataccctcgatggtggcaggggtagtagcagtggcattggatgggacggtgggttggatatttccctttgtattggtcaaatacatgcacagatggcaccaacaccacggggatctctggagatgaaggtaggtatttcttcagtcactcagcacttaacaactgtcagagagggccgggcgtggtggcttatgcccgtaatcccagcactttgggaggccgaggcgggtggatcccgaggtcaggagattgagaccatcctggctaacacggtgaaaccctgtctctactaaaaatacaaaaaattagctgggcatggtggcgggcacctgtagtcccagctactcgggaggctgaggcaggagaatggcgagaacctgggaggcggagctggcagtgagccgagatggcgccactgcactccagcctgggcgacagagcgagactctgtctcaaaaaaaaacaaacaaaaaaaaccaaaaaaactgtcagagagataataggagaaatgtgcccctgcactcgcactgcacagcatgtgccggatcatctgtgaaatggatctttcctctgggagctccatcttttccaggtgattgttcacttggacatatttgattataagctcccagagtgtcagacacggacttctcatggcaagttagacgatcccaggtgcccagtgggtggcagtgcagtgagtggcaggaggaaaactttcctgctggcttttggtctgaccaagacagagtgatacttatccagggcctaaaataaccatagcaataggccttgccagaagggatctgtggcaggctcctggcactactggtcagttcccccagtggcctgttcaagtttttctttgcatgagacagaggttatggctgaggaaacagccaggccaggaggctagcctgccctgcagaagcccaggggaccttcctgatgccatctttctggtatgacagctcagcaggcctgtgtcaacaagccctgcacggtttggacaagatgtgagtgactaacgttttcctctggagcagcaggaatggatgggcctgctgggaagaatccctttgctgtgagctacctaagacgcctggctcctgaattgaaccagcaggtcccttctctgtatcttgcttgctttcctttaaaaaaaaaaaaatcctcagcagatgatgggaggaattatttgctgagtttgtccagactctgaatagcccttggtcactgaagtgtgcaaaaacatggcaacaatgcaggtgctatggtctgaaaatgtttgcaaaggaaggagaggaaagagcagttattctgacagtaaatgatacataatactaatattggaaggattattttttccctgtgtggtcagtgaatagaatttttggcagtcgtctatcatttaactaggtctgtatagagcacactggagcctggtaaggacctctggctttttttacagtcagagttttggtgcctaggggtctgggctgtggacaggcgagatgtacctgcaggcagggagtggtcagcttgctctcagcttgccagatccgtgactctgacgagagagttatcagtacctacagagcttcctcctgcagcctgcctacccacccaggccatcttctgacactgcctcaatgtgtccatgctccaggcaggtcagatcacctccctcattcggtttggacatcaaggagactgtgtgaatgaccatcagcctctctccagtctacccaaaggtatcaggtatccagcactattctgatggagaagcagtaagagtgagcctaccttagatctattaatagagctcattcagccaaggaaaaggatccaactaacccagatgactacatgagcctaggtcattcacatgtagctttggtgagtaatgagagatgcacgcatgatacccctgctcctgtcctttggtgccctgcacccctctcaggtgctctccagagtcagcccttctgactgcagggcagaccccaaaaggagatcagcttttcacctcgattacccctagtacttaagacatttgccttcatgagtttttggtaatcaatattgtacagccagtaatttaattttttcatggtatcaatctgatattaaagctctagtatctgggaagagcacagcaaagcttacctgactgactccactattatatttggaatggataattgagatataatttaaagggtagaatatattctttctataactgcaaaagtttgctataactcacaaaaggaaatacaaaattgagtaatagtgttggaggagaaggaagcaaatatttattttgtatctactatgtgccaaacactttatgtattgtattttgccctcagaaatcatatgcagatgattctattttacaagggaaagttgaggtttagagcaggtgagcaacatgccaagatggaacagaaggggcatagaacctggattcaagtcagagcagggtttacaccctcggtaccatttagatgtgggtcagataattctctgtggtggaggctgcatccctggcctctacccactagatgccagtggcatttcccccatttgtgacaacagaaaatgtctccaggccaggtgcggtggctcatgcctgtaatcccagcactttgggaggccgaggcgggcggatcacctgaggttgggagttcagagaccagcctgaccaacagggagaaaccctgtctctactaaaaatacaaaataagccggttgtggtggtgcatgcctgtaatcccagctactagggaggctgaggcaggagaatcacttgaacccgggaggcagaggttgcggtgagccgagattgcaccattacactccagcctgggcaacgagcgaaactctgtctcaacaaaaaaaaagagaagaaagaaaacatctccagacattgtcaaatgtcctctgagggtcaaaatcagacccgctgtggagacccatggctctagaggctttgttttttctgccatcacacactcggagggaaatttgggggtaactttaaggatgctatatggataacttatgtttcagtattttttcttatgaagataataaaagctgtcgtggatcatttcgaaaataaaataaagattgtttagaatcgtaccacctagagatacccactttcagcatttggctatgttttcttccagtctgttttctgtgcacacataggtagtttttaaaatcatacagtaaatcttttatctctttttatacttaatattatatcaagaacctatccctatattaaaatcagtgtaattatttttagtagctgcattatatcctattatatgtttatgcctcaatttactcaagcatttttgcaaatggccatttagagtttttccagtttatcccatcataaacacagcttcaatgaacatatttgtgcataaacgtttgtgtacagtcttgataaattctctggggtatatatttctatgaaaagaagaataattgggtcaagctctgtacctattgtttaggctgcatttcctacatactgtcaggttgctttctgtaagtgttggacttatatggctgtgctttctctctcacttgtttgtgggtgtcttgtctcacttgttaactataagtattaactttttaaagtattttaatttgataggcaaaaatggcatttcattgttttatttgtgtttatttgatgaccaatgaaacagaacatctcttcctattatatagctttttgcttttcttagtctctgaaatatttgttaatacgatgcattgcttctttattagatctaatttttgtctatccactttaagatttgtttctttccattttcacatgtagacttaaaactacagttctttaagctatttagcagcagtagaggaagacttgaggcaagttggaggagagatgaaggggagtgcttttgtataaattggagatcacctcaactatagaattaactgagccctgaagttggaagaagagggaagaatggcgagagaggaggtagtgcagaggtgtgcggtcaggatttcctgtaatggccaccaggtggtgccatctgcccgggacgatttgatgtctctggtgcaggagagcggagagctggggagagtattaataaggtggtcacaagcgaggtgattggagtgccattcatacatgtgggacattagttgggcctctgtaattaacctgtcaatgatcatgagttggtgcacgtgtgtttgtgtgtagagcggggaagagaagattagggctgttaaaaaaaaagaatatatatatatatatatatatatatatatatatatatatatatataatatataatatgttatatatacacatatgtatacatatatacatatataacatatataatatatgaatggcagctttattgagatataattcacatactatacaattcaacaatttaaagtatacaatgtaatggtttttggtatattcacatagtagtatcaattttagattttttattgccccaaaagaaactccattccccttagccattccccccatctctgcctccttactccttccctcagtctcctttccccagaccctggaaaccactactctactttctatgtctgtgaatttgcctcttctggacatttcatataaatggaatcagaataggtggtcttttgtggctgtcactgcttgtcctagccaatgctataccagcttgactttgtggcaggaggcatcagggtatccagatagacttactgttttaaaagaaacagcatttccaggctggctaggacagagaaaactacgtagaacaatacttttcctacctggtggatcatcagaattacctgggaagcttaaaatgaaagattcctggcccctaatctctccaggaattcaaatatggtagttccagggagtctgagctgcttgggatttttttcagtgccaccagtgattctaatgattgtctagctgtaagcagtgggactcaagttttgaacagaggcatgagaagaaaatggcatttccctgcagatgggctgtaccagctgcagcttcaagtccagtgcctcttgtgggaaaggagccactcccttgtcattcgccacatctacactgcaacgctggtttatgtcagactatcatctttgactcggcatgacaacagtgcatatttgaaggccatcaaaccaatgatattagccttgtttacggtttagctggaaaatatctcccatgtggtatagtaagaagagcactgaatttgaattctgaagctcaccagagtgttccactgactagtctcagggctactgtgagcacccagtgagagtggccatgagaggtgacacactgcacaagtcagggcactggaatcatgggacaagatgggaccttagagaatgtcttgtctgcctgcctcatttcatagtagagaaaatgaggccctgagaggtaaagttcttcactgaaggtcatacgccagctattagtagtgtagccagcaccagggtgtcctagcctttgcctccttctgtttctcactgtgccctccttccctacattgctctcttttgggatctgaggaatcatattcaatcacctttcattttcagaaatgaggaaacccaggcctcgtttgtccatggctacaaaactaattgatttatatttgctttggatgactaggagttaaaataatgacaggtgaaaaatccaagatggcgtttgtataccgcttttaagagcaatccacagcagattcaagttttgtgaggcctgaaactcatgcaatttgaaaacttttttcaagaaaaataacacacaattgcaaatgaaaagttaggttccaggccttggaagcagtctgcgcccatgaggggccctcattcacttcactataaatccacctccaggagcagtaataaagagatccctactcatgtttgtgctgctaggttcttctgtttgtataaatagcatgtgtcctgctaagtcacctccactcttataaaatggaggccattctgccaacacatgtgtattgaacatctctttatctgtaaggaatacagaagggaaccaagaaaggaaactaagctaccatctctaactcaggagatgaggcacaaaggcagaatggaggaattccctccctgctgtggtctgggccagggtgcctatgggagcccagcctctaggaggtctccagttttaatctcagataatcttcctcttgtagtcattcttctccctctgcctatcaaatgcagatgttgagatgagtaaaccctttggggtttttggatgaaaaacttttcaagatttacatgacatttttggggttgtgcctacccaaaaaagtcttatatctcacatcactgccttagaaatgaattaaaggtgcatttatccatcagggccacattcccctaaaatgcacctaatagcactgaaacaattagaataacacagggatcctgaataatccatgcctcttgtcaagaaatttttttctatttttatttttgtaaaacagcttccttatccagttgtgtttagtttatttaaacgatcacatcagcattaggttctggtttggggtttttttttttatttgtttgtttaagtctcgtttctgacactttctgaaagatgcaacatggagataggccaggagggaaactagttttagggtgttctcattacattcattttatgtcattttttattattaggtttacattattgaattcctgtggagaagaggagtcagagctgtgaataagtcataagtccctataggtaaaatcaagtactatttgtctctgatcaaaattgccctttccattgataggagaaatgactgggcctccttgtcatccagagttcattttgtttttcgtggcagtttcactgtctttgggaattgagctttttgaaatgttaaagcacgagaagcatgaacaccttggcagggtttgcagtatctccttctagtgcaggatggagggctccagagctggcaatttgaggaatggctggtggcttctgatgtcacctgccactcatgtgtccctccctgttttgaatcatggatctcaaacatcctcaaaagctcttccctggtaatttcaaaactctgaacaaatcaatcctaagaaaaaataaacaaacatgcagaagagcagaaggatatttaggatatggttctaattaaaatttttaagttttcctttttcaaaatcctgtatgagctattaaatagggaaaaacaaacttctgagtaggaaagaaataaaggccattacccttagagattttgaatcttacaataaacaaataggtcttcttttccccgaatgtttcttcttatcaacacaagggagttgagtgatggctacagctctaaaatactgaacatggctgcctactgaattcagcatacatacgtagggatatgttacataagatgcacatacatactttatttctattagcctgtgaaacagtgaacatgcctgctcttataaagcttctagtaaaggaactacaaaagaaacacatctactgggcattctcacactggctgaggtaggttggaaccatctggattcttgcctgtggcatagttaacctcgtgactatccagttttccaattatccaggcccatttacctctgctcccactcagcgagccctttggctatttctctgttcattggcacctaaagtcaaggagaaagaaacgaacatttattaagtgctatgtttgtaccagttaatcttctcaatgaagtattattatcacccctgttttacagagaaggaaactaatattcaaagaggtaagataacttgttcaggaccacatatgtttttaagtatagagctcatgcattataaagtgaccaccctagctaacatttattaagcacaatatttgccagaattcttgcaaaaagccttacaaggactattttattttatcctcataccaacggcttaaggatggtattacttaagtattcttgttttacagatgaggtcatacagctaaggtgatgaggccaatattcaaactcaagcatctggattgcaggctgcacttttgatcgccatgtctagcctcctctatacacctgctctgaccgatttggtattcaccacgcccaagaggctactgaacacctgaaatatggctggctggagttgtgatgtactctaagtataaactacacaccctatttggaagacagtatgcaaaaaagaatataaaaagtctctttggcaattctttatatcaattacatgttgaaatgataatttggatatattgggattaaaaattatttaatttcactatttctttttactttttgaagtgagaagactagacaatttaaaattacaaatgtagttcatattctatttctatagaacagcactgctatatactattttaaaataatatataaaggggactagaactgactcaggccaacattatttttcatcaatagttctagttaaaaatttggttggaagtgggtggatgggaaggttgaagcccatttttaaagataagtttggtgtttttatgaatttgagttatgtgtgctttcttcacccgttttaccatgtgtgggtaagagacttgccatttttaagaatcagaagaattctgtgaggtgtatttccagtgtctgtgtgtagtgctgcagctgtctgagcgtattgccggaggcacctcctttggactttaaggcacgaattgctcatcactgtccacacagctttgtggccgcctttgagtctatctcttttaacataacattgagttctggctccaggtctggcacaaagttgataataactagtgaatactgttttgtttggtttgttgtagttttattctttttttttttttgagacagagtctcactgtgtcgcccaggctggagtgcagtggcacagtctcggctcactgcagcctccgcctcctgggtgcaagtgattctcctgcctcagcctttcgagtaactgggactacaggcacacaccagcatgcctggataacttttttgtatttttattacagatggggtttcaccatgttggccaggctggtctcaaactcctgacctcaagtgatccacccgcttcggcctcccaaacttctgggattataggcatgagccaccggacccactttattcttaatacctattgccaggcagaggttacatggatataaaagagagaaattgggaatatttgtatgagatgggaaaccacaggccaggaaagcattaccaaagggttgtagaggatttagtctgggcccctccccaacgtacacaccacgtgccttctcctctcgaggctagaattaaccctcaccccaccaccagctgccaaaaaatagtagtagctgctgggaactcagaaacagaaaagaattttctatgagattactgtctaaaacaaatgtttattctagccatttataaagaacacttatggatttacagcagcttaggatagtgaaaaagaagtagaggaatggtaattaattcaggtacgaatttgtaaggccaagtgagaatcacgttccttgtcgtggcccaaaaggccttgtcagactcagatggagtctcctcgttttagtctacagacatatgggtggaagtgacatgatggaataattacattcccaagccgtgtacccaaaatctgtgctaggaccactcccctggccagtgcggaaccaggtcagctggtggaaggggctctgaatgggcacagcgctgccaggccctgccactcccacctcatcccatccagaatgggtccaacacagttcctgctaacccttatccacacctcctcaaccatagtccccagtgacctgcttcctctgtgaagcccaggctgactggaaggtgaccctcaacagaaaccatcagagagctttgggtctggggcggagggtcacctccactctcacggtggtgtcttggtgttaatgtcatctgttggctcagccattcattgcttctctcttccctaagctcctgcagatctcctttactcgtttcttaagtgtaggaagctatctccttggatgctgggtcactaattataaacttcctatgcatttacctggctctggtttggcccctaatgtctttatttctgcctgcaggattgtcattgccattgccccttttccttacctgggaacccgacatactctgcttatcccttgagctggcacaccagggggcctggaattcctgttggtgaagtcactactttaagagaattatcccagaaatcctctaagttgcaaatcctacaggagcagagtactacatgttaattagcactcattatcatgttagtagagaagcttacccaaaggaatgatacataggacctgctatgtcattgagaacagagaggtggggctcaggttctggacaaatgatgtcataagtaagtgtagtttcagaaaggaagatgaagtgggagctttagataattggaggcggtaggcctgtatatggaaccagatgctagagagcccaagtccatatttttactttttcacagttttgtgtccatatcctcaccgaatcccaaccaccaccaccacagttctatatcccgttattttttcaataataactgatacctcaacttaagctccactctgaccctcagctaagccatataatttcagcaagaattataaaataaagtttttaaaggacaaacatgagccttaaccttagtataaagacatgcttagccttcatacaaattgccaagttgagacttcatttcagacggcaaataaaagttacatgaaggagctaaaagtgctattgcaaattacctatttgaaacggctttttcaaaacctgctaaattcacacctctcctaaaaatgcttcacttccagattattttattttggggttttgtgtgtatgtgttagagggggtggggtttgtggtgactacagaaaaattagttaaattcataggataaaatttgaacttttgcaaatgagtaaacagccaaaacaaacaccgcttcagaaaaaaaaaaaaatacacgttttctccttttggaaagcaagcaatgcttaagcaaaataccttaaaagttaactaaaaagcttttctaaaataaacaactctgcttgtgatcctaaattgggaccacatgtagatgtgaaagctacaaatgcagtgcactcagaatttgcgtctctgccttcactgtttgcgtgcctctgagtagatgatgataatgttggctttggtccccaaggagcctgagttttttagatcctagtatgagggggaaaagcagaagaagaaagagaaggaatgaaaacaaatgcctttcaagacaaaatatccgaatgggtttcattttgcttatctgccaacaggctcaacccaatttagatctctcctacaaggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgtttttctcaattaccaaatgctgtgtgctttgggggtcacttgtcatgtgagtttagagaatgtggatattgcaacataaaccctcaccattctaaacagcttaaactaaattctgttactagggaggagagctgaggtgataatatccatctctaagtataaactattgtgtgttcattttcccattatgggagacaaatttctcttctccgctagtgctcatgatctcttccaccaggcacaaacatcagatgtgtgtttatgtggacatattttgtcccctattattggagagcaagctccttgagagaagggattatgctgcctggatttgtaactttgttaggcaaagcatgactttatttagttttgaattgatgaggaggcactgatgttagtaaaaagctcaaatgtcctgagccctgttgctcaatacctcaaacacaggaccatgatcaccacaatgaaaaatatgcaggatcattaatttcggctctgttaattgtgctgttaggaaatgttgactagataggaaaagcagctaacgttcatggagtgcttattacataccaggtactgaggtaagcattttacatacagtatccgatttgtatcctcccacaagcatgttatccccgggttaaaaggggaggaattggggtccagtgagattgggaggttatgagaatcccacagtgtgtggcagaatgtggacttgaactcagggccctaacaacaggaagctataaaagcctctttgtataaaaagtgctctctttctgtgggtcctcagtaaatgaaaatatttgcttttcataaataggtttgaatgttgggaccctcatttctcaccaggagtcaaggccaaaaggtcttataaataagagtgaattttgagaaaggatgtgtgaaaatgactctgttcttttcttttatctcacttcagttacttgggatggaggaagcagaaactgggagtcagacatctaaaatatgaagttccaccctcatgttggccatttctttcagcctcctttccccattcctaggggccaatctgtttctccctctcctgctctttctctttgcctctgtcttcttctttcctgtggagacaatagcgtgtggtggaactgcctgagtgcttactgagaaggagaaaccaagcgcagattgtatagaagctgacgaatgagtcctctgattgtggacaagtgatggcgctttttgtaaaattgtgtatgtgtttacctcaagtagtgaaaaaaaaaaaagaaaaaacaacttttggggcaagttggaccttaggaaggagatttctgggtctcggggtttctcttagcccccagtgcctggtgcctgcggccggtgtcgcctcagggagtcccaggctgttctgtggcctccagaaggagccaccccgccccttcctcgccccactccgctttgccttcccttagcctggggagccttgccgcctctccaccttctctcctggtctcctcgggcgctctcgcgctggcaccttcagctctgtcagagtctgaggggaaaccaaaggaggccaggcggtgtctggaatgccccatccgactgcttcaggctcccagaccgctgacaaaaggaaaactggtccgtcgctttctgaatgatgtatcgagaccgcagtgtatttttagcatctgctgtttgtggtaacataagtgaaaactgctggacccgttcccttcagctgaatggctggtattcaggggcctgtgcccgctccctgccagacgctcctcacagaactccctttttacgaggtgggcgactggctccctggcaccaggctgccccaccacaattctttattgcccagcgccagtgcccaattgcatgaatccccagggctgcaggcagcgtgaggggtgcgaatgggacgatgctggctgcgggcttgtcagggtgttcccaagttgtgtggcagagtctggagggcaggggttgtccggatgttccaaacctccagcgtgaggtgggcactcaggtgcgaaggaaccatggtggcgaggcccacaggtggcgtcccatcccagagccattttgccggggcctggctctgcagtagtcactgacaccggagatcccctgagtgacctggaaactatgagagaccccaggtaccccgacaggtcattctactaactgtggctgtggagctccagctcatctttggaagacggaaacgcactggaaagggtatgaatggacgcagaaggcctcgtgggggctctctcagtgccactgtagagtgaacacagggctggaatccaaaatagcaccaacttgctgagtggctttaggcaagaaacctttccccaggtctcactttctcacttagaatgatgaatagtgattcttgtcctactgacctcactaggacgtttttaataaggatgaaagcactttgaaactgttgaaaccataacatcacaaaaaaaaaaaaaaaaaaaagagacagagtgacgaagtaacgcaggtcccatttatgttcttaatttctgaccaaccttaacttccatcaaaactgcttccactagccccagccaggagagccgttgcatcgtggtgggacatcatcaggctctccaacggacatcgcttatactatgagaactcacgttcaagggaggtgtttacctctaattcccacagaactagcgtaagtaaaaaatggggcagcaggatcctttccttgcaaagtgtgagcaagtgcctctgtagagtaaaactttaagtaaaaggactacaacggcagtgacagctcctttatctgaaactgcagacttttaagaaggttcttagcagccacaccgatgtcacaaattccataaagcaagatcacctaggcactctctcggagctaattttatctcattttatatataattttaataagcctggctctctcattttctagccccttattactgaaaatgtggctcatggaccagcagcatctgcactatctgggagcttgtgaggaatgcagaatctcaggccccacccttcaccttgaatcagaatccacatttggataagatccccgtgtgtgtgtgtgtgtgtgtgtgtgtgtgtgtgtgttgtgcgggggagggtaaaattagaagagacttgcagggcctaggcgcactctcaatttattgtatttcattatggaaaggatttgggatgactagaattaataacttagaaggagtgaggtgacaaagaacattaaaaactattgcatctgggaccatttaatataggtttgtttgtttgtttgttttgagacggagtctcactttgccgcccaggctggagtgcagtggcatgatctcggttcactgcaacctctactccccaagttcaagtgattctcctgcctcagcctcctgagtagttgggattacaggcgcctgcctgtaattgtatttttagtagaaatggggtttcaccatcttggccaggctggtcttgaactcctaaccttgtgatccacccgcctctgcctcccaaagtgctggcattataggtgtgagccaccgcacccggcccatttaatatagttttatatccgaatgccctttaatactctgagaatacactgttacaacactgtatagtcattgatattcccagtaatagtcccaaattatcaagaacaggcaaagtcatattctcctgctgtttaaagtatttacctaatgttcatagtggaaaattctcctttaaaatggttaaataaatcttgatcttaaaccgatgcttcagtgatctgaatactacatgaaacagcacgttctctctaaagagataagtgagatggtactataatcggaaacctctgttaattcggattttgttttttatgcacattttagagagtcaaattatatcaagataaaatatgataacagagatttactctaaaattaaacaatgaaaaaaaccctaccagtgcaacaaaaaggccatggctgttcagagccaagtaaaactttgggggtcagaaggtatttaattttcatatttctgtttactaggtactaacaactgatcttcaaaatcatagagacaggaaaatggatttgaaacccaagggagtttttaagtaaccagaaaagttagtgccctcttctggacaagcgatcattggagttgttagaggttgtccttgggagtgctgttgggggctttgttaacaccgaacaagaccatgagtggcaaaacttggagctgaggttgatcaggtctccaaggccagggagagactcaaaccaaccaggtcaacttcccagctgaattgccaacctcaaagggatacgtacagaagggagaattggaggcacatagcagagggtgagaatgcagagaagagcaggatgcggtcaaaagattggcagatttttatggagggttccagcacaggccaagaaagagatttaagggttctgactcaaataagaccaactgtccttctttctcattcccttgacaattacatctgagtgcaactttattgccatggcaatacaaagaaagtctaccaatgatttgatatctagagcttagaaataaacagctgcatggtaccaattttattatataaagcaaagtttatataaacgcaactgggcttaaaactcatttggcaagaattaaatattttccatttattctagagacatttttagagtgccatggctgtggtggaaacataaataaagcatcatcacaggacaggattaattaattgcctgaaataatttcaaagctgtaagtgaaagatcctatctttattaatggtattcttttctcaaatcagattttgaaacctcacaagcttttgactcatctctctcctgtgcactgctagaaatcttatttaactcatgttgcagccaccctaattccaatccttgtcacttcactcctgagtttcagcaacactcttagagaagaacttcttaatttctctccaacctagctttgtacaatggtctgttctctataccaccatctattgtctatactacaatacattatgttgggaatatatcttattatgtactactggcttattgtgttagtcatgggtaaccaactagaatgaagaacgaactagagaacaggaactatgtctttcacatttatgtcgtctatagcacctaacgtaattattgctacacagtatgttgctacagggagtcttccgtggcctagatctgggctagatacttctcctctacacaactgtgacacactgccgtatcctggttacattatcagtgcattacaactggctgtattacgtttgtttctttttgtttctctatgaactatgagagcagagcctacatttatctggttcatcactgaccctctagtacctagcccaggttttgattatatattatgtgctcaatgcatatttttagattatttgttgttggttagtgcagtaagatagttaaggaggctgggatgaatagaccaaatggcatccatagcatcatattattttgtttgacttggcttcaggtacaatagatcaatataacctaaatattataatgaaccagataactgcatttggccctttgcaactgtataatattaaaattattatattttctatacctgtttaattgtctataaaattctagctcctggagtgcaaaggacagcattttttacttctgcatatctccctcagttcctacctcagtgagtgtttcttgatctgacatcattaaatgcagtttaaaaagagtctgtgttctaatctgtctgcttagtgctaaacatctgttgcttcctaacaagtgctgcattcattttaatggcactggtgcacagaggtaaacggagctttggcaggccttccataagagaaactgtttgcttccttcattaattactaatggagcattaagacacgcattctgccttgagccaagttggataattcctggcacttaatgctagggtgctttcaaaagttgagacatgtactgacacaccagagagcctgccctatagcaagcacagtggtgtctatagtgccaacattatataaagcttcaaatatatcaataccaagtgtactgatatgtctaacctttgcatctattgggttaatgtggaatcataggtatccctacactagctctgaaggtagctatcacaaatgagctggatgaatcatcagaaagatacagaaaggttaaaaataaaaggataatcaaagatttaccaattaaacacaaatcaacagagtgagagtggcaagctaatagaactataaatcaacatctgatttatcaatttatatttagcagccaattgccaacacaattaaaatgaaacatttatacccttggatatgctaactagtacagcatcaaaatgataaaaacagtaagaaataagagaatgacagtcacttattgttagtagtagattttaacatatagccatcagattatgatagactagagataaaatatgaatatggatataaaaagaatataattataaatgttgataaattggctatatttagatgtttatgggttatataaaataccttatattacatattcacatggaaattttacaaaaataatatggtagtttacaaaagaaatagcattttttttaaatgcagatattttacagtttctctcattacaaagcagtgacctagatctgggctagatacttctcatcattctcattacaaagcaatgaaatataatataaatgtaaacaaaacaagcgaacaaccactcgatgttgcctgaatgcgggggctagaggaatcagcagaggtaagattgtccttttaaggttaaactttaatcaacacagcacacaaagccagagtgatgcaatgtcacttcagagagaaaatatgatccccaggacactgagatctagtcatgattctactgaatatattaacatttccaatgggggaaaaaagtgtgaatccaacgaagagctggctcagccaaaacaaacaaaggcaagtgctagtgttcatccagggacaagggagcctcattcaactagacttaactaatccagcctgtggcaggatcctccttcatgagaagatggaagcatggtgttgtttttgcctggttttgctcaaatgtcatgcacaccaggcaccttttgattgtaaaccagcctttcctgtattggtctgcgtacaccatgattgtcccttaggggaactgtgagtgtggggctcctctgtcctcatggagttggtaagtatgaaatccttctaagaaatgatctgctgtggtcctggaaaaggaagcttcatgagccttatagaatgttaaggctacaaggaaagaaagtccagaaattaacatacattggtatgttaacttggtaacttagtaaaacaagttatggagtagaagttgttcttattcactgctgtgttttggtgctcagaataggttttcgtatgtatgagacacttaagtatttggtagagacatgaaacaagtaggaaaggacagaattatttagcaaatgctggtgggataattgattaactgtttgacatacactgaaataaataacatggattaaagagttaacttacaaatagaaaattaaaagaatgatccaaatgtcagtagtacttctgaaggggcaacgattttgtgcatttagaaggataagaagaaatcacaaggggaataaaaatgacaaatctgactacataaatattaaaaacgtatgttagcaaaatactataatagtaaccagaattcaaactcagacaacatgggaaaatattttcagaaaatgcgacagccaaaggccttgcatctttattatgtaaaatgttcatacaaattgataagaaaaacactgaaattccaagagcataaacaaacagctcacataaaagaaattaaaattagtaaatatatgggaagatatttgacccagctggtaatcaaagacattcaaaataaaacagtaattttaaaaaatttgaattagcaaagaaaatctaaaaattgattttcataaaacccaatgcttgtgagaatgttgcaaaagttgtatttcatattttgctgctgatggcttataaattggtacctcgtttttggaaaacagtttggcaatacaatatcaagagtcattaaaatgttttatagcctttgacctagtaatttgacttctgggaatctatcctgaggaaaattaatccaaaatatggaaaacattaaatgtctaaaatgaattgggaaacactaaatgtctcacaataggggattggttaatatgttgtagtacagccattggactaaaaactacatagccatttataattacaggaatagagaccatgcagccaaatggaaagatgcttgtgcttcaatattaaatagaaatgaatatatacttagtataaaaagatacgtagcaacaattggagtcaatacaccaaattttaagtggttgagctaaaatagcaggataacagtgaccttatcttttttcataatgtgctttcagcctgtatttctggatggcaattgccttcctttcttgacccaagtcctgcccaagctccacgcccagcttccagagccctacccatctgtgttgatgccacttagtttccagcttttccaagaagccctcccatcccatcagccaaatggaactctccctttcccatgctctttttttttttctttttttgagacagagttttgctctgtcgctcaggctggagtgcagtggcatgatcttggctcactgcaacctccacttctcgggttcaagtgattctcctgcctcagcctcttgagtagctgggattacaggcacctgccaccatgcctggctagtttttgtatttttgttttttagtagagccggggtttcattatgttggccaggctggtcttgcacttagacctcaggtgattcgcctacctcggcttcgcaaagtgctgcaatgacaggcatgagccaccaggcctggcccctttcccatgctcttgtgatgctgtattaacatttcttttacaggataatatacagtttgccttgtatggaaataatatgtgtacagtatgtgtctgtttctgcaactaaatttctaaacccctagagggcaagaaccatttcatttatttttctctccccacagcagaaggcacagggcttttcctgtgtgatatgcctgaataaatattggttgaaattaattgaattgcactgcaatgaactacttctgattccctcgcaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacaggtaacagatatgcctttgggttcccatgaaaagttggggctttggaaggaaatcagaaattctaacatcagctacaaatattcccagaaattgttatttccattctgatgagcccatgtgtatttgtaagtagatgggaaggggaaatttattctagaatttttatatgagctctgtgttcagacacacccacataggattttcccttgccaaggctttactttctttctgtgtctccccttctttgggaattgatgcacttttctgcacttgctactctttttttttttttttttttgagacaaagtctcgctgtgtcacccaggctggagtgcagtggtgtgatcttggtgcactgcacgctccgcctcccaggttcatgccattctcctgcctcagcctcccgagtacctgggactacaggcgcctgccaccactcctggctaatttttttttgtatttttagtagagacggggattcagcgtgttagccaggatggtctcaatctcctgacctcatgatccaccctcctcggcctcccaaagtgctgggattacagtcgtgagccactgcgcccggcctgcacttgctactcttttaatgaaaggggaaacacttttttttccttttccatgatacaacttctgctgagttttaatgtctttggaactagttagtttgtggattatccatgcctgtttgttctcctcgttgatcatgacagtcaacattctaacagtgtcatgcatcaacaccgagttagcatctatcctaaaatcctgtttatttgggggccaggaggtggcatgggagagaagaggttcaggaagaagctggttaaggaagaaggttgaaattttccatgttgttcatgcatcccacccactttcctacccactaatgccatagagaatggtgagtgggcttcacttacatccggctttgagcagctgaccttggtggttaagagtagtggctctagactctgactacctgagttcaaactccaggtcaacctgtgtgaccttaaacaagttaattaaccacttcgtacctcaatttccttatttgcaaaatggaggtcattgtgggaattaaataaaattatccatgtaaagcattttagcacagcacctagcacagagtaaggactctttaaatgtcatcctgattataattagctttgctgcccctagtaaataatgcacctcttaccttgggcttgtgttagcttctagcaccagagtagtcttttcctgcaagcctaataataataatagttggtatttatcaggttggtgcaaaagtaattgcactttttactattgctttcaataggaaaaactgcaatacttttgcaccaatctaatattatttctactttatattaagaaaacagaagcttagagagtagcttgcataaggttatccaggtaacaagtagctgaaccaagactcaaacccaagtctacctgattaaggactgtgtactcaaccaccaggacatactgccttgctctgaaaattgtgataacattgactactcaactttttttctttttctttttcttttttttttttttgagatagggtcttactttgttgcccaggtgggagtgtagtggcacaattatagtaattctgtgcctcagccttccaagtagctgggacaacaggtgtgtgccaccatgcccagctaatttttaaattttttgtagaggtggggtctcattatgttgcccaggctaaactcaaacttcagagctcaaacgatcctcccaccttggccttccaaggtgctgggattatgggtgtgagctaccacaccgagacttttttttcttatgatacccataactagtctgacatcagcttttcttaaacacaatgcaggctgtctctgaaagagactgtcttagaaaatatgctcctcctttcatttaggatgaggcctctgttttccgtggggcacaaagcttccatcttgaggcagaacaaccaaagtagttggatgtgaccaagccaatgtgtggctgctgggccaggaaggcaggaaaacctgaatccctgcctggctctaatcatttcagccaccttctacttgtttgtagggttttggatgggtaggaagaaagactagttcagagtttagagagcgacagtctccattgttaagtccattggatgtggtacagtgcagtggttcttaaagtgtgattccaggaccaccagcagcagcagcacctgaaaacttgctaaaaatgcaacttctcagtccctaccctgattcaacctattgaatcagaagattctgggggtgggacccaggaatttgttgcaaccagtcctcctcatggttctagtgcacactgaacttagagaatattataggagaatggaaagaggtccagagtttgagccaagagatctgacctctagtgttgactgtagtatgccactttcactttcttgagccttaatgtcttcacctatggaaggaagacataggcaatgcctccaaagagcatacagtgtagttctagcttgtctgaaaacaaaaacaataaaaacacaaaatcatacagacctgtggaatcaagctctagtctgtgcacttaggagctctgagaggacagcaatcaagctggcctggtagaattggacaaaatcccaaatccagacactttcttgtcacaggttgtctgccatttcctttgctgttcttccatgaaactaacatattccctcattctttgttctgccacaatctgcattccaagaatgaaatcgcttgctaaatttagccattatttgtgaggaattgcttgaattatgacacaacacagcacagttgagcaatccaagaataaaaccttgatttctcctttcatgccatgctgtcctctgaatcatggcccactcaccctggatagagcagcagagctcaaagagtccatctcagcctcagagataggatgtgaattctagggcacatttttaagcccggagacaccttcggttcccagagcaggctttatctgcatctcagtcagggcccactcagaggtacaccagaaacaattatgaaaggttataaaggtgccatatgcagattgcctgaactctcttgaattggtatattttcctacatgttaattgctatatattgtgtaagttagataaatagctcactgaaaagtggagagccgcattagggatttgttcagaatgctgatgacttccacactagctgtatactgctaagagctgagagactgtgtactgaaagcttaagagcagtgtcaagaactagacaacctggctaattgtaaatggcccccctttcagcattgactttgatgtctcattatgtctttcaaatgagaccctccttcttccccctaaccctgcacaaaattcacaatccctcctctgtccccctttttattgctgttgtctaaaatatattagacatgggaaaaatgactcatttttagagcatcatgcctagtaataatagaatttacataaaagcagcatctgagagagatagccttctttctttggtttcaatggaaaacttgcttgatttcaaagggcagtcatagtataaactgtcagtcaaagggagataatgggaagggaactaaaacatattgcaaacctattatgtgccgggtgttctaaatgtaatcatctctattcctcacagcaatcccgtaggtaagtatttgattatttgcatctcacacatacatgaacaaacttggagagaccaagttaactttccaaaggaactaagcctatctatatcttaggagctgggatttgatccttgagctctgctcttgtctgactccaaagcttaagctgttatcacaataaaacacaacatcaagtgctgtgtggagattgttgttgttgtgtaatgtactttctccaagaagccaaagtagtttctaaactgcttgctcaggagaaaacagagtgggtcatgtgcaacagaagtatgttacctaaggaaacacttgctcttgtaacaaataaaaacattgtatggctcaacgcaatagaagtttatttttcacccgtgtgaagtcctgccagaggcgcgtgaggctgtagtgcggtggatggttcggcaccccagactgccatctttacacttgacccccacagttgccctggcaacatgtaacaagctgaccaggagatgggggtggggaatgaggagaagtggagcatggtatgagaggtttttatgcttttaggtgatgtatttcaattccaggcctgggaatggaatacattacttgtgcccacattctgttggcctccactcaggcaaatgactccacgtgattgcaaagcaaggctgggaaattagtctagctgggtgctaaggaggaaagggaagtgggtttggtgaacagccagtgagtctctgcacaggagtgggagtttgagatgagtaatcctatctaactggatcctagagggaaggtggctgctagtgttctaagttactactgatgtgaacagattctgacctttggctgcctagttgtttttgataaattaactcttagaataatgatgaatgtcttggccgttcctcaaaaacctttggctgtttgcagcagatgatggatgtctagaaaacacccctgacactgcagagttcagtcgagagttccagttgcaccagcatctctttgatccggaacatgactatccaggcttgggcaagtgggtaagtcctatctcaattgttagtagattttgcactttggtactctgaaggtgctgatggcagggatgagcaatatgggcagaaggagagaagaaaaattatttagaagctaatttttcagaaatctctggttgacagagcttcaagtcatgactactcaaaaccacacttatgtgtccaggcagcactataccaaatccaactaaagagacagcaacctaacattgaccatagtctccagagtcttctactctggtctgcttcacagcctgtgtcatacacatcctaaatttcaccagtgtttcatgcatctctatagggttttatcaaaggatatgattttttttaattgacacagaaaatttgcaaatgtgatctctaaactaagggagatgatctctgcagaatcaagggaataaagatgccagagcttagaaacagatatatataattctgctttatagaaagagaaaaaatattccgtgatgtgtagcagtgagattgctgtcagtcctaggtaagtgcatatagctgtcagttaagggagttgtttataagcacttggaaagataaatcatgaccatttggcatcagtgtgctaaaaacaagtcttgccaatctaattatattcttccatttgccagcattattcatttatttgccagcttgatgagggaaatgcagtgggcatggtgcatttggacttttgcaaagcatttgacaagatcgttttatgttcccctattggaagaggtggaaagatacagcctaggcaacagaatgtcaccaaaatggggcttgttaaagagtccatgtaaatagggagggagatttcacatggtattctgtgtgtcttagcactaccccactccacatttttatcaatgtttgtaataatatagaacttgtacttatcagattcccagaggatgacatgaagttggaagagataccatcagatgacagagttgggattcaagaagatcccagcagactagaacaatgagccaaacaagatcagaactgagtggggatatgtctgtgtttctgtggttgggccagatgctgaagccatgggagaaaagtggggaaatacctaggagtgttccttcacatgtaacagtaggtggccagtacgtctgtggaatgaatgagtgagtgaatgagcaaatattccaactccctcagcccttctaaagtcctcatctcttcttagctcattattggcagatggccttgcttactgctttactgggaacactgaaatttcaaaactaaactccctcctttcctcctacattgttttagagaaatcttcattaatgaccacttttatttttttcagcgtcttgctttaacatgcattgtcagttccctctgtcttcaacatacacacatttcctgtcttaaaacaacaaagcaacaacattcctaagttaattttgcttcttccaatttgcattattccatttccttctttttcataaacagttctgtttggaagaattggtttgtggagccactttcaagcctagtagtagagcttaaacatgttgaattaaatagaaaaacatctataggttctcgaataggagactgaaataataaaagccttctataaaagaagttattttgatggcatattaaaggatgaagtaaaaggagaagagactaaccctagacaggaagaaaatatggggagtcatttcagttatgatgactgtgaacaccgtgaagaagggtgagaatccaagacattttaaagggggaaaaactaactagaattggtatacggaataaatataacatgaagaagaaagaagagatatgtcaggttcatatgaaatggacaatatgaactttttctttgaatgcattttagaaagaaagaaaagagaggaatagagggaggaaggacataaaaaagagaagagagagtgagggaaagagtagattgcggaggagtactgggaagagatccacaagaggtgatcgaagcattgccaaacagaagcaaaagccaggttcgataaggcacaaagagaacacattgagcctgctgtgttccaggcactgtgctagatgctcagtatgcaggagtcatcaggacatggtgctggtcttcagagagcttatagtcccacggttgagatgaattgcatgaaaatgaaatgaacccaacttagcaccgctccacttcatgtttcgtctgtattctgagggccaggggcaattattagggaagatggaagacaagggtagaggaagatccagaactgaggactggtgtggctgattggggtagtagccacagaggaagtcaaaggcactaaggagggcagcactgaagtttcaggtgggaaagtcttcagcttcaccagtaggctaggaatgagagaaagaaaggagggagactgagtcaaggtgtgagtgaaggcaaggagcccagttggtggcatgatgaggtgggagggatgaaaacatctcttttcagctctcttcatctcttcttgaaaatcttcacagatttctctcatcaaattccactcacttccagtgccccagtatgaggccaaccacggtccttcattctctgtgcttccttctcgaaacactgacttgagtttctctcagtgtttcctattctttgtccacattagagctaaagactagaatctaggatcaaatgtaaaaggaaaatattagagatcaatgaccaggaacaatgtttagataccttttatcatctgcaattatgtgtttacttaaacttaggtctccttgtttattttctcattactacctaccagtaaaacattgtttccttggttttcacatggaagtgggaattgagtatgtcttgcttttctaaactgggaaccacaaaccttcctcagtgcttatatggaatgacagtctcaagcttgtcttcagcccagccatcctttaagttaacagagtcatcatctttcatgatagaacagcacaaagaccctgcttccttatctgctaataacgcttccttgtttttgacagtagctggagctgagctgcatctttaacagtgattcacatattacacatttcagtgtctgtcttgtttcctgcatttctctcttcgttagtgcatcaagacacatttattaacgacacatcatatgccttccgggccccgtgttaggtaatgggaatacaaagatgaatgataatagtaattgtattacataatacataatactatataatacaatagtaaatagtaatatttattgaccacatactatatgccagactcctttctaaatactcagtaatcttattcaatctgcccatccttgtcattctcactttccagatgagaaaatgcaggcttggggagctgaggagcctgctcagcccacagagctgggatttgaaccccatcatctgactccagagtactttacaagctgaatacattccctatcttttcatggctcattgctcctaacctgtcctgtgtggtagtcctattgagtcctaccgagggctggctgccttccagacaatgtgtgtgactacaccagtggtgaccacaccaatggctggctcctgtacatgccagctacccactccccctttacacattaactgctgagtgttatttacttaagaaaaagttgtctcaaaaagcaaatatttttcctttccaaatgctttcacaccttttcatcagtagctgatcacagccagagcctgagccacggggatatgagggaccagacccctccctgacttgctttgtcattcctgaccttaacatgtttgatgagttgaatgctcttcaatgtggatttgactcaggtttccatgtgattagacctgcttagtattttatgtcctacttagtattttacatcagcaagcacatgatgtcagggaagtttgtctcatgactggcagtgttcactttgttaaggtgctgccctccaggtttctctggtgtaaaattcccttagaaattaataggccgggcacagtggctcacacctgtaatcccagcactttgggaggccgaggcaggcggatcatgaggtcaggagatcgagaccatcctggctaacacagtgaaaccccgtctctactaaaaatacaaaaaaattagccgggcgcggtggcgggtgcctgtagtcccagctacttgggaggctgaggcaggagaatggcgtgaacccaggaggcggagcttgcagcgagccgagatagtgccactgcagtccggcctgggcaaaagagcaagactccgtctcaaaaaaaaaaaaaaaagaaattaatagttactctgtgggaagaagttttggggctgtgtaaatattctgctcctcgttcaacttttaaccaacaaatataacatccattgatgatgcttaccagattcaataatgatgatagctgcaaaatgatgattttcttactccgctattctttctgcatttactagttgacattctattctaagcaagagtttcccctgctgttctatttatttatttatttataaatgtgtttatttatatagtataagtatggattcatggattccataatgcatattattatgtattctggtgttcaaactgtcctaaatttggccagtgcgagtctcctcaagctttcttttctttccttttgacaggacctcatcatttttttgagcacttctttattttctgacctaattagctattccatcttcacccatccttgcactttccttcctagccctggaattagacttttctccaggaagctccctggctgtatttaggagtgtaatttgaaaccaggatctggacagttgtccaaaatcttgatggcactatggaaagcccttttaatgaacttgaacctgctactcacatggaaaacaggctcaccactccccaaggaatcaacaaggaatgggcgtgaggagagatagctgatttcttttcattcaatttgtatgcttctcttacccataccatacctgccaatgccttcaagtccatacaataatagggctaattaagaatgtcccagacactttcatgcaggggtagggaagcattatcctgctaatcctaaccctagctcttaaggagacacagggaccatctttgagaggaagattagccaggccttttgcatttcttttttttttttttttttgagacggagtctcgctctgtcccccaggctggagtgcagtggcgcaatctcagctcactgcaagctctgcctcctgggttcatgccattctcctgcctcagcctcctgagtagctgggactacaggcgcccgccaccacgcccggctaattttttgtagttttagtagagacggggtttcaccgtgttagccgggatggtctcgatctcctgacctcgtgatcctcccacctcggcctcccaaagtgctggggcacatttctttttgaatgaagactcttatgggtaggatctgcccccaagatctcctaaagaattaaatgatgctggctttacctggctgatggcacagtggaactctgccagagctggctgacagtcccaccccatggtagtagctctcaggttcttccacactccatccagctcaggcagctgaaaacaatggtacacatgaagaagacatgtcctcaccccttcccggccttcccagctctaacaccagctcttcggatattctctgcctcaggagtttttacgttcacagaaaggcaaccacagactgtagagaatgagcctcacagcaatatcctcattcctcaaggaaatgatctgcaagtctgccttttctcccttccgatattaaattgatttattccccaagtgagcaggagatagaggctgtagccagtactggtgtttttggtagtagaggctccttcactctggcaccgcctccttgcatagttgaggttgggcaagagatatgcattgtaaattgcaggtggggtagattttaatgaacgtgaaaaatgatgaagctcattcttggcatttgtcattttcaattccaaatctatcactaaaaataagtctttataagtggacagctcagaggatacatgttgtataaacttgttccttaccagaactctgtggttgtctttgttttttttttttcttaatgtcagagtattttatttagaacaaaacgaatcacctcttttatacatcattttcctccagataaaaaaaatcaaataaataaaacaacacaagtaaagcccccccccaccgccaccaaatccccttctccctttctgccttcaggttaagtgttctgtcttttataatctcaatagaagggaaatctgttgagcatgtgtctgatattctagagctcattgaagcccactatgtgtttgaaatacagcaatgtgtggaaacacttacacaaactgtggtaacagagccctgccccccgacccaacataactttcctttctgccaagaagttttttggcagtttttaaaaggttcactctattaaaaatgttatagaccaaatggttttccaattgtcttgactgggggcactgacttaacgccacagacaaaatggttgcagaagtcagaatgtctcgtttatttacacaggggattgttgttaatagtcagacgctactctagagagcagtttataaaaagggagttagatacaaaaataaatgagataaaatcatttgttttaaacaaaggctgttcaaagtgaggagatgggtttccagcacccttcatgttttaaaatgtcgtatttccctgtttatgtgattgttgatgacactggtgtgcctcagggcattgcagaggactttattaaaagccgaaccaccaccagctttactcttgtggtctatctttctgacacgacattcctttcatctagttttgtttccaaaatatgcgtatgcaaatatctaggggacacaccaagtattgcttttaaaatagacattcaccaaatttgatccatacttctgcattttttgttttcttttctccccattctagaacaagaaactcctttacgagaagatgaagggaggagagagacgaaagcggagggtaacacgtgcctggctggattgttgcggggatgcttggagctttctgagtggggcagtgaacaggctgaaaccctcgcttgttgggaagtcacagaatcctcccttgtgtagtcctgagaaacactggtccatgtgacaagggccacacccagaaagtctgtccttggtttctgcgatggcttccccaggctttagcagatgatttttagtggaacgcgcagtctgtagcaattctagcaactccattccgttcaggaaatgtgtattgcttcccccatcagtgtgggacatatctggggggacatgagggtctgtctgccctcccagggtctgtaggccagtggggaaaaactgatcacacatctgcatcaattctataaaaacacaggacagaaacagggaagtgctgaactgcatgctccaggaaataactttgaaggaattcgggagcaaaagatgagatgaacaaacttaatttctcctatgtatctttttttcttggcctagccagactgatgtaaaatctactagatctgtaatatttgtttgctgtctgttgaatttactgcaggcttagtttttaaccatcccagggctgcccaaggtaggaacttggtctagatactccacatttagctacttcatatacagtgttgcctcacgtaaaactcaatgtcacatttgctttggctttccagggtattttatagcatcaagacttgataagtgatcaaggtccattctgctaatccactggtaccttactagtcagaagggcctggccacctacctccttctttatctgatcagatgaaagtgggagaaaaaacaaccccactgttacatggtaaaatgctatgagatagtgaccattttagttaaaacatacaaacctaagcacgtactcaaagccactgactatttattcagaagagcaagtgcctggatcctcacaaaatttgggaatctgggcagtggtaattgtggccattctgaagggttttgccaaatccggtcagagagagcttcaagaggtgtggattttctggcctcagcatcagtcctcaggcccccacaacagaaggttccaagcccctgtactgcctgacaaaacacagaagacatacagcaattttctacgcgagaagtagaaaatttttacctctggaaacaaatcttttttgaggagagttaacagagttattaggggtttttcttggtgattacagcttccaatagcagatggtgacagaaagggtccaaagggtataatgtggtcttgagggaacatcaagaaattctattctaggaactcaaaatacacataatttaccagtaacacggcttgaatatctccctacaacacaacaagaacatttccaaataagagcaatgactgacccaaaatcaataacttagcttgaaactttaattgtctctacttcctggcccaccattccttctgccctgactcagtgaatgaccatggtcacgatttaggtcatttttccgtgagactagtgattaccaaaactcagaatgctggctaagacacatgctataaaggattttactttagcctcaatttcctccacataggaaaggcttagaatttaggaaaagaagggtcactttgacccagagatatcaagttcttcctgttcttgggcatctacaaagacccattctcatgccataaaccatgggcctctctggattgataaggaagcacgttggccctgcccatcatgaggtctcagatgatgttcccatcttgattaaagacattaacactgccccaccaccacccccagtacatgaatcaatataaagaaactatacgctttcttttttgaacaatgaagtcttccttcagtgaagctcagcatctgctgtgagtttccagaggacattgtaagcaaagatccaatcccagtggttcttccagttgtgaaatgggaatcatgttctctgtgtgccctacccaatctcttgcccaagtgagagaagacaaatatagcagtgccttgagtttttcagagcacaattaaagccaaggctcagctaggcatggtggctcacgcctgtaatcccagcactttgggaggccgaggagggtggatcacctgaggtcagtagttcaagaccagcctggccaacatggtgaaaccccatctctactaaaagtacaaaaattagccgggcgtggtggtatgctcctgttatctcaggtactcgggaggctgaggcaggagaatcgtttgaacctgggaggtggagtttgcagtgagccgagatcataccactgcactccagcctgggtaatggagtgagactccatctcaaaacaaagcaaaacaaaacaaaaacaaacccaaagctcattattattattcctaagtgctggattcaatactcagttaaatatttatcaaaaaagttcacctgattcctctttttacctcctcattaatttttcccctcccctccaacctttgcatgttgtaggtctgggcaggacttctcccatgagagatagattctcctcaaagttgcaaccaagccccatatggctttgaacaactttttgtactcacccaaatccaattgaattcctcattgcttcacaaatgaaatgtcaatctacctttaaatgactgtgaacttttaaactcttaagctgtatcttgttaatatttgagctctactattgatcttatttaaacagtttatgaaccttttaatctcatatttgataaacttgaacctctcatatcctcctttaacatattagaatttttggaataaatattactaaacaaaattctgatatgatcccctggggtaggccaaaccactgtaattgataaaaggaatttttattattttaaatatttctaagatgaattctcagcaaggtgttgtcttgtggcatgtcacttttcaagtgtctgaggacattgctcactttgtaattctcacctactttgtgatgcatctttgtagagtgagtcggacctttcacgattcatgcgtttagcagtcagaatgtgaaagaacatttgtaaatgctaaactcaggtttcattccttctcttttgaagaatgtctgctcacctttcaagagtcatggcaggttatttcatgggcaagagagctccacctgtgaacagactccattcatacatggggattgagcatgcaacagggattgctgatcgtttgtaactacagcttctttctttctttttttttttttttcttttttgagatggagtctcgctctgtcgcccaggctggactgcagtggcgcaatctcggctcactgcaagctccgcctcccaggttcctgccattctcctgcctcaacctcccaagtagctgggactacaggggcccaccaccacgactggctaattttttgtatttttagtagagacggggtttcaccgtgttagccaggatggtctcgatctcctgaccttgtgatccgcccacctaggcctcccaaagtgctgggattacaggcgtgagccaccgcgcctggctacagcttctttcttatatttttgttccattattggaaggcaacttcaatgaacaaacatcttccaaaacttttgaatttttcttctgcttgctaaatactattttgtaaagtttcaattactagttcgaatccacacctcaataaatagatatgtattagagaaggaatggaaaaatatttactcattaagaataccaacacatgaaagtgatttcagagtatggagtcttgagtcaaaaacaaaggacccttcccggaagcttccttttttgcttcagtttttgaatttgactgaaggaaggtggaaatgatcactcgagcccctaatgaattctccttagtaaaatactggcgaggaagaatcaatcccagcaacaggatgatctgggaccagtcttcagatgttaattcccacttggccctactcttctcctttagaacgtttttcttgcaaaatataatttaatgcatttcagattccccttcctacctaaatagggccatagaataataattatctttcttatgggtcttggtatctaaattagtagcaaggacttatgaggtggtttactgcacttctttgcaccaaaaataataatttttaaaaagaccacattgtatctgataaagagctctatagttgtgtgaaaaacacaattagagacatctatcagtcagaaaatgtttcataggccactgaggtattaattagtacactggagtaattgtttggtagttggtaggtgccactggttacattgttgttaacctaataggccagaaacaattcttttcttttcttttttcttttttttttgagacaaaatcttgctctgtcgcccaggctggagtgcagtggcatgacgtctgctcactgcaagctccgcctcccgggttcacgccattctcctgcctcagcctcccaagtagctgggactacaggcacccaccaccacgcccggctaattttttgtatttttagtacagacggggtttcaccgtgttagccaggatggtctcgatctcctgacctcgtgatctgcccacctcggcctcccaaagtgctgggattacaggcgtgagccaccgcgcccggccccagaaacgattcttgttcatttcttttctgagatgtctgtatctgatgttcacatataacaccaaaccacatggtttttgtttgtttgtttttcagagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggc

SEQ ID NO: 615 - DNA, 55429 bp, Homo sapiens; identical to SEQ ID NO: 614

SEQ ID NO: 616 - DNA, 302489 bp, Homo sapiens
tggacatgaaaccaagatttattaaaatacccttagcatatttacaattgaaagccatgaatgcaattctctgtaaattccaaaaaatataattctcttaaaacaaattaacagaggtatcaacagattaggataaatataatctatcacagagatagaattttttgaatagacaattgacgtttttctaatcaatatatattatgtacaaaaatacacttgatattgtgaccaagtactgtcaaggaggaaaaaatatatatatataatacacacatttttattatgtacaaatcagtgttggttccttcactctctttttaaaaataaatacttcatttggttgcaaatgacatttataaattcaactcatgagcatttctcagctttgacaaaattaaatatgcaaacaaattagaaatacgtatttttaaaaatgcaaagggaaaaatacctgaatccaatgagcttattatgcttaaaaatatcccaagagcgtgtaaggtttcatgtctttaaagggccttctcctttccccaactgtcttcattactgcctacaatcttttcagattatatctacagactggtctaatacttaattaaacagaaaagcctatgttttaccaggttaaatggctatttaggacatgcttgcacttttaagtgctttcaagagtgtagcagttactgttcatctgaaaataaccaagaagtgtcaacatcctgattcagaacaggggtagatgtttgaatcatgaatagtagtaagaatggagcggcaataaaaatccttatgattcaaagtgtttgcctgcacagaattaagtcaatttgtccagcaccacagaaagttacttgagattcaaaaatctggcgttctgcatcatagctggtgacccggtctgatgtacaaatttatcaagagaatggccttaattagtttaaggtaaaatctatgagaaattgagaaggcctagaataagaaccccccccccaccccgcccaatcttcttaaaataaaataaaaagagacgtattttccatctcttttatggattttcctttttgcttaagtgatgaggtgatgctgacattaacaagaggcagtcacagcagtgtgtctcacatgggctccttggtgacagcggagctccctgtccaaacggctgaggaacggagcacagggtgtgagaggatggaggaggggccaagggagctactcagttgtctatgatgcagaggtgtgaaaaaatctgggtctgggggaaactgtaaagtaggaaagaaatagccatggaatatgaaggaaaaggacgaggaaacagaagtattgaaagaagaaagtgaaacaaagctagaagtcaaaatgacttttgaacaggcatggagtaaacagggtctatggtcaagcagccccatggatctgaaattgttggagctgttaaaccaagcacagaccagtttcactggggtacctgctttcccagtacattggcactgatcaatacaagatcaagggcactcacatttgcctaatacagatgccttgaatttccacggaaaagctgtccacgatacgaccatggcaaaaaatcaccagctccctaacaatgtaatctatcagcaaaacattgcactagcctcgttcaaatttttctcctccatgcgtcctttttttcttgctcatcccattgcttgcaaactcacaagataccagttatatgaagacataaaactgcatggatcaggtgcactttagaaagcagcatccagggtccagggtgtcactaagaaaactaaaccctgaagtacttgaaataatttacatttctgctaggtctgattcatactaggatgttgactgccttcactcaggttctaggcatgcaggccagtgcttattttccaggccaaagcacgatcccctaaatcaaagtccaaggccaccctgcttgccatgctagtctaaatgaaaactcaatgaaagaaaaagactatgataaaccaatgttttctctaaagattcttaaaaattatccaatttctaattttaaaagtttctgcctttttagtattttagattggttctttaaagggaagttctttttattaatgcatactctctttgaagataagacatctagctgacagtagggtcatattacttatgccttgggaaattacagaattgcacaattataaatttaataattttggagtagacctatcccttaggtagatccccaaaacctatttgtgtcattgcgagcaaacagaagaattgatactagactttccctctcactcatggatttgttttcaatggaaatggaagccttccaaatattatgcagaacacaatctcagtggcgctgagctaccttctttatgccttgtggtccaatgtatgaagaaataagattttatctagagacaagttagcatgaagcgaggaaaaaggagatatttataattcacaaaaacatctaaaatgtaaagatttcaaatgtccttttagtcccttactgggaagagcagtataatttttgtatgctataaactcctttttatacatctcctataaagaaatctggaattcaaaatccatgctaagagtttccagagtgttcatccctcaacacttatcatccatgtcatggggaggtagagagtaatttccctgaatagccagtggtctatgggactaacctttcatttgggaaagacagatctggaaagcgaacccagttaacagtcaaaaacacattcgtttcataagaggaaagtggaagaaagcccctgaagagaacaatgaaggaaagcaggtacacgtttgccaaggacattaacaaacaattgctaatgtgtgcctgaaatctgatttccttcttgatgtattaagataatgcattggcagctcacactatacatggagagaaatattcatattaatttaagacgttctcatagtttcaaaggtagagagcccctcagtgtctgcacaggtagaatttaggaaaatgttcagcctatgtgagagctatagtgtggtagaggttgtttaatccatgccaaattctttggacgtgattttctgcctgaaactatagtcttctttgcattttgctggcccaatgtcatcaagtttcacacaaagcttggaaaaatagcccacaagtgtagttggatcagcctttagaaaaggagactagagattctcagtatatttaagagaagatttaaaaatagaaaattacataagcgtagagggaatgtagaaaaataaattgatggctatatctaacaccttcatataaaaatggaataaaagtcaatcttccccacatcaagaacttcagagatgtaatataaagtctggagttcacatgagctcttgactgaaggacacgatcctatcagagaaaggtaagagagaaaaggtcttctatggccctggttatcaccatagttaggagaagggctggggatagaggaggaaatgagttccgtaagttccaccagacagcagacctactgaatgaggcttaatttgcttccctaatctctccattggtagaaattgcatagtggcttaagagacagttagccagctgccattttaatatcttcatgtttccaagttgttaactacacgtttcccaaatcctaactttatatcacagtattggttaagagtcttggaacaaataaggatactgaattggcttcaaatttgacatgttaaaactctcttaaattcatcactttccaacaaagcattgatctggaagttcagtagattgcccattccttgggaagggagatgaagaattgtgaaaccaaaatgcagtgcctctaataaggtgtcaacagcggacaggtgtgcagaaatgacacaaaatgggcttcccagtcacagacaagctgtgtaactgagcccggttatgcctggattcaattgctaatggagagatgaatatcattatgtaagtctaaagaagaaagatatgctaagtcaagtatttgaagatgcttttctttaagccacttctatactaataacagtttccaggcagctggattgtttctctctatagctggaaaatggaaatatatccaagttatttgcattttggaaaggctaaaaattatccactcttttcaaatcccatcagcttggccacacagactggtttcatctgtgttgcagatttctttatgaggtcaaagtagcagacatgaatgaaagttcacttctttattctctccactctcttcagttgtagggtccctaaaggtaaaataactaatacaaaacaaattttaaaaagtggaagctttttctttcctctccactttttggccatttttgtttttattaggacagacaggataaaagaaaaatgaagctcaaatataactgatgcttgttagcaatttaaaaagacaatttaaactgttttataaaatcagatatttaatatttggatcagatatgtgggaggggggaaggctatatatttttggacttcttcctttttgtcatataaagctccaaattgattttatctttgttgtttttgtggatggagatgagtactacaaaattgaccaatttagtatgtcagggaatgaagaggttccccggtcaatgttacagcctggttcctggaaaaagagcctgcaagcgtgcattgctaattcccattcacacactgacttggcgcaatttgctgtgctgttgtatgcaatgatctgcatcaatgacactggccaagggagaagcagaaacagaaatgaggacatgtaactttcaagaaaggaagagtatcattaaaatgaaaatttctctgttgcaaacatcatagagaaaatgtgcaatcccaggccaataagcaaatctttgcccaaaataaacatatttcttctgctacatctcactgcggcccttagaaaaaccgtaccaatgacttatcttactggaggtgttaataccaccaacatattttattccttccttcagtttttccagtttctttaccagcagtatctgaacttttcatttaggaaacaccattcttcatggtgcttatgaaaacaggaggtgcctgaaggaggctgagaagaggtttgcagcttctactgtccttgataggggaggggaggggagactgcatgccatctgatattcaattcctcaaccatactggcaatttgttttggctagaacatttaaaagtgtaatagctccactgggtttccttattccacttctcagatttcagaaaatctttataattcctgagtagttgcagtgagtgtgtagaaagacaccatcatcaacataaggattcaaaaggcaactgttgggcagtaggaccatcacctatgacctctgggcccccaccgtcatcataaacatccacttctgcttggccacactttttcttatttctttttccccagtaagctgccacttattgagataaaagccatacagcacacctcctaacctggtttttgatacttcatgggcctgatgcttttttttttgaaacggagtctcactgtcgcccaggctggagtgcagtggtgctatctcggctagctgcaagctccacctcctgggttcacgccattctcctgcctcagcctcccgagtagctgggactacaggcgcccaccaccacgcccggctaattttttgtatttttagtagagatggggtttcaccgtgttagccaggatggtctcaatctcctgacctcgtgatccgcccccgcttggcctcccaaagtgctgggattataggcatgagccaccacgcccggcccgggcctgatgctttttacctaacgtgtctgtagtgtaatttatgatgtactttgtgtaatttatgtaacttatgatattgtgtgctctgatgctgtcaattgctcatgcaagaatctgaactactgtcaaactgtgtcctcagatttaatgaatattgtctaagaggagacaaagttgtttgtaagttaagggttcttagagttactactaagtcaggtgtgtctggttagatgcagcatagcaaactggttactctcctttctagttcagggagggctatgcctagaacagccacttaaagcctgctggcaggatgtgcttaagctgccaaatggcatcccgatcacctcctctccaggaaaagttcagatcctcctgctacactgaacacaagctcaacagcattttagagggatcattttcaaggcctccagattattttagatgaacttccttgaacaaattgtcattgacctttactgagcatcaatttgagttaaaaatgaaggctgtgtcagcaacgtggtacattggtggacttgggagggggcatcccagatacatgatgcagggttcagaataggtgagaataatgaagattctgccatggtgtcttacaacactaacatcatacatcgactagtgtgacaaaaccactaggtttccccaaccgaggcaggcaaaccttgctttgtagaaataggtattttactgcaaagttttagtctgttcactaggatgaaatccaaagtgggctgtatttgtctaactctcaaattaagtgttctcactcattattcttcagcactggttcctgaagggttacgtggccacagtggcagccctgcttaccttcactgatttctcgtaagcatcctacttacagaccaaagtggactgcaatgagtacacctcaaacctcccgctgctctcaccatcaagcctataaggattgagacttctgctggccccacataactcaaaagagctgaattatatggcatgggtaaaactggcacttttcttgtgcatgataacactagaaggagcatacaatggttataagtggaatcagtttttaattgatccgttcttttggttgtcttcagagttaagtgaaaatgaagagaaactatgtaagaaagcagcataaaaagcttcttgctcacaagcaacttcaagcctttttagtcatgcatgttccttctcggcttttctgttttgcttgtctcgttccttcattgtgaattttaaaaatccaaccatgttaccatattcctttcagttgcaccagtagaaaaggcggttagcacctgcatgaatatggcttctgtgacttgatttgatcctgactgcagtcttcattctcgaagctgacattagattaggatatggtgctgctttcattactggatctattatagaagcattcctgaggggctgctggctggcaggcatatcctgggaagatgctcaggcacctggcaagtccaggggttctggaaagatgctggggcaaggggcaggccacatgtggaggctggatcaggaaggaatttaagatttctgctcatctctggactgtcctccaccaattggggggagaaagctcggcctcttcaaggcctaaaaatgagtctttgatcatattgtccattcatctccagtcctctttcttcacccctcacaagatttcagagacgtggcttaaagacaaaagtgtcagagaggtcaaaggtggtttccttatgtgactcaagagccagggtcagaaagagctgcctgtgaacaatattccacttggaagttttctattaatgtaattactttcattttgatgtaaggaaccttttttctgcccttcagtttttttgacattaaagagtcctgcttcatcctacttcacatgcctatcagccaaggtcatgagcaggtgctgtgagttgcatttgctctcctgtctggaaactgcctcctggggatgggggtcgtccagctgcacagtcacagcacataacgtagaactcggctgcgtatcaacacaacattgcccattcatgaacggtccaaaatgtaaaaggtgctctgccgctgggtctcttgtccaagcacacccaaggctgtgcttgctcaggtattacattttctcctgggagttggggtgcagaatctctgctggcccagaaaaaccacaaaggaccgatgtaaaaacaagaatgggcctcacttaacaactgatgtcaactccttgcatggtaacttgttctccaggatgaagtttatggctatttgtctccctctctccacccaggtatgattctgttttttctccttttcatcacgtaaaccataacaacaaaaaatcatttttttagtctggataatacatgttcttggacctcttcaagaatagttttggtgagttgcaacattattggagagaaagatgctgcaggattttgctgcaacaggatcaaaactaagaccaataatcaaaacagcagtgtgtaacgacaaagacttgaactctcccaaggcaactgtcctcaatgatcttttctctcttctgtgacaatgtgacatatatcaagctttggttataaagctggaaatctcagcttttaaaaaaattttggaaacattttggtatttcttctgctcttagagtggactttgggcttccacaagaaacagtcatcaaatatttctgcaatgttcccttaaatagttttccattgttcctgcggcttaatgagggacttcttaaagaaggcatggggcactctctgcagatgacctcagaaagagatgagcaaaaacaaacatttagtgacacatctttcaagaacgtcctgcaaccctgtggtcacaaagagtatgcgtgcaaggtcctccacctccagtgccatcatttccatgtgtcttcatcttagttagtggtcacactggcttccttctgacgcagtctttctttctgttaaggaaaaaaaaatgaatgtatcattttctttcatctttctcaagttttgatacatttctcaaattttggtctagaatgctgagtttccggaattgtgccaaatggcctagaaatgagagtacctctactgctttccctaagctcttagttatctgcccctccctacctatcacccttactccccagaaaaacaaacaagaaatcaataaccagccaatctaccaactacatccatctaaaacacgggcctttaccatgccagggtggtcttttctgttctcttcttttgtgacaaagaccctaactttgtagtgttactcaaggaccccttccgtccctacctttggctcattgatggaattagagaatgcccaagaagatatgaaaaaaaaaattactatttccaatgatcaacttggcagaactcaacaaaagccatgcaaaatgggagatgaccagatttagtctctgcagaatggcagaagttcccgatttgccatggatgttatgctcttcattctccgagcttcctcctcagagactgccttctaaagggaaggacatggacatctgctgggaagacgtaagaatacacaggagcacactacacagaaacatggacccccatggtatctgtgacactagggaagcacacatatcagtatggtaaggatggtgtgcctgctctgggaggagggtaaatagaaggctaaaatggaaaagggagaagtatactcttttggaatgagcagatgcagagagaagcctttgagaatggatccttagctgcttatgagctatgagatatgatgttgcagtgaattactaaattggcctagatataaacttaagttgatgatttttcgacacccatcctaaatttggaccccatccctaacttgcgaaattgaatcaggaatcagtttacaagctcttccctgatttccacccacccacccacacagacaataaaataagcagccccaacaagcccaggatcacaactgggagcttgctcacaggggaggtcgtaaacccactgtttcccttttgtctatatggctgaccccattctctctgccttgggggaacaagcttggctgtaaaagtctggatagaggcccaaataaaaggtctgaggaagagggagaggctcatgaaggaagaagacaaaaatcagggttcagccgactgccactgaaagtcatacaaatgaatgtcataaatataccatcaaacgggtacaaaggacatgtccggttaggtaggggccatgtgctcaaccatggctttccccgaccaaaaagtatagcccggacttctccatttctcattcatcaacctcatgcaacattcatttagctgctcatggggttgttgggagaaacattatggtcaatcaacagaaataatctcactttgtaacttagaacccatttatattttcaaaggatttgaagcatccagcaaaaaggtactaataatctaaaaggataaagtaagtagttgttggacatcagggcccagagaggacagagtttgaaaaatccgagagaggagggtgatacttccacttcccactcattgccattccccattgcagggtcaaccaaagcagctgaaattcacagcaacaaggaaaacaactaatatttattgagctcttattatgtgttaggcattttacatgtcttttctcagttttctcaaaataaccccaaaaaaaaagtagtatgttcttttcatggaagagaaagaaacaaagtaacttcactaaggttttacaactatttaagtggcagagctgtgatctgaacccaggccatttcattctcggcatcctgggatcctaaccatgtagctattctgactattgtccgtaacacctaggtggagattcattgtgatctctactgaaaactggactttggaggacaacgcaatctcacatataggaaggctggggagactgctggtttccagcatagggagagatgtcaggagacccagaatctggtcctggcttttgttatccacttgctaagtgaccctgggtaggctgtatctttctgcacttcaaattttccaactatcaaaataggagaatccctgcctctttctttaatggggaaaaggaactgaagagaatgaatatatttaaacattttgagaaaaagatactttgagataagggtgactgtactgcgggtagggtgtggaaggatgtgaaatggtaagtgactaaatttggtttatcagaaatgacctatgttgagtttacaggaaaaacatataaagctatgttttgtacctccacccacacatacttttttttttttttttttaaccatatgctactctgggatgggaactgagaatctggatactatgtttcatctctgagctttagcccttcctgggcgcacctcaattttcatgacaatcgttagattatgttgaaaaatatatctcaccaggctagcagtgggattgattttctttgtctccactttcttctctgaagtcaacttgctgactgattcctgagccattttcaatctgaaatagaaatagggaaaagacaggggagagagggaaaagaaaggaagagggaaaaggaaagaagaaaagagttaaggcaggttaaacataaacccaaatgcttttgaattaatccatcagcaatttgaaaatactgaaatgttttttcaatgcttgttattaaattcaaatcctaattaggtgtgaaggcttctctgctttatcaaaatttaattttcttcaccagctgaagcctgtttttgtgaacaatgtggtagtttctgatggatggagtactatgtgcacagagcattatttacttcagtgttatccggcttgtgatccacttagcagataatgagatgattttgaagaatgaagttctgaggaaatgtgaaactacaaatactaaaattcacgaattcacatcaattaagatgtgataacctatagaatgggaaaaaagataacctacggaatgggaaaatataaatatatgtatttttcattctgtaggtttttttccattcaaaaaatatatttatatattatatttatatattacgtatatttatatattatatttatatattacgtataacatataacacatttatatattacgtataacataacatttatatattacgtataacatataacactttatatattacgtataacatataacactttatatattacgtataacataacacatttatatattacgtataacataacacatttatatattacgtataacataacacatttatatattacgtataacatataacacatttacttatatattacgtataatatataatacatttacttatatattatgtataatacatttatatactatgtataatacatttatatattatgtataatataatacatttatttatatattatgtataatatataatacattaattatatattatgtataatatataatacattatatattatgtataatatataatacattatatattatgtataatatataatacattatatattatgtataatatataatacatttattatatattatgtataatatataatacatttattatatattatgtataatatataatacatttattatatattatgtataatatataatacatttattatatattatgtataatatataatacatttattatatattatgtataatatataatacatttattatatattatgtataatatataatacatttattatatattatataatacatttatttatatattatataatacatttatttatatattatataatacatttatttatatattatataatacatatatgtataatatagaaatatatattttatatatatatatatttttttgagacagagtcttgctctgttgctcaggctggagtgcagtgatgcgatctcagctcactgcaacctccacctccagaatgggaaaaatatttttaaatcatatacctgatagaaacttgtgtctggaacacagaaagaactcttacaattcaaataagaagacaaattataccccctcctctaaaaatggacaagggatttgaatagacatttctccaaagctgacatacacatggtcaataagcacgtaaaaagatgctcaacatcattagtcatcagaaaatgcaaatcaaaaccacaatgggataccacttcacatccactaggacggctagaatcagaaaggaagacagtaacaagtactagagatgaagatgtgaagaaactggaacccttatacactgttgatgtgattgtagaattacacagttgctttggaaaacagtttggccgttttccaaaacgttaagcacagaattaccatatgacccagcaattctactgctaggtacataaatatatctataactaagaaaattgaaaagatgtctatataaaaatttgcatatgaatgtttatagaaccactatttatagtaatcaagagtagaagcaaccaaatttccatcacctgatggaaaaattaaatgtggtatatccatacaatggaatactactgagccataaaaaggaatgaatttgctgatacatgctacaacatggatgtacctcaaaaacattgtgctaagtgaaagaagccaatcacaaaaacacatgactctatttatatgaaatgttcagaacaggcaaatccatacagaaagtaggttagcaaaactatgggtttccccatgctggggaaaatggggagttattgctaaccagtcaaagatttcctctaaaatcagatagaggtaatggttgtagacccttgtgaacatactaaaaaccactgtgtagtgaagtgatactaatgtgtatggaattgtacactttaaaagggtgaattttatgatatgtaaattctatctcaatacaacttattaaaaattcattaattcagcatgatagtatttcttacccatcaggttggcaaatgtaaacaattagacaatattaactgtttgtgaggatgcaggggaatgggaagtgccacacagtgcactaaggagaagaaattggtctagttgggtttggcaatatcaagtaaaactgaaagcatgtacactctacgagccatcaagttttcttgtagggagataccaaaaagaattataaacagacacagagctttcactgtggcaatatatgcaatcaagaaaaactacagacaacctaatgaataggttcaacagggtgatatatgagaatagcaaataacaactaacatttattgggtacttaatctgtaccaggtgctgttctacctactgtatttgaattaaacttaattttcacaactctgtgagataggaacttctactattcccatttcataggtcttaaccaccatgcaatgtgcaatgctgcttatgtactgtattcattcaacagaatagggtataacagtgagaaggaatgaactagatctacaaattcaaaaatcacaggaatcagaggcatgatactgagagtgaagaatcctgcagtgatacagtgaatagtccatctgtgatgatggtcaagagctcaggctccaaagcctgattgcagaattaattctcagccctatcacttattaactgtgtgaccctgcacaagggaactctctgtgtgccttatttcctaaaaaacatgacagtaatagtgcatgctacataggatcaataagaggactgagacagtatcagaagcatgtgaaccagagcaactccatcttcaatagaagctgggtaaaatgaggctggaaccttttgggctgcatttccagatgactaaggcattgtaagacacaggaagagacatgaggtcagcacaagatacaggtcataaagaccttgctgataaaataggttgcagtaaagaagctgacccaaactctccaaaaccaagatggccacctagtgacctctggtcgtcctcactgctacactcccattagtgccaagacagtttacaaatgtcatggcaatagtcaggaagttaccctgtatggtcttaaaaaagggaggcatgaataatctatcccttatttagcatgtcatcaaaaaataaccataaaagtgggcagccagcagctctcaaggctgttctgcctatggagtagccattcttttattcctttactttcctgataaacttgctttccctgtactctacagactcaccctgtatcctttcttgtgtgagatccaagaaccctcttttggggtctggattgggaccactttcctgtaacatctttctggcaaccacagaagggactatagtgaggaaacccctgacccaaaggctagctttgggtaaccggtggggtcctgtatcagcagtacagctccaggcaggcggtaatagcagaataaatgtaagctgctattgttactttgcatgcagtatgctacactgtgcgtataattttaaattgaacccatacatacagacatctatctgtatttatatatggatacacacatatgaaagtattcaaaatagactagaaagatactcaataatttcatgatagaggttattgctagaaagatctgggaagagaatgacactggcaataatatgccaagtagaatttcattttatctgtaatacttcatttttaaacttaaaatcttaaagaatatatgatgcatgttaatagttataattctaggtagtgggaatatgggtgtgatatgctatcttttatatttttatttttaaaatttcttcaaaaaatcttcaaaatagtaaatacttaaagatctatcaactcagacatttaaaaaatatgctttttcttccatgcttcaaataaaaatatcttacttaatattaatcacatacttgttggcatctgtaagtggctgagtagcttagctctttatttagctaatgttatacaatttgcttaaaacacacatttagtaatcccatctccctgcccacatgcacacgttagttacaatgaattcaacattcttacttgtgcactggacaataaattaattctactgttgcagtgggaaagcagccatctgaaaaatgcatcaacgaccgggctatgctatgttctgatagattttattgacaaatactggtagtgggccagatccggctcataggctgtagtctgccaattcctggactgtatcataggattcaaaatcttatgcttttggactggcaatacaatctccctgctataaacccagtttacttatcttaccttttcagacccagatctgttgttgtattcgtagtatgctggtttaattagctgagtatccttggataagtcatgtaacccccaaacctcaatttcctcatctctttaaagtgtgaataataccacacctaataacattgttgctataaaaattaaagaaaatactatatgtgattactgatcaagcatcttttccttcacctcactccacgtgttccatgacccacccaaacgacttacattctttgtacatggctttttctcacctttgcatcttgcttttactgttccctcaatgacggtctgagtcatttccatgcatgcaaattcttcccattcttctatttacagcttaagtgtcaaagtcatgaaagcttccttcatctctcttagccagaagtaattgctcttttcttaaatgacaaagcactttgtgcctctcttaaggtacttaaggcatttcatcttagaactgagtaggtgtcttatttttcttaaaccattggaatgacttagggacaacgagcaggatttatccatatttgggacctctccttgttcctttacccagcactgtaccatgctcaagtcagttcttagtatctacgtgacaaatgacatgcattgataacttttgtttttctgacttaaacaatttaaatgtttagtaaatagttataaaatgattgctttttgcatttatccttgggaaaaaactataaaaacatttagaagtgtagttccagttactgattagctgattaagtcttaaacaaggaaaaagaaaagatactcaaggccacccaaatgtgctaaatatttacacgtgtcatcttatgtatagattccaagatacttaaaagtatccacattactttgcccacaaggagactaagactcagtgaggttatgtgactttgtcccaagtctggaatttatttctcccacttaggaggtaagggctttttgcatttaatcaaagaaaatttgctggttagacagtttctagctgcatacacgctcaacctcctcattgtttgtggacttgtttttgtttctggcctaaatgttggctctaatgtccatcagtagatgactggacaaagaaaatgtggatcacatacaccatgaaatactatgcagtcataaaaagaatgaaatcacgtccattgcagcaacatagatggagctgcagatcattatcctaagtgaaataactcagaaagagaaaatcaaatactgcatggtctcacttataagtgggagctaaacagtggttacacatggacatatagagggaaataacagacgctgggggtggggagagtggggaagacagtgagggtcaacaaataatctactgggtacaaggttcactcttcaggtgatggatacagtagaagcccaaaccctgccactatgaaatacatccgtgtaacaaacctgcacaaatccatgtacctcctgaattgataaaaacaaaaaaaaataaaggttatatggcaatccttacaaaagaatttggaaatataggaaacaaacaaacatatcagagaaagaaaatatatattctcaattgataaacgtctcagtaaaatttttgaaaactttatcttttcctctttctcattatcatgcatatgctccctaaggagttattgggagccccagtaaataccaagtgctgccaaagactactgaggaaagacacaagtgtaagatgggaaagtgagtcatgtcctctgatgttcttgcctagtcttgactctgtagaagttgactgtaacctggccgggtgtggtggctcacgcctgtaatcccagcactttgggaggccgaggtgagtggatcatgaagtcagatcgaaaccatcctggctaacacagtgaatccccatctcgactaaaaatacaaaaaattagccagatgtggtggtgggcgcctgtagtcccagctactcaggaggctgaggcaggagaatggcgtgaacccggggtcgggggagcttgcagtgagctgagattgtgccactgcactccagcctgggcgacagagcgagactctgtttcaaaaaaaaaaaaaaaaaaaaaaaaaaaaaaaaaaaaaaaatagttgaagtggcgtggctttccatttagagatttaggctccccactgttatagcctcatcttttgggaaagcctatgggcatactgtgggctttctacaggttagaggcatacagctgcagctaaatcaagtcaattttcagaatctagccatctgtgagactgaggaagtaccaagtctttattcttttgacattcagtatttcactggtttgtgttgtacaaggcagaagatactgaaatcattatgaagtttgtaataacagaagtgcttttatttttgaccacagggattgagcacaccagccaatcaagagataaatgagatatggaggaaatggggcagataagagtgttcaggctgctttacactccttttcactattggaaaatccaatagtttggagcagtgtttgtaaactatttttcaaagagctttaaccttcagcaaaggtgtttcagggagaagaggcagaattaggggatcctccagatgccaatgttggcaagctctgcttcagttagaaaagctttactttgttttatacattgatgatttatgtatgtttttagacaaaaagaggtctgcttttttttttttaacagaactttttgaagctcctagggggaaaaacaaaacaaaacaaaacaaaacaaaacaaaccttcctcttcaggagaaagacaacagaagccaacagaaagcttcttcctaaagaactgtctatgaatatcttagaggtagacaactgatttaagaagaccaaggggatgattcttctgacagccataaccacaagatttcagattttgggctccagtaaaacatcaaatctacaaaaatcacaacatggccagctttcccactctcttctgcttattactttccaggtaagttctaagcctgtgagatcaccagtgtctggcaaatacagacaggcacagtggggacagatccagatgaaccagactgtggaaataagtggggcacccatttatttccctctcataaaggcagagattgcctcacatttcattatgattcattttatttatggtcttttctggaattttgcttgagttccctgatttctgccctatgcaactttccaatgtctatttgcctcctttgcttttaatagcttcagaatgaaaattaaatagagctatcttattacaccttgcctatggcttctcccaacttaattctgtgactgcaattaactttttttggaggggggttcatctgctcatcctcgtttcctttctttcccattcaacgtatctgtgtgaactgtaacaagactgtcaacctgttaacttttgagtaactcttaagtatgatgctaggggtgtgtgtgtgtgtgtgtatacgtacgtgtgtgtgtgtgtgtgtgtgtgtgtgtgtgtgtgtgtgtatatatatatatatatatttttttttttttttttttgtagagatgaggtttcaccatgttgcccaggctggtctcaaactcctgaactcaagcaatccacctgcctcagcctcccaaagtattaggattacaggtgtaagccatcaagcccagacaaaggctaagttatatttataatgaaaaaaaggaatttaggctgatgactggcgtctggacacaacaggtctcaaatcatggttcaggtttgggtttacactctaacctatggaattaattttagtgtttaaaaataggtaactggcccctgaaaattagcgttatcttttaaacacctatgggtgatatgttagaaattctcctaaataatatgattggttcatttcagtcagtacagaaaatacaatctggtaatactatcagggcatttttgttaatacattacttgcttttgtattgtagacaacaggaccaagaagtgacttcaggagcagaggaataaacttttggcctctaatgctactagctttaaaaagaaagccctaccagctacctagtacagtgtgactaaaattaatcaccgctcgactcagatcatgtatgtttcttgatccaagccattaaaagttaatggctttggaaatattggcagacaaaggcaaagaaaagagacacattgagggaatatggttcatgaaaggcatcttgggaaacacatgagatctgaccagctataatatgaatctctttaaaaaaagattttaatatcactcgttgctaaagaaagaagataaaaatggtctaaaaaatggatacggtatgctctgtgtgccaacaggtaatgtgcctttaagtcagcatgccacaggaaatgtccacgttccctaaaaagtaggatgataaaaactgaaggtccaagctgctgcaccactggacttaccctaaatgtaaagacaggagttcagaatctctctaataaatgcaagagctcttcattctcatgactgttcagaaatacatggacgaacatgataaacaaaggaacatgcaaaaaacacatttttaccactggctcagtcaattctggcctatggtcctttggaatggtgaataaggtttccgtggtataaaaaaggtattggccctcactgtagatcacacctgtaaaataaatgactcaccagtctgactacccaatatagctttgctctaccagtcattatcagggacagcttctatgagcaaataatgacactcttatggtctcccttcagaagaaaaagtcagaaaaggggtatatagagcttcaaggatgaaatacaaaaaggagtgaatattcactcctttgccatgatctccttgcagctttgaactaagtcacatcaggccaaggcacaaggaataacatatagactttggggcatcagggaaatggcttccttgcctcagaaagctcaatatcacatggtttatggcattttgaatagagaagattgagggcaacgttttgatctttttctcattaggcttacctgaaacatagatggtattaacgccataagggctgttttaaatatgctttcagagggatatggctgtgtccagccatccctccaaccactgcctggtggcctgaacatcagaagtaaggctctgtccactctatatagtttgttcaggtcttttgatactactcgagtctatacaaggtacagcccccagttcccagagcgaaattgtttctccaggcgaaaacgggctaatgtccaactttgattctaaataagtgagatcgtagagacctgaccagggctgtgaggaccactctcatttctatccatcttgacaacagtcactcacgaggcatttctgaattcctgacataactatcgcacgaggttaactgctataaaagtcaatgaaataagtaaagtcactccctactgtaagaaaaaaacaacaacaaactcattaatttctcaatttaaagggaaattttttccttgctgcagcagctgatgaaaacatcattgactaggctatgtggaatgtttccaaagggtagaaaaataaaactaagagaaaagagccataaacagtaagaaagaatgggtaaccccaagttcatttatcccaggcaggccaacaaggccacatacttagacagacacactcttccatgctcattttctcttcagagtctgaccttcggccctgaccgctctggcaccgaccacctcctgtgcctcccaggtcagtttcactagcagccatgataaaacagaccagcaggaaagtaagaataccagcagaaagtaatcttaggcttagctcctaacacaccagaatttagcctttaaaagttattccagttgggcatggtggctcacacctgtaattccagtgctttgggaggctgaggcaggactgcttgaggctaggagttcaaggccagcctgggcaacacagcaagaccctctcaactaaaaaatgctttttaaaaaatgagttgggcatgatgatgtgtgtctgtagtcctaactagtcaggaggctgaggcaggaggatcacttgatcccaggaattggaggttactatgatgacaccactgcattctagcctgggcaaaagaatgagaccttgtctcttaaaaaaaaaaagttattccatgataaattagcatatcacttctactttgtccaattgtgtactttgtcaaatctaaatctgacaattttccctactctattcctaagatattttcctatttaaaagtaaaaaacttctcttagagactgcatgcatttcaccagctacacagatcagccacttcatagtttttgtgagctatcacttgtatacccaaacatactttgacttcaagtgattaattgcagaacaaagtcctcttccgtttgcagagcttctcccccaggacacaggggagttgaagttggggagccctggacttgccctggaatgcatgatcagttaaagccaatcactctgcacttagtagacataacacccagagccgacccggcgatttaggtgcagagtgaaaggtaacagcatcgcattcatttcctcatttagggagagtagtctgggagacagtttgaaaactgaaatcagccctgtgtcataaatttgcaaatttaattgaaatgcattagtctttggaagacatttccaatcccgataatgaagacatgcatgtgctagcagatgcaagctcccccttttggttttgaaacctctaccacctactgagtctcaccaaaaactagcactgagagcctgtttgcatgggtgactggaacaaaagggtgaggaaacagggaagattgtctggagtaaggagtctctctggcgcccctcaaatcattctacccaggcagccccctgttgcatctctgcccaaggcaggagctgtcaggagtcccacagataagtaatttagaaatattctaggctgaatgaaggagacatactttaggtttccattgttctctgccaagctagggaaatggagtgcggacagatgctctctaaggttttgatttgagctccaaagaggtttgaggcttggcatagccatgaatccaaaggatctccacttccttctttttttctaaacaaactgaaagtaatacagtcaagaacagagctggcgattgttttattccattaactaatctttcttgttctgaacatgtctattctctttaacaaagctattaagattttagattcttgggcaaaagcaacccatatgggatacatttagggacttctaccaccaaaacccaaataaacaagatttttcatctatcagcagcagacagcaaatcttgcaatcaatttcaacatggcaaaaggaaacacaatgattatttatttgttcaacaaatactaactcagcatctactatatatatggaaaaacaaggtgctacagagaaaacaaagtggtacaagacattgtaattatcttctaggggcctatgatttatctaaaagagaaagtgcctataaccaaatgaataaaaaaccaaatcattaaatgacaaaactgaagatacagtaaacccccaaaattctggagatacgatagctcacacagattggagaaagcttcatgaaggacaccgtatgtgatcaataaatttttccagaatagtttcatagtctgtatatcacttgagacataatatttttagattataccattatgtaaatattatagtagttttaaagtagagtcacacactgcataatgacatttcggtcaaagacagacctcatatatgatggtggtcccataaggttataatggagctcaaaaattcctattgcctagtgaagtcatagccaccataatgttgtggcacaactactttattataaaaataaatttagtgtagcctaaatgtacagtgtttataacatctacagaagggtacagtaatattctaggccttcagattcacccaccactgactcactgactcacccagagcaatttccaatcctgcaacctccattcatggttaagcgccctacacaggtgtaccattttctatcttttatactgtatttttactgtaccttttctgtgtttagatatgtttagatacacaaataccattgtgttacaattatattcagtacagtaacctgccgtacaggtttgcagcctaagaacactaggttatgccatacagcctaggtgtgaagtaggctacaccatctaggtttgtgtaagtacactctataatgttcgcacaatgatgaaatcacctaacaatgcgtttctcacaatgtatcccgctagttaagtgacacgattctacgtgtttaaattaagtgctgcaaatttatattataggaatgtgcaaatacacaagagactggagtagaccaagcactcaaaggaggaagcacagaaaagaaggcagttaggctgatcccaggaataacactgcatgattcctccaaacgcatgttcagtcacccaggtccgcctctttatgtctatgtagccaaattcatctgctgtcaatgcccagctcattttctacttaaaatcacaggaagtcagggttggaagagaactgcaagatcacctgagcccaggagtttctaaacttggctgaaggatcactaggaaggtgtcaatctctgatctccaaagcctacctggtacatgtaaacaagaggatggtgaagccaaggcatttattaaggaaactaaacacaaaatgtgttcttgctctgccatctctgtggggagtttctaaaaccacagatttctagactctacactctggtattctgattcagtggatctgtttacatttttacaatgacctccaggtgacttgggagatctgccaggtttgggagctgctgatctctaacactgccctactggcttctgaatctcctctaaaactatctgcttagggtggtcctgattatggctaagtgtcttctcaaagctccctgtagcttccacatttcctttggatcatttcttcctccaaactcttacaccagccaagatcttcaatgctctttcaatatccagctgtgcgctggagaatgcaccatacaagacacagcaaagaacaggcttgtgtcctagaagtggaaagatacacataaactgctaaaataacaagttggaatgaattaaatactaaaggatcgtaagaagaaaatgctgtcagagcccacaggaaaagctaattcttttattaagggagatttcagaacatttctacagaacctggtttctggaggcagcccttgaaagacgactctattttgatcagcaggaaataatggggggaatgcggtatgaagaaattatccagtgagaacacaaggaaagaaagtgcaggtgtgagacagtgagtggtcatagtaggtgcagggagggatgaggctataggaaatgaggctaaagagtgagtttagggcaggttctcagagggccatgctataatttgggagagaatatgaagttcttgaaagaactcaagctttagtgtaaaaaaaaaaaaaaagacctaggttcttatcctcattctgtttattaatgaaactatgacattgaaaattcatttactctctcatgcttagctgtgaaatagcaataaaccttttttttttttccttcagggctgttgtgacaacttaatacattaataaattaaagtaccatccatggctaattatctttcctttatttcatgagcaatggaaaaccacagaatatgtttaaagagataactatgatctaaattctgttttggaaagataattggatgcaatattcagggacacttcaagaggaaatagaaaacctctaggcagagagaagagttagaaggatgtttcaataatccaagtgagagatgatagagtcctgaatcagagcagagacacctcaaatacagggtaaagaacaatcaccattaagggggcaaaactataaagagtcagaaatagatgaaaaataaatcttgtagcagtaaaaataattctcattccagcctgccttttgctaataggaggaggatagtgttgcaattgaaagttagggagcctaagaggaataggccttagttgagatggaataatttccaaccgagacatattgaattgcagatgaaggctgggtatacagtttaatgtgcagtaggaaatgtaggtctaaaacttgggaggccttggcaatgaggtgataggtgaagctgtgaaaatagttgggactaacaaaacagagaatagagcagaaaagaggaacactgagatttaccttggggaaggcccacacttaaggaacagaagaaacagaggaactaaggagggagatgaagaaggggagtagtcaccttcgcagagagacccaatatattatcagagcaacgaggcatttcgagatggaggaaactaccattggtgtcaaaaactagcagtggcacactttgggaggccgaggcgggcagatcacgaggtcaggagattgagaccatcctggctaacacagtgaaacccagtctctaccaaaaaaaaaaaaaaaaaaaattagccgggcgtggtggcagacgcctgtagtcccagctacttgggaggctgaggcaggagaatggcatgaacccggaaggtggagcttgtagtgagccgaaatcgcgccactgcactccagcctgggcgacagagcaagactctgtctcaaaacaaaataaaacaaacaaacaaaaaaaacccaaaaaaactagcagtggcaaagaattagttagaaggagtcatctgatttcagttaggaaatgtgacacagtctagtaacaatctcaatatgcagttctcctgcttcctttagtaaaggaaaccatgagtctttagcagggacatggctcccagctaagcctacatttcctggtctcccttgtgtatggccatgagactaagttctgtccaatgggataaagtggaagtgatgtgtgcaccttccagctcatgctatttaatattaaaaggaaaggttgtgcagtccccttcccactggcaggaactcagcagcaatggtagcagtagacctgacgtgtgcccccttacacgttgggaataaggaccttaccttaaggacggcaaccacaaaagagaagaaaactgggttcctgacatccaaactccttgcattcagattgttatacatgaggaaaattgatttttcctttgtttaagcaacagttattttggcctctgttatggcagccaagacgttatccttactgagacaggaaggagtgtgtggtacgaaaaaggaaataaggaaatgaacgtaaatcattcttttaaaagaagttagaagggaaaaggagacggaatgatgctttcagagagagggccaagaggtgtgtatagttttttaaaccaatgatcctataattcttacagttttttagtttatcctctctccttattcatggcatatttttaattttgcagatgtagttttaaatttattgcttggggaataagcagtttttattatttgtgatttctttttttcttttcttttttttttaaagacagtctcactctgttgcccaggctggagtgcagtggcgcgatctcggctcactgcaaccttcgcctcccaggcttaagtaattttcctgcctcagcctcccgagtagctgggattacaggtgtgcaccaccacacccagccaagttttgtattttttagtagagatgaggtttcaccatgttggccaggctgatcttgaacgcctgacctcaggtcatccacccacctccgcctcccaaagtgctgggattacaggcatgagccactacgcccggctgttctttgtgattatgacaatgttgtttatcagttaggtcttggggcatttactgtttgtgtatttgcacagaaccattttcaaatgtgatttaggaaaattcaaagttttgacaattaattagggggtgattgtattattaagggatttttaaaaataagcagctctttagtggttaaatgaatacaagtcatttaactacataacacagggcaaggaaaagaaagttaacatgttacaagttactgaaattatcatgtatgtatgtcagtaggaaagcagaattcaataaataacaattttatttatggagctttttctaggagtaagtttatcatgtaaagaaaagaattcctgtagtgtctacactgcagtcagtggcttgtggattgagtgacagcatctctaagtccccagctcttggtcctaaagtgacctgagcagtagggagctctgagaacagctttcaggatagcctcacaacagctttgaactatcttctgtaaagggtacagcagttccataatcacccataacagcagcaagtaatagacttaaaacaaaaaccctattggtaggtggctgggtaataaaaaaaacagccccctcgcccccaaaagaaaaaaacaagataactatccattcccctatggtgtaaattatagctatgtgtgtagtgaaatttcttattttcatttcacataaaattcaccaaacttctaattcactcattacttacccattatggggtttttaaatggcacttttaaagtttgctttggctcagggtgaattatatgcccagactttattcctggagtcatgactcccgtaggccttctgtaccttttgcaaattcaaagctcattttgtgggaggcagtgcttcgtgtgcatgcgcgggcatatgtgggggcagtcttaggatatcctaaatggtggaatgttttgtaagtaagggtcctatcacccagaataattcagcagccaaaaaaaataaaaaataaaaaataaaaaagagtaaagaatagccaataaaggtatcagcaaaaattaggttacctacttgcagttatgcatatacttggataatctattgatttaacaggtggaagaaacatgtgtaccaaaaattcattgaatgtttggatatcatgaggtacaaatacaaaagtgcattaaaaggtaaaagtgaggcaaagttgcttctgaggataaaataaaccttggattatgatacatcgtaaatgcaatgttggatacagatgagcagagaaaaaaacgttttgtgtacatgctccataaaaaaacgtgatcttcaagaacaacattaggatcaggcgtggtggctcatgcctgtaatcccagcactttgggaggccaaggcaggaggattgtttgagcccaggagtttgagaccagcctgggcaacatagtgagacaccgtctctacaaaaataaaaaaataaaattagctaggtatggtgatgcacacctgtagtcccagctactcagtaggctaaggcaggaggattgcttgagcccaggaggtcaaggctgcagtaagctatgattgcgtcatggcactctagcctgaatgactcaaaagaaaacaaaacaaaggccaacattagtattttatgagaagaactgggggttcaggtgaggcaaggtagctatagatgtttaccgatttcaagagggcaatgaaaattctttctggcacctaatctctctcccaactcacctgcaagtccttgcttgaaatatcttccaatatagtacctatagctcaagagcaaaggtgaggggcactatggcagaagggaaacacacagctcctcagaaaattagaaccgcagtttctagattcatagagattttgagctagaagagctcatagtcaccatttaattcctgcttcatcctgatacatacattttacagatgtgacaatcgggttcccagtgaataagtgactggcccaagatcacatagccaattaatgggggtgggggggtggcagggtgaagggtaaaaatgcctgttttcagctctctgtctccaggtctttttttacactgctcagcactgcacatattcagaagggataagagaagggactgggatgcttcactgaaagatgagtcctgataccaggggcagcacgatgactgagtgggtcacagactgcacgtctagaaagtggcgcttttggatttgtgcctgggctcagaagtttgctcttttgcttaagattggcttgaatgccaaggaaaattgaaagccattaatataccacgacacagtagattactcttccaaagatatagttaatctccaggtaaaccatattccccagtgaaatattgttccttctgccgaaccacagagttgtgccctgacaccagtttaataagattattgttcactcacaaggcacaagaacttaggacatttttatgtggtcatttgtatgttacagattattctggattttatgaggggaagctgttatcttgttatgaagatgcattcatctcaattttgtatcaaactaatgtgtactcatgaaaactacctaagcaggaaaagtaaatattcaccaccacctaaaattaacctccagtggcctaagtagttttcaacacttccatttcatttggaagtagaatttaaacaaaacagtgttttccatgaaacctgtccctttgaaaatgctagtactgattcttaatttttccaatgattttgagcacttagttggccttccaatatatttaaaaattaagtgagttgaatttttctgatgagatcccaaactagtttttttctttataattacacatcatcaggtttttattttggttatgaattttattttttaggatgcccttgttaatgatgttatgttgtctcctgatgtttagtgttgttgggatatattcggtttctggggaaagtataattgaaactataatatcaaatatcattaaatagatgtcaaaacaaagcaattatagtgttcctcatttaatagaaaaattccagttaatttgcttattttaccataatgaatgtgtgattctaacaggaaagaagctaaaatctttagcagacagagaacactttaacaaagttctcactttaggattttaagaaaaccctggatatcaagcagtttgtttaaatggttgaggagtaatatacataatgtgctaatatttcttaacacacagattttcctaaccatgctgctgcctccagaaatatcttattagccatcatcaactttcagagatgttgttttagggtagaaaccttggtgatccatcctcacagagcatggctggaatgaagggtcccctgaaactgcgaaatgagaagaaccaaaaagggtcttgtgaggtcatgaccctgtaaaggggttggtttacagagtgtgaagcaggcaattcaacagctgcacccaggaagcaatgccacaaacgcccgtggctgggaatcagagatactgtcattttgaaggacttctggataccacctctatgacagactcacaatttctttgatctaacttctatgatacagaacactctttaatgtggaatacagttatttcaacagaagatcattaacatataaagcaattaattgccttctctgttggtcttttgtttgttttagaccatttttagggccccaaggacaaatatactaaggactgtgctcaaaatctgaggtgtaaaaattcttaagcaaaagctgtacattccaggcccactgtgggatgtcccagcctcaaggtgtatggacctggagggcagactggccagctcctatgctgttttaagaatagtattttcgtatgagaattgattccacagaaacttattttagcttactttaaagggctaaataagtgatggcagggcaagaactatgggttgggtgccaagatttttaggattttttttcatgttattatcaacgacctattttctcaacaatggtacttttctctgcttcagttttatctatataatggatatattcagtttaattcccatgttcccaaagaagtactgatgggaagatgtgttgataaacacatctttaacttccttggaaagaaagaaggcctttctctttttttagctccctgagaaaatacttagagactaatactaggtcaaaaatctcacaattttgctcctcttactagtgttttaaggtgaaatatattagggtaggttgtgatgtgtctagaaatatattatgtatatatcttttctttgattacaaagtgaagaataaaaatactgaattatggaatgtcaggcctcacaggttagtaaaaggtagatgctataatgaaatatatcattttccttacgctgaggaattttttgtctccttccactctgttttgaatgccattcttatacatctgttccacaggagtagtagtaagacctgtttgaaatttaaatccatgacaccccttccataacagtggcaacccaatcacaaaaatgatcaggcagaaatgcttttttctgataaataggggcaaattcaatctctctaaggaaaacgcacacacacacacacacacacacacacacacacacacaccccgtctatattcagagttgaggtttttcttctacccccagctaataaaatcgggggctgcaacgaggctgagcggcacgcagtttgatgtccgcagcaggatacagggagtcagaagtggcgctgtaaatccaatgcggggcttccacgctgtgtgaagtgtggcctgagtcacagagattttcctttgatgcaagttcagtatattaatgggaaaagcattcacttttatttgtctatactgtctgcgacagcaaggctgcctcatttagcctgggccaacatgaaaatacacagagaagcaatctgttgcaaattagcacaaccctcctttcatttactagctagtaattggaaggggttaagaaagtgtaacttatcagatcatgtgagcatatctgcctgtgtggacagcaagctttccccgaatttccctacgatccctgaggcaaaaagtccttcccctatgaccacttcatccgaaagaaaacatcgacaggtgtgaaatagacacactttgataggtttaagagtgcagtttcctaggctcctgaaggaggcattaaaatctttttttgaaccttacctttctttagatatgtttttactctcccgtttccaaattgtcttgaagtcactgcagaactcataccacaccataaacacgtagctgggtgtgatctccttctcaccagactttggcttcatcccaaaatatcgtactgttgtttcaaaactgcaacaggtaggggggaaaatggaatgaggtagaggtgagaaattgccaacactaaaatccattagaggggggatgctgggggcagtttctcttgtgtttattttgtaacacagaagctgggggctcatagttactgaagtttattgtaaacctcagaaaatctatttgctcaaactgatttgccaaaaaatggaacttgattgggatgctcctgggcacatcttatctgtataaaatcagcatgtataatttctgggggtgtgtaggtaaaacgtctcgagtttgttcttcatctcaaatccccgtctcttccctgctcttcattttatgtttagtgattacatgcaaggtggatgacacactgactgcagcattagcagcggtcagttcgatagctcattgggaataattaatctgtcaaatgtttcacaaaaaagcaagaaaatccattctatcctttttcgggcatatactggctttgtaatcttgggtcaatcactcagcatctttgactctcaattttctcaagggtaaaataagagatgtagatgatatgatcttcaggagggctaccttttaaagcttaatatgatacaagaatacaaaccactgatgtacaaaaacagatacagttgtaggcatagcaagttttggatgaaaaaccatttctgatcttggaaaaatgatctccagtctggtcagtaaagaatcccaattttccagagtggattcccagatatcagtaagacctatcccagcaaggctcactgcacaccagactacctgggcctcccaagcagcccttcttggaggcactagctttgcagcaatttacagctttgaactcaatctttccccctcacccccacctaccccaagcctcacaagctcatttgccatgagcaagaacacttaaataaatgacccccttttctagggtgttggaaactaatcaaagcaggaatggctggccaggtttattactcaatgctctatcatctgttcagacacagtggttttttttttgtgtgtggccatcctgaatactgattttctaatggaactctattcaatggcgattgtaaaaccctgaagctccgttactattatggagcatactttcatctcattctcggttattgggcaatatgtatctcataagattttatcacatttcacagatgaactgttaattgattccatgggtacgattaggcgagatccaagctggagctgcagctctgagtcccataaattctttgtgcttctgtaaagaataaatctgtttttaatgcaaattaaaactactggtcagggaattttggctcccagttattaaaagactggaaatgtgtaagtggagaaaggcaataactgcagtaatctcttaagggactctattataattccaaacatacataatgttgagaaaaaccgggaagggaagaatgtggcaatgtccactcttgccccagacataacccttatttccatggcagtccaaacactggtaaaaccaaatgtacactctatagcatgtaactttatttcactcaaatgaaaattattttgactatagcatgggaatacataagtagagagttatataacctataggaacaggccattcatttcctacaaagtcacaggactttagaatgggaaggaatttacaggatgacttgcccaaattatcattttataggtgacaaaacagagacctggaaagactgtgtggcattattccctggtagggttgggcctggaattcaggtcccctgattttctgtgaaatgctctgtctgctttatctttctgttgctcatgctcaataacacaggcatttaagagacaaaatagtcgttctaccccacccttttctactttagacacaggtgtcctcctctgtatcacacataacatgcattaccccagggagggcatgtgattattttttctctttcttatgcttaccttctatacagatacatatttatttgagcattcatggggaagggaaagtctttcatttctagtatttagagggacaacttatcttctgattttccagcaaaatatagtgaagtccagttattgtgcttcatggaacacctgacacctctggcatcacctggagtctagattgtgagatcaacatattgcaaatcctggtgcagtttcagagaatgtcaagagtgatttggtggttgttgcacagcctgagaaaaacacatcatcctcctgtgggcctcgattttcccaactctaaactgaagctaaccattgccctccttgcctctctccctggggatttgtgaggtactgcttgcttactctccctgaaagggggagaaacactaaaaaaaatactaaatttcagccttttttttcttatgtgttttggaaactaagaaagcaagtgaacctcttcagaagaaccaaagtacacagactcccagaggatggcctggctttggcactcagcagcttagacaaagataaagtcgcttcaagaatgtgccttatttggccgggcacagtggctcacgcctgtaatcctagcactttgggaggccgaggcgggtgcatcacgaggtcaggagatcgagaccatcctggctaacatgctgaaaccccatctctactaaaaacaaaaacaaaaaaacaaaaacaaacaaacaaaaaaaaattattcaggcgtggtggtaggcacctgcaggcccagccactcaggaagctgaggcaggagaatggcgtgaacctgggaggcagagcttgcagtgagcccagactgcgccactgcaatccagcctgggcgacagaatgagactccgtctcaaaaaacaaacaaacaaacaaaaccagtgtgccttatttgatttcattgttattccactgtttaagaaaatgctaaaagctagaatatgaacctgcaatggtttgataaggcctagactgttgtctttcctagacaaaactccattttaaattcagttttgattcacagagattgaccactgaaaatcttttgcaatttggacaagaaaattgttgatatttaacaaccaggagaattttctctaatatacaggaaacaaaggtcaatcatgcgatttgaaatttctatttgttagcagatagctctaaaatggctctcaaattttagaagattgatttctaatcctatgtttggttttatataactttttcatttcatgcaaactagtccctgaccccttttctctctgctataattccctgtctgatttgtatctttttaattcagccaaacatttttaaagtacagacaatgattacatcaaagagcctgtagcgaagtgaactgttttacttttacagtcctgagatccagagcggaacacatccacttattgtcttacatgcatgccttcagaaactgcttaggaaaagcaaatatgccttagcctcagagtaaattgtttctcttgagaataaaacataagaattcactaatctcacacaaatattgcaacactgaccacaacctccttaaagagtataaccaaacaactgtggtttctacattaaagatgggatctaacatatttcatgtatgacatgaaagctagactaccttcaccacaaagccacggaaaacgctgacaaccagaatttatgactcccctccacagagctaatgcacggcagcagtttcggcccctccacgctgggcccccttttccttcagcaagaatcctgaaaaagtattagaaatttgacatccgccccagaagctgaatttctgtttggcctgacaccaacgtgcccttgttgataatctcttatgtgctggatgtttctataacacagacgtgctagttttatgcattgtgaagggaagcttaacataggaataaggtcaatagagagacacaaactcctaaaaacatagccatggaattatctcagttttgaatgattattatgataggatgataagcacgatttgagaatatgtctgtacttagcaaagtgcaagacttgccttcaccttgctttcaccagcattttaatcttattggtaattacagtgggaagcagggcaagatgttggcacctgtgaaagcagggcagatggcaccgtctatgggatttcagaagtctcggaaattgtggctagacaggaggaaaatggttaatttctacaatctgtttatttgcatttaaattcctaactgggtaactgttcctctcacacatttgtaaagctcatttgtccttagatgctgtctcctacctctacctgtcatctaatttaccagtacttttagaattcgtaccagcaaaatgtatctcaaatttcagccctaaatatgagaataccgctgtctattgccactcactcttctatgagggagggagagccacactgactaacctggtcaactaacaaaaaggaaaaagccctaagggatgagaactgctgatgattaggttccactgggtggagtgaatggttcccatgtgatatctattgagagagtgagcgagcaagaagatgcctgaagtgggtgacatgaatctgaacagaagatctctgaggtgttccccaacttctgggggaaattgtccatacgctgtatgggcatatggacagccccttctccccacctgaacatatggacagccccttctccctacctgccccttgtttataatatcctcctctagaagctgaggaaagacataataagtctcttgggtgtctgcaataattagtttgatctagttgtaatgccaggaaggatcaaactgtccctgacttccatcaagcggttcaggagcagagcaatgcaggacaggcaaacaggcagaatagtgtcatgacacgcatgtgaggcaggtgagtcacttctggatgattcctcacttcctgaggaaaaatattcctaagtcctgctacagtgctttcactccagcttccaagtgaagcttattgcttatggatgcatagtcttaacacatggggccgaaagtagggctagtcaaaccttatgctacaggaaagaagtcagtcacacaaggacaaatactggatgaccccaattgcatgaggtagctaaagtagtcgaagtcacagagacagaaagtagaacggtggttgcctagggacaggggagtggggaatggggaatttgtgtttaaagggtataaagtttcagttggggaagtaaaaatgttttggagatagaactgcatagcaaaatgaatgcacttcataataataatacaaaagaatggctagtcaaagaaagaactggggccaaatcagagctgcttaccttttctgtgcattctccaagtgactttcttccatcttatgctcttttttggctgtaaaagataaatcatgattaaaaattttttcttctgttgtctcctttgcgtaatcttacagcttcaattacacccattcattaccacaggaggtctgaattcggggggggggggggggggtagcctgtaacacatgtcctggcaataacactcaatttgctttatttgctaccactgctttttttttttttaaattatactaagttctagggtacatgtgcactacgtgcaggtttgttacatatgtatacatgtgccatgttggtttgctgcacccatcgactcgtcatttacattaggtatttctaatactatccctcccccagccccccaccccccaacaggccccagtgtgtgatgttccccaccctgtgtccatctgttctcactgttcaactcccacctatgagtgagaacatgcagtgtttggttttctgtccttgtgatagtttgctgagaatgatagtttctggcttcatccgtgtccctgcaaagggcatgaacttacccttttttatgactgcatagtattccatggtgtatatgtgccacattttcttaatccagtctctcattgatggacatttggcttggttccaagtctttgctattgtgaatagtgccacaataaatatacatgtgcatatatctttatagtagcatgatttataatcctttgggtatatatccagtaatgggatcactgggtcaaatggtatttctagttctagatccttgaggaatcaccacactgtcttccacaatggttgaactaatttacactcccaacagtgtaaaagcgttcctatttctccacaccttctccagcatctgttgtttcctgactttttagtgatcgccattctaactggagtgagatggtgtgtcattgtggttttgatttgcatttctctgatgaccagtgatgatgagcattttttcatgtgtctattggctgcataaatgtcttcttttgagaagtgtctgttcatatcctttgcccacttttcgatggggttgtttttttcttgtaaatttgtttttctttgtggattctggatattagccctttgtcagatgggtagattgcaaaaattttctcccattctgtaggttgcctgttcactctgatgacagtttcttctgctgtgcagaagctctttagtttaattagatcccatttatctattttggcttttgttgccattgcttttggtgttttagtcatgaagtcttgataacagacatagctaatagtggccaaataatttattgtttcctctgggatacttttgagagtaatgttaataattacacctaggcaaagacataaattagggaaatcttgggtagatcacgacatgtggtccctcttgcacgtctcatcatgttcccccttactctaaacattataaatccagtagcatttgcagcagtgctgctcagagtcatgggaatcttgccgcatactgcctccacacccacaggcccttttggcagtctagggaagcccatggactcttgtcagaataatgttttcataaggttactaagaaaatcagtgatactaagatacaattctgaatccacaggttaagaacctatgttctttctataggattatcaagaggtttcattttggggtggttcttttatatatccttctctacaatcagaagatatattattatatatgaaaataccactctcacactttaaaatatccagaaaaataggaaagttgttaacataagctacaacataagttgttatgttattatgtaacatgttattatgtaacataagccttcagattcctttaatttagggctacaatgatgtaaaatgaacgaaaataagtaagtctcgtatctaggatctatgctgtgatacttcatgaaagataagggattttgaaacatcacccttttattaaacctggccctaccacttactatctgtatgactttggcaagttagttaagaccaaatgcttagttattgcctcatctgtcccatgagaacagccatagtgaccattatcatacagctgctgtaaagatttaatgagataatacatgcagagtgcttagcacataatgtgtgctcaatataggccatggcaggtattaatactacattaccataatcttcctcattgattttaaaatgtaaaggctcccctgctcaaaaccttccaatggcttgtcttgccatcagccttgacatagtatctacagtcttcaaaatgctctagaaggccctgcacttaagtcggctccctggctgtttggtggcattacctcctctttcccacaccccttcctttccagcttcgctggcagctgcctctggcttgagcgcactgagcgtgcacattggaggatctttgcacttgctgttcctcctctctgggacaccctgaccacagtctgcacgatgggctccctcactgcattgaggtctcagcagaagtatctccttctccagcttccgtaaataaaagaccatcccttgccactcatcatcttcctactacccctccacacacaccctctacccctaccttccttccatagccttcccacagcctctatctacctaacagactattcctttcctcatgtgtttatcatgcaacaactgaatgtaagctctaggagggcagcagcttcacctggcttgctttctgctgtagccttaattgtagaaaactggctatatgttaaagcaatcattttagcttaaaaatgcatatattggataaagcttgcttaaaaagagatatactggctttcctgaaaaaactttatatttagaatatgaacataagctaaagaagattgagaggctaatgttgtataccattatctctaaatgtagtatatttcaactagtaaaacttattttgttttatattaaaatgattcagctttcataagtgcatcattttaggcagacggaagccatggccagggccatcttttgctgtctgatgtccccccatactcttggcaggaatttctgtgaattagtctggtacttagccaatcagatactgagaaatgacctgtgtctctcctaggttatcaagttccccaaaatgtgaaacaaactagtgatctgttcttctccagtgattttaagttatgtgcatagccaaacaggaggaaaaattcctctgaggcccgagtgatcttcttggaccagctctgctctctcagcagatggtttctaactggctacttccaagctgtgtgtgctaagcagagtgtggccaagccataactgtatatgaatttagtgacaagaaataccctattcaaactgaattgagcatcaggtaagattttgcaatacctctgtgaatatggtgatttggagaaacagagtctaaatgtaaaaagaggtattattaagagccaatgcacactgcagaaaactctgagggtttagggaaaagggccttcaggaaaatgagaagaaattagagatttaaatgttccctaattttgcccttgtacagatacaaaaggcatctacctttatggtgtgacttggaagctctaacagcatgaaatatttctcctacttgaatgtgtaaaattttaaaccaggccattacacattttaagtcttcaagatgctctaagcaaaacacaaatacatgacctggaagaaccatgtttaaagactggagtcacaaactcaaattctaataccatcaacaaataaggtcactgtgggccaagtataagaatcccggtgttccaacgttctagttctagcttttcaatacgggaactatatatcatacaattgctccacaagaacaattctgaagttcatagttccacagcctaccaagtgaagcagaaatggctttctattccatggctatgggcccaaggaatgcaaatcagaactcatgataactaactgccaagctttaaccctagctgtgtcacctgagtgtcatgagccaatcacagtgtcctgtgtttcagtctcctgctctgtcaaatggagatgatgatacctaccctcccacatagttgcagccagtctttgcagtcaggtctttgacagttcaacgtcatgccatggctgctgggggttcaagcttccagtgggttggctgttttgccagagttaaatgaagtgtagcatagaggaaagagcttgggttttgcaccaggtggacctgggtttaatttctgctctgatacttattaactgggtgatcgtcagaaaatcacttaactccactgagccttatccgtaaaatgggaataataagatctaccttgcaaagtgcttgtgactatgagatatactgaacgtgtgagattaatctagtgactgacatatgatgggcattccagaatggcagccatttattgtctattggctagaagcaaatgctagtagtcactactctagctttctgactttttggcatggttatcacaaaattgcacacaacatgctttctttagaatgttcataactgctttcagtagacaagaattttggttgttatcatttatgctcaaaactttagtgtttttttttttttcatttcactcactgagctgatgtccttagcatggcctgtaaaaggcttttctacaaaagggtggttccctatgtctgacctaaagtcattttatttgctgtttcagctcattttgttttatttcatcctcaggagaaagagaaaaacttatttataatttaacaaataactgggagtcatgggggtggatgtgaggggagaggtacttaatgattactctcacctgttttttccccttaatgaccatggagttctgtaatctttgacctgattaactggatcacttccccaataccaaataaaagacaatgatacaggagtctttttttgagaggttaagttttctgagagctaagattccttccttaacctctaggctctatatggtgacctgtaacaggttcccctcattgcacagtaaattcaattctctttgttgccaccaaaactgccattttagaaggcaaagtgaactatgccccttttctgcttaatgttctcactggttccccctctgaagacaaagtgcatttgcagttcacagtgtgcccctcacacctgcctcctgccatccccatactatcatccccagagctcctgctgcgtgggactcatggctggtctctggacttaacttgctgcatggtgtctttatttttgggcactttgctccttctgtttctaatgccttctcttccttgcccttctcccttctcctacccttctgtttgaatgtcttctctttctttgaaaaccaagcttgaaaatctcctctgaggggccctccatgcctctcccccataatgtggtgagccgttctttctgtggagatccaaacacactatctccccacaattccttatcacagcacacagaatgctatgtcaaggtcactggcttgcagctggcttttcccactggactctgtgctcctttcagagttgcaaccaaaatctgttttcagagtttttctctcaactattacctagcaggtactcaaatacttatttttttttttcttttgagacagggtcttgttctttcacccaggctggagtgccgtgatgcaatctcagctcactgcaacctccatctcccgggttcaagtgattctccagcctcagcctcccaagtagctgggattataggcacgcaccatggctggctaatttttgtatctttagtagagacagggtttcaccatgttggccaggctggtctcaaactcctgacctcaagtgatccatctgcctcagcctcccaaagtgctgggattacaggcgtgagccaccgtgcccagccttgtgtacttatttgacagatggaaaagtacacaacagaagaacccatgttagcagaacacagtccctactcattaagtgcctgttttttggcacagaaatttctaatcttccatcttttgtttgcaacaaaatagtgaagagtagagtagaactgaaaagcaagagattactatgcccatcctatgtcctgcttttagactgatacattaacacaggcacaaacagcactaacactatagggaggcacaaatagcattaaccctccagtttcgtctgtatcagattgagtctttaaaatatactattttccacagttaactttgaaaaagagaaagtttttataaataaaatgatatttccataaaatattcagactaagaacattcaccatttaaatgtacccaaataaccgaagtttttattctcaagagggtggcattcatacaatgagagtggctgaaggaggaggccactctttaaagaaagtggggcttttatgccaaacgcaattaagtcctatttatggatgcccatctgggaggcagtaaattgtgaaataaggggaagggataagggttggagtatcttcctagtattctttacacagtctattacactttaatataccatggtttatggacctgacatggttggtataaaccaacaggacgcacagttaagaagttgtttttattacagctctacaaatatgggagccgggtgatgctaacgaggaaacaaagggactgcgctctgcttcacgtgggatccgtctgatgtgagtgtggcaatcgttttccatttcttagaaaatccccgttgtgcactttccaggagaaacaaatgctttacaccaacagaggcacagcacgctgacatcggaaagggatggccttttaacatttgagagaagaaaacaacagatatttggaaccagtttgtgatgcagagttcttacccttacatttttccttctggtatgcttgcccatggaggacgatatccttgctggtcttcctaagttattagttttcctggttgtggtgaaattagaagagtgatcatttctggtctgtcagagcaagtgtctaagctggatggtaaagttgaagagtagagggccacctgtgagattttctgtgtaaagtgttatgaggttgtataaagacatgctgtcaaggttcctagtgtagggtgtaggatttccaggtcacttgcctaaggctaaagtggactaggaaactaggcttttggtgaaagtaccaagtaaaggacattgtgtcactacactctgaagaggtcttcagagtcataaaataaaaaaaaaaaatccagttaaaaggagtcttcaaatggtcatctagtctacctcccaggctgatgtgctatcctggatcctcttatttccagtcagactttgcagaccttgtctttttcatcattttatttgctttttttttttttgagacggagtctcgctctgtcactcaggctggagtgcagtggtgcgatctcggctcactgcaacctccgcctcctgggttcaagcgattctcctgcctcagccttctgagtagctgggattacaggcacatgccaccatgcctggctaatttttgtagtttcgccatgttggccaggctggtctgaaactcctgacctcaagtgatccacccacctcagcctctcaaaagtgctgggattacaagcatgagccaccacacccagcctttttcaccattttaatctgccatttctagttgccccttaagtgaattggagtattttatggacactaaacaaacaaacaaacaaacaaacaaacaaacaaaaccacgaaatggtatcacctaacttgggcacctggggctgttctcaaccagggtccttcatctgaactgcagaacacagaaaaggatttgagaagctattttctcagtttccccatatacacatcaccgggaacattctaaatgtctaggacaatgccaactcattacacacaatggcagagatagggcagtacgacttaattcccttacacatagttgaaaatgtgagtcctgaggcaatcaaacttacaagtgacttataatattaagtcatttacacttttatacaggctgagtactccttatctgaaatgcctgaggccagaattgtttccaatttcaatttttgtcccccacattttgggatacttgcatatacataatgtaatacattggggatgggacccaagtctaaagatgaaattcatttatgtttcatatatactttatacatagagcttgaaggtaattttattcttccctcaaggacactgaaaaaactgtctattgtgctcctgcattttggccgagaccgtcacataaagtcaagtgatgggtcttgtcaaaacgcaggtgcgcaacagacagtttattcatgtcatgtcagtgctcaaaaagtttcagattttggagcattttgcattttggattttcagattagagattctcagcctgtatctctaaatctagtacgatgatattcgtaaaatatcttattggtataacaacatgaattacaaagtgctgtttgcatacaatagaaagggtcagaccttctacaatagaaatatttcaggtgtcatgtattcatttatattctctggtgactgtaataataatttgtataggtgacaggtacaatttcagagatcacaatatacagttggccctctgtatctgtgggttatggattccaccaactgcagactgaaaacatttggggaaaaaatggatggttgtgtctgtgctgaacatatacacgctttttttttccttgtcattccctaaacaacacagtctaacaactagttatatagcatttacattgtattaggtatcataagtaatctagagatgatttaaagaatgggtgtaggttatagcaattacgacaccattctatatgagagacttgagcatctgtagagtttaatatccataagggtcctggaaccaatcctccacggatactgagggatgaccataatctcaaacacttaaccacattatacatctagtctgtgatcaatagtaactactgcaaaagtaaacattttatcaagtcacagttctaggaggtaatcggacacaagtataattgggatctaaatgaagtatatttacccacactttttcagaagtaaactcactttttttttcccaatatattttcactagagatgagatgctttgccccaaggtaagtctttcaaccatttacaatactgacaaaacacttggccttcagactttatgaaggattttgttcattcttcttaaaggcaatcatttgatttgtggctgatattctactacttttgttcctctgcttctgtgtagtccagtgaagtccctcaatgctgcacaactacctgtatgcagaaacatcttggcttcgagtgatacagatgcaattccttgatgaagttgataagacagtataaccttaaccttgctataacttagcccaactatttaatctcaacgtggagaaaatggatacccaagtagatgaagcgactatttggattacactaatagtcacagaatccaggccttttgactaataatttaataattttggctaataatgtgactaataatctacattttccaacgctccctgctgcttcccaaggggcagcatttttctccaggattcccaaacaccgaggtggtattttgaagctgcactgtactacacatcttccataggaatagatacatcagagagaaagttccaagatggaatttcagctttcacgctaaatttcctgactcttgatgctttaaaacagaccgtgggggtacaatttcagaatgatctggtgagagactcattaacattaatgggagtcaggtggtcacattctcaaacagggcctgaaattctccaagttataccatcttctagacccatatatgtctttaacttatcaccattaatagaagtgacagatgtcttttgtaaaatgcttttccttagttatttttcacagatatttctaaacaagcatatttataaaatataattttcacttaagggataattatacataaatctatttccttgtaattaaaaaataattatacataaatcctgtttccttgtaatgtctaccttgtctcccagccatctcatttccaacgggaagggtctgaccttatacaatactttagaagtatttcaggtgtcatgtagggaaactaaactctatagcctcatcattcagacagcagacaccatttaggaaatattaggaattgcaaagaagctaaatttttaaaagaaggcttcttgcattttgtttcatcaagaaccttagtgaaatttcaaaagcaatggggtttacaatcacaaggctctggataaccatttggtgataaattgcaggtattctaatttggaggaagctcttctttcccagacaactctgtctcatcttaacattagcactagtctgaaggtgtatagtttctgaaaggcatggactacggcctttttctttcaaactttgtattcaaatgcttagcacttgagactataaacctagtatttataaatcggtaacttgttgctttattaattggtgagaatgtccacaaaagtgtgaatttgtagcaggttcatgagcaaagtggtaataggctgcatgtttattttattttattattattattattatttttgagacagagtctcgctctgtcgcccagactggagtgcagtggtgcgatctcggctcactgcaagctccgcctcccgggttcatcccattctcccgcctcagcctcccgagtagctgggactacaggtgcccgccaccacgcccggctaattttttgtatttttagtagagatggggtttccccgtgttagccaggatggtctcgatctcctgacctcgtgatctgcccgcctcagcctcccaaagtgctgggattacaggcgtgagccatcgcgcccggcctgcatgtttatttttatttcttctttaaagtagtgttcttcaaaagcaactctcatttttttaacctcatagcattttagtactagatattcagcaaatctaaagaaagaaagcacctcatgttaattttttttaatggaagaaaaagttctccaactagcttctttgggtttcccataactgcctctgatgattatctatgatatttagggccaatacttcattcttcagactttaacttgtccatatgtacactagataaaatgaaaccttacacttgaaaactatggagctatacaaaacttaagaaattacctcatataaacccctcatgctatagtttaaaaacaagctaagttaaacaataataggagactgaatagatagtggattttccaataacggaatcacgtactggagtgtgtccccttcccttcaccagccatagctacaactaagatccaaggacagtcaacctaatgcttataaagtagtctaatacaatggcctagcacagtcagattggtggtggtggtggtaatgatggtgatgaacattcactgaatactcagtatgccaggtgctatgatactaaattcttaggttctacactgtggattaacagtggagccgaagcttccaagtgctccattactttctaactattgacactgggtcagttgtttaatgtggctaagactcagttttctcatctataaatgaaagtaatgatagagcctacattcgacagctgtagtaattaaaagagatgtttgtaaggtgctcggccatggcacctggcacattagttaagtaaataccgattatgataatgactaccatcactataattctttgtaatccagtgacatttgcttgtgcagcctttcttgggttcctgtgaaacttctctggggaatttcagcaccctgtttctccttagtaatacgtgtatccctacagtaagctcccaaggattaaagcacacttcctagacccacataccacaaaacgtgcttgcaaaaaatatcacgggaaaatgctatgacaaaattataaataaagaatataaagcagtggcatgatgtgcctaaagttacgtcaaaaggtatatcacacacattatatatatagttatcaaaatattgaatccataaaagagtcagaaggtaacataccaaaatattatggttgctatttctgcctctctggttaagaggatttttgtttttcatttgtttttagttgctttttgaagaaaggggctcatttaatataatcagaaaaagaaacaacagatgctgtttggaggcagctgcagagcactttgaaagcgagtgacctgcctaaggtcatacaaatagttttgggcaaaaaagaaagaagctgtcccctgactcccgactagttttcactaggccacactgtgattctttataggttcctgctgaaaaactgtaaaactgtcatattactacagtggaacaatagagaaataagtcgtaacagaaaaacaaccattgtcacggataagttaaatttcattgggcagtcacccacattaaagtcctttattcacaccttatactcacaggcaacatgaaattctacaatctctataaagtaaccattctacatattttttacaaattgttcagaaggacatccaatattaagaatagtttcaatcacattataaagagtaaaattcagataaaaagctattaggcatggtcagagattttaatggcttaagactgacgttaactaaagaaaaactaagagaagaaagaagccatacttatacatgatttacaatatacagcatcataccttgacaaaggaaatttcttgttctagatctatttacacgaaacctctgacatctgtgtagcttaacacatttgttaaatagctgaagctctccctctagaaaaataattgttcagatgtttagtcataaaaatgaatagactaccagaacgtcctgtaaataatcatgaaatagccattgctatccttaaatcaatcttcttttaaaaccctggcaaaggctaaatgtacttaggaaactgaatttacatggccacagaacccgacaaaagtctaatttccctaatattggctattgcttacaacatcaaattactttttaacccatttttatttcacttggtcaagggtttgtcatagctggaggtttaaaacgggtccactagaaatggtacccaagaattaacacgatgacttcaagagctctgatgttaccaagtatctaggtgtgatgaaggtcataatctgtctcttgggtgatatttgcaggaaaagaaaatgctgagagaactgggattcccaaagaagatgctgcagaagatattttccacattaaagaacatttgatctgttccaccagtagatgaaccattagcagaagcaatcattatcagagccagtaaaaggaaataaagaaatgaggcttggtttttaaagtgaccacactgcttctaagtcaaggtgaaagtgctgacagtgaatttatcagaattccaggtggaatcctccagagtcacctttcaatcataactgtcatcctcagagaaaaagcttttgttgaagaaaaatttgtacaaacattgaataatcacattgatatggtaacaatttaacaatacattcaataagaatgaatgttacagtgggtcactttttccctgctttttatcaaacctttgtattttccccagattttacaagtaataaatcctcattgtagaacatttgagaaagatataaataagaaaataaaagcagtgcataagactttctctgagcaatggccactattaatatgctgattcatttcataaatgtatatatttataatcacacactcatttgtgctttagttatatagttgaaattatattgaatgtaatgtcctttcttgctttttcattttttcccttgcattttatttaacataaaggtataggtataggtcaacttctaaatgaatacttttataatgaatttatatttaaatttacaattattaaaaataattgttgaaaaattagcctttatttcaaagtgagtatggaacctattcaaacaaaacattttctagaaactcatgaaagcatttcagaataattttttgacagttcttcctaaacgagatcttgtaggaaagaagtgtttatgaaggattattaaaatattaccaaatagaattaaggcagatttttatcttttgatttaacttggaaatcatccattgcttcaccctttagtcttcctatttttgcgccttagagaaatgttttacatggctaccagtgcattttaaaatagtgtctaatactgcaaagtaagttgagatttctttatcctgtgcttaaacctaatatatactacttattctgtatttgaaaaatatagtataaagaaaatacccttaatgcaaaaaatattgaggatcagtatattcttggaagcaaatgtgaagcctctgtgtatatgacaagccacacacacaagcacgcattcagtaggaaacagatctccctcgaaatctgagagggtaaaatgttcaaatattatgcaaactggagaagtgccaccatctcctgtacgcaggagcctgaagctaattgtacaagtggcacgaagctgatttcagaaagtaaaaaaaaaaaaaaaggctcatgaaaccagaggcttgaaatgttttactggagaaaaaccatagcattacctcctcctgtgggatgataacaatgatttatgaagctgaagtcattccttgtgattgcacttcagggagattggtttcacatgatctgcgaaggcaggcaaggcgagctgaagaagaaccccacatgttcaactgaggctgagctctgcctcttcaaggggattccagagctccgaggagggggaggaaaacctactgctttctgatccatgcaacccccttccccccaaccaacaagcttattaggtggacatacggctctcttattttctctctccttttaaaaagtattactacttctgctgtgtgggagtagaagcttgttgtaaatgcccagcaggatagtagcaaagccaagattaattccctatggatttatatgggtcgttctcacccacgatgacttgtaccgtttcaaaggtgcttatgctgctgtttttatggctggtcactaactttattctggcatatggtggttggcgccatgacatggagtgaacattttatacctgaattaaagtggatatttgacagtttctgtcagaaagttcagagcaaagaatttgtgggacaagatttattgcatattttatatgggacacatctgtttctttgctagctttgttccttcccacaaaaaaatttaaagacgtttcctaaagaaatataatgactgataggaaaaaaattccaaagcagaagaaaaatatggtcaaaagttgggcatttaggatctaactttataaaaaagaaagaaaaaaaaccacttctcattttgacgaggaaaaatgactcacagtcatgtatagaagctcagtgaaacaatgctgttattattggcaattattttatggttagtttaatgtcatttatataatgaaattaaaaatgtaaatgtattacctaccatttttcgcatacttgaaacaggactggcaagaataatctgcctttgatgtatttttaagattttgccatctcaaatggtggactgaataataagtccagctacatcagtgttaaacaaaataattacagatatttaaacatttaaaactgatatgcctaaagataaacgcagacgacttccaaccaaaatccatcaatacaacctgaagggtgtatataaacttctcatctaaaaactccctgtattgtaaaaagtcaactgagtaacaaagattcatgattacaacgtgaagggtgtatataaacttctcatctaaaaactccctctactataaaaagtgaactgagtaacagagattcatgattacataaaaagcgggctcaacctgaaactttgcgttaacagacaggccactttttcttttaactgcaaagagagaggctttaattctattatgaaactgaaaataaaacttccactcttaaatattttgcaaaattaatccttaactaatttaggttatatgcattctccttataaaaatataaaacattacagataaagtccccctgatagccctctgcatcacaccctctgtctcccccaacacatatatatatatagttatcttctacaactcaagtactgttatcattttgggagtatccttccagaacttctgagtgtccctgtgcaaacatgcaaggtttctctaagacagacatagagaagtagatttgttagtgttatcaggtagacatagttttaatttatttgagactgtcagtcctccacaatgatagtataatttaatactacgaagggctgataattgttttgtcaaacttttaaaattctgcaaattacatagattttggtaccaacccttggttaaatattttgcaaatatattttcccatgcttttgcttgtctattaactttgtttacaacgtttatcatttttaaatttaaatctgaaacagtcaaattcataaatactcttcatgtcttttgctgattaaatcatttgcaagaaggtctcgtctactcccaaggtaataaagaggtctcgtattttaatactgtctatatttttggttttgcttttgtcctttagattattatttgaaattgtgtgaggcagttttgttgttgttgttggagatggataaacactgttcaaatgtcacagattttctaagatacaattttctaagagataatcagattttctaagagataatcagagtatccaaataatggcagattgtcttgtcctctctcaggtttaaatgagtcatttctttttcctttcagctgcctgggtaaagttggtccattcgtgtttattttgattatgaatatatttagattaatcctcatatttattttgtacttttcttcaccaagcttgctggctatttactttttcaccttttcctaacttttgttggattcaccaaactgtctttgcttcatttttcctttactggtttgaacatgataaattctaactttttgactaataaatatttaaatcttttttttttttttttttttgagatggagtcttgctctgtcaccccaggctggagggcagtggcacaatctcggctcactgcaacctctacctcccgggttcaagcaattctctgccccagcctcccaagtagctgggactacaggcgcccgccaccatgcccagctaatttttgtatttttagtagagatggggtttcaccatcttggccaggctgttcttgaactcctgacctcatgatccacctgcctcagcctcccaaagtgctgggattacaggcatgagccaccacatccggctaatacttaaatcttaacacccattatacctgtgattttaaggttatctacagcttattatatctcaataccctaacctggaacaatataagggaggcttgcttttcctttcattctcctcctaaattctacggtcacatccaatgcctcatcccattttgatatcacctgcaattttatttccacattatcaaacacaaatgctttacattttattagtaatgctttaaccattattttataaatgtctttgctcattataccttttgctactccacttcttcctagattcattttcaacttgaagaagtacaacttcaagagaagatctgtgagatacctgtaatcccagcactttgggaggccaaggcaggtgaatcacctgagatcaggagttcgagaccagcctggccaacatggtgaaaccccgcctctactaaaaatacaaaaattagccaggtgtggtggcatgcacctgtaattgcagctactcaggaagctgaggcaggagaatcacgtgaacccaggaggtggaggttgcagtgagccgagattgcagcactgcactccaggcctgggtgacagagtgagagtctgtcacaaacaaacaaacaaacaaaaaagatgatctacgattagtaatctttctaggctctgcgtttctcaaaagaatttacttttctcatttactttaatgacagtttggttaaatttagaattctaggttctgatatttttcccctcagaactttacacttattactccatttttttttcctgcatccagtgttgctgctcagaagcttcttgtctctcagcatttttctaaagccttgatttctcaaggttcattataaagaattaagggtgcacatatgtgtacatttatttttcattgcctctgttggctctttcaataagagatgcaatgtattttcatttctgggaagtaatgttgcattatttgagtatttcttactctcttttaaaaatatttcatcaactcaaattttaatttctatattctctactggattcttttttatgaaggtgtctgtatcttatagttctctgagattataaaacacacatgttctgaatatctgttctgcctacaagcatgttttttcaggtgtaaattctcctgtttgttgagtttcttggctttcctctgttgttgattctggacacggaaccaatcttgctagttgagtctcaccattgggtacaagagtaggacaatatgctgcagctactctatcttggggagaacagaggagggcagaatgttccatggggcagggtactcactcatatcctgagctacccaaggcactgcgccctttctctcctacccacgagcccccattcatggtctgtctcaaagacagagagtttctactgtttttttttttttttttttttttttttgagacagagtcttgctctatcacccaggctggagtgcagtggctcaatctcggctcactgcaagctctgcctcctgggttcacaccattctcctgcttcagcctcccgagtagctgggactacaggcacccaccaccatgcccagttaatttctttttgtatttttagtagagacagggtttcacggtgttagccaggaaggtctcgatctcctgacctcgtgatccgcccaccttggcctcccaaagtgctgggattacaggtgtgagccactgcgcccggccgagagtttctatcgttattgcctacaccaaggtgggcccaaagaggtcatctctgcagaatgagaaaattctcacaaatgccgttattccaagaaaactgcttaaatttcaaaactcaaagttttaagtttcctctcacatacattctatgacagttcttacatgttttgagcatttttaaagatttgtaaaccaacaaaatgctaaagtagcaattttactattatcataaataaggacatggtggtacaatcataaccatttttaaaataccaattttaaaggcactatgtggaaacaaagcccctgaaagctactattccaactcatgctggaggtttagtcacacccctggtccagaatgcttcgtgggtaactttcatattcgaaaagtattcttcacagaacaggcttctgcgaactcacaaggtggaaggcatggagcctggagctgtaacatcctactgcaaacatagggaagaccacattggaacagtgtgcccctgccaaaagccatgtgctcccttctttacaggtctataaaatggcatgtgtgattaaataagatttcactgaagtgctggaagccacacacagttgaaacatggacttggggatggcagcaatgccaccagcaacagatagtgtaatgtaccccccgtgagaggggaaaggtgggaaaggaatttttaaaaatctttggtcacgttattattaatcatgttatttaataactgtgagtactatttaaaaagcaacacgtcccatttccttcataccatgaaagccaagtctgcctgggctggagcgtggagcccaacactggttttcagaggctcagattcttacatggtcctcttagtgcgtgcttacctcacagagtggatagatatccacatgaatttgacagattacacataggtaatgctttagagttttttgaacattttcagaaacagtatttttaaattttatttgcaaggaaaaaatgcttatcagtggcaagtcaggtagggtcatgttcaacattggtcaattatctcacccattctgatcacttgctctgttcccgccactggctcttcttctccctcttaaatatattcaggctccaaggcccgctctctagactcttttctatcttttaagagacaaggtctcactctgtcacctaggctggagcacagtggtgcaatcaaggctcactggagcctccaattcctaggctcaagtgatcctcccacctcagcctcctgagtagctgggactacaggtgtgagccaccgtgccccagccctctgttttataattagctataaattcagctactctcgttctgccgatgaatctcaaatctctatcatcaactccaaactacattctcaacatcagatttgcatttcccctgctctgctgaacatcctgacatgaatagctgtccaggaattccaattattccctgaattgtctaccataacacaaatttgttcctttccttgtctgagtcacctcagtaaatagcatcgacattcactaagatgatcaaaacctgggatttggctcctccttttgtacaactcctacgtttaaatccaattcctgtcttttctacttcgaaaacatagtcttgaattcatccatacttttccatctcaatttccaccagcctggtccaagatgctcatttttcacctgagctacttcagtaacttccttatctacttttgcctctgtgcatttatttgtctacacagcaaccagaataatcttttaaaacatgaatgtagtcaggttactttcattttacaaattcttttaaggcttcctgtagaataaaatccaaattccgtctcatgatcttcagggccctgcctaggtggtctgccctagttctagttgtattcgcccatcttaatctctcagtatgccaagctctcagctgcctcagggctgccaatcatggtgttctttctgcgtacgatgtgtttttcttctatgcttcctataactggctccttcccagacttaaatgtcatcactgttctactctccctactcttttaaagtaggtttcttaataccagccctcttcagccaaacctaaactttccacaatttgtaattatacaatgggttacttatttgctcttttgtctcttgcgcttgctaattataagtttatctgtcctgttcatgactatataaactatgcctggcacagtacctgacacactgctgactctcaaaaatgggctgaagaaattttctctattacccttttcattgccattcccctattatacagttgtctgtttaggattggctctcctgactacgttgtgagatctttaagccgggagaccgtctcttatctttgctcggcacaatatctgacacactgtgggcctattcataaagaatgaatggttaagattaggtactcagtaaccttttccccaaattgtattagacctgacatataaaatcagtgtgcgagatgttgtttagaataagtagttttgagaggtcaaacaacaatgacactggtagtaataacagcacattttggataaggctgtttggataacaaaactcgaatgatggaaatagtagttagaaatcactcaaagtgagactcaagggagctgaccctccctctggatgtcaaaatctatcactgacttagcagtggggtccctagagtgtttctcagaatagtgcttcccacacatgtcaagagggcctaatggctgcttctttcacaagggtggtggggagacacgtgaggtcaagtgtcccacagcccatagagaagcagctctccagggagagtggaagactctccagggccctgcttagcgcagcctgagaggctacaggccaacagtgaaggtgttgaaagacactgagatcgaattccctgggggaaaaacgctgccctgagatttaaggagaaagaggaaacaagccaaaagggtatgctcagaaactgatggaaagggctaatgtcatcagatcaaaccaaaggaaattaaaggaagatttagtgaaaagagggcaaaaacagaatcaaaggaccccagggaagcgcagaccaatttaatgagaaaccaggaaagtagtgagaacaacaagggagtctctcttcatctatgtttaatccagacttcttgccatttaatgctaatgctttgctccattcttaagtcatacccacctaggagtttgctttggagtttgtatgtaggaacgaagagagacccaccttctattagaacactacatgatctcacactatcattacaatattccaggcggcttccagatagcatcttagctgtggaaatgctattctcttatgtccttcccagttttcctagcgctggctctttccaaagctactcattcttatctccttcaactactttctaaataaacaagctgagaaaacacacacaactgatgtttgcctacaactgatgcattcatcttgttctgaaactaagtagaactacaggagaatcagaggaggggattcagggatggcatgtcctcaggcctgttgccacgtctccattaggctctgaatatgcgtttatttttatagctccctttcatgaacaggttgtgtgagacagaagtcttatttccaaggttcactttactgagtggcctccagtcactctttccaagaagaaagatggaaaattatggtccaagcagctttaccgtccatctaggaaccaaggagaatgctggacctcagccactcaccagcttaaactgtcatttatgagcaacaaaatgattgtctttgggtctcggcagcattatcttgagcagagtttgtggcggtaaggcccagctaatcacatttgtctaattttacattcccatcactttcacaaatggattattacctactattcacttaaataaaacaaagaatgatcaaggaatcttgtcgttctagatgaaaatcataacatataagaaaatagcattagttttcatgtttgtaccactttctaacaaaagagttataatcatttcacattattgtcttgttcatctttttaacgacccaatgaagaaaggacatacaggccggacgcggtggctcatgcctgtaatcccagcactctgggaggccgagacaggtggatcatcaggtcaggagatcgagaccatcctggctaacatccgtcgctactaaaaatacaaaaagaaattagcctggcgtggtggcgggcacctgtagtcccagctactcgggaggctgaggcaggagaatggcgtgagtccaggaggtggagcttgcagtgagcggagattgcgccactgcactccagcctgggtgacagagcaagactccgtctcaagaaaaaaaaaaaaaggacatacagattgctggctctcctttatagcagaggtccagaatgatgtgactaacttaagaacatgaagtgaaagaggtatggataaagaaaaacatggtttattcacacaactgaataatgtatagtggttaaaaggaatcggacccaggctgggtgtggtggctcatgcctgtaatcccagcactttggaaggccaaggcaggtggatcacttgaggttgggagtttgaaaccagcctgaccaacatggtgaaatacaaaaattagccggcatggtagcaggtacctgtaatcccagctacgtgggaggctgaagcaggagaatcgtttgaactcaggaggcggaggttgcagtgagcccagattgcaccactgcactccagcctgggcaacagagcaagactctgtttcaaaaagagacaaagtaattagatccatatgtatcaacatcaatagatattaaaaattaggatgcagaatggtaagcccaatatggttcatcctttctgtagtgcagaatgtcagaatttcttcttaatttggtaaattttgattactccaagtcgtacaaagggaaattccattttccaaattaatggagctaattgaaatgtgattttgtaattctttatcatttagcatgttttttttttttctcactgggtttttgtaacagtgaatagactctagcttggctgtaagagctaacaatttggataatagtactgctttgcatctactgcactctgcagaggatgattcaaaaaagaggctactcatctcccctgaggatgaaagataaacatttgcggttaaaatattgtcacgactcagacagaagaagggatttagccctaccacttggctcatgttccctcttaaccaaatcatatttttttagtaacctaataaaattactgggaatagaaagcatacattccgactactagaaatattgatacaacaaaggaacacgttagtagtttcaacgtcttttacttaaggatttcagaattcctcccagtgaacagggagataggtaggtaaaatataatatttcctggtagatgacctaaggcaaaactctttatctgctggcacctatgtatatttgctacacatcgaatgttttgtcatcccctagaggaaagacactggtggatggcaagaatgtcagtatttgtttacttggagcaagaggcaggtcatttggtcacagactcaaaatgcaatgtgcaagaactcagaaactggatagcaaaactccagcccaaatgaagcaaaatttccttctctgctttctcaaggtctactctagttaatattgatgtaactagacaaatacccaataacaaaaatttgccatgcaatatataatctaagatggcacaacagtttatgagaccaagctattattcctactaagttaaaaacatgcgctccggcgaaagttctgtcaaccttacagctctttaaatgcatgcatccaggaggactagacaagccatcttctgcttccagctgctagtgtttctagctggtgaataacacaggcccccaggagaggggggtgaaagatagttttcaaagattggaaaatttcctccaacttacattaaaattaatattaagggctctatatgtggctgctggagtagaatggtgggaatctaatcaagagcccgtgccttcctttgaggccagtttcctaaaattggttctctgtgcctatattgcatgagctgaaagcatatggatgcaatcacattccaagataccttatttggtgttggtatggactgggcatattgtctcagcttacaaaagcaataaggattctctgactcctgccaatccatgtaaatcactcttttacctgtttaaagggtaagattcgtgagtgaggaaaatagttacaactattttgttaccagcatatataaccatgttctatatctagatagaactcttcaagttgtgagacctcagtagtgggaagggagacaagatttagacaaatacccacacagaaatgaggggggacacatttctcccacgtggcagagttaggaggtactgaatccaaattttgtccttatgtagagaccttatgctggttgagaaagcaaaataactaaataaggattacttatatctgcaactcattttaatgtcttctttatttttaaaagcaaatggactagtgaagggaaattcacttctctgaatacaggatcatcccacattcaggctatccaaaatttgggggatctggaaggccaaagaccaaaaataaagtaaaaaaaaaaaagtaaatgaagttattggatatgaaataacaaatgacaggagattaaaatcttctaattcttgtgtctggccatataactgagtgccactgaccattagataaagacagatttttaaaaataatcacccctattgtaagggatagtcactcctgactcattgtcttctcttcttcattagtttgattgtttttccctccagatcacatttttggagttgttcttttggtgagatagtggttgaaatagtttaattttcctttttgagtcctgttttcacctctagatgaatttgcttttatgaaggaattccattccatttatgatctaaatgaggaggaactcctttaaattctttccttttttggacagcttcaacctgtatttcactgagtaccactgcatggtaagtaaagaggatactataaataaagtgtgaaatagacatcttccctctcgtatcagctaagtaatttctcaaatatttaaaaattgaaagaagtgccacagaggtaacagaaagaggggcagttatattattgagtagaaacctaattttcccaggagtatatgtaagaaaagccctccctgtccgaggagacgtcatcatgtgaactcacatatgaagaaaggtggaaatcaattaggggtaggagcagcgagggccctggggagtgttcaagtagtgcaaatgacatctaaagacgggatgaaatgtaacctttcagatcgggagggcaggatccaagccaccaaaaagtctagtggtttgtatcctccaaacaccccccaccactataatctcccgccacttactcaaccactctagtccaaggcaccaaacccccatgctggattcttaacctgtcctgattgaggtcctcctttaagtcacatagatccagcccatctgagttcaatttcctcctttgtaaaatggagataataatagtgctttcctcaagggtttttttattcaatgagaaatgagatattacttagtatcaaacttggctgagagtattaaataaatgttagctaatattatttttactttttttttttgagacagggtttcgctgtgtcaaccaggctggagtgcagtggtatgatctcggctactgcaacctccacctcctggattcaagtgattctcctgcttcagcctcccgagtagctgggaatacaggcacctggctaataccgttgctaataatataacgcacatatcatggaagcttgggaagtttttataaaacaggtggggcttgatggcagttttgaagggtatttgctgcttgcctagaacacgggaagtggagctggcagtccaagctcaaggagccccaggagccagggctttgcagaggctgcaggggaggaaagtgtgtgtggggtggggaggttggtattgcataggtccagggaggcaatcatgagactccctagaccacaggaaaaatcttttgtgggaatagtaagcttggacaagtagactagagactatgaagataatctctcagagactgacacaaataatccactcatgcaaataatctcaaagaatgcagcctttttttttttttttctaacttctgattcttaaggatgaagaatgtgggtggggatgcctgttcccggtgtcagtaagtaaaatcttctggtggggaagtattttgaatatttgcaaagaaagttcaatgctctccaaagtggaggtagaaactggcaccagggatttctgtgtacctgcctagaaatacagggctttaatctacagccaatgtgaacttttgtaactctttaaaacatcatcatttctgagggacttcagactctgttctgtaggtcagcaccagaccaacaatatagagttcctgtgatcacttatgatttgaaacataaactcaggctttgaatgttttaaaaacacccgtataactatgggttgtttaaaaatagctataccccaaagagtttatttccaacatctgacatgaatgcattttgcagcgatttgttatgcaaataatggtagcagggaagacatatgaaaaaacattgacccttctcaaagcccgatggatttaatgcttttgttaattctgaattccaagtctaggggttgtctgtttgtggtgtataaaataaaatactatatgcctgcctcaactttccttctgatgaagctgtaatttgcaaaggagctattgttcctctatggcttccctaatttttcttcacagacaactgtgcttcagtgtggagaggggtttcagtgtattggctgttgagatgatgctgtgagtattttcaaggcagagggggctgggtgcggtggctcacacctgtaatcccagcactttgggaggccgaggcgggcagatcatgaagtcaggagatcaagatcatcttggccaacatggtgaaaccctgtctctactaaaatacaaaaaattagccagacatggtggtgagtgcctgtaatcccagctacttgggagactgaggcaggggaatcgcttgaacccgggaggtggaggttgcagtgagctgagatcgcgccactgcactccagccagcagaaggaagagctttttgagatggagactcaggtagtgcttggaattgctgataatccaaggcctgatgatacgggggttatttgctgaagcttctatttcaactctcctttatgaccccgggttacctaaatatgttgccttctaatgttgttttgtgagaggtaggaagtagggtagacatcatcagtcttagatttgtcaatgggagaaaaccaagggacagacttttttgccgccattttgtccttctaaagtgttagctcctttttcccactttacaactcctcctttctcccctcctcctctgctctgctcttctccaccgccaccactcccagcagctgtttattaaatgcccactgcatgctagctttctaatttcttcttgtctctaatggtcatattttaggatgtcattcctctactgacagctaccacttctagagtaatcctaacctgtaattcttttcttagaggataagtagaaaatacgtaatgggaggtggggggaaatggttttgatcttcaattagtgtaactgatagggaggaaagggcttgggttaagggaatgtcttatgaagcagcagctgttttataagggactcatctggagaagtggggtgtatcctctactgataagggagaagacccacagaaagccaactagcatcaaaacagccccagcatccaagcacagaggaagtgagccttctgacccccatgatctaataagccccaatattagtccatacaggagatgagcaacatcccagggtgagtgagtcagtcactcaagtccccggcccaaaagtgtaatggactttgttttatggtttaatggacatttagctgagttaaaagggttaacaagtctgaacacttctctgaaacctgatgagatatccaagcatcttttttctgaaggtctccattgaaaataccacttatgagtaacttctgtaaagaaaacccatctgaaaataccagagatgaaccagctgcttttttccccctgaactcttagcaaatgatctaagggcttaaacacattaaaggccacaatttcaacttctggaatcaatagggcaaaggaatgtgggcatattcatttaaatatgaatttgctgactccattcttactctcttgggttcctccataagcccagaccttacactaaaaggcagctacttctcacactgcagcaggattttgagaaccatcgccctttgtcatcttcaccctgacccttctcatcattttttctgattctcagaacctcctggcatttatttccaattcagttctgtttcctttcaccaactcaggttagttgaggctggaccctagcatgcctgttttgtcatactctgatgaaaagcaaattaaattcttggatggtaaactcttttcttaaacttctgtctggttctttggaaaaaaattaaaaattatatttctgttaatatcaaccaaaatattgaatccatctcaggatcctacatcccttgaccaacaagctgataaaactgcctagctcatcttagtcaacctcttcctctcacatggtgtgtggaacagaacttggtctcccttgggcttcagtagtagcaaattgaggaagtaagaccttaattacatataaccatgtttccaccctacgttagctctgttcccttgccctttcacatttcaagctgcctcaaggaggaaaaaatcagacagataaaacacaaacaaaagacagaaaacaggagctcaagggctaaatcaagactattaatagttcctccaaacaaagaaaccgactgccatcatccaagctctgttcatctaattcttcctttctccaaatgtggctgaaactcatctcccttttagccttctcttactcccaccgttattattttcagcaatttttccctaagacaaggcagcagcagcaagaagtgagaaaataaaggtaatctaggtagtacctttctttgaacaaatagttttccatctttttcttatttccactgatcttgaaaacagaatcactgtttaaaggggagaagccctagttccctctgatcaccttggttaattttagaatgggtgcttcatattcaccacacagagaaatctaaggcttttattcaggtgaacccttcaaaatgataacattatgacaccaaagcttttaaaagtcttgctgttctgaaactgccattgcagtttggctttgtggctttggatactctcagagggaaggcatcacctttgttagagtttgtgaatttaaattagtttgggtttgtttggaagcagagcaacatcagaaaatccagtccctttctacctaaaagcacaaggctgctagtgagcaggcccatgaggaagagctggaggagagggcaggacacagggatgtcacccagcctagctgggatacgtgtcaggcctgaccacgtaatcacagatactcatgaacaagggaaagcagactattcagatacaatgaaaactgattttaaataagaggcatctcttattttattattttttctaaatcgtggctctaaaaaaataaacttagaattattttcctcttccaaagtgaaatatctttttcttcctggcttagaccaccaaccaggtttctgctgccggaagccgggaaaatactggatattctttgaggaagcctgatcagatgccctattatcccaatttccaaaccaaagatgcttggagatgaagacacacttttttggtgtgtgttctaagttgcaacctcaaaaacttggcagttttctcaccatggactgtgatttccatgatgtgatggtttggaagggtttgttttcaaatagatgttatggggtgattccaagggaattctatttcaatcctcctgagttgacaacctttccttcttaagtgtaactttggtgttcagataaccttgggacacagacaaggaagattcccagtggtaaatgtctgtgtggtacaaaatgggaaggcagaaagtgaagcttgtaaagtcatgaaaataagaaagaaagagcttttcatgcattatctttcacactgttcttctttttctgtttttattttattattattatttttttgagacaggttctcactctgttacccaggccggagtgcagtggcatgatcatggctcgctgcagcctcaatcttctgggctcaagtgttcctcccacctcagcctctctgtacctgggactacagatgcatgctatcatggcccagccagtttttaaaattttttgtaggatgtggcctccctatgttgcccaggctcgtcttgaactcctggcctcaggtgatcctcccactttagcctcccaaagtcctgagattacaggtgtgagcgactgctcacagctgggattacaaggctgctcactagcagccttgtgcttttaggaagaaagggactagatttctgatgtagctctgcttccaaacaaacccaaactcattcaaattcacaaactctaaaaggtgatgccttccctctgagaatgtccaaagtcacaaagccaactgcatggcggtttgggaatggcaaaacttttaaaagcttttggtatcataatttacttttatttaggaggatagtatagttcacattttctcctttttcacaggttctatttagtgtcatttatagtagcaataattcatattctaacttagctttacctcagcaactctttctccccttacttttagtctcagtactacaaatgcccgcatgctttctccccagaaccgaggccttcatatttttctccctaagctgtatatgtcttacaaacttgtaaaatgaatgtaaatgaatgtaaaactttccccttgtttggtgaagaacaagaggatacacccattgcttgagcatacatctccctcagtctctctctttttttttagaatgcaaagtattttctttttaaacttttaaaatctgaaaacaagctagcctatgttaaataacatagtttccaaagctgaacgtgctcacttggagcccagttttctgcttcaaatacaaacacaacttcctgacactcctaggtgggaacactactgtttgacgatctgtgattagatgaactgatcgatctcagtgggtaacattcctttattttttccttggtaaaggtttaaaaattctaaaatagatgcattttttttttttcagttttacactgacaatttcattccaattgtctcctgggagacacagaccatgtacaggaatccatcttcatccttctcactctgctacaatgctgtgtctgttcaccgccaggaggaaggcttgattagcactgagctggaaggaccttctaatgatcttgatgagctcactcaggttgatgtggtccagtacaaggaacattgctttatccaggacgggaagctgcttctcagccttgtatcgttctgttactaccaagattttgggtggatgctgctctcggagaagtcaaacttctactctttgttcaaaggtgtggtgtggcctgaaggtcttctctgatgtcatggtgcagggatctgggtggtggtggcgacataagggttctggcggctcctgggggtggcggtggcagtgaatctaactctggcgacagtgacttctcttgtctccctcagtctctttattatatgcttgatccatcagaaagtctcaaggttctatgcacctcagcaaccccagtgataaggcaaggggttcatggactgagtcctgaagccctcttgtgtttagagattgggaagatgaagaaccagcttaggagattgaggaatgcccatgaagtagagagaagacaaaagagggttaggacctaaagcaagaaggagttttcaatccatcatttgatcagctatatctaatgctcctgaaaggtggagtaagattttgcgtcagatatatagggtcttttagactggaatagtgtctgattcttctttttttcctcagagtctcacatatagtagataacttataaatgctgaatgaacaactgaaaaagaatagtagtgattggtcacagagaatgggatgtgctctctgttaattccttgcccatcaacagatgcccatcctagggcaaaatgggagaaagactatcatttccacagtcctcatgctgaatggatcccaagtgctattgcctcatttatgtagcatgatccagagacacttccagtctgaagaacttcaaaggttttaggaggctgaggtggagggctcggggagcaatgaaggcaagagggaaagggatgaacaaccacaataaaaggccggcacgttcacaacaatgttgggcaaagacagtgattcctgaatatgaaggaatctggagagcgagtcacaagaaactgaaaacataagggggtggaggagatgctgagagaaaacagaaagctatgaaagaaggcagacgctcaaaccgaggtaagagagaaaaaattaaaagcggaaggggagaaagaaaaaaaatcggagaggtgaggccaatgtatggaaaaagagcaaaggaaacacagggccattgtctgatgctgagaacagtctggagactgagcaactggtgcccgatttctgtgcatctcaagaggagataaatggcagattgaagggaccctcttggcattctggatccaagaggaaaacatagcaggcgcagtgaatgctcaagtaaacacaaacagcagcagccgtggggttacgagtgacctgactgcaggctctgtcctctcctggcctccagcctgtgtgtacaacacacatgcccgcttaaagccccgcttaaagcgggagggcaaaaatctcctgcaactgggtgacctctgttgtcagcatttggctaattaaggaaagatattaccctacagatctctatgccttggtcctacttcctgctcattaaaaaatggtttaatgagaaaaaaatcaaggcaacagaatccaaattattattttttctcccaaatgagctgaatgacagtggctgttgccagaacgcttgaacaataggattgtgacacgaagactgaaatctaaacaacatgaagaaatctcgagagcccagcagtccccattatctcatgcttgcacgacgatagtccaaaagatgagtgatgagtctccatttgtgcaagcacagcagcagtccaaggccctgacacagccactaattgcccatctgcttgtttacacagcccagagatggtgactggacaaacagttcatttcccttgaaacgggaccaaactgggaggagcctgtcacatgggacagaggaggactaggaagaactctcatgagaaagtgcccccagatcaaagccaaggaccagcaagccaagcaaagatgggttccagcggctggcttctcacaggcagcttcgggtctaccgctttctgcaccctgcccacccactcccagcagaactggaacccctctccctgaggacaggacattttgaaccattcacgtaaaagtctcaaccacggagcgtcagcaccaacccacccttcaggcgttggcagcaaggacaactgtgttcaggtgaacttctagccctttcagacttcactggatgcttggcatttgctacactagttcccattttagtgttctgcttgtctcgtagactggactgtaaacaacttgagcaccagggacctgaagcccccggattccacagcagggcactttacatgtgaagagccattagccaggaaatgcttatggttgttaatgatgataagctactccaaacatagtttcttttatctgcctacatcagaagcttggcttcttgagacaagagactcagacttctcatttatactcttgacagactgtggaaatcaataatggcttgcacccatcagtgtcctggaagtaggattgagagagaagattctcttgagaaccgatttctcctcaaaataagattaggcttgaaaaaaaaaaaatcaacctccccactgcttagctcacaggtatggtgctaatggcagcaacttagtcatgaaatggggaacaacaatgtaaaaaatccttgttaatttgcttataattatccagaactaactacaggtacactgaagaactgtatacttgatgggagggagatctacaccgctaagtcaataagaccaatttccgatttttccctgtgagcatttatttgcagagccacatattggcaacataagaaactagcgttgaacaaacctaagaagtgatgaatcctccccgggaggagagctgcagccctgaaatccaaagcagaatgggctgggggcagcttgaggtctgtgggcgaaactcagcactcccagtctagggtgctgctcacccattaacttggcctcctcttgccactgttgttttagcccttagtgagcatctgtgtggctcagatttaaccagaccaaaggggctgtggtggtgagagggcagagaaagctggaggaagaaatggctttttttctggagaggagtgaggactaagtcacttcaaggatgatcatattcccaggaggagccatgatatgatattatttgaatatctagctccacgcagctctatttttcccttctcactactagaagattgtaatcacccggtatcagcacattcaagatactaccgaggacctaacagcatgcccaaaacctctcatctctgcacataactgcgtacaaatgactaaaatcactttgcttcaaaaacagagtagctgtgtgaaaggcattttagagcatgtgggattccacacacaggcaagttccagggatctcagaagcttggctatttcgttcagtgccaaggaggcaaagatgaggacaggcagtcgtgtgggtgggaggcagtccttggatgattagcacaggtgtccaggagggaggggagggtatggaaatggtacaaacatgagaggaagctgtgccagtgggtcatcatgccccatttgtacagaacattgagtggactgtaactgtggacaactgaaataccgaaaagaaaatgtgcacacactgtttaaattctaaacagtgggagaatcgttgtttaaagaagaacagataattgctcattccaccctccccagtctttgaaagatagacacaggagtgtcacacagtacaagagtttgtattacacagaaagagggacttacagacagaaacaaaatttaaaaacaaacaaaccaccagcatttatcaccgtttatccagccagtggttttctttatccccttggctattactttagatatttttgcttggaacttctcccccactttttctgacagctcattgatcttgggttggatcatcacagttcgtgggaaacaatacaggctacttttctagcttattccttcttagatgcctcttggatattgtccatttaatatgtttgagaaatatagagagacaaaacacacagtgttttaatctcagagtatatgtagtgtgtccctggagaagaagtctcatatatccaagggaatcattccattattttaaagtaaggcttgtatttcagattgatccacctggaacatgtaatcaaaactcatgaactttaatataaattccagattctggtttcttatctatatttttgggaacataacattggtagataaactaattgaaaaaaatattttcaatgttgatttagaaatggcttttaactatttctacacattccatcactccatctcagaagaagcggagtagaaaactgcagcaaatgggactttatattaaagtcctaggaaatatattctggctgatgtgatggttcttgtgtgtttcagtaggcatgtaacatgtgaatcgctttgtggaactgggttcgtgaggctagtatttatgaagctgtatatttccttctgtgtagtaacacagagagtgattcaggagaatgagaaaatcctgtttcctggaaataccatccatcctgaaggagttacgagaaccagaacagatatgtattttgctatttatctcacacttaaagattatacaatccattttcctagggcaagcacaaatggtcagttttataaatcttgatggactaagtcaagtaaaaaagcccactagttaagagtccagatatcgagagacacaaatctgaggaacgatcaattaggacaccgtggtagcttgtctccaagatgtccatcatcagctctttccttccctgcatgtttgtgctgttctctagttgaacggtggcgtctattcactcccttaaaactggactggactgtgacttctctgaacaacagtgacgtgatgtttcattcccagtgtttgagaggataggaaatttctaatttcttttccttggaacatttgctcaggaaaaagccagtaactatgtaagaaggctaactactgcgagaccaccatgctatgagaaagcgcaagccatgtggagtgactgcacgggctctcagagatgcccagccaagccccaccctccatccacccgagccgaggctctgcagcctacagatgatttcaattccagccataatctaactccaacttcacaggagacctgaagcaagaactagccagttaagtctaatcaactcattaaactgtgagagataggcatacattgttgtagcctactaagttttgagatggttggttatgcactgtggattcctattaccaatcggctataattataaaatatccactggcaaatataagttccagaggcaaagactgtgttccttttgctcatcattgtattcataacatgcagcacagtgcctagaacacagaaagccctaaactaataatacgtaaaagtttgaaaaagtttatctgtactagtatgaaagaaagacccatagtcaaacggctgacattttttagcaagtttgatgggcacaataaccttatggtggtggtattactacctctgtctttgagatgagggaacctcagcttttttttttttttttgaggaagtaagcttcccaagctcagaaaggtaggggagagggccaggcatggtggctcacacctgtaatcctaacactttgggaggccaaggcgggcagatcacctgaggtcgggagatcggggccatcctggccaacatggagaaaccctgtctctactaaaaatacaagaaattagccgggcatggtggcacatgcctgtaatcccagctacttgggaggctgagccaggagaatcgcttgaactcaggaagcagaggttgtggtgagccgagatcacaccattgcactctagcctgggcaacaagagcgaaactctgtctcaaaaagagaaaaaaaaaaaaagaaagaaaggtaggggagagatttgaactcagatttgtgcaattctaaagccagcctgtttattatagtctcccaggagactacaacagaaacaatgagaaaacaatttgaaagagatgcaaaacccaccccttgaatcttacccaggactatggagctccattaattgctgtcaacacgctggaacctatttcacatgaagctcagaccaattacaattaatgccacagtcatgactacaaactagaaaccaatgccagaggaagcttaagttaaagaaagcaacgatcacgcacatatattatgttagcaattaggcttaatcctagaatcgtgaagccaaagagaatatattaaagagagaacagtgccctcctgggaagaagagcaatttcaaatagactttttagtggctttctacattacttacttgaatatattatgctcccctagaattactatattacaattactcacgccacattttatttatttcagcaaggaaatgggatggtgcaatgagctcagtgggcagacggtttggttatttcaatgaataatttgaatgtcaacaagttggtggatgctaagatgaaaggggaagtagtaaatagcaaaggtctcaatgcctgactctgagatggagtaaggatgagctatcaggactggcacttcacttctaaatgttgagcactcaggttttgctaaatttataaaagcacatgaactaactaacatcgcatatttccttaacgagaagaccagtttatctctgtttaaaacagttctgatctactcaaatacacatttttaattttcactgaaaaatgttataaataaatcaaaatttaaataaaaaaactgggagggaaaggtagatctacttctcaattcagaagattaataaaaggattaaggaattaaataatcacattctctagcctcagctcacgactttttcaaggctcagtttctcaataaatggaaaagcaaattctcattattctcccaatctgtttgaaagcagagctggggtgttacagtgattaacagttatcaaggcccattaaagttgttaattatagtggcgttcactatctttttccatcatttttagctattgagacagggtctttgtggatcccaaggatcatgtgtttgcagttcaattcagcagccactaggtggtaatattgttgattttggtagccatgaagtgtgatctatcagacctgccctcttaaatggaattatgtacatcccttatatcatcaagatgtaattatagaaataattatactttaaaatatgtaaaatattttaattgtgaaaaatataatcccttataaaagttccatgcatatctggtaccttttaaacttatgctaattctacttaccttttattctaattatacacatgactatcttcaaattatacatataacaaaaataaagtgtctggtcttaacagaaatccagcttatattcattgcttctggcttatttttagaagagatgaaaaagatgcacataactttccttctaaaattatggccgtcctctgtagtaaataattatttgccacttgaacttggaaccactgctattcgcaccattgggtaagtaaaatttctgtgattaactttctgagacccactgtctgaagcatctgataagatttgacaaaatcacgtaacaacagcagcggctgatatacatagtgccaggttctgagctaactgctccacatacattagtcctgcgttcctactagagctgccacaactcatttaaggccaaatgaactcagcagaagaaacatacccgtattatttgaaggaatgaaaagatctttccagaattggacattgtctgcgaaactatgtattatataacatgtattatgcacaataactcccagaaggcaatacaggtgttaagctctttcattatgaagaagacaataactgtataaatcaaagagaagtcttgtgatagcatctttgatcaatcactgatgaaaaccttgccatagttgtcaagaatccaaagagaaagtggtggctaggccaataattacgtgaggcaatttatcatgagaacaaccattatgcaagatgcagagctcaatactgattccataaaatacttaaatacttgtcactgcaattctttactaattacaatggaaactttgttgttattgttgggaaaggtaaaagaggacctctattaagacctcagaaaaggaatctttgaggttaagctgttacccaaggttaaggcaaatctactattctgatacttttctcctttagatgatgaaacaaatatgcttatttctatttacccctagggtcctgggactcaaaagaaaccaagtggttctctaagttagtaggatggcacagtaacaacgctgggattgagctcaccctgaccctgagtaagttaccaagaccctcagactcagttttcttatctggaaagttaggaatgaaaaaaatcagtttcaaaggattgctgcaaaattaaatgaagtgctatgcacctgttgaagtcaagtatagcatgctccccaatcaccccccaacacacacaccagaactaacaattcaggaaggaaattttcagtatattggtgtttctcacagagggtcaaagtgggacaataagaatgccttaaatgtaacacattgtatttattaaagctttatagtttatatggtggtttcccatgtatgttatctaatttcatcttcataatgacactgtgtactagatattactattcccattttacagacaagaaaaaaaaaaaggccccaagaacttaaaatcctttgcaaaatcacatagaaaggttaagtggtgaacccagtgttcaaacctaggtcttctgacttcaagcacaaagctctctcactacattcagatcacttaaaaacacaacattttattgtgcctatcgttaataagactgtattgcacacttaagaatttgttaaagagggtagaattcatgctaagtattcttactaaaataataaaagttgtatgtatgtagaaaaaagtattgcttaatctaattaaactaaacagcttctgcacaacaaaagaaactagcatcagagtgaacaggcaacctacagaatgggagaaaatttttgcaatctacccatatgacaaaggcctagtatccagaatctataaggaacttaaatttacaagaaacaaccccatcaaaaagtgggcaaaggagatgaacaaacacttctcaagacatttatgcggccaacaaacatgaaaaaaagttcaacatcactgatcattagagaaatgcaaatcaaaaccacaatgagataccatctcccaccagtcagaatggcgattaaaaagtcaagaaacaatagatgctggtgaggctgcagagaaacaggaatgcttttacactgttggtgggaatgtaaattagttcaaccattgtggaagacagtgtggcgattcctcaaggatctagaaccataaatgccatttgacccagcaatcccattactggtatatacccaaaggattataaatcattctgctatagagatgcatgcacacgtatgtttattgcagcactatttacgatagcaaagacttggaaccaacccaaatgcccattgatgatagactggataaagaaaatgtggtacatatataccatggaatactatgcaaccataaaaaaggatgagttcatgtcctcctagtttttccaaaacaaactaatgaaatgtgaaaagggtgaattcacaaggggctatacatagaaagaaagagcctgactgacttggctccatcctctacttctacctggggacatttccaatcatcagaaagaggttaatgcaattgcagctccagagtctcatcaaactatcttggattctgccatgatgaaagggaaatgaggagattacccaataacaccatcatgaggttgtccttagtaatacttcaattcttacatggttgagggcctactcaaagttgtaaaaatcagtttaaggtatagtcccctgttctaccaaagcaagcaaataaactggttccataacgttgaaaagatgtaggggtgtgtgtgtgtgtatgtgtgtgtgtgtgtgtaaatatctgctgctgctctaggaaagaccctgtaagagttaatgatacttatctgacaaataatatcttacctccaaacccaaccactaccatctctcttccactagcatgtagttctgagacagtgtttaaaaacagaagacaaggctgggcgtggtggctcgtgcctgtaatcccagcactttgggaggctggggtgggtggatcacttgaggtcaggagttccagaaaaacaggagacaaactctttaaaaaactaagagttaaggccgggcgtggtggctcatgcctgtaatcccagcactctaggaggccgaggtgggcggatcacaaggtcaggagatcgagaccatcctggctaacgcagtgaaaccccgtctctactaaaaattacaaaaacttagccaggcgtagtggcgggcacctgtagtcccagctactcgggaggctaaggcagaagaatggcatgaacctgggaggcggagcgtgcagtgagctgagatcgcgccactgcactccagcctgggtgacaaagcgagactccatctcaaaaaaacaaacaaacaaaaaaattagagttaaggcctaaaatgcaaatacccacggaagaggtcagatcctgacaatgatctcaagatataaatgactgagatttggttctatgtttgtgattaggtttaaaggatggtctgtgtcggggtaatctgagagaagatctttactctctcattttggcatattcataaaagtgtacattgaagcacctgtgtaatgaagagcccaaatgaaataaagaacaggattatggcaataagaaaaaaaatatgaggaacaggtaaaacaccctacatattagaggcctcttcttgaccataatgtaaattagggttcatgttacatacctaataataacatcacaaaagtgtgacgcctgaaactgaagtgatgatggaagcatgagcaaaataagtgaagtcaatccaagtcaaggagaaagaacggaggggttccagcaggttcatgtgtgtgcacgtgtgtgtgcgtgcacacgtgtgtgtgtattagactgtcttgagctctcaatgcctttaaacatttccttgcattttctcattgactgggaggcttccattagatagagccatctagagcgatgttgaagaaggcagccataggaaacaaaccaaggtactagctcatagatcttgcttgataagggaccttcagatttccttttaagttgtccagttcagcacccaatgaaagtaatgagactgtgagtaagaccatttggtttccaattctaggttcaggtggctaagggaccccagttggtataatgatggagaagcaatgaataggaagcagaatcttagggaaaaatgtgaagtgcgaagtactatagaaaattgtttttcaaaaaaaatttgtttactattttaagaggtactcactggttaaaacacccaaatttataacaaatctgcatacgcctatgaacctcatctgcctattttctacctgctgcagcaatgaacctgtttgattagttttaggagtaatagtctaaatatttaacaataacataggtactaactagcagaacaggcaacctgtatgggtgttatggtgaggaccagctgaatatcagtcttgggttagttctcttttgttttttttttttttttttttttcagagacagagtctcactctgtcacccatgctggagtgcagtggcgcaatctcggctcactgcaagctctgcctcccgggttcatgccattctcctgcctcagcctgttgagtagctgggactacaggcgcttgtcaccacgctcagctaattttttttttttttgtatttttagtagacacggggtttcatcgtgttagccaggatggtctcggtctcctgacctcgtgatctgcccgcctcggcctcccaaagtgctgtgattataggcgtgagccaccgcgcccggccagtcttaggttaattcttatttgttctcactgttaggtagtattcattttttgcttcatttttatctgaatgataaaataatatacctaataataacataactactcttctgacccttgcttttatccacttaaacatatacattagggatcctccaggtcaatacatacagactttttttttaaaaaagatgcttagtattccaatgtatggaaataccataatttcacaactccattactggatagtcattagaaaccgacttcgggggaaaacatacgctctttgcaggaatttctgggaaaaaaaatcccctctagcccttttagataaaagcctacctaatagacctgtgataaaatagctttcttttctttattttttttttggaggagtctcactgtggcccaggctgcagtgcagtggtatgatctcagctcactgcaacctttgcttcctgggttcaagcgattctcctgtctcagcctccagagcagctgggattacaggcgcacaccaccatgtccggctaatttttgtatttttagtagagatggggtttcgccatgttggccaggctggtctcaaactcctgacctcaggtgatccgcctgccttggcctcccaaagtgcagggattacaggcttaagccactgcgcctagccaaatagctttcttcatcttccaaggattactgttctgttacttaagtgatccggaagtcacaagagattatcttaattcttggccatttaatgatctttggaaccacgcctgtcggtattttcttgagtagcagtggagtacacaagaacccattttggctcaggcagagttcatgttctctagccatacttcttctttccacaagctttgtaaaggacgtcagaattatttccctcacaggttacattgttcagattactgacctttcctgatctctgtaaccttagtggttgaatatggtgattcagatagttttgtttctttatttctgggggttgaagtgaagagattatgtaataacctgctcttattttgcaacttagagatttaagtatggcctttgtcaatctaatctgaccaaagtatttactaagaatagattacgtgcatatgcccaacatagaaagatgattctatatccaggaggtctgaccacagaaatgtattatcgaccaaaaatgtacctcttcagattctgggatgattcagcaattctgaaaggatttaaacagaaaacccaaggaggaggaaaaaatagcctctaggtacattacacaattcaagctgtttgttcataaattcaacaaacacttattaacacctatcatgggacaggctgagcctatatgatgttgggacaagtgagtgaacaggacaaaacagacacagtcccagctgtcatggaatacccatctatttatataattccttttgcattcaatgttgaaaatcagaattactgcttttgtttattttaaacctggtaaatttatctattttttactagaaaatagttcttttttttaacttttattttaggtttgggggtacatgtgaaggtttgttacataggtaaactaaaacaatttttgatattaagaatatctctaatctagccaggcgtggtggcaggtgcctgtagtcccagctacttggaggctgaggcaggagaatggcgtgaacccgggaggcagagcttgcagtgagccaagatcgcgccactgcactacagcctgggtgacagagcaagactctgtctcaaaaaacaagacaaaacaaaacaaaacaaaaaaaacagtatctctaatctcagctggtcaaaggaacttagaaaatagtttcatagactagggctagaatggttcatgcagaatcattcagaatttggctccattcatggatgccaagcgaaattaacggagaatgagataaggccaagtgtgggagagtgctgggattagagctagtttaggttccagccctccctgccaaagctataaatacaaatgaccaatttaacagcatgaaaagaccacctacaagatctatacctgggatctaatcagttgctctgtgccttcttttaattataggatccctgccatgtttatgggaacttttaatgtgagcatcacagttttgaaggccatatcattatgaccatgtttgatctgagggtgggaaagcaggagctcacaaaatgcctgcacaaggttattctgaactgagctataaaccagcttcaacaagagcctagtgtggaaaagaaaaaagacacgtaagaaaaaaggcatggatatcatggagtttgcaaccccgccaagtggtgccattaaaattacattcaattcttctcagaaaatgaaattaagaaaaagtaccacagttttgtcaaataacactatataaggacattctgagaagggaagaatgaaaaagacataaggataaacgcatcatctccatctgagtgtggcaacaggatatgatttacagaagaaaaattaaatcatcatgattgttagagctgaattgcagctgatataaaaataatcctgagtcacaacgcacgtgacttctcaggcatacagaacacaattgcttaaaactttataagtgataagactcctaatagagaattagctttcttgcaaaacactctgtataagctgtgctgtagaagtacagaagtatcttttctcagttacatttgttatatgatatcctgtgctcagatactctgatacttcaggtatcgcctcattctacactcttttctttgggctatctcattcattcctatgacttgaacctttgtctcatctagctctctcccatgagcccagcatctctacctgcgcgtctcacatgtacaaagttaacctgtctaaagttgacctcactgtcttccatctcaaatctagtcttatcagtatccaaccagttatccaagcaagaaaaaggagttaccctattctcctctgtttcattttgtacatccaatttattaacctgtcctgtaatgcctaaaacagccctttactgtttacaattatgtcttttccttcttatttttactgccattgctttgtttgtttgtttttgagacagcgtcttgctctgttgctaaggctggagtacggagaatgatagttcactgtagccttgaactcttgggctcaagcaatcctcccacctcagcctcccaagtagctgagactacaggcgccaccactttcaactaatttttggagagatggggtctcactttgttgcccaggctggtttcaaactcctggcctcaagtgatcctcctacctcggctttgccattgcttttgctcaagttcttaattagtctgttacttgtccaatatttttttatattactgttagttataactaacatatttctcagccacaacaaaaagcaaagagatataccccctgcaaaataattgcacaaaccaaaacaatgcaaacaaatccaacatgatcatgtcactcctgtacacattatttttcaatattatctgcggcctgtcagacaaagttcagattctttagcaagtcatattgtgactcttatcaccgttttggtcttgtgttcttctcatttgccttgtgatctagccacaccaagttgcttgccatttcccaaacacatcatgtctttcatccttctgagacttgcagtgttttcctctgcctggaatgccctttgtagcctgtctgctgagaatttctaatcctcaatttcctcatctgtatagcagggcggtaacagtactcacttcaaaggactgtcatggtgactaagtaaaaaggtgatttgttccccatggtatttagcagatagaagcactcagtaaatattaacattatcattgccatcattattattttgttttttcaactctaaacaaaaatatcttctttgctgaaagtcttacctaaaagtgttgggcattcttcctctctgattctatatgcctaattatagtaccacattacaccaactccaaaattgatagaattttcacgttttagagcctctgatattggggtacatcttaagagtctacatgttgtggcttatggcagtaatttttctttttttgtagtacatgtaataatggtatttcttacaataaatagcgtattagatgaaatactataaactgtatgacaattgtcatagaaatttgattatctatggtgaatagtgcctatctgtggcaaatggaaaatcctacattttctacgaatcagtgaaatatctacgcaataaatgaagtactatttggaactctacacagtagagaggagatactccatttgtatatactgcaatttggcaaaaacccagcccctacatcatagcatactgctgtgaactataatgtatttcttaaccacaaaccctaaaccatacatttcagaaatgtagaggtaacagcctgaccaagtagcatgctgtcacctcctttggttacgtagccccacttgagagccaaacaagggccaggcccagagtgggcagggggctagcttgtgaaactctgcattccagtaacttaggattcaagctgagaaggcagggcgacaatgagaagagagtgtaggaatgagctgaggaaagcctacggaacatgcctctagactagcactttctgatagaaatagaatgtgaaccactaatacaatttagattttctagtagccacactcaagaagtagaagaaatataatttagctaatatattttgtcaggttattaacatatttattaacttacctataaatgaatattaatcgttttatttatttaacatatctaaaatgttatcactttaccatgcaatcagtaaaaaaaatcagcaataaaatatttgacatgttttttctgctgagttttcaaaaccccgtgttttaccctcataagacatctcagtttggattagccacatttcagcttctcaaaagccacatgtggctagtgcttgccacatcgaacagcacaattctagactgttttgacaaaatgagttaagtaatgaaataattgtaacaagctatttcaacagtagacttttctaccatacggtattgggaatgtttaagattcctacaatagtatatatatttttatattcttaacttttttaatagaatggtaatgtttccttcaaattcaatctgtgtcatattttggctggttttgtcttaagcatgatttgatgttattcctaatgttacttttacctcatctgtaaagtaggagctgatgagctgattgtcacttttacctcatctgtaagtcaggagctgattggccgggcacagtggctcacgcctgtaatcccagcactttgggaggccgaggcgggtggatcgcctgaggtcaggagttcgagaccagcctggccaacatagtgaaaccccatgtctactaaaaatacaaaaaattggccgggtgtggtggtgggcgcctgtaatcccagctacctgggaggctgaggcagaagaattgcttgaacccgggaggtggaggttgcagtgagccgagatcgcaccactgcactccagcctgggcaatgagggtaaaactccacctcaaaaaaaaaaacaaaaaacaaacaaaaaaaagagctcgttgtattcaattatagatcttttcccattaagatattccttgggacagagtgtaggagtatacaattaatcttagtactcttggtctctaacatagagcctaacctatagcaggctcagaataaatctttgaatacacattaaaaggtgaactaagctagagagtactggctatctgggttccacactggaattacgtggagagtaaaaaaaaaaaaaaaaaaaaaaaaagaaaaaagaaagaaaatctgatgcctggccccaccctgagagatgctgatgatgggtctagagttgggcccgggtatcaagattttaaaaaatctcctaagtgattctagtatgcaagagagttgagaaccactgttttaggactttcttagaacagcttcctatggccatacctttacttccctgtcataagatccagtttccctcatataaattccctttctctgaatagaccagaattgtcttgggagccctagtagagaagaggctaacacattatcccaaatggggatttgcaaattgcttttccaaggtaccaaagaagattctcaaggttttaaatctattcatatttatgtcttttcaacaaaaagaataaaattcacaatataagctggctgctttgcagacgcaggattctaagagcattacagcatgcaggtaaatagtaccctgacatgcacatggcaaaattttctagaaatagaatagcaattaaaaataaagatggaatccaagtacaaatgagcctcatttcaagttaattctgcatatgtaaaaagcagatactattaactggggtcagcaaagggaagtagttcatggttttcttcaggctacttaggttatatttacacagtataattatacagcaatgcattttttgataagtcacttataaaatccatctcctatagtcacatagcacacaagtattggtatctttgctctcaagatggtactttgtctgacagcatttcttccatcatatatgaggttctgtaatggctgagagagaaatctgacttctcctacttcaatacagacaacctttcatcatggagaagggagcaatggtctctgcaccaagggaacagcagctggaatggagttcctctgactcatagactgagaatttccctgctgattctcaagctggtttggccacactttatgcattcaccctgcttaacagtcttttgttgatggtgtggtaacaagtggccttactcagtaatagaaaaagcatgttgagatatcccccaaaggctcctatgtgtgtttcctctagctttccagcagggaaaaaagctgcctgcaacaaccccacacttatttttgttttacatcttaagttaaatttgagaaattagaataggaattatctaaaagacatgatacttccatgttcactaaccctgataaacagaagttccctactcatgccaaaactgtgaaggaaggaaatctgttaagatttcaaagaaagtgtggagtctcatgcataccagcacatcactttcactgactaacccccagagggctgataggtagcaagtgattgatgggtgacattcacttggccctaattttcctatctgaaaaggaatggaaaatataacacaagtttccaagttgctacactcataaaaccaggagggtgatcaccatccacctgtccaggttgaccacaaatgtgaaatgcatgaccacatctgccttacatgtatgtcatttgtcagtaaacacgggctaaggaattccttgagccccatgaagagacaaaaaagtttgtcctcagagaatttacaaaagccagagtaacattcaagaatttaaaatattaaactggatttgaaaggtgatatgaaagctacaggacaactttatctaccgtgagtatgtaaccaccatggaaagatgggctaatgaaatcaccagagctgcctgtggtcagccaggatgccaggggccgtgggcctcagagaaagattcatggaatgaaggatgtttcagggccacgtgtatgtgcggctgacaaagcttcctacctttttggaagaactcctctagtttgtccttgaaaggctggagatactcctttggggactccttgcacaccaccaccatctgtttctcacttgctgtgaagagaaatttagaattagacttaggaacacagatttgctgagctcctgctatgggccaggtactgtgctatgcacttggctatcaattgtgcacactccttgtcaaccactgttggtccaaattccaggattggggggcagggggaacaaaacccagaaataataaacaaaccaacaaaaataattagttcattctacaccactcttgaggaacagggcaatgtacaatccttccatttttcttctagagatccagaaaagtctctgacctgggataggtaaagtattctgcttgtgttctcccaaagataaagagaggcaaaaactacttgaggattagtctcacgaaattaagggcctcagccctcctcagattcacactccaaaagtagagcttgaaaaatatattgcagaaattctcaggcacccaagttgtctagaactaccaacctagtgattggccagggtgacacacgcatcccaacatgagaactaagaccaggtcggggaggaccctgtcagttcttcatgcttcccgttcacctacccttccttttaatcctctactaacacaagggaaataattttacataatttacttcagatagactatctaaaatttgtaatagagtactttttgataatcaggtctgaggtgacttgactttttaaaaatgacctaccttattggatagttacgatttgtctacagggaagccacagtaaatcatagttcaccatcacaaaaggcagttaacccagccaagaggcatctccccaaggttcctatgtgtttgtgccagttacagcatgcactgggaaaagaaaggcttcgtttctacaaagctagagctgagtcaagatcactttcatctgttgaccatggctggaaattagatatgttcttgtccaaaagcctattaataaagcactggatttcaccataaagatatcatgccacctggggttcacaaaatagagaaacatatactacagatcttggagcaatttataaacacacaggtaaggtattttggaagaaggaggttgggaaggagatctttatttacattgggaaattcctatccaataatttggcatatttaaaactagcatctcagaacgtatactgcaggcaaagcaataaacatgtcagttcagaaatagagaaaatgcaaaagacaccacttaaatgttctctgaaattagttatctgacacttttcatttgcaatattgccaactagattgcagaaatcctagacaaccctggggactacaaaacggtgctgaaaatgaaagtacaatttgagggaaccctttgtcattttctgagtcaaggtcagaatcacctacattttcagaggtatctagggatttctcatgatacagggatgctaggtcacaggacaggggtaccgaaattcaagctctatctattgacattgtttcttaaagagtttttatagagctatctagaatatctgctattagctattctgacaaccattccaaggctatctaggaaatcctgtccgttgggaggcaaagactaattttttaaatgacttatcttattgaaaaaatacaaatcttaccttgaaacaactagaacaaattctataaatccagtcaaataatcatttaaaacattcattttttccacatttttttcctttctttgtaagcctttttgtcctctctacaataactactttatagcttctctgctattatgagattacccttcacctcttttgaaatagatggatctgtggccaaatggtaagtatatccttcccactaccattcttttctcaaaataggacactttgcgctagagtagtgtccaaggagcgagagagtagatagagctgggatatattttgcaggtgtaacaaataggtcttgctgattcagtcaaggtagggttgaagcagatggaagggtaaaggagtgggcaatgggttgctggaagtgccatttgctgagatagagaatagtggggaagtatcttgttggattatgtttttttaagagacagaggagatcaagagttaaatttgatgcttaagttttctctagtctctataaattgtaaggcaatcttgtcccctgaaaacaaagggggaaaggtacaaaagaagataaaactattaatgggttctcatcacaaattcaactaaattcaaacttcggggacttggattatttaaggccttttccattatggcatatttcagctctatttcccacatgtatttgactaaccaaaccaaagctgttcaatgttttccagttacattattcggcattcccagttccatgtcttcattcatgtggttctctgctctgctctcatgccatacattctttcaacaatatctgacaaagtcctgttcatcctaaaaagcttctctgagatgccaacattgccacaaagcatttttcaatccaatgtttttgcatctttcaaacatatctatcaccgtctgcacagtgtttatgttttacctttaatatttatgtaaaagtccatacattaatccctgagaagtcatcatgcaggattcatttacttctccccaaacttctctagagagctccatgtatctggcgaaagcatcagatttccttatcttggctgaatgtcgtggttcgcacctgtaatcccagtgctttgagaggccttggtgggaggatcacttgaggccaggagttcaagaccagtctggcaacacagtgagaccttgtctctcaaaaaaaattttttaagttatccaggcatgatggtgcatgcctgtagacccagctacatgggaggctgatctgggagggttttttctgcccaggagttcgaggctgcagtgtcataccattgtactctggcctgggtgatagagtgagacagacagacaagaaaggaaagaaagaatgaaagaatgaaaggaggaaagaaaggcaaaggcaaaggcaaggcaaggcaggagggagggaggaaagaaggaagagagagacaaagagagaaagaaaaagaggaaggaaggaaggaaaaggaaaaaagaaaagggaggaaggaaggaaggaaggaaagaaaggagagaggaagaggtaggaagggagggaggaaggaaagaaggaaggaaggggaaaggaaagaaagaaaggaagaaagggaaaagtagatgaagaaaaaaggtttcttcatcttaactagattctcacgtgtaggaaagtttaaataaaattagcaatgttggcttggcacagtggctcgtgcctctaataccagcactttgggaggccaaggcaggtggatcacttgagcccaggaatttgagacaagcttggccaaagtggtgaaaccctgtttctacaaaaaatacaaatactggctgggcatgggggtgtgcacctgtggtcccaggtattcagaaggcagaggtgagaggatcacctgaacccagggaggtcgacactgcaataagccatgaccacacctctgcactccagcctagtctcacagggtgagaccctgtctcctgtctaaaaaatatatatacatacatattagcaatgttgacccagactccaagtgggctttccagagatgcaatgtgacttgcttgcccttcccctgcaccaaggggtcaccgtctctgtgtctctgtactcctcaaacatggtgaggtgtcccaagatgatctaaggtttgagtgtattttaaagacccccagaaatgtccaccacctcatcccatgagtcataagcaaggtaacaaaggtaacaaagatgattatcctgattgggtagttctcaaggtaggcagggaagcaggaaagacatctgttttaaggaatcagcatttctcaatgaacatttgtggccacataaactttcctgattatttccagctatgattctgagaatacagttaaagaaaagctaggatttcccacaatataaattgggaggagttccttaaattatttaattaaccctctactatattcaaattccaacaatttcatttatatagaattgtttttcatgaacgtagtataaaacatgcctgcaatttactaataggatataatcgaacgcctgacaataactccttcaaggttacttctccctggtgaaagcaaagctgaaggcagagcttgtttccccaattacaaaagcaatactttctcttttgcctgaattcacagggttgatcgctgcagctctccctttgtgctagatgtggtgacagagcccatgcggtgcccatcaaattgctccaattttatgaggccatatcatgggggtggtaaagagcttgtgcttggattgagacccactaggactcaggtgggctgtggcttgtttttctcatctgcaaaatggggacctcccgcaacacaggcatgatatgatatttaagataatacatacatagtgatttgcagaatgcctggcactcacaagcaggctcataaatattatttgttatttttatgtttgactaaaattggttgggaaacatgtcaaggtcagaacagcaagagagtcatggctggggattatttgctacagatgctgggcactgtatttacggaaatatgccacggtgcaaatctcctgtttagaacatagggataatgattttcattcccgtgctgaagttccaccacccattgtgagaattcactgaagaatgcaggcgaagtcttggggaaagacgaagcaaaatgggaaacaattcccctaggcctctgagcttcgcggttttgaaattagaaactgaaaccagtacaaacgagagcagctccactgctgtgctccaaggccctctctgcagccccacgggctgggattcccacgtggcctgtaagaattaaacttccccacatgatcaaaggagagggctgccctccgacggtccccacagagccacgcgccccggaggccaggcagcttgcctgctccaatttattgacttggcttatccgagatgctttctagcagacaaatgggagacctgaaggctaattaatgatgacaccggagactggcagtgcataaaggagagaggtcatggacagatccacaaatgtccttcactgttcaaccggaagactcgcatacgatattgctagaccaccaaggttgcctcaggcgtgggctgtgccaggagctccagttaaaagccaaagtcaccccaggttctctttctgttatttttctctttacacaattttttggcaattaaaaatatattaatttccgaagttagttactactaagtgatcactgtgagacagagatgaaatattaaaaaccaatacatagtgaaataactgagactacatggagaatattttcacttacaggttaaacactggtggagtattttagtgaaaggaaagatatggcctagactattttaatatttcagatattaggctgttaaggtcagaattatctgttttttgtttttcacccctaagaacaagggaataaagcttattaagccacttaaaaagcctaggcaggttagaaaaatgtagcagtaagacccagatataattcatcaaaatcaaatacgtttaattgctttgtaaatcaaatgtatgtgggcaattggtatgaagatatgaaacttgtttctttttgtatgagctgaaggacctgtgggcttagttaagtcagaatacagttttagaggaaaggaaaggtttatcaggctatctgcttttccagagttctctcttcttccctgtctggttacctaagtcttaccccacccttccacagtcctgcgccagttctgcctcttcctcacttttacaagatccatgtcctgttcacaagctccctgctcaaaggaccgccatagaaaatggctgcagcaacatatggaatttttttactaaagcaaattcttgtattatatcaatggggcttagatgagagacataaagtgaagccagagatcaaaagcctagaatgcttggttaaggagtttatcatacaggaatccattcaataaatacatcagttcggctaggcgcggtggctcacgcctgtaatcccagcactttgggaggccgaggcgggcggatcacgaggtcaggagaccatcctgcctaacacggtgaaaccccatctctactaaaaatacaaaaaattagctgggcgtggtggcgggcacctgtagtcccaactcgggaggctgaggcaggagaatggcgtgaacccgggaggcggagcttgcagtgagccgagattgtgccactgcactccagcctgggcgacagagcgagactccatctcaaaataaataaataaataaaataaaataaataaacacatcaattcaacacatgtctactgagcacctactacgtgccataaattgtgtcagatattggggttccatcagcaaaagaaacagactaaattctctgccctcagacattatagtgaatgggtcaccaactaagatttcttaatgggtatggcacgcagtaattattgtttctagtaacttgaactgcaggcaaacctacgagttatttccttccatgttcatcttttctactttaatccctttagtaagaacaggaccgtctagtgcacttcctggtggtggggtgggaggacgtggttagaaaaagtgaatgtccttttagcttcctgcccccaaacacacttttatcaaaacaaatgtaaaaacaaattcagaactcagaatctcaatattagcttaacttgcacaattttcttcttatggcattggccttaaactgactaaggaattacatgaaatgcaatgtaataaaatactaaagttagaacagtaatattttattttggctagcagcaatgcatggacttctatgaaaggggaaaatcatacttacaattaataaaatattagatattttttcatttgcttattaaagcttggcacaaatgagaaggtactattttgtggctatctactgtacacacttttttataaggccatatagaaaaggccacacaaagggaggtttcaagttgatttaagccaaaaacaaatgacagaagcctgcaataaaaagtacctatttcatgttcttgaggtctgatgctacacagcaggagtattttaaatcttggcagggttaagagtagggagtggtattactggaaatcacagggtgaggataactaggagagggcaaaggggaaatctattcaaggagacaccgacataagttagattttgaaagggactgctacacccattttctactaaatagcccttcaaagcccacatttctcagctcaaatcagacaactgtgcattaatgacccatatgtggaaaatctatatgtaaccaaaggtgttttccttctttaaccttggtttggggattcacctgacatcatatgcaaatttttcctcctaatgactctattcatccaaaggcaagacactatatttaaagtggtcaaaaaactccgaattcccagttgtccattcaagttaaaacacaggctttagacacatggaacccaggtcaaaatattatctcagaataatgtagctacatacatggacttagacaaacaagtgcctttttatagacaaacaagtgcctttttatatctacacatacatagtgtctatgcctcaaaagctaattagaacattgtacttagtgaatagagctttagtatactccaagaagtagaaacaatccaaatgcccatccatcgtctgataaatggataaataaaatatactttatacacagaatgaaatatttggccattaaaacaaatgaagtacaagtacatactactacatagaagaacgttgaaaacattatgctaagtaagaaaagccaatcacaagagaccacatatcctatgattctactcacatgaaatgtcccagtaggcaaatctatagagacaaagcggattagtagtggctgaggactaggagagaaagagggagagagagagaggtgacagctaagggggtaagggagaaaagttttccttttggagtaataaaaatttcaaaaaattgattgtggcaatggttgtacaactttgtgaatacaccaaaagtcatcagattgtacactttaaatgggtgaattatgtggaatgtgatttcatcttaataaagctgcctaaagctaattagaaagtcagccttaaactggaactataatgaacagataaatgaagaatgcctcatctgtacttctttatataaggtaaataattttaaaaatcttaggtgcaactatgtcttcattataatacttacaatattactaaactaggaatcaaaagtgggaaatgagtttgagatgcacatgtaattgagaaattaaacatattagtcaatcttcaaaaagtagcaacaaacgttattaaaataaaagacctggccgggcaaggtggctcacgcctgtgatcccagcactttgggaggacaaggcgggcagatcacctgaggttgggagttcgagaccagcctaatcaacatggagaaaccctgtctctactaaaaatacaaaattagccaggcgtggtggcgcatgcctgtaatcccagctactcaggaggctgaggcaggagaatcacctgaacctgggaggcggaagttgtggtaagctgagatcatgccattgcactccagcctgggcaacaagagtgaaactccacctcaaaaaaaaaaaaaaaaataaaataaaataaaatacctactaaaaataactgaactcaataatagaaatacaagtaaagcatttaaattaaaagtgctaacttttggaaaattaaaacaatagctttcgcacattcttaattgtggcatacagctatgtatatatatttacacatatacaccaacaattggtacattagaaaaatttcccctttgaggaacatcacacaacggggcctgttgtggggtggcgggagtggggagggatagcattaggagatatacctaatgtaaatgacgagttaatgggtacagcacaccaacatgacaaatctatacatatgtaacaaacctgcacgttgtgcacatgtaccctagaacttaaagtataataaaaaaaaagaaaaaagaaaaaaaatttcccctttgaactactcttgatttaaagatgcatttattcttagtttttcatacactctatttggctggaaaagttatttaatatctgactcttagtttcttgatacataaaatcttgtgaggactaaataaacatgtgaaaaaaaagcattttgtatgctgaatagtaaaacgctagccaaaatattcttcagctattttaaataatcaaacagtagaaaggctggctagataacatactgtacgcggctttattctttgtttccaagaagagctaaacaataacagcaacctcacaaactctttgaataactgacattcctaatgtttgtgtgtttaataaacaaatcatgttacagtctaatcattttcccagtccaactgtcttttaaaatttgcaatactcactttttcctatttcttgtttcatgacccactgaaatttacttcctccccattgtgacactgagaaagcactctgaagtcactaattaacccatcctgtgggcagtgtcctcattttgtatctccttcgctgacaacccagcaggattctgcatcttgactacttctcctttgtaaaacactttgtcccttagcgtctgtgttccccattgtgggctttcctcctacttctgcctgccctgtttcctatgcagcctcatcttcctatacagagtcattaaacgttaaagttctctagggtttggcataaggctgctcctcctcccatgctatgctctctgtctagacaatgtcatccaggtaaacatttcagtaaccatatctgggatgtgtctcccaagtttacacagctagcccacagtttcacctcctacggaactcctgaattcattactcttcaccaggctgctatagtctcagcctaactgttcttcccatatccaccctgcctctctctgatttgttctccatacctgagtcaaagtgacctttataaaatctcattatgccagtcccctgcttaaacctgcaggcacctctattactctgagaggttgtcttcaatccctcaagctggcctgcaaggccctccatgcgctacgtcttgcctgccttcccagcctcaccctgctctccctgccacagtggcccttctttccattcctcaaacatgctcacttcttcccattatggtgttctcctgctatgccactctccttcacttcctagtaaccaggacctagtcagtgcttagtcatcattacgacctcagctcagaagtctcatcaggttttttttttttgagacggagtctcgctctttcacccaggctggagtgcagtcgtgtgatctcctcggctcactgcaagctccgcctcatgggttcacgccattctcctgcctcagccccctgccccccgctccctgtgcaaaggctaattttttgtatttttagtagagacggggtttcaccatgttagccgggatggtctcaatctcctgacctcgtgatctgcccgcctcggcctcccaaagtgctgggattacaggcgtgagccaccgcgcccggccatcaggatttcttttccaccttccattctgtgatgagagaccctctgttacaaagtcatagcactgtatacctttccccttttcatgattattggattgtctccctcattaggcagaaactgtatttttcttactgttaaatctccagcatctactgtaatgtctatctagtgaaagctgttccatgggtatttgctaaataaatgaataaactaccagttaaaggggagaaacttacacatgtgcagtatggatattagtgtcttgacagaatttggctgtagtacatgtacactcatgtacctcagaatgatgcttctgtcaataatggaccacatataaaacaatggtgccataaaattataatgaagctgaaaaattctgatagtccggtgatgatgtagcctttgtaacactgtagagcaaggcattacctttcctttgtttagatacacaaatgcttaccattgtgttataattgcctacagtattcagcagaatactgaatacagttacagtatagtacagccagtagtactgtaatatactgttaactatattcagtattctactgaataatgttggggactgtaacagtatagaaacctgtgcagatttgtagcgtagacgccataggctataccatctagcttaggtgtgaagtaggctacaccatctatgtttgtgtaagtacactctatgatgtttgcacaatgatgatattgcctaacgacacatttctcagaacatatcccagttgttaagtgacacatgactgtatgtatgtatatgtagacacagacatatgcacatacaccgacacgtgaaaaacatctctcttcatttgtataatacatgtagatggaggcaggggctggagaagacacaagtacactgacattcactcattcacccactttcactcacattcactcattcagatacgagatacacatttttttttaaatccctgtccgggttccataaacattcatacattcaaaatacttaccaagtatctgctgtatgccactgagctaaatgttggggacaaatatttaatgagacctactggtcatttctcctctaaaaaacattcacagtctagcaacaatgagaaacaaggaaatgaacaaattgtgatatagtgtggtgtgatggaacgctgggtataggcctctatttcagactgggccaggagttagtagccaggaaaggctctccaggagagaaaacttatgagttgaactgcaaaggtcaaggaggagctagccctcaaccacagtgaggaaagagaattaaggtgaaatgtcatgaataaaagtaatacatgatgagaacgcacgggccatttgaatgagttaagtggtgtagcatgtctggagctgtgggaccttctctcctcagatcactggtgttctgcattcagattttggtgtaaaggaaagagtgtgcgtaggggagaaaagcttctgggccccaaaggtatcccaggttacacactcaggtgaacggtgaaaaggctggtgaccagcctggttaggaaaagtgtcacagacataaggggcttgcaattttacttaaagtagttaggaaaagtctcactgtgaagctatttgactagagatttaatcagagtaagggagggagtcatgagcaagctcgaggtggaaaatcaaaggtgttatttagagcacattaagtttgaaatgtgaattagacactcaagtatatataaaagtctgcagtctgggactcatggctggagtagacacacatgccaggaagtcattggtataaaattggtatttaaagtgatagcaaaatatgaattgccatggggagaatacagccaaggaagagaaggtgttgcaggacaaaccctggggcatgtgcacagtggaggagaggccagcaatgaacagagaagagctggtcagtaggaaagtgaaggtctggagttacatgacctgagaagaaaacagaattgcaggaaagaaagagcagtcagctctgtgcagaaggatcaagtgagatgaagacagagaaataacactgattctagtgacacagaggtcacttgtaatctcaaaagcagttccagggaagttgggggtgcggggaaaaagccagcttggagaggcgtgaggtaaatggagaaagattctgtagccacttgtttaagaagttaagctacagaaagaacgccaaaatggggaagtcgttggaattaagcctaaaagatagctctagttttcctggtcaagtgctaaagatcaaatgaggccatggaagtgttgttttcttggtgactttaaaactgatttagttcttatctgcctgggatgtttttgatagtttcctttcatggtagtaggactccttagaaagattcttcctttaatttttcaagaaaactcccaaagccatcatgtcataaaaatcattccatacaagaagatattctctagggctactttgatcacgtgcagaagaggtctagccctttacagagcggctgcctctttctccagaggaatgttccataaaaataaacccaccaggaagctggagtccaggggaatcccatgattctgattcactccactgagggaggctgcccaagatcaaattcaccttaatgtaccatgattgggagtgagtattctccatgaaaaaatttaagcagaggtgacagggccaagtgaggacatgctagtgcgctttaggacttttggaaagacttgcaaagctgggccactgactacagcctttgcacggaattgtctaaagcaccattcaaaggtcccgcctaccaaacgtcacagctgagtcagaatttccactgtgatgattatgtggttacggacgcagcctcggtctgcgagacattagcatgaaacatattcattaatcacctacccatgacgaggcctaaatatagatggattgggcatgatttgatttatagggtgttaagcgattcaaacatttattcaaaaacatccctttcactggtccccacaaaaatcgccaccatgagaagccttcccttgaattaaagatggtaactccagaaatttcattagaaatgcatatgtattcgttgaaaaagaaaacattgtcaagaataatttaatgctttagtagaaatgtatttctaagattggtttaggaggtaggggatttcaaaaacaataggtaggaaagttgtgttaacatggaagaaaaaggcacatactgcaagctctggcatcgaggtggactgtgtggcaggggtcctaggcaggcagcccaggcatggaggtaccgggcctctgaaggggaagggaactcatcttcgggaggagagcagcgactaacttctaaaaagtattaggaaggtaacatatacacacaaagacatttgaaaaacatttttaaaacagcagaaaaaacaaatcggtcatgacaccatgaccaaaacacagtcaccatctaagacttgcatactttctctttcagggtctgggcctcggtatcgcgctccttgcccctccatcattttatgggggttgccttacttatatttgataaagaatttttttgtattttgattctttctattaacatatcatgcacacattctcctgttatttcacaaactccacaagcatgtttaacagccatataaaatttcatcaggtaggcatgccatagctcacttaattctcctgtagttggatagtgaaatcctttctaccttattctcatggggagtcaggcttgagccacatctgtgtccatacaaacttattctaggttgagggtcatttctttaggaaatgacctaaagatacaagatacaaagataaaagatacaagaaatgaaattataggtaaaaaggaaaaacctttgtagaattcttgatattagtggtcaaactgtttttggtacaaaatgggttgtaccacaatgggagagatgaaggggagagattttggaaataaaaccattttctgtaccactctgcagaggtggctggctccatgcaagctagaacggtgcctgtcactgtcatgtagggactacggtcatcacattggaagtgcaaaactctggaatggaaaacagtaagaggaccatccatccactgaagtaatttactcaaacacaagaccataactggtgatatatgagagttgatatagaaattggggattaatcacagcataaaactaggtttgaggcctgtgcatgaaagtagctcttttttttttttttgaaaggccctaatgtgtcacgtttaattggaatgtaaattatgctactgtcagcactagcaaagctgtctgaacttgggggaagtgtacagcaaacttacatcaaacactcagagttttgtaatatacatttatataattatgagcacacaaaattttaaatgctcagactttccaatcaacaatatcaagtaatcatttggacatacgattgcaattcaagtcatttgtgaagaacatatagagcctatattttggggcactcccattgaatagtacttcaagaagcatacaggtatcattagtgcaagacaatggttaaaagtcagcaaaggcagagcaaagttgttagctagaacgcctcactcctcccaaaattatagcaacacatcttatccactgctctaatcaggaaaatagtactcctataggaatgcttaaatactaaatatgtcctctgaagtcaaaatgcatattttgtggcaatttttactagaattgaggattctctcacacatacacgtcttgaaggccacaggcctgagcctctttatgaatcaaggaaatcagtaagaggaagaggtattacagcaatgctggtcttaggactagtccccttccagcagtgcaacagctggctacaaagaggccagtgattaagatacacaaggcctattagtaaaaagcaacctgtccccacattgctccaccaggacagctgcaagtcttccacggtttctctgacctctgagcccatgttcccgtttcagccctcgctggttagtcacattaactgtaattttctactctggaaagtgtttacatctaaatgaaccatgagggaataaaggagaaatgacagaaaggcataaagagaagagagggaaaaaaaaaaggatggaaagttatttttaaaacacacaacctaatctggtggatgaattctggtatctagtcttggctccagaatcactggcaaagcatggagctggcagccactgctaatcagtttgccactgtcttcagatttaatgcaatatttggctcagacatttaaaaaaatcctattccagctaaaatatttacacagtcctatgtgtctcacttaatgcctgttaagcaatcgtcttttaaaactccacagacacttgtaaatctgtcgggagaattgtggcctataaacaaggtttcatataaagaaggctgcattgtcaattttgggggagtagggatttcttaggatgtgtttgaaaatagagttgaatatcagaaacagtttagagtgggtaacaaagtggccaatagtctcgcttgctggacgccgttagtggtattaacgggaagcctccagacactgatctcagctatttaaaactgtgctctcctgtaaatctgtcattgatcctacctctctcttgagttatggcgcagggacagtttctggtccagcagcccctggtagtctgcatcctagggcctgtcaggctagagatgatgagctgctggagcctttaacaggaggctattacgtggttatacgtaaagtgagtgtgtgtaagcatctgaggaaggatgggggactgctagaggagagggggagttctgggcagggctgatgttgagaagaacaagacggctgaaatgacaaataaatagtatccactgagaggctaggtgtcacagattctgaaatgcctattaaactctctaacatcttcagccctgatgttaataagactaggtgataaaacttaaagtcatggaggcccctccaagctatctcctgttggcctggggagcgcaaggaatttgtctctgtctttgggatgagtcaggtatatgtaatatgactcagcaaaaccgctccatcattcaattattcctagattagccgcctttttatttttactccatttcattaatgaatacgccattggttatgattcacaattttattttagttgtttttttttttttttttttgatacagagtcttgcactgtcagtcaccaggctgcagtgcaatggcgcgatctcggctcactgtgacctctgcctcctgggttcaagcgattctcctgccttagcctcctgagtagcttggattacaggtgcctgccaccacgcccagctaattttttgtacttttagtagagacgggatttcgctatgttggtcaggctggtctcaaactcctgacctcgtgatctgcctgcctcggcctcccaaagtgctgggattacaggtgtgagccaccaagcccggcctatattagctatatatagcgaatatcaagcccagcttaaacactcaactttgggatttggtggagttaggaaaaggtatgtcatggattgaaaaaaaaattagatgtttgtaattccaaggtatataatgccttgaaaccaaggtggcaagtattagttgattctcttcaggatcacagtcaggaagggctttgcagatgtttttatgaatcttcagaacagctggagggaaaattctatataccttccctctgtttaccctctaacagactgacaagtattatctctgttctcaggtacagtcagattcctgttcctgagcagaagagaaatcagaagtaggaataaatctctcccctagaaaatggggataaaacttacccttaaaatgtgtttataaaggacttgatctttcagtgagtttatttaaaattcgcagtgaactcagtgctaagaataaatatttgctgaacaaattaattgattgaaaaggtcaaacaagatctgtctcgtattctgtagttttttctttgatacccggagatttgatgacactttttaaagaccatcaaaatggtccagaaaaggtttaaaaacacaaccaaattagcactgttagtacattagccattataaatgttccttgggcgtttcccctttctgtttactatggcagaggaaaagtttctggtccagcgggtcctggtcctccatgctgacttggacatattgccatttatctctcactcagtaattccttgaaaacaacaacaaattttcaaactgtataatcaaaagcaaatggcccttaaatggccaagggtgtcttagccctcagcctgctttatgtgttatctcatcttaccctatgaaagttttcctgctattgtcccctttttggtgagtattagtaaagtcacacagacagtaagtagctgagtcaggatctgaatccaggggtaacagaccccctgcccttataatatgccacctcctactttcaccatctacaggaaagttctagaaaaaactatgggacacctatgtgaatgctttgtcaactgtaaggaattaataaaagctaaaaaaatcaccaagtgccaccactgggatcctgtcatttcaaatggggaaaaggcctaccaggtggttaggttagtaagtggcatggcagagactggaaccagggctgtcaatttcctggtaggtctgtgatctttccaggagtattaaaaggtagagtcacagttcatggcccctatccacctaggagccacgctgaggttgagctatctgggaaagaatctacgagagataaggatattggcaaaaactccagtcccctttgcaggggctaaggaggtctccctctaacttcactcatttggttgactgacatgagaagaatctctctgtggattgtgaatcttccacagagtcaaagatatacaacttacttaggcagaaaaagtattttgatattcacaaaactatccactactctatttctgtaaagaaaatgttttgacccaatacaagctcatggtatggtagcttgggcgctggcttggcagtcaaggacctgagttctgtgcctggctgggtgatcccggccatgctgcttcctatctcgaagactctgttttccaagctgcatatgcctgccctactcacttgggaggatgaagcaccataggcaggtaaagtatcaccattataattacaagagtacctttaaaaaaccaaaaaaacaggaaatatcaaggatactttgttaatgaacttgccaaattaatgctattttccagtcctcatacttgattcagtcttccagctatcgagcagaatcctgatcaaaagcacttgtgttgtttctaaacctgtttattcctgttgttctttttattgaaattatgtaatttaatgacttgatggtaaaccagatatatgactgtcaaaaggtactatttctataagttttaatgaaagaagctaaaatattgctgttaaatgtaggtatagaaggccaggggaaactggggaaacatggcaactaaatgcaatgtggtagtcaggattaggtcctggaacagaaaggggacaaaaatggaaaaaccagtgaaatccatataaaaactagcattcagtcaatctaaatgtatcattgccagtttctcagttttaacaaatggatcacagcagtgtgagatgccaagaatggggaaagtaactgagaagagctatatgagaactctctactctttgcaacttttctgcaatttaaaaattattccaaaataaaaattaaagtgtattgtttaaaaagtgtgggaaacacagttttaaaagattgagaacaattataaatatctagaaagattctatggtgatatttgcaagagtctttactgaactttaaaaatacagtagggaaattacagatgctgtcattatggagtatgtagggaagacctataggactgcattcgacagattcataattcaagtaaaagcttcatccctgcatcagaatacagacaaaggatacaacatttaatttgttgtaagttaaagtgttaagggatacaagtgtcattttccatgattcccaattttggccaatttttttccattaacctaccacactggataagcgctctgctctataaagacagatggtatcggctgggcatggtggctcatgcctgtaatcccagcactttgggatgccaaggcaggtggatcacctgaagtcaggagtctgaaaccagcttggccaatatgatgaaaaccagtatctactaaaaatacaaaaaattagctgggcatgctggcgggtgcctgtagtcccagctactttgcaggctgaggcaggagaatcgtttgaacccgggaggcggaagttgcagtgagccgagattgtgccactgcactccagcctgggtggcagaacaatattctgtctcaggaaaaaaaaaaaaaaggatagatggtatcaacacaagaatttttgaggcatgaattaattcaagagattgttcagagtcatttacaaagagaatacctgagatgcaagcctgatataatttgaaagttgactttttaaaaaaaagtcttgcaaatggtcagaattcctaggatttttcagttgttctaattaagtcagtctagggaggaattcaatacagtaacccttcatgaacaaggagaattatagaatgcactgaaatagcatagtaagaataatcatctcagaaattcaggagttggaatataccttcaaaatcatctagcaaactacttgtctaatggtacctcctctacccacccacataatacaatcttccagcaagcagtgggtgaggaacccactactgctcaaggccatcagttttctcttcagacagctttaaaatctgtccctctaaaagattctactcacggatgcttatctgacatctttggccataaggaagtgatctaatttctcactaatagcagagtcagcgattatctgaagttgagtcatttcttccattgttcatttgctcattcattcacccatttaccaaatattgacaacaaatacgtggaaagtgctgaccagcacagtaaatataaacataaaaaaggtcatatatctgccttcatgaagctggtggaggaagagaaaatttacaaacaaataaatagaaaataatatgaaatatgaatatgtgaaagtaatatgaaaaacgaaggctgtaatagacagtgcctattcaaagtgcctcctgaagagtgggtgggcaaggaaggctcagagcatgggcctatctggcagaagggctttctaggagagggacccactactgcaatgatcctagagcaggaacaagtacatcgtgttggaacacaaagaaggcccgtgtggctggagtttagtgggcaggaggggtgagtggtgtgagagaagactggaaaggcagaagtggttaaatcagtttgtacggcatgagtatgaggttggatttgattccaagaggaatgaagatgaaataacagagtgctgtgacctatgcggcaggtggagacaaaggaagaccaagagtggaagcagagaaacctgcttgatatgggccaggtgagaaggtggtagcttggattacaaaagcagtaggtgtggagatggagagcaatgaattgattccagacactttttgaagttaagagtcaacaggactagctgtcagacatgagagcacaaaaggaatcaaggaaaagtatgacacatttggcatatgctatgaaaagggatttcctttgtgggatcccagtaaatcctcttaaacaatcagtggagcaggtagccttacactcatttttatatgaggatactgaaatgtcagggatgaaatgatttgccaagggttacaaagcttgtgaagcaaggatttgaattcaggacttctgacccagacttttctatgattgcagcttttatttcaatattttatgtttcttgtcaaagaaaaaaactcaacaaaacacattctattaaccacgtgtttttataaaatagagggtagaaatagagggtgcaaactgagaggaggaaaccaggacaacataactcatccttcccacctagaaatgtcacaatcacagcttcaaaggaaaacacaaacttcttccattaattaaacggatgaatcaagtttcagtttcctctctcctttctgtacaacttgtctttgaaggcatttcatttgggaaatgtgtgacctttagtcaccatgctcaattaattgaatgctttgcatcaaaagtcaccatgccgatccacattttacacccactgcttttctgaaatacttatcccagttccttaggtctgttttgttgaaatcattttacaaaaataaatcatatcaaagttttttttattatttctaaaactttgcttgcaaaactaaatatttttaacaccatggcaacatggtcaggactctggctaatgtatccagtctcgtaccagagctcagacttagtaaactactgctgtggacaaatgggctgtgaaggaggaaagagctaataaattagacatggtcaataatcattcaagtcatgtcttctggagcttcccaaaaggtgataaattagccagacctgtcctaatgatcaataccctgctctcccttctagaacacaccagcatccattgagtaaagtgcagactgcaaggcctctcaggaatttaagtactacctcacacctcctgaggtacttcctcaggcatcgcctcatctgaccctttcaatatccctttgtgttgggcagaatccagaagtatgatcggctccattttttttttcagttgagagtcacagaggctaagtgatgtggcaaagtgcatggtttatcatgtgataagaggcagaattaactttaaacttacatctcctaaatctcagttcagtactattttcaacacaccagcctctgtcattgaaacttaacaaattcacaaatgctttgtttcattgtgggattttttgtttttatgtatttgtcaaagttatacgtgcacgcagtttaaagaatcagtacattctatgcactttaagaacagcagtcccccatctccaccccaccatttcctcaattcttcctcctcagaggctacctcttttaccaattttatgtgattatttggtgcttagtagtatgtctctaacaagcttctattgttttttttttatttttctctttatcaactataaatgatgtagttctttccttcactcccgcctcttcacttccatcaccccaatatagcacacggtaccatgacttggttagactagcgtttggtgttgacattattatgactttgcaaaaacaactcgcagtcccagctgatatatggaaactctgattattccacatttcccgcacatttcctctttctctcacacttgctctcagaatttttttttctgatttagtttgttttctatgagcttaacgttaaatgaacctcacacttgttactagttgtataaaatctcttgtccaaacgttcagatatattagatgtattaattgtgtattccttaagaaccttctccatgatgcttttgacttaatcaaatctgaaatgttttctttcaatgtctggctgccatcctgggctttttctctgtgctggaggctccattcaccttccttctccactgaatttttatttcctgtgacctatgtcttcctctttaatgggacagcactttctttagtagcatcctgaagataactgtatgggagataagtattttgagaaattgcatgtctcaaaatgtttttaatctgtcctcatatttgactaatagtttggtggatataaggttctggactgggaataatttttcttcagaatcctgatgcatttgtagcttttagtaatgctactgaaaagtctgaagtcattctgtttcctgactgtgtgtgtaatccatccccacatcccacctactcctagaagggggtgagcttttctttttgtcctaagtattctgaaatgttctagtaatagtataaatctgttttacttcccccatattagtcaaatatcacatggtaagtggcagaattaactttaaacttttgtctcctaaatcctagttcagtgctattgtcaacaccccagcctatgccattgaaacttaactgccattcacaaagcttcatttcattgtggggttttttgtttttgcatattttttgtatattttgtatattaatcaaatacgggggagtaaaacagatttatactattattaaaacattaaaactttttaggccttttaaaattaggaactcatccaacatttttagacattttaaatgactgtattaatttatgtacaaatatgtatgactttctgcatgtttgtataaatatgcacaaacttgtggtacatgtaagtcttatagtaaaagttggattgcttctcacctcctatcactcctggattagaattcagctttcttgtttgattaattcatttatcatgtatacatctgtttttgagtttccaaaattttgtggttctctctatgctttaaaattgatgcttttaaagaattctactatcgttctagaaattttcaaaaggaactgaaattccatgagtgttcagtccttgatgagtgttcaatcaatgacgtttccaccaaagtcctccaaaaggtttccaaagtgacttttcccccttactagaaccatattgttgtttatgggccatgttttaattagtaattaaagaaaattttcaccctcatgacaagatctaatttttgtcttttttcctcttacaagaagcatttaaactctcatggagggaaagccacttgaagacaccaggtggcagaggtcattcgttttgcagggtcagggctggtcttgagcacaggaagcatagctcaccctcttatgtgacttgacaagttctggaaaattcccttaccttctcatctacatcaggagcccaatacatctaacttccacacatggaagagataacaaaaccttgcaggttgcccagggatggccctttagtcctctgctattagttcagttagccacatcagactagtatgctttcttttgggtcacgaaggaataaaacagaggctaggtcaatgtcagagagacagagagggagtcagagaaactgaaaaatattgacaggcaggaggtggaaggagagagactacaataggcagactggttgagtggttgtatgtagagacaagagaaagcctgaattcaatccaatttttatctgtagtccctttagaagatgagccacagaacgaagtggggcttattcttcaaactttatcattctggatcacattttttgtgcttttagggtgagcctgcaaactgtaaaggaacaaagtacggcacagataaacctgtttcaaatttcagctttgccagtagtagcaaagtaacttccacttccttactgtaacaacacaggtaataacacttactttgaaggagttttaagaaatagaaatgatgtaagcaaatttgctggtattaagtgctcattaaatggtaagtgttgtcattagtgatggtggaaatggacacacgccacacccttaaccacatttatagaccctttgtccactgtctacactggtagggaggagaattttattgctgccattgtttagaattgctagtgcataatgataataaaaaacgaactgacttctagttgactttattattgcttttagattctctacagacatgccagataaaaaacagtacaccaagttaaattagaatttcagataagaaaaaattttttagtgtaagtgtgtaccatgcaatatttgagatacacttacatttaaaaaaaaaccctgaaagaaaagtattgggcctcctgaattttatttaataaatttgacaaccctaagagtaaggaagaaccattttgcttcctaagataatatcaacaggaaacactttcttaaattctctttggggcccaatagcactgactgactcaggcaagggccacactttcatcggagtggacagatacattgattcctgacagaacaagagccagcatggctgtaagaagccagaatcaaagaggatggtgacgaggcaaacttgcattaaaagctgctgaagagcagggacagaggaaccgtttcccctcccacagtaacacaaagttgaatatccattagattagcaaccagttcttagcattcctccctcctactcatagtcaactcttgatcaactgcagtaataggaagagaaaaggacatcacacataaccccaaatgaaaatgaaaacaaaactgatcaagggtaagatcaggtccagtggtggctcatgcctgtaatcctggcactatgggaggccaaggccggaggatcgcttgagcccaggaaatttgagactagcctaggcaacacagtgagaccctgtctgtacaaaaaatacaatttacaaaattagctgggcgtggtggtatacatctgtagtcccagctgcttaggaggctgaggtaggaggattgctggagctcagaatattgaggtttcagtgagccatgattgtgctgttactctcaagcctgggcaatagagcaagaacctatctcaaaaaaaaaaaaaaaaaaaaaaaaaaaaaaaaagaatgagatcaagcggtaagtaatgacatgtggccttgtttctgctaagtcagacctgccctcccctacgttactagagatcctgactcctgcaggcaggacccagtaatatcatttcaccaacaaccgtgttgctagtacaatcaatatcctttcttcttaaagtaccttttacacaacttatgctctgtaaaaatattactaagtagacaatgaaagggaaaagaaagcaagccaatgtttcatgctttaagttaggaaatgctgttttaaacagcattaaacttttttttaactacagaacttcccagaggctttaataagctcatgtgctttgaatccctaggatatgattttcgtacagagcatgtccaggtttatttgatcatagactctttcagagaacaacagttccagttcacatttcaggtaatatttttaggtgctactatttgacgaatcctacatctatagtttcagcaatgctgcacgcgcatgtgtgtgtttgtgtatgtgtgtgtgtctgtctctggtattaactggtgcaatcagaaagaagagtccactccttggtgtattagtttctgattgctactataataaattagcacaaacttaggaggcttaaaacaccagaaatatatcaccttttagttctatatgttagaagtctgacatgggactcacaggctaaactcaaggtgctgacagggctgtactcccttttagaggctctagggagaatctgttccttgccttttccacttctagaggcttcccacattccttggctcacggcccacttcctccatcttcaaagccagcgacattacatctctctgatcattcttacgtcgttatatctccctctgatcatagccagggaaagtcctcagcgtttaaagactgactttaaagattcatgtgattagattaggcccacttggacggtccaggataatctccccatgtcaacatcagcaaagtccctttttgccatgtaaggcaacatgttcacagattctagggattagggtttggacatccttggggggcattattctgcctaccacatatgggtgggtaagaacaccctgagagttccagccagcaaggacaaagagggagaatgaaagtaactattgccattgtttgtgttttctcaattattgcttacaacttcacagtatcagggaaattgaaattattgtcttgttaagggatgtagaacaataaacaaaatatggaacatgttcccaagcaccaagaacttggttctctctttacaatgtagagaagcaagcacaagtgctctgtgaattagatactccacaaacatagccagctggcctctcagcaacaccggctgattatacaggctgtgcactttccagtgaaaggtacatgcccttaatcagctttattgaagctgccctcactaagaaactgtgcagacattatttcctatgatgcaggtcctataactgtcccattttacaggtgagaaagtgaatactttctacgattatgctacttgacaagctgttactttcactgaaccagtaaaacatacacatctgaactcaaagcctgatcttagtcctatgtaatgtgcctatttgtatgtctatttgacaatccatctacctggacttcttcccctttccaattccaacccaaagcaagttccttcctgtgactctatctgatctgacagtctacatgtgtggttttgggagtgtgtgcacacgtgtgcatgcttgtgtatatatgttcagtaactctaatttttttcttcatgaggcttcacattttgaatgccaaaactttctgtctgatctccaatcagatgtggtgacttctgggtcacaggcgtgatatgtattgaacacatgccttagaagtcgtatctagtttcaaaacttgactagatcatcacctctgaaacactggcaaattacttgagcaccacaaacttcagctttcttatcttgtgagaagtcaaaaatagtatctgcctcacaaggtcactgcagaattaaaagaggtgatatagataaagcacttgatagataataatgacacaataagttgcagttgatactattatcaattccatgctacgtttacctgcataaaaatgccattcaaagttcttgcctctctgaaagatgcttaatgacaacttctacttaaatcagtgacattagtatgaccaataaccataggttaattcacattaggttaaggtgtgttaatactatttttttttttttttaaaagactctgcctgcctggagatctagggcctgatacttcttgaaatttgctaatcacatctggtttagctttagacattttctgggattttgccagcagctacgacactttaatggctacaataaacctcaaagcctcatcaaatctttgctgtatgtgtgaaaattatgtcctcttcaattaaacattcaatctcagctcacaccaaggccttatggaaaaggaggtgaaacctgaatggaaacgttaagatgaaacggaccgccacgattctggccatcttgccagatggtatttagaagaaaaagaaattcattagagaacctacggtgtgtattttctttaaatatttactgggtacctttcatgtgttgaaaacactggcatctctaaagattagcagggcatttttgtttaaatattccatgtgtgtgaggtggggggagtcatttcctcatttgcctttgtggtacttcatgtgttttggtgaagcctggtacaaagaagaaaagtaactgagacaatgttcagttttctttcctaaggccgctctacctgcttcaaaagctcttgtattttcctaaaatcggctgaggaaagtgtcagttgagtactgagagatccggaacgacaattcagagcctccctagacaaaagaaggtgtaccaaagtgaggcgctatgggggaacccttgtctctctgctcgcctcccagttcactcctcttatcctcttgctatttatcatcaaacgtacagggacgtcaaagtgaggcagcccctggaaggagaagggaaaagatcaaacagggatcaggtttcggctcaaagactataggagaggtcaggccaagggtttcacaaggggccaagagacaagagggaatgggcattcaggaacagccgtggagcaaacaagctcccctgccattgctaactcttgctgccacactgaggaccagcctgggccctaattctaccagtggagagggacagacaaaaatgctagctggtagcttactacgctttattacaatattaatcaagctcctcaacttcaacaaggatacaaccgccaattcttcaggagacagaaaataacgaccgcaagttcacatatcgcatttctaaaggaagcatccatttgtttgaattcattcaaccacatcaatgggagaaaaaaaacccacgttcctttaaaaataatatacaagataaaaatattcacctgtaaccattatcctttccatgtaagttttatgcccaaagtaaaaataaatggctctctttgccaccgggagcagatctttcccactttacttccatttccaagctgttctcagcctcagacttaggtttctgagtactctttcacaataaacattttaaaaatgtttactttatgtcttggtcttaaaatattcctggttgaagcccttcatttcctcaagctctgcttctggcactctgggctccatttccacattaacacgctctctaaatcctccgcagagctcttcaattggagttatacaagctccaaggcaagtatttatattcttggacaaggagatgtctccacagtaaaaacacgagactctagaaatgccaaaggaaaattcctgcccaagtgagacatattttcaccttttaaaaaagccaaaaaggggctttcagcattttcttttgactaattaaaaatgtaaattaaactaaaatggaatgtttactgtgggccttaccatcattattagactcatatataaaccaaacatacaggaacatgtgtgtatgtgtacgatatgtatgatatacatatatatttaaagcagcagagtaaactagctaatgtgtaagttctagaaactagaaactagaaaatgtgagttctaattagacagacttgattagacttgattagagctcagtaaatctgtctattactggctgtgtgaacttaacttctctaagcctcatttttctcatctgtaaaatgggtttagtgtagttccagcttattaagattgttatatgagacaacagtaagcatctagtaaatggttactgctattatcattaataatgttataactactaaatgttagaaaatgtagatataacgagatatggatataagaaacaaatgatcaacactaataaaagagaagaatttgaaaatacagtgcctctacacactgtgtagagaaggaaagtttcctgaaagctgtagtgtaccattgctgaactctgcaccaatcccactctatgaaccagacctaaataatcctcttaaaacattttttaaaagtaatcttagctattatcataatagcagaacagttcctattaccttctagttgcctcttcagttttctcaaatcttttatgaggtcttcaaacttgacttgggaggccagaaagaaatcctgtggttccggcaaggggaaaacactcttttctgttccagcttcctaagagatatggtaaacaaaagtacattatacttcccaattgtcactttcagttgaaattccaaagcatcaatgagaaaaaaaaaagcttttttattggatgtctgagtaagaatcatagcaatgctcctctgctattcctaaatttggacttgtgactttgaagtgctttcttgtctttcacaatctctttttggacttattggcaatgaggtcggctatggcatgggccaggttctattttgcctcatgaatcaaagagaaaattgtcaggtcgtcctgatcttggacactccactcccatgaaaaatggaagaggggaacacatgaaagtacttacatttgaagtccccatttgatttacacatgctagcaattagacaagtcatctttggggcataccaatgggtgtgaatcagaaggtgctggataagaaggcactgcaatggaagatacaatcaccctcccatcacctttcctcacctttctctgtggcttaaagctcttctgtgtgcatgcatgatcagattctttgtatatgggtgtatctacacatatacacaggttttttttttttttttttggagatagggccttgctttgtcacccaggcttgagtgcactgacacaatcacggttcactgcagccttgaccttccaggtccaagcgatccttctagttcagcctattagctgggaccacaggtacgtgccaccatacccagctaatttttaattttttgtagagacgggggtctcaccatgttgcctaggctggtctctaactcctgggctcaagcgatcctccagccttggcttccccaaaattcttcatatatttgaaaagcttttgcaaatgttgtctggcttatcttaggagaccgagggcagggtgaagtatagttttaacaagctccactgctatagctaatggagaattctcagctgagaaacatcttgaaggacaaaagcttcaggcacatgagcctcaaatatcttttccagtctagctagctttctccctgagttgtttaacgtaagctttgtatcttgcatgtcttaggccgtcttcaattattcctctctctgcacaggctactttgccagctttccttcacattccatcttccctactgccattaggactaattccaaactctaaaactgctttacaaggcactttatgatctggcctctgtctacatctctggcctcatttttaccttccccctatctccaactccctctagaccttcatgaaataacagaccacaatctcttgcttctaggcctttgtctataaaatggtccctttccgacccttccctagtgcctccttacacttccttgttcatactcatcctttaagtcttaaaacaaacgtccttccttaaagatttcccctaacctccagcacgtgggtgtttctcccctgttctccaaaggcctatgacgcttacattatcacagcatttatcaccattaatttttttcccataagttattggggtagaggtggtatttggttacatgagtaagttctttagtggtgatttgtgaaattttggttcccctatcgcccaagaaatatacactgcaccctctttgtagtattttatccctcatccccctcccactcttatccccaagttcccacagtccattgtatcattcctatgcctttgcatcctcatagcttagctaccacatatcagtgagaacatacgatgtttggttttccattcctgagttactccacttagaataatattctccaatctcatccgggtcgccgaaaatgctgttaattcattcctttttatggctgagtagtattcgattgtatatatatatatcagtttctttaatcactctttgactgatgggcatttgggttggttccatgattttgcaattgtgaactgtgctgctataaacatgcacgtgcaagtatctttttcatataatgacttcttttcctctggatagatacccagtagtgggattgctagatcaaatgacagctctactttcagttctttaaggagtctccacactgttttccatactgactgtacaagtttacattcccacctgcagtgtagaactgttccctgatcatggcatccatgccaacatctgttttctgattttttgattatggccattcttgcaggaataaggcagtatcgcattgtggttttgatttgcatttccctgatcattagtgatgttgagcattttttcatgtttgttggccatttgtatatcttcttttgggaactgtccattcatgtacttcgccgactttttgatgagattgttcttttcttactgatttgagttcactgtagattctggatactagtcctttgtcagatgtatagattgtaaagattttcttctactcttaggttgccccttttgaggtaccaaagctctttggtttaactaagtcccaactacttatctttgtttttattgcatttgcttgtgggttcttggtcatgaaatccttgcctaagccaacatctagaagggtttttccaatgttatcttctagaatttttatagtttgaagtcttagatttaagtccttaatccattgagttgatttttgtgtaaggtgagagatgaggatccagtttcattctcctacatgtggctagccaattatcccagcaccatttgttgaaaagggtgtccttttcccactttatatttttgtttgctttgttgaagatcagttggctgtaagtatttgggtttatttctgggttttctgttctgttccattggtctatgtgcctatttttataccagtaccacgttgttttggtgactgactatggccttatagtatagtttgaaatcaggtagtgtgatgcctccaaatttctcttctgcttagtcttggctcccgccacgtgggttcttttatggttccgtatgagttttagagttctttttcttgagacggagtctcgctctgtcgcccaggctggagtgcagtgatgcgatgttggctcattgcaggctctacctcccgggttcacgccattctcctgcctcagcctcccaagcagctgggaccacaggcacccgccaccacgcccagctaatttatttttagtagagacggggtttcaccatgttagccaggatggtctcaatcgcctgacctcttgatctgcctcggcattccaactgggattacaggcgtgagccaccgtgtccagcctagagttgtttttttctaattctgttaagaatgatggtggtattttgatggagactgcactgaatttgtagattgctttgggcagtatggtcattttcacaatattaattctaccttttcacaatattgatactacccatccatgagcatgggataggtttccatttgtttgtgttgtctacggtttctttcagcaatattttgtagttttccttgtggaggtcttttgactccttaggtatattactatacacacatatatatatatgtatatatttgcagctattgtaaaagaggttgagttcttgatttgattctctgcttggtcactgtcggtgtacagaagagctactaatttgtgtacattaatcttgtatcctgaaactttgctaattattttatcagttataggcgctttctggaggagtctttagggttttcaaggtaaacaatcatatcatcagcaaacagtgacagtttgaactcctctttactgatttggatgcccttcctttctttctcttgtctgattgctctggctaggacttccagtactatgttgaagaggagtggcgagagtgggcatccttgtcttgttccagttctcagagggaatgccttcaacttttccccattcaatattatgttggctgggggtttgtcatagatggcttttattacattgagatatgtcccctgtatgcaaattttgctgagagttttaatcataaaggaatgctggattttgttgaattctttttctgcatctattgatatgatcatgtgatttctgttcttaattctgtttatgtggtgttatcacatttattaacttgcgtatgttaaaaccatccctgcatccctggtatgaaacccacttgatcctggtggattatctttttgatatgttgttggatgcagttagctagtattttgttaaggattttaccatctatgttcaacaaggatatcggtctgtagttttcgtttttggttatgtcctttcctgattttggtattagggtgacgcttgcttcataaaataaattagggaggcttccctctttctctatcttgtggaatagtgtcaaaaggattgttatcaattctcctttgaatgtctggtagaattctgctgtaaatccatctggtcctggacctttttttttgttggtaattttaaaattatcatttaattcttgctgcttgttactggtctgttcacggtatctaattcttcctgatttaagctaggaggattgtatttttccagcaatttatccatctcttctaggttttctagtttatgtatcaccattaatttttaaattgccatgttatcttgtacatcttccccactagactctaaacacctcagaggcagaaactgtgtcttgttcttggtatggtaaacaacatctggcatatcaataagctttatttttggttgatgggcactactacagagggcttgtaaaacatggttctgagatgtatgtacctttagcaggagacatctaatttatcactatgttttcttgtagtttcaggaatcctcttgacccttcctctttaaggccattagctttgttagggatactaggatacagtagttttcttcattttatcagacacaatgtacttttttcccccatcttcatatacttattttactactttaaaatggaagcagtactctcatctgagtgccaagatggaacaacatctaagatcctcactacaaagctccatgctaatctatgctggaagaactcaggcatagtatctctttccattttccaaaactttatcagattcagtcctggttttgattgcgtgtgtgtgtgtgcgcgctcgtgcgcgcgctagaaaaaaggaaatgttgctgagtgtatcaggctggtagcagctcttatgaaagctgcttaattagagttaaaaaggcatgactctacatgggtttctttaaatttcacagaccaagacttggaccaaaaaccaggcatgagaataaggaagcagggagcaggagtcatctttctttagctaattgctcatcaccactaaccaaaaaagtcatcacttaggctcctagaggaaagggccagtttcataaatcacataattctaccctcttgttgagtgaaatgcattttgcacagtaaaagccagaagagcaccacactactgtgggcttatttttcctagactgggccatcccatgtttgaaactgttctcattgtaagattttcctctgtgaagttgattccactgggttcagctcttttcaaccacaactatattccacaggcatatttcagccttcccacacaatgcatttgacttggttggggtaggtactaccaataaatctgcccatgccaacctagggttagaaatgtcaccctcaaagattcttcaggataattcttctgccacactagtacctgctgtcaaaacctagggtatgtgcttatgtgcccgctgctgcttcttaatttcctgaagctaaacatgccttcctcactccaccagaaaacagctctcatctcctcatatctagttctttacagatgccacttattacacgtttgtgaatattaacattatatccagttcagcaagttttatcagacacctgtattacaggcagtaaaaaagagacaatggccaggtatggtggctcatgcctgtaatctcagcactttgggaggccaaggcgggtggatcacttgaggtcaggagttcgagaccagcctggccaacatagtgaaaccccgtttctgctaaaaatacaaaaaaaattaggtgtggtggtgcacacctgtagtcccagctacttggaaggctgaggcacgagaattgcttgaacctgggtggcggaggttgcagtgagccaagattgcaccactgcactgcagcctgggtgacagagcgagactccatctcaattaaaaaaaaaaaaaaagagagacaacaatgaattctgaacctcaaaaaccaatgccaagataataggtaattcctcatatatacatacaaggcagaataagatgcatcttgagaaagattcaaacaaagtacttctcaggcttcaaagccttccttcaaagatcaggatgttaataacgacctcaaaaaagggccatgtaagattagactaagttatttttcactacatcttttttcctgtttacaaaagtgatacatgttcattatgtttagtaatggaaagagagaagacagttaaaaaaaaaaaaacgcttacaatcctaatattcagaaacattttaatgtatttttttcaggttattctgtgtatttatatttatctactacatatttggtattatactatatgttattttgaaacactgcttgtaaattaaaagcagatcaaaattattttctaataccactatattctctcctatacactctccataagagtatattattccagtgtgtgactctagtataatttatttgaccttggtctccatcattgtacacctaccaaaatttttccaatattttgctatcataagctattataagtaaatagtcattaaatccttagttgttttcttagggtagaaatttcttaaaaggttacacgtatttctagggctgttgatacagaaaggttgaaaaccttgcttatgatcctgagattcatgagtgtgatggattgggtgttcgtatgcatgtgtgagatgcgccaccattgaaccttgttaagatatggacacattacctgtctgacatgaagaaaaaaggaaaaaatgaaaaaatgtgggaaaaaagggaaacaaaaagaggaaggaaaaaaaaaaacaaaaacacaaccttgcttgcccataaagcatacatgtataaattaggaaaatgtgttcctgtaggtaggaacagctttatgggcaaacagcttgacaagcacatggcatctttatgtgaattttttaaagtgtgccctttataggatgtataatttggtgaatcaacggcaggctaaatatgagtcccatttgacttagagaccttaaacagagaatatattgatttaccatacatgacagtcctgagaaaggtttgatcaatttacagtgctaattctatatatctagttggcaatttatgtcttctatatgtcttttgtaaattgcctgtgatatattttgccattttttaaaaataaggaagaaagttttttttcttgttaattctcgagttcattgtctattatgttgtaaacattttaccagtacattattttgaatttagttttaagtcatttttgagatactacagtattttaaaattttaattaggaattgaagttttttagttttatgcattgaaagtcatcattctcaccttttatggtttgtgtcttagactgaacacttcgaaaggattttgctacttcaaaatcagtaaactatttacctacacttttgtcatgtcttattgattttatttttcatttatttctacatttatctcttctgttctttaaaactttgctctggtctctggtatgagatctaggagataattcaatttcttcctcttaccaattacttgaaatttctcttttatcacatacttgacacatatttatttagatccatttctgagatttccttttcatgttcttaagttttgtgatgttagtctatcattctacacttttaattattatagctctataatatattagaatatataaatgaatgattctctcttcatttttaaatcctggtcaaatttttgtctaattatttttatacataatatttaaaattattttgtaaacttctaagattgattagaattttgactggtacttccaacagaggacataatgccactccttactgtggtaaaaaacaaacaaaaaaaaccccctataacatgatatctgttctcttaaatttttaagtgtacagtatagtattgttagccatgtgtattattgtacagatctctagaacttcttcatcttacgtgactgaaacgccgtatcctcaattctccatttccccattcccgcatcattcattctactttctgttcctttcagtttgactactttagatacttatttaagtggaatcatgcagtatttgcccttctgtgactggattatattgacttagcataataccttcaaggctgaccccatgttgcagcatacgacagaatttatttcttctttatggttgaataatattccctagtacatatacgcattttctttacctattcatctattgacagacatttagatttgtttccaaatcttagcgattgtgaacaatgtttcaatgaatatgagagggaaaatgtctctttgagatcctggtttcaattcttttggataaatacccagaagtgagattgtctgatcatatggtagttctatttttaattttttgaagaaactccctactgttttccatagcagctccaccattttatattcccactgatggtgctaactggttccattttttctacatccttgtcaacacttgctattttccatgtggtagggttttggttttagtttttattaacagccatcctaaaaggcatgatgggctatctcactgtggttttgatttgcatttccctggatgattagtgatgttggcacctgttggctatttgtttgtcttatttggagaaatgtctattcaagcccattacccaatttttaaaattgggtttttcttttcttcagtctgtttttaaatttttatggctttcagtaaaattacgtgaatgtattcacaaaggtctgtacttgtctggttaagtctgtaacacatatattggtaatgttactgggagactttttcccaaaaaatctttaaatttattatttccagagaggagtaatgagaaaaaaaggaagttttataaaaaggctagagacaaagatactttcagtgagggagaacatcagaagtaaaaacacattagtaagaaagcacagggtgtgtgtggaaaacatcaggtcttgagttggatcacagaatacgtgtagagggaaagtaataaaagcaaggttgtaaaagattggaattaaattcgtagagtcctaattcacttgaaaatggggagccacttctgttttgagtagaaaagcaataggatcagagctgtgtaaagagggtgtgggatggcttagagtggtagaacctcgaaatagagagctgagctggaaagcaagtgaaattctccaagtgagtggtcttaaaacctgggtaagctggggtcggcaggaaaacaaaacaaaaaacaaaacagggaaggacatcagaaacaactcagtggaaggacagagagtagccagagaaggacaaggtttcatgccttaatagccaaaaactatcaaaaactacgatattcttaacagaaatcagggaaaagtttggggggcggggaaacgatgagcctggctgtaggtatattgaaaatagttagataagcccaccaggagggtagaagaaagtattatggagttcatcagtgcctcacttgtcttctggatgaaactgcaggcctattgaaaggccctgagatctctactattcttccctcgatgcttaggaacaattatgcttacatggatggttaagcagaagtcctgacagcatttactttgagacttttactattcatatcgattgctatatttcttaacatcttacaacaatacctttttcttctcaaaattacaactccttgttctcaatttaacaagaaggaataaaatagaaaattctgctcagatggactcacacagaaatgtttatttctaattgcaaatgccctctaagcagaaaagatggatttttcaaattctacatcttcagtctgttcatagattcattactgataaaatattgggtattactgagtcttactttcctaaattttgctttgcatcatcagaatacagtttcaattataaccaattactgagcggatctagatttcacagagaacctcacaatctggccataaagcactgaggcagctaggggtctctctgaagctgtgttatagtcgattgagactcagtagatttacaccactgaataatgcttctcttcataagtcaactaaactctcttggtttcagtgtgctcatctgtaaaccacgctggagagctctcatattctatgttgggcttgcagttcgttcatccatctatccatcatccaacttatgaatgtcaacaatgagtaagaggtgaaacttttccacgtaataccatttcttacctgatcatagtaacgcaggtaatacttaacaacgtagtccaccagattaatcccattatcctaggtttaaaagagaaatgtacatgaaaatcattcccatgagactgtcatgttacacggttgagaggtgaaatctcagttgagaaatttctaattcgtgaaaactggctttctcttcgatgctggcaaggttttccttcctctgctttatcccatccatttattatgctggctacataaagaaatgacactgtactatcctttgtggggaaaaacaaacagataatccataaaacttctgaaataatggctaaaacaaacaaaaaagttgtgtccttgtattttctggcacacagccaagacaggaggtgcggggaatgctaaagggaaccagggcctagaacagaaaagcaccctccctgcccgtctttcaaaaaatgtgcgttcttaatggtgtgaaaaacaatccaggccagcttaaaaggagcaccacaccactttatgaccccgggaggccagtggggagcaggccctcccacaaggcagcctttgtgtcctgctcactggggcctaattctaatttgcctgtgtgtttcccctccctgcacccccctgccccccatgggacgcctagctatgggctgattgtttctaaagaggtagcgccacaggggtgtggagccaagtgataatcaggctcagagagcttgacagtagaccccagcccaattgttgtggcaaaaaattggtgattcaacattgctctgccattcaggaatgagtaaactactagtagccaacactaaactcaaacagcctccagcctttgcaggatcctggtactgtatgctatctgttttgttctctcactgagtagcagttcaatacctgattgtgtatgtcagagcacacgaagatgggaattgagtaattgaaaataaagtctaacgtgaaaaaaaaaaaccaaacaaaactctttattcgaaagtgaaaagaaagcaaacaaaaaaatgcatgctctaatataaatgttgttaaggggaggatagagataaatggaacaatctggaatacgttttttaaaattaaaggtaaagaaagaaaataatggcagatcatgggaacttattatgaaaaataaatacccgacttttgacatccttgagtttgggcagaatttctaagctatatccatcggcttgtccccgagtcctatttcctccattcatataatttccaaaagccaagatgagagctaaaatatccttcacgctcttcacgtgcagcaagtcctgtgatggcaaacaccagttattacggagctgaactccaaatgcacccatgttcattcagtaacaaatatcgactgtgtactcaataggctgtcgggaggcttggtaccaacagaattaacagttgctgaaatgaaaaacacactttactaagccatgagtgtctttacaaacacattaacagccattattttctacccactcaaattaattataaacagtgcatgttttaatacatgaggattaactattggttttatattttcatttgagccagtttaatttttaatacttattttaaagtagaagttgtaaaaagggagttggtatatatagtaaggcttaacctttgatgacttctaggtagaaaggggtttaccttttgaggatgtatttcaggactatttatctagataaccaatacagttaaatgcagagcagatacagaagaagtatgttcttctttatccccggatataattttcagagctaaactacaataatgcattttaaggctgtaggccatctttaataaatttattaaacttactttattaagtgcttgttgtattgtctattaacttttacaatttcaagctgcttaggattttctttgtctccctgtctcatttgtttgtccttttatttattttttacttcaagtacaattttccaattgaaattttttttctttatggtcttaattcacattttatccccctttatttcagggtaaaaaaagtaatggctgggcacggtggctcacgcctgtaatcccagcacgttgggaggccgaggcaggtggattgcctgaggtctggagttcaagaccagcctggccaacatggtaaaaccccatctctactaaaaatacaaaaactagctgggcgtgatggcaggcacctgtaatcccagctacctgggaggctgaggcaggagaatcgcttgagcccttgaggcagaggttgcaatgagccgagatcacgctactgcactccagcctgggcaagaagaatgagactccgtctcaaaaaaaaagaaagaaagaaagaaagaaaaaaaattcagctccaggcagacttctttttctgctcctgcctttcaggtattattagtgcgtgtataattatatttcagtaatatttattctctactgaaatatctcatatcttagaggaaaaaaaatcatttctccaaataaggaacaaagtactacagtatttgtggagaagaataacgtgtccttaagagcatgggtcaactgtgagaaaaaggcaggtgctagaatttaaccttataatgaacaccagtgtagtaaagccaacaaatatttctttgccaatgactcactgtcagtcatttatttcacttatcaagtctctaggatcctcttattaggttgacacatttcagatgatcaaatgtatggatctcaagcaaaatctcttctgcaatccaaattgtaaaataagaaacagaccatgctatttagattggtttttagtggccagtatgtactttggaagatactcagaattttttagaaggaatctgtaaaagtgtcatttttttccctccttctccctcttcatccatctgcatctccttttctctccctctctctcatacacacacacacgggcaagataatcatcaaatttacacttagaaaaacatacaatctgagtccaaaaaggtttctataatggcattaaagtggtctctcccactttcttctttactcttcagagcaaggctatcttttaaattagacagtaaacataccttagaagctcgcgtgatgatctctacctttctgtgcaaggaggtgataccctcagaaaagacagatctgaagattatgcactgggcacgttcagcaaaattaggaatctgggctaactcatgtaaaaatctgtaaaaaagaaaatgtgtcatctaccttcacatataatcacaaggaaaataaaaagacagctgaaaaagacccactttgggaacattccttacctaacaatctcaacaattataaaaggtgtcacataggtagactcaaggaattccaagggcatggtttccattgttgacaacagggctgttttttaaaggagttctagcatgatgaataaatgcatggtatagaaattccttcgggaacagaaagttaacacaagtatactaaacaagttatctatctcctgctgcccaaacaagagactaaacccaaatggaaagccccagtctttaacacacgagaaaaattatgcaataaactccctcataatgcagcattctctaaaggtgtatttatacaggctaagcaaactgaagacttgaggcaaatgtctacagacaagtgatttaaaaaaaaatctcttactaaagtgatattgctactatttttgctcagtgagttacataatggtctataatgatcacattctccagatatttgtttactttttcacattaacttacacacatagacatagtttacaactcagtatttagaacaaagcaggcactcattaagtagacaacctaaagtttccttaaaaatgtggcaagacagatcttaaaagctaaaggtgagtactgacctacacacagtagctcactgtctgagtggttgggcacttgttccctttgcaaaactaagttggaaagagcgacatactctccaggccaaccaccagaggaaggggtataaatgaaaatgggtggaaacagttggacatgaattcagaaaaggagaaaatctactaacagccatttatttcattttggtgttgagatgatgattaactgatatttctgaaagtcttggtcaactcataacgtcattaccaaggaattttgccatctctcaccaaaaatggttttacataggaacaaagctgaagcctacttctttctataccgaaagatattttctttgcttatacaccctgtgctgcctctacctttagggagatttgggttttaattaatttctaacatcaattgatttcgtatttattccacgactaggtcataatccacaatctttttttagatgacatttaatgaaagcaaggaatatccataagagaaaacacaatcttgttttaaagttcaataacccattattatgaaaattatctgatgaagtataaaagtagaaattcataggaattctgcattaggacaagatgaaaaagttaaactctgtgtaaattacttcttaatgaatattaaacaatttattcatttatcatgactgaaatcaggggtatcatcagtctttataaatacataagaagcaaaaagctcacaagactgacagcatttgatcctgtaatgagtctggggaagacgtatttattcagatgctgagctattctgaaagaagggccctgcatttctccccttctaaatgtgacccatgaggcgtcattcaggacccaagttcccagagcatgtacacttcctatcacagtgagcgaagcagttacagacaccacctgggaaaatatacagatcaatgcctcggctcaccaaaaaggacttagatgaaaagcagaaaatgctgaatgaatagttacctataactaatctcaaaagaggaagcataggaccaatatgaggcgacaagaccatagtcttatcaatgtatgttacgcaagaaagggtaggatagaattgcaaggctctctaggattaaagcctttctggggttagggcttgcactggaaaagctcttaaagaatcttaaatgttccaatgtcctctttaagcagaagggtctgcaacccatacgaagagttggaggggggagaaaagatcataattttacattacttttggaaagacttgaaaattcatactagaagatcagtcaccaagaatgtcagtctgtcctttaggaatgtatgaggcatttacagtgtgtcagggaccatgcgaagatctgagaacagagcttaatctacagtcccatcttgataatctgagaagtaaaccaacaattactgtggagtgtgaatgagtgctctcggtgatggatccagaagaggagctaggaaagcaaatgcaggacactcaagtgtcatggggggaacattgtcagctagggtccccggagccctgtgatgctcacgcacaacatgtgagaaactgccgggagagcccagataggctgaatggtatctgtgggggaagtgagtagaaggcagatgctaaaattgtgttctgtattctaaaatacagggtttaaacttctgaacgaatgaagggttctaaacaggaaggtgacagtttctgctttttgttgtagaaaatctccatggcagcagctcagctgattggatgggagaggaaatttgaggctgggagacctcctagaccacagctgtaatcttccaagaggaaaggtaagaggggcttgcagtgtgaatggagaggggcaaatggatgaggaagctgctaaggtaacaagacccagagcaacctactcctaagagatgttgtgaagagtccaggatgactttgcagttttggcgtggatattgggtatagcgaaaatacaaaataataaagaagcaaatttggaggaaaaaaatagagttttatgacccttgccatccaaaaacagccatgcaaggagcaccatagctcctctcttatttatctgctaagctaccagaggtatgggttactttgaaggctgtgaagcaagcatctgacaaatagcttctcttcccctgccctgccccattactgttttatcctctacccacaagagcaaacacagtaactctcttaaatattcccaagcatgggatcttggacactgggccttggtacttctgaatatttatggattgagttccttttgggctagtctaactttacattctaggttcagtaagaaagaagactaaatattcccaaaagaagccacaaatgagggatccttcccttctttctccaatgtaggctaatacttctaggaaggactgcaacttcagcttctaatatatgaaagacgttctgtgtctcacattatttgggttacacatctacagcagcaactcagctgacgggtggaatgaagcaatgtggctcatgtttttaagagactaacatttgatttattatccctaaatttctgaatggtatcacctaaggtgtatgtgcacataggcgatacacatagcataactgaatgttgcaacctgcattcttcgatggaggattacactaacagagtctactgtgtgggggccccaaggcagctgtggaccttcatgaaaatcacaatagactgtgtatagtgttctcaccctaggccatgagaagtgtgtaccaggcctaatcaaacccagtagagcctcacctcacaaccattacccggcagcataagagtcaacggccatccctagagggagtggttctcagacagcctggtcccaaacagatgacacctctgtgggcaatggctttctaaatctggcactggagtgtaagagagttgatgaggtgagtgatgaggccagcctctccatgctctgatttataggactgggcaccacagggctcttaggaaactgcaacgttaaaactataaatgattcatattttccagtatgtaaaacatgcttatagtcgactcacttggagttaatggcaaataagttgccagagaatcagagtggcataaatcaaacaaatgctggtttgtgcaggaggttggtagcaaaggtgaaatgcacccaggtctgaaggcccccatctatccgtgcctcaccctcccgcaactgagcccaggcaagtcacctcaccagcacagcatgacagtcctttttgctgggtttgcgtgttcacgaagccattacaatgaccatttataaacattaaaaatgcttttctatctagatcatcagtagagaaaacaagagtaagttgtgtgttaattacctgctaccattatctaagtcccggcaattagaacaataattaggacagtagcagaaacgcatgatctctccctgcctgttcatttcaccggatcagccattcccatagcttagaacaagggctgctcggtggttaaggggttggcaaattgcagcccacaggccaaaaccaggccaccacttgtttttgtatggcccatgaattaaaagaacgatgtttacgtttctaaattgttgaaaaaagagtcaacagaaggacaacattttatgacatgtaaaaatgacatgaaattcaaatttcagtgttcataagtaaaatgtcattggggcacagcgatacccatttgtttatatactgcctgtggttgctttggcacagcaatggctgacttgaatatttgtaacatcccgtaagccacaaagcctaaaagacttactatctagtcctttacaggaaaggtttgccaactccaggcttagaggagaatattactgtgtaacttggtataaccagcactacccaagtgctttgatatgcccactgtgccccaatacaaccaaatggccttttcagtgttgaaacagcccattattaatcactttactttcagtcattagcaccgtaagagggattcatttgttataataggaaatatgacttggaaataaactataggatcagttgagggtagggattggtaaggaaggtgtctcaagtcagtggaacaagacagcaagggaacctcacttgacttgattcacaatattcctaggctttagaaacctactttgaggggggatcctggaccatgctccatgtgagagcaagtcatccaaggttcccagaaccatcatgtaggtttgtcgtcaactgagtaaacccagaattctcttcccaactcccatcctcagccatttaagatgttttcctgagtctaaatgtccaggcatccatggggactgaggtattctagagcagctgtgcccaacctttttagcacagggaccggtttcgaggaagacaatttttccacaggccaggggttggggttggaggtgggatggtttcaagatgattcaagcacattacatttattgtgcactttatttccattattattacattgtaacatacaatgatataattatacaactcaccataatctaggattagtgggagccctgatggtccctctagcttcctgcaactagatggtcccatctgggggtgatgggagacagtgacagataatcattagattctcataaggagcgtgcaacctggatcgctcacatgcgcagttcacaatagggtttgtgctcctatgagaatctgatgctgctgctgatctgacaggaggcggagctcaggtggtaatgccggcttgtctctcactcacctcctgctgtgtggcctggttcctaacaggccatgggctggtaccagtctgtggcccaggggttggggacccgtttctagaggacccaagggacaaggcatggaactccagtgcaagccggagaaccttggaagtttctagggctgactggtaaccctgatctgatagctccatttctgcttcattttctacacttgcctcatctctagattgagagggttggcctgaactggacaaaaaaaattcaaggtagcaacaggcaaaagaggccctctgaacctgtgtcagaggacacaggtcctctgaacccattttacagtctcacagagtcctaagccctggaaagctgggcagggtcgtggggctgcagagccccgggagcttatctatggcttcgagaccccaagagtcactcagttacaccccggagttctgggtcttcaaagcctatggaacggcatcacaaacaacagagcaagcagccatagatagtgactggagagaaaaacaagcatgtacagagtgagggtgagaaaaagccacatttgggcagagcaggtggagaagtttggggaaaagctagcacattcaggctgcacttactggatatgacctttaggaaaataaacttgaattctgtgactctgatatcatctttttaacttcatcaagagaaccttaaacagaacaatgccttcttccttcctcagttacccttttggtcaaattgtttagtctaggaggaattaacaagttgctagaaaaagaaaggggagtctcttggggtgggggaggggggtgagacacactgtatccaacagcacaaatctcagcgctgcttttcccggcagcagggtcatcctgctgcatgcaacaggtcacaggaatgacggtgttgtgatttagctggctgcacatttagatttggttattctgagctgggagacaagaagacagaaattgcagttctccttttggcctaacagaaaaatgttaagtatccttactgctcaggtttatccagcagcttcagttcttcttctttggatgtctcgtaatactttcttattttaaccagctcatcctcttgggctctctgtatcaaaatagaaaacaaaaccaaaaaaaaaaaaaaaaaaaagggaagtgagactctggctatggcagtgggtctcaaagtctcgaagtgtggttcctagactagcagcatcaacaacatcacctgtcacttgtcagaaatgcaaattattggcccaccctagacacaagaacttggggtgtgggtgggggtggggggatgcaagcccactgggtgattctgatgcatgctcaagtttgagattcaatgcaaatggacctaacaagtacacgcagctggacacagaagtacagctatttgagctctacttttgaatcccccatctcttcctctgtaaggaggctgggggaatattgttcttagaatttgtttccttactcttagaacagccctaaattatatgaactcgcagctctttcatttctagtcaacaacgtccctttttccaaatttcgtaagcactcattgtctgtaccacttattttggcattgagtcacttactttctcaatttatccaactatttcagttgaatgaagcttatctctactgtgagctaacaagcggcaaccatgtgcttagtcctgagctcatggtaacaacacaaagcatctggaaggtactgcctttgacaaagttctttaacatgaaccactgtatcctcattttacagattattccactgaggcttgtactaagcaactgttaaagagcttcagacttggaactccctctttctgcctctataccttgctgacctccaagtattcaagtgcataattagctcccaatggcctggtatttgtgtactttctggtttattaacgaaagctttactagtggaaacgtgagaagttccgacccacttgtactaagtagctcctgatacatataaagatgtgaaaatgagcaaggaattggtgatgccaccaagcctagactattagactatggaaatcttctgtaagaaacttaaggtcccaggggacataaatatgaaacgaatcatcttttgaactggtgaccacagtacactatagagccctagacagcttcctgggaaataccattacttaagagaatgtggttcaatctatgtttttgtagcctaacagtcagtgaaccaaaacaatgaacaatcatgggaattctgactctcctgtgttgtcttctcaagagagcctgacaattctgctggttatgtccacttaaaacccaaatcaaaaaccttatatgtgtacagtcctgttgactttcaaaatacattgctactgctacatatattaaatcctcatttgactaaaaaaaaaaaatcagagcctactataatccccgctatactgatgatcacaacgggattaagaagtttaagtaactagcccaaggtcacttagcaggcaatggtagacacagctggacctcaaacctaagactgtctcattctaaatccaaaacacatacctaccattctacacaccttcccacattcaatatcatcaactcatttggactaagagtaatcatccaagctggtattagcagtcccattcttcagaagtagacaccagtgcacgctatcatttcagtaggcagcttaccttcattcacttggccagcaagtgacaggactgggttccagggcacgtaaatggtgtccacctgagatgccctgccttgcaagtgtgcaatgagatctgctagcccagataccacagtgggagtcaggaatctagtgcttctcacatccactcccattcaagcttgtgtttctatgccttaatctcttccaggccacgtcaaaacccttactaccaaagaacatgaacagctcagtcatttctcaggtagaagataaatatggaaatactagctctgtaagtctttgacactcacgttttcatataaggctgccagggtctccagatcaaccacggagtcatccacattgaaaatggctgccaagcacccaaaaagaaaagaggataagggatttgattaggtcccctgcaccaatgtttactccacatccagcttccaagcaattaacagagtattgcgttttcttacacaagctgtgcctctctgctccccttcctttcgcaccaggggtctcaaatgaaagaaaccaaaatggttcctatcattggcctgagccttggctctgccttgtttaattcctcaggctctgagtcctttctgcagtttaatttaggctccacaggagaagtgtttgtgctttaaaactaaatcagtttgtaggtttgaagcacaattttaaatctttcttcccgatggtaattgaagagatttagtacctaatgcaccagaactgactcttgcccattaccagaaagaaagagagaaaaaagacaatgttggcaaattaaatgaattcaggcatgtgatttcaggcacctttccgtggccactgccaacatcttgtttggattaaaaagacaagaaaaaacaataattgcatcaatagcaaattaagattatggaaacctcccatgagccagtcttcaggcaggctctcattcccatggctttattaggattctacttgttctgtattatttaagattaatttagccgttaactaatatgcttatgatttcatctagagaggtaccttcccatagatactgggatgcaaaaattgagacttaaaatccttaatggatttggctatcgaagtgtttgaaataagcaggtccacatctttaaataattattcaaaactaataaggtttgttccctcaaccctacctcccttccctgactttacattgtgaaattaaccagcacgctagtaaattttctccgtggcaggctaattaattttattaaaccaaccagtgatacttagaatgccttaaaattttgctcgtcaactatttattctgttcatttgcattacaccatggtttttgggaaggtggggaccaaggtaaggggcaggttgtttttgaggtattttgcttcttctgtggtttagaatcacatgaaccctttcatacaattttaacaaagctaaaattaactgagctaagatcatggaacctcacagaacagcaagaaatgtacttaaaattcctttgcaggccaccttctcaaacttaggggttaatcagcaagctattcctagatacatggaacagagagaaaagaggaggttaatatgctagagtcaaagtaagtcacctcagattccaccaagacaaaggaacatcacacatccacaaaggccaatgtgaaaccagtaaagaaaaatgcagtttaaggacagaaagaaaggatttgtcctctcaagactgttattttgtgtgtggagatcacataaatccactaatttgtcagacacaacaggcatttttaaatgtctagtgcgttgaaaaccaaaatagccagaaacaatgtctattttatgtaaatctcagtattctctcacaaaaatcaaccaacatgagcgcataagaaaaggtcaaattctaaacaataatctaccaaaaatgtttacatgttaactaatcatgcatcctgggtaactatatattacaagcttagatataatcaaataatcttaactaatgagaaagagaatgacctgtgagtttcttttcctagtaagtaaatactcagtttttaaaagttaatcagtctggggcccaggcacacagttcctcagatggtattgtcagctgtgccccttccagtgtgttcagtagcagaaaaataacacccagagaggttgggactgagaacaaccatgggctctgaagacatggattcattcattcctccatccagcccttgaataagtatttgttggatgtgtacaggatctgttctaaatactgtggatttttaagttagaagtgcaaagtacttaattaatctcatgaaatttatatcccagtctggggacagaaaataaacaagtaaatacataatttcagataacaatttactatgaagaaagtaaaacagagaaatgtacaacattagacagaaggctcaaggaaggcttctttgggaggtgacatttaagagaagacctgcagagatcagttttgtggctatcttggagaataacgtcccagggagaggtaactgcaaagacaagtttctttttctgaaggaacacattcaaggtatagaaaaaaaaaaatcaaggtgactatcatggacagagcaaaatttactcattgtgtgatcctgacatgttaaattttctgagcttcagcatatctataaaacagctctaataccacttagtgaaaatattaagtgaggtaagatatatgcttagcatagcacgtagaacatggtataagcccaaaatggtatatatgagctattactatcatgatttcaaatatatacattgtaaatgtgttttaatgcttgttaatgccttatcccctttaacatctggaaagagttagagaaagaaaactacaactactgagtgatttgtgctgtaaatgcaaccttcccgaattcttaggtgtttctgatcgcggttactaggaaacccttccagtcctttaaaaccccactcaagacccaacttcagaaagcattattaacaggaaaggtctatgacacagaactctaattacaaaaaataatggatcaagtgtcttaagggaaatgccaggtacctccaagtctgtattatcatatttttatctataatttcaatatttctcatcaatccatccttcattgtaccaaggttactttttaaaaacatggatttcaaaattttactgtgatgcttaacatacctccaatatcttcctttaaacactcggcgaagtctaaactccttggcctggttgttaagctcattccctgcctcgcctcaattacacttccaaactcatctcctaccatgttctccatgcaccatgggttccagtcaccctgtgtccttccccattcctgaacatgccatggcttcctccctttcttcatctctccatggcacagaggtcaaagccctggaaggacatcctttgaccctcacatcattaagtcctcaatcttttcctctgccatggtacctctctcatattttacataaggtgaagatggtatactttaagaatctgtggtatgttgcataactgtttccttctcccagtagactgtgaaagccttgcagtcagcagttgatttcttaagcatcttgataactgtctcccagcatggtaccaggggtgtagcatgtataacatagatgtttgtgggtataattataccatacgactcctgaagactgagtcctgctgatgggaggaaaagcttcttgacaaagagaacatagggtcttaaaaagaaaccagagagcctctaaaggggcacagccttataaggcatgtatctgaatcatggttgtttgcttcttcccaatttgaccctgtccaaaaatcaaggtttggccagcagttacataattgtgcccccaactcacacactcggtgtagattataccgcttgcctgaatactccctaacaaaaataattaacttcaaagatgagttttctcattattagggaatgaataaggaaaatatctttccttattcaaaaaagttttaaatagctgtatctccttaggaaaaatgttgagtaaaagttcaactattatattgctttaggcagacactgaaaacactaatctattaatcaccaataattaagctaaattcatccatgcaatgacaatttgtaagtatgcaatacgtgccagtgaacgtaaactggaaggatacaaaacattccagctagaagcagcagataataggctcacaaaatgtttaggcaatggcaggtagttcaattttggtttgaagagagacttaattaaagggactagaaagatacactccaaacatagtttggggtaaaaccttgtagaattttgaatgccacgatgaacctgtaatacacttgttatacaggagagagctgttgagcagttatgaatggaggagtaaattggacaaaattatattacacacacaaaaagtcaaaatttgaaaagactaatttagaatctattgtaatgggcaagaggtagcaaaaacttgaatagtgtggacagaaaggatagggcaaaaaagaaagacactacagagcactattatagtgacattgctaactagctctggggacttagcctgaaaccactctgaggctttgagcctaggtttaggggaagagctttgtaccatccccccagaaacaggcagaggagtctaagaggtgagcatgactactgatctgtcccccagggactgggaaaggaatggagtagagaggaaaggacaggtaaaagaagtagataaacagatgaacttagggccaatgccaagtattccactgaagtttctcctcttccacggaaggatcttaaaaataaaatctaaaaagtaaaagaaaattcagaggtagcagaagcaatatcaagagattgatactgagcctagaacttatggagattaaattagttgtattatttctaataatattggcctgggaaggttagggtatcagccagaagtctgaaaaataaaaaggcctaccaagtcctaggatgcctaagagaactgccttacatgtacataatcccatgtcttagtcaccaaatatagtttaggttcctagagagccagaatccacacctgataattctattctcaaaatactggaacaacgtattagagaatcaatgaatgctctccgattaagtcattcttgcaagcacttaccattaaacttattagccattacataagcccaattaattagttaactaatttgtaatcataatgatcacaatgtggaaagaagtcagtcttcaactaaactattttcggcgtcacccaagatcagatcgctccctccattttatactttgaaaacactcactttctgtctctgtctcttccacgcatgtgtgtgcacacaggcacaccgctcataaactgaaccaacaaatacaagcctatgcaattttacagcaagcctcaaagctctgatacagtaattccaagtaatcctacttttgtttccatctgtataggtctcattatactaacactcctgcagatggtgtcagaaaggtgaagtgtcaagtccacaaaggggagaccccaacagctcattgctactgcaatatcaatcactgctggtggtttttacttttatctccttccctccttagttgtcccactcacactgtcagttcggttagaatatttcacctacacctcacaatatgtcaaaaggaagtagacacacgctgtgaaaagctggtaattttattagattcctttacctttaaaaatctgttacttggtcaagtctggtttctgggcttcttttttgcagggaaattgaggcaaacatttttatgtggtcctctggtgcctgctctgtaccacaagaattatatacacaaggatcattagagtagtgtttcgcccattaagatataataaccgtcagcagggacaaaaagcagatcagtatcacaaattcaaactaacaggcacacataaaaactatgtgcctgctttagggcacatgcaaggggtcagggtctcatacaacagggaaaattccccctccgggtaagagatggcttttcacaagaccagggttaagtagaaagaacatgcaggattctctcagctctccagccatttttcaaccctgaacacttctctctccaagtgtaccatgcccatataaacaaagaatgcacttgctgttcgaagggcttctaatgagtaaaaagacaggcagagttatttaagggagttgttctctttgactgagggagcacctctgagcaagaagcatgggacacggtggtgagaaaggcataccttgtatagtctgttaagattagccaaagtaaatctggtcatccgaagtgtgggagatgccacaggtaggtagggttgggttggctcaccaggtttcggctgacggtggttttgagaatgatttgtacgtagcctgttttattcttctttttatttccttaagtgactgatgtaagcctcttgcacaaagcgggtatgtaataatgttttgcaaatggactagatatagtctggtccagcccaggaaagcaaagtttgataggattacttgactctattagcagaaattattttgtttacaatgttaactctgcaacagccaaaataaaacttagctgctttgcccaaaatactggtatttttcagaactcgacagaaattcaatcagtaagagaaagagaacagagcagggaaagaaatatagaaggacttggttttttgaaactctcatgtcacctatatcccacaaaactctgacaaacctactccgtgacctctacaaaggcaacgataacatggggttcatgggaagaggcagtagtacaatctgagagttgaggaaagggaaggcagaaacatcttcccacagttttccctcccaacaatgaggtcatccttgagagcaaacaccaagtctatgaaaaaaactgcaagaagtggaaagaaggggagccagtagagaggggtgtggagcgtggaaggaccactcggaggcaaggccaggggaccgtacagatctgctcccgctgaagagctctgtaacaagcctcttcaaaatggtcatagttctcctacaacctataccttgtgtttctcctactggacactaggttccacctccaataagcaccaggcctacctgtgcaaacccagatatgcacaaatcctcactctatgcaagtatccaaatgagacgcttaagggcaccaattaagtagcagcttaaaagaatctctgtccactccaccacagggtgaggacagcaggcagactttattggggattaatacttaataactgatagaatttattggcagcttcctctgtaccaggcattgttctaagtgttttgtatttaatcatatgaggcgggtgcgtttgttgtttctagttttacagatgatgaaactaaggcacaaagtcacactgcttggtttcccaagctcaattcgacaaccaccccaactatcctccaaggcagtggtaatttactggacaaagattgtacttcattttcatagatgtcaggctataaataatcattccacttaaaatccttaccatctaaaaaaagtttcaatgaattaaccaattaagaacaaactacccacaaaaggctacaaagaaaccagggtctctaaatggcatcatatgctttttacattgatcagcaatcccagagtgggaagcacatacagcccatgttatgaaaatttcatttatttagtatatacattcatagttccaccattatttaattcatgctaatacatggttcacttctaatacgctattgcaacatatgcaatgaaatgattaagctttaatctttgttacaaactatttgcagttcttcaaaaataatcaatattgcagctaaggcacagcagacagaatttctttaaaaaaaaaagaaacctggaacttgaaaataccttaccttaaataagaagaaaataaaatctctagtaacataaagtctaattttcttgagtatataacaataattgtaattttacactgcatgccaaaactgactaacaaggaaaactaaggcacacagcacacgaagaaacacaaacaaaagttgcatccaaacagataaaaaaaaaatcaagagactatagtatagtttataatcttatctaaattgctaaatgcctgctattgtgtcatgttaacctgggctctgatggagtaagagacaagtataaaacacacagtgaacaggagctgcctgggtggtggaagaaatggacaatcgcaaaagggatacttatctaatctattacaaaacttcaaaatcactcaatctcataaagcaaaaatccaaattgtctcctaagtccaggcatgtactatgcctcaagttgcccaaggtctccttttacaggcgcaattaagattgtccatggttcaaacctcaaagaagggcacagggcatagaattcacaaaacttccccttctatatcccctctattctccagagggcagtggaatgagaaacagtttgggttaagctgcttctgttcgtccattagttctggttcttttaagccaaaattacattccaggcagattggatggtctcagccagttgcctgaaggtaaagtacaaagaaatgccaccctctgctttctggactcagctctgcgagtgaaggaatgcagaatggtttagaaagggtaggtgggagccccgctgcttaggtgttttagacacagcaggaaggaggaaaaggtggaaaaggaaaggaaaatattagagtgactacttatatttatctaacattttaaaaaatttagctctacctatatttaataagttaattgaaactgcccatttatttagtctgtatgtcagcaggtcagggtcacatggcacttttggtggataaactctttcagacgtggcatgctcacttgttcctttgctttcaacatattgtgatggggggggtattaaatgaagttttcttattctaaaatctggttttaactaaacttcacaaaataaacaagttggcttcaaaagcctcctgcagtgaaaccccagatttaagataatccatcaacaataggaaaatggtagagcagacactttggttgctagtacaaactcttcatcagttatggaagtgggtaaaaacaaggatagccaaatggcacccgccaagaagttgatccccataaacagaatttatcactaaggctacttaaaatgtgggtttaacttcattactgttaataatgagactcattgtaatcgcatattgagccttgagatatcaggctcataagaacccaaagccatcaaaattagcaagacatttaaaaatattactaatcttattttaattcatattttttgcatatattttataacatgcatattagttatgtcctacacttatattttagaaaatagaccttgagaaacatgcactcaaactttttactgttggggtgcacgataaaaaaattctgaagaccaaaagccttttgagtagacactcttctaggctagactgagattgttcctcaggaaagtcctagataagttatgttggatttcagatgcctggtcaaattcattacgttttagacaacttgcataaactttgacaaagatttctggcaattattaaggcaaaaggaaacaaggtccagcgggcattctcagacctgggttttagactctgagcacatagctgacatcccttttgtacactttgaactgagattcccaaacagaaagaaagccaatgttgcagctgatctctcaaactgacgttctgaactagtaagaactaaataaaggatgttttatcttgatgttatttaaatattataaatattaattctgcgtgtatgggaaattccaaatgaatgccaggaggtttctggcatctagtctgttgcaatgcatatgaacgtttatatcaagaatagtcaacagcaattttctatctcccctgggacaagaataagaggaactcactaacatggaatgaaaacactaatttgcaatcatgtaggcagtcactgtgaccaaggatgccaaatgcttttaaatataagtcatcctatctagcagatggaaaaccagcagtaagtagattacttattcagagtctctcctggaccaaatgcaagtgcttttggtattatggtcaccctcctgaaaccattcttcctctacaaccaaggcttttcctttagtgattcagtgttttcacttcagccagcatatggatttggctttcttttacaagacatcaaacactatcttgggtagaaataaagggataaaggttacttttgggagtatgttatgtctaacctagccctatccgcttaccactagcacaaaggtagatttttagatgctcaccgaacactttagctgagatgtttccactcatctcacactcaaatcatccaaaacagaatttacctttatgcttcaagccctgcgtctgcacctgtgttttcagtttctggcttggggcaccattatacacattcctgctgaagccagaaacccaaggtacagccaaaagtcttctgtattactccttgcatctgatgtgagcaaccgtagcaattctctctccaaatatccctcatacgtggtctcttctctacatttctatagacatagcttcagttctgacctttgtcatttatcatctgaacaaacacaatcccttctaaaggatttctccaccttcagtcctatttttctttattcattcaacaggcacttcatgatcatcacctgggtgccagacacaggtgcaaggtgctggggatacatcagtgagcagtctccttctcagagcttatattctcgtggtagatgtaaataaaaacataagtagatgaacaaataaaatattagttgctgtgaaggaaataagagtattaaattaggatgacctgtattagggtgggaggacctaggcaggctctcctaggaggtgacatttaagctgaaacctaaagaaaaacacctagctacatagagagtggggtggaaaagcgtttcaaacagagggagcgtgcagaactgttcattcaaaatgtgttgtgcatgcaatgacaaagagtaagaaaagtacttggcctctgtaagaaatcaaagaccactgtagttggctagagtgcagtgagatgagatgcaggtgggacaaagtgaaataagagatctatgttttggccaagcatggaaaacattagaggccagtcttccatgaacagtgtgatagatattgctgcattcaaaatcagatcacaacatggcccttcttagatttcttgtccccattactgatgcaataatataaacatttcttgtgatgctattcatgatcttcctggtctggatgctgcttgtgtttcttgccttctaccttaaaacaacccacattcatatatacaatctatatactccagctgtgtcttttttttctttttttttttttcgagataagagtcttgctctgttgcccaggctggagtacagtggcgtgatctcggcaacctccacctcctacgctcaagcaattctcccacctcagcctcccaagtagctgggattacaagtttgtgccaccaccatgcctggctaatttttgtgttttttgtagagatggggtttcgccatgttggccaggttggtctcgaactcctgggctcaagcaatccacctgccttggcctcccgaagtcagggattacatgtctgtttttcacgttttgtttcatgctctttcctcaattggaaaagctccatctctgtgtgatgaccactatttcatcctctcagacttaatcttaacttttacaggaagagtcaagatactgctctgttatttcatagccaattctactataatgttgggctgctttacatctctcccaccatcctgggtgtgcctgaggatgttagagcctgatcttatgtgctgttgtagtcatgacacctgatgcggagctggcactctatacagttttatggaaggaaagaaggcaggcaagcaggcagttttgtccaagtgcactggaatagaatacatggcattctgatcctatctagtttaagattaagtctgtattttttaaaaattgaattaaattcaacgaacacttgaatatatgacttttatgcatgacacattagcccagttatttgcaaacaatgcttaatcaccatagaaattcctggcaaagaaatgcataaaggaatgaacactagccctgctccttgttacctgtcagatgttaaggtatagagaagcaaaactcttcctgaatggagagtgtaggctgtgttaaggagagcacagagaagtgctcctcttacaaaagaagaagagaagattgctcttcaacagccaaaccagtaaaagccacatgatctatttgtgggagacaattgcagactgaaacacacaaaactgttatcaaggtgacaaagctgcaatctcagaaaaattgaaatgtcattgccatttggaaaattggaatgcctgaagctatccagaaggcctgtaagtacttctattcctatcaacttaatggtagagttttccaagaatcacgtactgtattttgtctctaaacctgtttatgcctgtttctttgcattcaaaaagatatttaccgtgtgcttattatgcatatgccgaaacagagtgatggaaatgacattttaatggggaaaatggcaggtagaggcaaatgatgtggagaaaacaatcaataaatgtgacaattttttttgttgttgttgtaagaaggaatactctcctctaagtgaatatactggcttgctggtttatacatcagcttcttgtgagtttggaaagtatgagttaatccctctgggctttgtgcatggctaaaggtgaatatacgaccacagggctgaagaacaccctctgaattgtcatttcaccagggctggtcggctgtgagatcttgccaggcggccagctggcctcctccagtcatatctaaccatagcccctctcacattaaaataaactttttaggccaacatcagcacagggagtcctttcaccagggtgacaacacaaggccaagtacattccacacacaaattcagaatgaaatataactgatacagcctgggctcctaatgaccttcagatgccagtgtcagtcaatgactccaaaggaaaactaacctccagttatagcgccatattcatctggaatgcattactaaacgaagaaatggaatggagatgattttttagaacttaggagccaactttgtggtggatcacagaggtgcttgaggaaggaaaacgaacaataaagttcccacaaggactagaagtctgtgatgctacagtcaacattcggacgctgaaatgaaagttcacgtacgcttcacagaagcatgttcttatctagagtataacattggaaaaggtctggatcgacaaatatcttttcaaactcacagtaaacattcaatctaataaggctagaatgccatgggaaagtttacagtcctgagctggtaactggactatcacatggctggaatgacttctatccatggggaaatctgacgcactgcagtaggacatgcttaaaacaaacggaatatagtctaaggttatatggacattgtgaaaactcacatccacagcgttacacatcatggtgatgaaatcaagcacacttgagtttcaccaggctcatggagaccactgtcaagaccgttctgtgatacctgaagaatccctaacttcaataactgcttcaaaacagtcagtcctttaccaaaagactataaactcccctgaaaacatttgtttttgtttttctttttttccctctgctctaacatcacattcttctgatgtgaatttttcagaaactcaattcttctggaagatctaacttgagattcttctaaagtccctgaagaatcccattctaatttcaatgacaggcctatttagccaccctctgccaaactcactgtatctgaggtttcatattcacacttatgtattcagctctgttaatgagcttaaatacgatacagcttatctgaatgctctgtgattatcatttaagatgttttagttttttgtggaatttttaatttttgtaatgtagcgaaattttaagtccctaacaatgctcccttgaatggaaaagtagcaggtgatgtgaaagtaacttaagtgtcttgtaggtcaggacctatgggtattctgctgagtagcaaagtcaaacaactaaacaacatgaactgaaacctaaagggccgtgtggtgtcagatgtttccactgtgaaactcatactaaattctactgaaaccatctaagagattgtattatcactcagcaaatataagtgaaatgtcaatataaagatttacatttgctgggcatagtggctcacgcctgtaatcccagcactttgggaggccaaggcgggtggatgatctgaggtcaggagttcgagaccagtctgaccaacatggagaagccccatctctacttaaaaaattagctgtatgttatggcgtatgcctgtaatcccaggtacttgggaggctgaggcaggagaatcacttgaatccgggaggcagaggttgcggtgagccgagatcacgccactgcactccagcctgggcaataagagcaaaactccgtctcaaaacaaaccaaaccaaaaaccaaaaaaacccccaaagatttacatttaattaattagtgagaaaggggagtattgttttcatgcgagacacagattttgaaaaggtatcatgtgttctggtctacttttctagatactaataaaaaatatgtgcacacaaaatctcttctctttaaatgtcttttatctaaaattgagccaaagataaccaaatagaaataacaacattttgaaaacgaaaggatgaagaaacaatgacgtaaccaaatgaaggaaagtattcctccctagaagtattccagctaataaagaagaaatgatggaattagtacatcattattttgaaaacttctattgaaataataaatccaggcaaagataataagtgctcactaacatcacagataactaaatattatgcacttcttgatagaaaacataatagcatctatgatgtattcttccactcagattaagtctctagatcagacagtttatagaaaacaggggacaggggaacatgataaataaaaacatagcagcatcatcagcaaaacctaaaatgtggggaagtctacaagacaagtgacctggtttcttcaacaagtaaattacaaaaggggaaaaaatggagggtagaaacttctagattaaaataaacttgagagacacgtcaaaggcaatgcatggaatttgtctggatcctcatttaaactaactataaatgaatggatgaattaatgagtatacaaacaacagggacattagaaccacttatgtgatgatactgagtaactacgattaatgtctttgaaggaaggataatggcactgggtggagtattgtttggaaaagtacccctgggccgggcgcagtggctcatgcctgtaatctcagtactttgggaggccaaggtgggcagattgcatgagcccaggagtttgagaccagcctgggcaacatggcaaaaccccacctgtaaaacaaataaataaataaagtatccttattttttagcaatagtactaacatttttaacagatgacttataaagcatctgaaatttgcttcataacctacttggtgagaggggggcattttcagataaaacaagagtgagttgatggttctgtagctgagtattgggtatataggattcattagggcattctaactttgtatgtgtttgacattcttcagaatgaaatgttttttaaaaaatggaaaaagtaaaacaaaagtgatagaaaagacttaccctgttggatatccttcatttctaaatgtaaactagatatcaagattcccacagtttgagatcgttttccatccaacaatttgatgatctaaaattagaaaaaaaaaaaaaagaatacaagctcaaatgaccatgcagtctttcaggacgcacaccaaaaacattaaatttttttagatacactgattgatgaactaaattgatgctgcatgcactctttaaataatacttaattgggaagtaacttatgcacaattatagacatcttacacaatgacagacgttttacaaaacaaacacacaaaattccatcagcctaatacaaacgctaaatctttatatgttactgtgatcattttactcaagtacaaagttataccagcatcaagatgtacagaatgtggtatccatctttttcacttatcactggaatattttcatgttgctactggtgaagtcacttcatagcctccaatctttttagtaatgtcatcttctgagtgatttaggggaaaaagcatgaacagctgagtcagccaccagtgatatggccttggtaaagtgataacctctatgaattgatttcctcatcatgaagggctgactatatttagtctatattttattttgagagaaggtctagctctgtcacctaggctggagtgcagtggtgtgatcagagtttgtctcagccttgacctcctgggtttaagtgattctcctgcctcagccttcagagtagctgggatcacaggcaggcgccaccacacccagctaatttttaaatttttttatagagacaaggtctccataaaaacttcattgcccaggctgatctgatcccaaaccctaaattcaagtgattcttccatttcagccttccaaagtgctggggttacaggcattagtcattgcacctggcctatacatttattttagaaattaaatgactatatgaaaagcacttaatatagttcttgacatatatttatttaaagattttctgtttcagagaggttacttcctatttgttattattaatataaacaatataataccttgcacacaaagctctagttttaaattaatcaattaatttttgagatagtatccagcgccgtcacacaggctggagtagagtgacgcaatcacagctcactgtaattttgaactcctgggctcaagggatccttgcaccctcacgagtagcaagcactataggtgcaggccaccatgcttggctaatttttatttttttgatgttttgtagaggtgaggtctcactatattgccaatgctgctcttacactcctgggcccaagccatcctcccaccttggtctcccaaattattgggattataggtgtgagccaccacacttggccttaaaattattttttataatactatgtatttttacaatcttcatagaaactccacatacctcattgccagttatttcaacctttatgaatattccatggagaagtctacatagttttgtgtttctctacaactagtaaaccaaatcagctccctggtaacatatcacgaagctgccactaagggaaaaaaactctctttcctctcatgtggcagggctacaaaaataaaagagaagcacccacaaaacacaaatcttacaaatgtttttaatgtgctttgctggttaaaatacaaactaggctgaacagctgtgctttccttcccacctaggtacttacagaattgccaaactactgtgaagacaagactaaacagtaacaaacatctacatttgtattattactgtaatagctgagttgcttgctggttgaaaagtaagggacaacaatagtttgttccaataaagatgatctaactgcctaattgtctaactacctgttgattaatcgatcttgaatcaattattgccagatatttttttcctttacctgttcagaatggctactttcatataacgattagacctaaaagatagtaaatactaagtattaatcaagatgtaaaggaaaaaaatctcatttttcagtcaatatgtttaagcatgtcaatattcgccttagaaagattcttgaggcatacagaattttaggagttttaaacagaaatagagaaggtactcagtaattttttatatgaaaggaaaagcaaaaaaaaaaggcaattaagcataatacaatatcttccttaaaaatgcaatttctggctttttcttagagaacccaaatttaaagtcaaatgatttcttcatctaataaaaaaattaagaaaagtcaatttagccatgcacccattcaaaaaatatttactgtacacgttacatgtgcctggcattgctttgtattctggggatgcggaggtgactgagacagatcaagtcgtaagaagtttgctgtagagtcaaaaaggcaaataaaagcatcacctaaactaactggagtgcaaattcaaaaagagaaacgttttgggaattgactagatttattcttaagtgtccaggatggtgactgatacaaccacaaccatggcatacacatcaatgacaaggacacaggaacaggatcaaatttatgacaagatcacagctgggttgcaaaagtttcttcaaatgaacacgcaccaagctatccagttagggctctgaaaactaccagtaatactctgcctacaagaaaggtaatgtacaaatgcacatttctctgttagctaattaaaagaaagcaggagagaaatcacgagagagtaaaagagcaagaaagatattgattctgtctgtccctgagtaaaatgaggcaaatctacccctcaccccattatacaaccagacttaactgtggaaaggatgttatcaccataagccatgcttggaattttgtcgaatgacttggcacaaccaggtatttgctgagtgttacctttactgggactaatgccttaaaacgtttttgtttggaaatctgatgctgatttcctacaaaggggctgggggcagctaagcagtggtgaagttggagcattttgtattctcttccctacctgaaccaaattctctgtctacttttaagtaaattttcaaaaagatccttctatgtttccatgtagccactcttgtgaaataccaccaggtttctcaaaaccaactacaatggtagggacacaatgcgcacagaatgatatgtcctaaatcctcttagtctcttcgtcttttttttctcccatggctttgaaggcttaacactaatttctctttatttttatgaaaagtgcacaacatgaaatgtatcctattaacaaaaatttaaatgtatagtacattattaaccacaagcacaatgttatacagcagatttctagaactttttcaccttgcgtaacagaaattttatacccacagaatagcagatttccaattcgccgttgttccagcccctgggaaccaccattctactttccattcctttgagtttgaccaccacggatacctcatataagtggaatcatgcagcatttatctttttgtgactagattattttcacttagcataatgtcctcaggccaatccatgttgtagcaaatgacaagatttcctttttttttttttgtggtcaagtaatattccactgtatgtacacaccacgttttctttacccatttgcccatcaatggacatttaggttgtctccatctctttgctattgtgaatgctgcaacatgggaatatcttttcaatacagtgacttcaattcttttggataaatatccagaagaaagattaatggatcatatggtagttctatttttaaattttttttttttttttttttttttttgagctggagtctcgttctgtcatctaggctggagtgcagaggcttgatctcgcctcactgcaagctctgcctcccgggttcacaccattctcctgcctcagcctcccaagtagctgggattacaggtgcctgccaccacgcccggctaattttttgcatttttagtagacggggtttcaccgtgttagccagaatggtctctatctcctgacctcatgatctgctcgccttggcctccccaaatgctgggattacaggcgtgagccaccgtccctggtctatttttaaatttttaaagaacttcatactgttttccatagtgactacaccattttacatttccaccaacagtgtacaaaggtcccactttgtctacatcctcaaaaaaacttggtatttttcagtttttttttttttgacagtggccattctgacacgtgtgaggggttatctcattgtgattttgaattgcatttccctggtgattagtgatgttgagcatcttttccttatacatattggccatttgtataccttttttggagaaatgtttggataagtctttagcccatttttatcagacatatggtttgcaaatattttttcccattctgtaagttgtctttttactccgttgattgtttcctttgctgagcagaagctttttcatttaacatagtcccctttgtgcatctgttatttttgctttttttgggggggggcggtctatgcttttcatgctatatccaggaaacaactgccaaaatcaattttagaggacttttccctattttttaaaaaagttttatagtttcaagtctcacatttaagtttctaatctattttgagttgatttttgtatatgttccaagataagggtccaatttcattcttttgtgtgtggatagccagttctcctagcactatctgttggagagactatcctttccacattgtacagtcttggcacccttgtcaaagaacatttgcctgtatatgcttgggtttatttctgggttctctattctgttctattggcctataatgtctgtctttatgccagtaccatactgttttgattactgcagcttggcaatttgttttgaattcagaaagtgtgagttccctagatttgttctttctcatggtggttttggctactcagggtcttctgtggttccatacaaattttaggattgttttttcctatttctgcaaagcagccactgggattttaagaggaactgcactgaatctgtatgttgctttgggggaatacagacattcaataatattaattctttcaatccataaacatgagatgtctttacagttatttgtgtcttcctaaatttttttaagcaatgttttatagttttcaaaactagtctgtactagtcttttaccctcttcagtttattcctaagtatttcatttttttggatgttactttaaatgaaattgttttcttaatttcccttccaggtagttaatatttttgtgttataagaacacaacgaatttttgtttgttgatttggaatcctgtaagtttgctgaatgtttttcatagttcttcacagtttgcttttttgggggaatccttagggttttctacatataagatcatatctgtgaacacagataatcttactatttcatttccaactttgatgccttttatttctctctcttgattaatgtctctatgactttcagcactatgttgaataaagtagcatgaatgagcatccttgtcttgttgctgatcttagtggaaatgcttttggtttttcaaccttgattataatattagctttgaacttttagcatatggtctttatttctttctattccttctaaagaatatttccttctttaggtaatttccttctattcccagtttgatgagtttttatcagaaaacagtgttgagttttttcaaatgctttttctgcatctatcaaaatatttttatcatttgttcttttaatgtaatatatcatattgataaatattcatatgttgaaccttccttgcatttgagagataattgacacttggtgatggtatatgatccttttaatgtgctattaaattatgtttactgggccaggtgcagtggctcatgcctgtaatcccagcactttgggaggccgaggtaggcggatcacttgaggtcaggagttagagaccagcctggccaacatggtgaaaccccgtctctactaaaaatacaaaaaattagctgtgcatggaggcacgtgcctggtagtcccagctacttgggaggctgaggcaggaaaatcacttgaacccgggaggccaaggttgcagtgagctgatattgtgccactgcactccagcctaggaaacagagtgagacaattaagtttactagtactttgttgagaattttaacatctatatttgtaagagctaatgacctgtagttttcttttcttgtaatgtctttggctttggtatcagagtaatgctgttctcataaaatgaatttggaagggtgacctcttcaattttttggaagagtttgagaagcactgcttccctgttaattattctttaaatgtttggtagaattctccactgaagccatctggttctgggcttttctctggaggtttttgatttctaattcaatctccttacttgttacaggtctgttcagattttccacttcatcatgattcagtcctgctaggttgtacatttctaggaattgatctatttctcctaggttatccaattttttggcatgtaattgttcatagtaggttcttataatccttccagttctgtggcatcggttgtaatgtcttctctctcattttgtatatacttgtgttttctttttctccttaatttagctaatgatttgtccattttgtttatcttttcaaaaaaccaactcggttgtgttgactattttcctattgtttttctatactctattttgctttttttctgctgaaatccttatttcatttcttttactaactttgggcttagtttatccttctttttctagttccatgaagtgtagagtcaggttgtttatttgaaatctttttaaacataggtgttcaccctaaaaccttactcttagtactgcttttattgcatcccatatgttttggtatgttgtatttttgtttctgtttgtcacaagatattttccaatttcccttttggtttcttctttgacccactggttgttcaaaagtgtgctgtttaatttccctgtatgtataatgtttccagttttcttcctgctattatttctagtttcatgccattgtggtcagaaaagatacatggtataattccaatttttaaaaatttgttaaggcttgttttctgacataacgtgtgacttatcctggagaatgtgcacttgagaagaatgtgtttcaaaacccaattcctgttgggtggaatggtctatttccattatgtccatttggtatatagtgttgctcaagtcctctgtttccttattgtttatctatcttgttacatcatttatcaaaagtgggttattgaaatctcccattgctgtgttgctgtgtatttctccctttagttctgtaaaaatttgcttcatatatttggcttgtacgttgggtgcacatataactgttatatcttcctggtgaattgacccttttatcattaaatagtgtccttctttttcttttgttagagtttttgacttaaattctaactatggccaccctgctgtcttttggattgtttttagtttagctaaggatgtcagttgttggtttttttaaattaactcttggaatatctttttccatcccttttcactttcagcctgtgtccttgagtctaaaatgactattatagacagcatatagttccatctttttttatccatttagcaattttatgtcttttgactgagaaattttctctatttgcatttaaagtaattactgagaggcaagaacttattattgctaatttgttcattgttttgtagcttttgtagttttgtctttttctatattgatgacttttgtgttttgtttcttacagtgacttgctttgattcttttctttttgttgttgtatctcctataggcattttctttgttgttactatgagacttacataaaacattttataggtataataatctattttaagctaatttcaatcacatatacaaattctactcttacttctccactcccacacttcatgtaattgatataacaaattatattttttctattgtgtatccattaacgtatttttataattatatttgtttttaatatctggcagacataaattctataccagagttaaaagtgatttatccgcatcattatagtattctgtatttatctgtatatatacctttatctacaagctttgcgctttcatatgcttttgtgttgctatgtcatgcccttttcatttcaactttaaaggctttcctgtatcatttcttgtaagtctagtggtcatgaacaccctacacttttatttatctacgaacatctatttctcttttgtttctgaaagacaatttttttccttttttttttttttttttgggtggggaggactgagtctcactctgtcacccaggctggagtgcaatggcgcaatcttggctcactgcaacctccacctcccaggttcaagcgattctcctgcctcagcctcccaagtagctgagattataggcgtcccctgccatgctgggctaatttttgtatttttaatataggtggggtttcaccatgtgggccaggctggtctcaaactcctgacctcaggtgatccacccgcctcggcctctcaaagggctagaattacaggcatgagccactgtatctggccaaaagacaatttttctttttctttttttttttttgagacacagtcttgctctgtcgcccagacagagtgcaatggcatgatctccactcactgcaacctctgcctcctgagttcaagcgattctcctccctcagcctcctgagtacctgagattacaggcacgcaccaccatgcctggctaattttttgtatttttagtagagatggggtttcaccatgttgggaaggctggtctcaaactcctgaccttgtgagtcacctgccttacccttccaaagtgctgggattacaggcgtgagccactgcacccagccgatagacagtttttctagatatagttttcttacttggtaattttctttcattgctttgaatatattaccctatatccttctggtctgcaagttcatgctgagaaatcttctgatagtcttgttggggtgcccttatatgagttgcttttcacctcctgctttcaaaattctcttttttgtctttaacttttgacagtttgattataatgtgctcagtgtggtcttttgagttcttgtaatcgggatccatcgggattcttcaatctgaatgtttatttcttccgccagatatctgaccattatttcttccaatatactttcctcccttcctaccttctccttctgtaactgtcacaatgtgtctattgatctgcttgacggtgttccatacatcccttagactttctttactcttttttttttttgagacggagtcttgctctgtcacccaggctggagtgcaatggcgtgatcttggctcactgtaacctctgcctcccagattcaagcgattcgcctgcctcagcctgctgaatagctgggattacaggcgtgcgccaccccacacagctaatttttgttcttttagtagagatgaggtttcaccacgttgggcatgctggtcttgaactcctgacctcgtgatctgcccacctcagcctcccaaagtgctgggattacaggcgtgagccaccggcacctagcctcctcttcgtttttttctttttgctcctctaaatggatcatttcaaacgacctctctttatctgattcctccttctgcttcattaagtctgctactgaaccccactagtgagcttttaaatttggttattgtattctttagccccaatatttgtttggttcttcataatattttctatttctttgttgatactgtcattttgttcatgtatctttttcctgagctcactgaacatctttatgacatttattttgaattatttgtcaagtaattcatatacatctgtgtctttaggattggtttgatttcttttgttccactggttggtccatgctcccctgtttctttgtgtgctttgttactttgtgttgggatgtgaaaaagaagtcaccattctcattctttacagactgatttcatacagtgaaagacctttgccaatcagcccagctagtgtctctgggggattttcaagcctttttctgtggataaatattctctggacttacgtatgtgaattcccaattagagggattttggtttttcaggagctcataatccctgctctctctagtgtctgtctatggtactgcagtttctctggaggtataagctgtccagctcctttttgttctcatctgcccccaaacatctagagtatgtcaagtcccatgaacacacagagtcaaagaaggaaaaggagaaaggagaaaagaggagggggagtgggaggaagaggagaaggaggaggagaaagaaggaaggaaggagaagaaagaaggaaaggaaggaaggagaagaagaagaaaagaagatgggtgaagatgaagaagagcaagaggaggaggaagcagaggaagaagaaaaaacagttccttggacaacactgtgaaaaggtgaaacactagacacaagctccactcttctttcccctgcagtccatgtgggagaagctgctgagctgtattggcctctgtctactgtactgcaggccacctagctttttgttctcagcagtctccaggcatctagagtatgctgtgtcccatcagcactccaagtcgggcaagacagaaatcagtctcttgggcggccctctgaaaagccagagcattggacggatgctccgactttttccttctccaaggagaagccaggatttggaggtttactctcacttactctgccctgagcaagggtgaggggcaattgcactgaatgcatactaattcatatcatcatctttcttctcagtggttcccaacctggcatctttccctgttagctcttagattcacacacaacagaaaccagtcttcaaagtacctccccaaaagtctgaacattagacataagatccagtcttctctctccctcccaaaggagaagccaggaggtagttttctctaaatcaatgtattgtgccagaaagggagtcagatgagtgagtgccatgaattttcctattagcttcaatacaactggtttcatgctcacctggggtttaggagcctcttaactgatttctgaatttctcacaaagggaactggcccgtgtattattaaattggcatctccatggggcaacaaggatccggtattttctattccaccatcttgatgacattacctccccctttcccacttttagtttctgagaggcaaatgctatgtcatccatggatagagagagaagacaaaagtggctgggttccaccaaatatgctcccagtcacaaagtggctcatatggacatgttggtagtgagagtaagagcagactgatctgagactgagtcaggcttcgctgaaagggggctggcctctccttcataattggaggacagtaccaaacaaactacaaggaaaagaattagaaatgaaggaagagtaacgagaaaaagagtagaagaaacatatattttaaaagatcttccttaagatatgcaaaataactgaaaggaaacaaatggaggacaataacacattagacttgtgaacacacatagaaatggttcagtacaacccaagactttgatatacacttagatctttctgagattggttagaaattgggctagcagggtgtgaggagaatgtattggaagtagacaggaggaaaaaagaaacttgaagactataggagagaaaaagtatacattttgttgcacttttttttttcactgtgtagcgtgtttttttcacgtagaaacacattactgacaacttccttgtcagtgcaggcagagccatttctaaaaacatcacatcatttaagtattcccctactaaaggacaattagaaatcatccaaattttggccaggcaagctgtggctcacacctgtaatcccagcaacttgagaggtcgaggtgggtggatcacttgaggccaggagttcgggaccagcctggtcaacatgatgaaaccccatctctactaaaaatacaaaaattaggtgggtgtggtggcacactcccgtaatcccagctcctcgggaggctgaggcatgagaattgcttgaacccaggaggtggaagttgcagtgagccaagatcaagccactgctcgccagcctgggtgacagagcaaagactctgtctgaagaaatgttccaaattttgtcaattgttaagaatgctacaacgaacaagcaggcagagagatccttagtcatgcaagtttgtattttcataggactcatagaaatcattcaaataatatgcccatttgaaaatttgataaatatttcagaattgtttcttattagacttaccctgccaagtatttgagagcaactgtttttctgttcccacacccactttaggtattaccaattttaaaactgttggctgaaaaacaggtgaaatgtgttttcatgattttattttgcatttttaatgatttttattagtcacatcttatgaattgtctttatattgtttttgctatattttccaattactagatctactaggctggtacaatacaaatacacttaaataagggcttagctaaataagacgaaaaaagatttacaaagagcctgctgtacataaaagtcattttcaaagggaagagggaatagaacgacctgttactacatctccactaagcactggtattgtgttcctctgcacattagccaatccaaatggacagttgtgcactgggggcagtgagtattgcaatactgtaaacctttattcctttagtggccccctgtggactttccagagtgataacaatacttcaggctcaagagtcctgtaaagtatgtatagctatctcactgctggggcattaaagcaagaagcacagctaaccgaatttttacggtaattcattttttatgttcattatcaaatcttacaacctccttacccagatatatacccattaccgaagaatttattgcagagtagtgaggaagaaaatattaaggggaaaaaaagacaagagtgaagaaaactgatgaagagaacaagaaaaagtgataacaaagatgtggaacatgacaaagattttttttttaatttgttatcaaccaatattactacttcgctttctgaatgcttttttagaatcattgttaagtttcaaataaccagaacgtaatttatgttgaaccatctattaactgaaaatttccctagcttttcttttgttggattatattcattattagtaagctaacttttagacagaaaaagtgaatttcaaaaattccccttggaagagaaaaactatatgaagataaactaatattgggtatttagtctcccaaatccattgacatctcttatactgtgcttgaaagaaatcaaattcaacgaatcacaccttccatatctatatatttatttactgaacgctgtggactggtgatcatagtgataatctgggaaatttttagaatcataaattgcctgaaattatcagatacttaatattctgctctttttatggtaggaaatttaatatatatatttacataagcacagatttcaaatacaaaagttataagaaactgataattaactcaaaaacctaattattaagcaccaacccactccttaagcttctgtttgctattagcattctgtgctattttgacaatttttcagttgtttggcctaaggaagaggttcccaacaatatcacaatctaagtagaaatacaaaaactgagaactatagccataaactacaacagtccttccctctagttttcaacctttgcctgctgagctttcatgaatgacctcttggccagctgtggaatgggatcaacatcatgatgtagtaaaccagttattcagagaaaagtcaggagaccagccttcagccttctatttctaggcctgcccttgctcgtcattgtatcaacgctgaaaggcagacagtccaattcaacggtcctcacaatacgcaaattcccatgtctactgcaaacaaaataaaaattgtgtgtgtgtgtgtgtgtgtgtgtgtgtgtgtgtgtgtgtctgttcaatggagttcaaagactagtttaaagagggcaaacatatataaataacggatacaggagctactcataagatcagtaacttaaaagagtttgtaattattctcaggtatacgatccttgaaaatgccaagactcttatttaaaaagggagtttgaaaaaggtggctgtttctagcacaatctttatccacgtaactcaaacacattcccaaaagaatgttacatccagtgcctttttttccgaaacaaaaatccagatctcacttttataaaacctctccatcagagtcttgagagatgataggctctgcagaacatgaaccccaaaagacactgtaactcatggtctgggtgtccaaacagaaaggactcttaccattcttcatggccactagggtaaaggttcttccgggcattaagacccaatagcagcagaggctttcacaaaaccatgaggtcagtttatcacatttgattgttagacgttagtgggattcctgactgtattagcatccagcttcatcatattaaaaggagttagttagcttgccttaggtaaataacaaaggaaaggttccccaaaagccccggcccacaggttagtgccttatccccacgtaacataaaaagcagcctgcgaaaaaaatcaagctgcaggaaccaataatatgaatgtcaaaataattattttccatgtttacgtgaagccagtagatagaatttatgctttaagctcccaacttgattttattccatgtaggttcttggggggaaaagtggctactacaggctgttcaggaaagatagttcagaaaacatttactggagagtgtaagtatttgtaagattttgcttatccaatgttactctggttgaattggattttggagtcatttaacacttagcactgaagaaacctacaaatttcatctaatttatccctctgcctttgggttggcccagaagtccacgtatgtaagtatagaccttactttacaagaatgtgcacacttcattataaaggttacatttagataatgcacacatttatagccattttctctcaaacaatacaacagagcactacttcagctaattgtaaatacaaattaaactgttcattccactcctagtctatgatcccttatcatactcacttttcattcttctttgtcctcatatgcatattacctgatgtgtaataatcctccaagtcattttctagtattaagagacttttggcagtgaactattttacctgatgtttggctcaaattcctcatgctcccattttgaaccatctttttctgctctcagggaaggtaggaaacagctggtcaccatcccctacactaagctccttcagaaacctcaagatcaccatttttttttaaacaagagatgttttatatcagattgttaaaaatcagtttttgagggacgttagcaagccctcactttatctccgccctatctagagtcagctgaacttggcagcacatggctttctcctaggtataattacagtctggaggagaatgcaatttgtgcagcattccactgacctacaagctgaccttgtgcaggggcaaattcacaggttgcgttaaaccctattagacatgcctagtttaaggcaaagcctttccagacccctgccacatgccaggattagggcatgtcacacgtgcgtactattacatcgcctaagggactctcccaatgccttccagagtgggaaaggcaggcccacactgtctaaacctgtacattaagccagtatagacaaattattattattcctcacatatgtgaatttttttaaagcctgcctctgtgaataagaattaagacaaaaatgggaagacagatttgctacactgggaaaatcataccttcaacctcagctagaaaagttctgccagacaggctgagaaagaattcttgtcaggtccagtgggatttttacatctacagaaaatctgtacactgtatatcttcggctttctgcctgagcttggcagacagggccaaaaataaaaataaatggttctgaatagaccacaagtgctggaagtctgctcagccaagtgagtttggcatagctacaaaattaagagaaacacagaagccctcttcttccatggagccttccctgtctgaaaggaagatgattaatttctacatctacacctttgctagacaccaaacacattcatacctataccagatcgagtgcatattttgctctttggcttaagtttcacatttgaacatactcagttccagtcacagggtttccatctccagcacagtcagttttatcctagagcctggcaaataagcagagagttttttcaaatacagccacatgtgctatcaccaatgaatagctgctggcacttcagggaactaagggcatgtgaaagttgctgcttttcctgtctgaatcaactatttcaccccaccaaaaacaaacaaataaatgtagaaaccatatatatatgagtagacatttactttcatgacaatgatatacaggtcgagcatcccaaattcaaaactcaagaactccaaaatacgaagtatttcaaaatccagaactttttcagcgctggtacagtgctcaaggaaaatgctcagtggggtatttcaggtcttggattttcagatttggaatgctcaactggaaaatttgaaatctgaaacgtttctggtctcaaccatttcagataagggatactcgacctgtataccaaatatccacatagggtacacggtcagctatatagaacaagtgtgtaaatgatctggcctttcttggtaagattgaacaacagcgtggagaattcacataaattagacaatctgattctcccaagtacaattctaaaaaatacaacttctatttttgtgccatcaaactagtgttatctcttgcttatgcttcacatcaatactcgctgaattccaccacctggccaaactatggacattaagaggctggttggtaaaaagtagatatgctactgatgacaagtcagcttgtcttagtaacagtcatcccacttctaagtcatgggcttccaaatagataaaggtaccttcataatgactgttatgtttctctttaagacattcttgtggagtgggttggaagacacgtagaatcctatgttagagatgcagaaattgtttcacttattcaagggctacaggctctgatgattgcactgatactttagtttgaatacctccaaattataaattagtatagggtctaaactttagctgcattagagagcagtatctttgtgagatgagagagaatattaagaaggccttaggtttaatttttattctcatttaactgccatccaaatcaaaaaatcttctaagtaatagacatctaattgggaaaacagagtgagagtttcgcaatggaaagaaattccaagaagtgatgcaaaacgatgcaaggcaatgaggtatggtagcctatggatacaggccttatgcacagaaaaaaatcatgggggaaccaactggcagaatccttttatagctgtggctattctagtcccctccctacgatttctaatatggcagtgactacaaatgggacaggtaagcaatgattcctcccagccagtgccagaagggagtgcctggggaaggggaagggcaggaccacagccatcttgctttctctcttacgggagaataaccgcttctttggaaatatgcaattgttacttggcaggtgcccaggagtacaatgctgattcagtttccttggtccccttcttcttccctgctccatcccctgccactctgccatcacacccagaagagctggttggctggctgtgtagtgccatattatgcaatgtcatccgacgtggtgcaaaacagctcttgctgctaatggccagtatggcctggtaggcctctgggaagaagcctctgtcaactggcctgataatgacattaaaataagctttccacatacagctgataatctgtctcattaaatgtttcaaggaaaactaagcttcactgtttagtcaaactgttaggtctgaatctcttccatggccttatttttggggacacataaaattgcttggatgaagtttactttaaggatctaggctcttcaccaagaaatgtgaaaaggcaaattgtcaccctgtcttgagtctgagaacgtatttggcaccccatccccatcctgacgagacagaaaaacccttttcttgtttttcaggctgatgaattccactcagaaggctaatgcggaggccacagcaggtgaaggctatgacagtgtgggggtgtgatgggttggaggggggagggtagggctgtgggcagatttctgattttgtgtaatgtagaagacaaacccccaaacaaaatcacatgctttttcctattgatcatggagtcttgcgggaagaaaagaccaagagacatcagtgcattcactgccttcagacagaaccagagctaccaaagcttggccctgcgaacagctttgattttagacttctagactctagaattatgagacaataaatttttgttgtttcaagtcaacagttggtgacagtttgttaaattagccctaggaaactaatacaggggctgatatttttatatttctaataatcttctaggtgattatgttgctgctggtccatggacattttgaggggtgaagtgactctaaataaatgtattattttgttactgatcattggcacttagcacggtgccaatacatagatatatgtatgtttctataatccctgatttccagaggtttttcccatgagcccctttcagaatatcaatctccacggagtcctttactaaagctattgtactcatttaggaagtattggaagtaactttctcatagaaagccaatcccaagtatacagacagccatagtgccctcctaaaacctctaaataacaaagtttgcatgacctttggacttcctgtcttgtctatataatttctcatctaataataaaaacttcaacccagtctcacacacgtatatctttggtggcttaaatagggctttttctttccaacatgttagagtgttaggcttttggaaagaacacatgctaataattacgccaagctggttagagataatgggcaacagaaaagttattatcttcaatgtcatcatatgtctttgatatgataatcattgcattcaagatatcagaaatgatggatggcctttgatttagagggtatccacgatgcaaattacctggctctttcccactcctgtgtagaggtgaagagccagcaagagtgagcacccctagctgcagtgcctcaagccactggaaggcaaaatctgagacagaactccaagggaaacacttcttcctttaaagatacttagggcacctcacattttccttttgcagacaacttctcgcatagtcttcatttgccgccattgccataatgtacactacttacaacccaagtcactccactctgttaattttctggctaacagctgctgatatgtaagtgccatattgcttccaacaggttcactgagttccttccatgaatataaaataaatattccacgaaatgttggtaaaaagagaaagatgaaatattactgtattttagtagatattttagaactgctgcaagattttgttagggtttgcggtgttatgtcccagcacatttcccccgtaattagtcttatcctccttcttactctcatagcacagctatcacgggaagcaagtgcgtatcatacactatcattcaggctttcaggtgaatggcataacatagtgactgaaaaaacctacccactgccatccatgaagagtgagcgtctacacccatcttgactggaaccatgagcatatgcacccagaggttctcttagatcaacaagggtgtaacacacatggtagatgatttgcccagagatgcctagatgcctgacttctagtcctgtggcctctcccttgaaataattattccagcaaagatgtacattcctaattagtcatattgcaacaagggaatagcctttaagatatgagaatcaaattcacttggaatttggggtggtaaaggcctttcgacttcctcttctcctaaaaaattagcccaaaattatgagacctaatgatttgaaaaataaaatctatcttccataaaactaggggagccctttaagttttaaaacagaaaatgtgaagttggaggactggtaaattcctaggtatagctgtgggaggtagaatgccagacatacacgagtaagaggcatcctgcgttggtggagacaggaatggttaagaagctaaatagaaatgaattgtttcaaagtctgcatatggagcaactaggtgcatgatctgtaattccatctactacaatcaggtagcatagtttctttttattactgattggtaagaattccacaaacattttggataacaattcttattgagctatatgtattacaaatgtcttcaagcatgtggcctatctttttatactcttcaaggtgtcttgatgagcaagagttcatgtcaatgattttattttaatgtagtcacatttcattatttgttttgtgctttccatgtcttttccgtataaggccaaaagataggctcctatattattttcaaaaattattaaatgtttcctttctcattgttacatctggcattgtcttttattcatgaagtgaggtagggatccattttcctttttttgccatatatattcaatttttaaaatacttttattcatagtcaattttgcccactgatctgagataccacatttgtcatgtattagtttccatatatgcatagatttgcttctgagctctcaattcttttcactcattatttatttatttagtttttcctgtgacaattactgccatactatagccactctactagctcttattaccttattttcctttatatgaggtagaatatctcccacttagttttccttttttggagttgttttttgaacatttgttcttgcatgcaaatttttagaataagcttgttaaattccaagtaattcttagattttgattgaaatgactttgaaactagaaatttgggaaaaattaacatctttataatattggctttcccattcatgaagagaattatgtctctctttttatttaggtctattttaatgctttcaataaagttgaataattttctacactgactcgaccatatttgcttagatttattcttattttatgtccctctaatggtatctttattttccaacttaatagtgtataaaaatgcaattgattattgtggtactgatctcatatctactaggtttactctattctctcattttttaaatttgtcaatacagattttctatgctgaaaaatcacaattcatcgtttcatttcttcctttccaatatattttatttgatttctttgccttattacacttgcttagattaaataaaggatgtagaaatgtgtatcatattcctatttcgtactgatctcaaaaagaaagctttcaaattttcaccaaatatgcccttgtcacatgcctgcttcgtggacactctttttgaggctaaagctattcccttacaatcttagttacaaaatttcattataaatcataatcatatttaatcaaatattttgccatcatctttcaattatatagttccccctttaatctattaacattttaattatttataaaaagcatttactaattttgaatcaaatttgccagtctggaataaatcagttaattatcaaacatttttttatatatttctggatttcatttgctaatattctggttaagatcttcatatctatatttatgagagaaattgtcctgtagtttcttttacttctgcccttgtctggttgtgctatcaagattatatatactagtcttgagtttaatattattttctattatctaatattttgtgtaagaaagacatgcttagtgtaataaaataagctggacctcgcattttgtgtgacgattttaaactactaatttaattaaccttaatatttacggaaccattcaggtgatctacttcttgactgttttgatcattcacagtcttctacaaaattatttcatattattttcatttattggcaaaaatttgttcatggtattgtattatacatttctattgcatctgtagttacattcacttttacttccttaatattacttatgcttgttttgctcaatcttgcaaaaagtttttgaatgttattcttttttttcaaagaagaaacttttgtctttaattgatgttctctattaacttaaaaaattccattctcatcttttaaaatgtattaggttaaaccacagaaaattgcaaatatttgacatatttaacctgtaaaaatggctttttcctgctgttcaacctaatatttccttttaatttctttgatttttttgtatttttctagttattgatttaaggcacttaactgatttttgatctatcttttgcttttctaatataaatactcatgactatacatttcagctacatcctatgagtcttatcagtatttttgttttttgctaagtgtttttaaaattccattataattactttcttaactcaatttatttatgggtgtgatcatgtatttttaaaaataaggaagtttttccattttaaaattcatatggtaccaaaaaagagcccgaatagccaaggcaaccctaagcaaaaagaacaaagctggaggcatcacactacctgacttcaaactatactacaaggctacagtaaccaaaagagcatggtactaatacaagaacaaacacatagaccaagtgaacagaacagagaacctattcactgccaccaataagacggcacacctacaactatctgacctttgacaaacttgacaaaaacaagcaatagagaaagaattccctattcaataaatggtcctaggataactggctagccatatggagaagactgaaagtgacccctttttccttacaccatatacaaaaatgaattcaagatggattaaacatttaaatgtaaaacccaaaactataaaaactctagaagacaacctaggcaataccattcaggacacaggcacaggcaaatatttcatgatgaagatgccaaaagcaattacaacaaaagcaaaaattaacaaacgggatgtaattaaactaaagagctcctacacagcaaaagaaactatcaacagagtgaacagacaacctacagaatgggagaaaaactttgcaaactatgcatttgacaaaggttgaatatctagcatctgtaaggaactgaaacaaatgtacaagaaaaaaacaaccccattaaaaagtgggcaaaggacatgaacagacacttttcaaaaaaagacatgcatgaggccaaaaagcatatatatatatatatatatatatacacacatatatatacacacacatatatatacacatacacatatatatatacacatatatatatatatacacatatatatatatatacacatatatatatatatatatatatatattaaaaagctcaacttcactggccattagagaaaaatgcaaatcaaaaccacaatgagataccatcttacaccagtcagaatggctattattaaaaagtcaaaaaataacatgctggcaaagctgtggagaaaaaggaatgcttttacactgttggtgggagagtaaattagttcaactattgtgaaagacaatgtggcaattcctcaaagacctacagacagaactgccattagacccagcaatcctgttactgggtatacacccaaaggagtataagtcattctgttataaagacatatgcacatgtatgttcattaaaacaccattcacaatagcaaagacatggaatcaacctatagatgcccatcaatgacagactggattttaaaaaatgtggtacatatacactatggaataccatgcagccataaaataaaatgagatcatgactttgcaggcacatggatggagctgggggccatactccttagtaaactaacataggaacagaaaaccacatactacattttttcacttgtaagtgggagttaaatgatgagaacacatggacacacagaggagagcaacatacactggggcctattagaaggtggagggtgggaggaggttgagtatcaggaaaaataaccaatgggtactaggcttaatacctgggtgacgaaataatctatgcaacaaacccccatgacacaactttatctatgtaaaaacctgcacgtgtacccctggacttaaaagtttaaaaaatgtagttttcaatactgttagttatctttttgttattgacacgattcctaacttaatttcattttgatcagcagatgtgatctgtatgaaaaattccttgaaattttattgagatttggagaacttttgcttttttttttaaagtcttaatattgcttgactttttaaattctattcatgcattatgttgataaaatttaatcaagtactgtatgaaagttaatgcagtctatttgttaataaagaaaccaacctaaaataacttcatattttaagagcctcacattaccaaaatcggtcattctacatatgtttatttatttatagactatcatgctctccaaagatttaaaaaggtgatattatgttacctgccaatagctggcattcttaaaattgtatcacaaacacaggttaccatgaaagcaaaatacaaatagaactagaaaatggagatacattttaaacttttccttgcattgggtggttttttcttggtacacactgaaggaattcatctctgagaatctggctaaaattcatttgctttaactgcatagctgcgccccagtgggacacacacacacacacacacacacacacacacatccacgcacacacaaataggggaaatggattgtaactagcagcccctggggtccaggaaccataagtgaatgagagatgaggcttctggttaaaattcaacctcttgctttcctttgggatgacactggaggatgtttcattattcttattcccagttctcatggtggcaatgatggtggtaatagcatagtgaaagcaccattgatgtgccaagccccaggccaaacatttcacatactacattttaattttcacaaccacctttgaagcagacattaatattactctttctttacagatgagaaaactgtacgaaggggccttagaaagatgaagggacttgccccatgaatgatgactcagccaggcctgtggggttcaagaagcccctgctgccctaccacactaccaccttccatacttagtctagtggtgactctcaccacactgggcatgctagagaaggcagctggtcagaaactggagctcagccctctgctacagccttgtcactggcttcctatggctctgaggcaaacgcccagatctcagcttgatcttgaattcataggtatgaactctctgtgcaggtctgtgagttctacctccttttccatgcaccttcagcctcagaggctcatcctttcctgcagtggcaactgaatggctgggttttatagggctaagtttttcagatacctccacaccccaagagtatatgtatatacaacaaaaacatcatcatggccaagcctctccaatgtcttactaaagcattctaaacaaagtatgctttaggcgttttactgctacattctgaatcacattcttctccaagcaaccatctcaacgtctcattttttccattagtaagatgattatatacagagtgatctatttataatgagccccagctcaagcagtatagctttcagttggcctcattttatataaatctttctttgttaattaatgtgtcttatcccagtgttgcaaggaacatttatgttcccgaattggacaggaaggaagcaaaccacacccaaggtgaaggctccaaaatctttagagtcaatatgaatgtaataaccgtttgaaaacaaagtttaaagctgggttttgtgcatattttaaactaaggaagttgtacaacagagtccacaagagagtaaaaagtgatgtgataattaggcggccatgaattaaccccctggtacttgcagctctgtactatttttaaagacctccttctcacctcctaagatattttggacatgcaaaatgcctaatgcgactaataaggcacctagcatgaaagttaattaatgaaaatgaaaacacgaaaactcaggttatttagtaataagggcctggagccagatcccaattaaactactcttgtggcgaagggagggatcaaaatgcccaataggttccatctggctgcttctgtgggtcaacgtagagtctcacgtccgtgtcaaattagcttttccaccctcttctttcccttgcagtgagaagctaaaggcagtcctccccacactgtactggggaactcccaggctctcccactcacatgtaaggggcttggcggctaagaaatccagctggaagcgagcgagcatgatttgattcacccgctcttcagagtccaatcccttttgtcattcactccactggaggggccccctaaacctccaatcccgtttgtaccccacctaggagatctgataatggtcctggcagagctgtggcttttcgtaacttctggcaggggcctcgctgacccataacatgacgacacacatgatttcttctcatactgtctttgtaaattgaccatggctaaccttgctgccctaatcagatcaatcagaataacatttttttagctgctgcacacaggaagcctcctgggctgaggcataactcagagtcaggctgggatacagaaggcagatttttgaatttccaatggtctcaggtttcctttgcttttatcacagttggtgagctttgtaaggtccgtgtttacagccatgcaaattagcctcagctggagggaaatcaggtcaggtctaaatgaaatgaagctctgggtcaaaagtattttatcaaaaattggaagtgtggccatagcactggggtccagccagactatcctaggaagtaagtggacagttttgtctggtgtaacctgagctccaggcctctcgaccgtggaaactctgctaggagacggaggaaaaaatggtggagggccaccccagcacaacgggggctggccagttccaccactggctgctgccgccaaatgcatttctgttatgtaaggacaactgcaaagagagaatactgtataccggaaggtgggaacattgtggtttgagtctggtttgcagtatatcccatgccgctcattgactaggtaaaaatctaaattcactgtttcaatcttacacacactcagtttaaaaatgtatgtgggaacgtatccacattcagctaagttctgagattttgcatctggaaagcatatttgcaaattttcactccagatgccatgttaggtatagaagttaaggtcagaggggttacatgactggacatacaacaactacaacaactaatagttaccttcaagacgagatctctggctgctaatttccactgcagttttctctatcatatttccagtacttcaatacccccactacataaaaaacttggtttgtttaaaaataactctccaatatatataccttacatttgggggattattaaaatcagaacaattatttcctgaacccccatgtacctatggctcatacaatatgctactgatggtttgagacagctctatccatctgattaggcctggatctgagcgctaagatattgctcaatgtgtaataccctcatctatctgccttctaaaaataaaatgaaagttggcagatcttgagtgtcttcatctgcaaagaagtcatgaccagatccttggaattcatataattaaagtttatcttttgacagatgagaaacctgagatcggagaatttaaaggacttgttcgggattcgatatttggttagggtcagagtcagaattagaaattatgtttactgacaccaaagctgggcacttttttcactatacaatgaccaaaaaataaaattcagtcttggccaagtgaatttaaagtcagaacttgcagttaaatgcagacgaatgcccatttatcaagtaattaacaacacaaggctgggcacggaggctcacgcctgtaatcccagcactttgggaggtcaaggtgggcggatcacttgaggtcagtagttggagactagcctggccaacatggtgaaaccccatctctactaaaaatacaaaaattagccaggcatggtaggtgtgcctgtagtcccagctactctggaggctgaggcatgagaattgcttgatgaacctgagaggtggaggttgcagtgactaggcaacagagtgagactttttgtctcaaaacaaacaaaaaaataagctgtggggttgttgctggaaacattcctttgctctttagaactatgtggtactacgcaagttgcccaacccctctaaactccagttttctcatgtataaaacaggaacaataataggaaccgtctcactgggtttttgatcaaattagttaatatatgacaggcacttaaccaaaattcctcatttagcagtggcactactagtgatatctttattttttaatctccacttgaatgacatcaaataaatccaaggtcattgagacttctctgttcatattaagcatgtgcctgtgagggcatgtgcaggggctgttctgactatcacatacatgggagatgtgtgtattttgcaaagcacttacaagttcaccttcaaaagcatccatgtgacctggacttgcaaccgaagtatacatatatgatctttccctattcttgttacatcttcacatacttctagcttggaactgaaggccagaggactcactatcaccatcaaggtcccaagcacaggcgctcagcctcatcctgttgtctagctccaaccccgtaacagaatctcagaaaatggcctggattgaggataaatgaatgagatttgggaaaatataggcgagacttcaaaacttccctcaacgagaagataaatattttttaaagcataaatatttagaatggttctctcatagcatatcctgtacttttttgtgttttccaaacagataaccccaaatctatattcaaataaacttttgcttttcactctcttccgatatggaagattttaaagatgtgtgtgcgtgtgcgtgtgtgtgtgtgtgtgcgtgcgcgcacgtgtctgtgtgtgtggtgagaaaggaattccagaatcagtcccaaagacgctaactctaatattccatatatttttatactgcaatcattcattctaagcactggaaccatggctactaatgattttttttctgctaataccttcaagtctttctaatatgcaattgactcccaatactctgtgtgggtaatttgctgtgaaatttggcctcatggtccacaatagagatatgagaagactaaagagagagctgggggcagttactctcttccaggttcctgttctgggggttctaggatccatgcaacttttatctttgtatctcagcattctaaggtgccctcttgtggtgtggggtaggaaaagagcatcctaaatgcagctggctggagacacaaatccagatcaagttactgttgaacagccaacaagagaaacatggttgaactccaagaataatactcagatgcagcattctgaaagaatcattgatattcatatttgacaagtcctaaccactcttttttttttttaaaaaaataagcaaataaaataaacgtacaacttctggggctgtctcatttccaaataaaatttacaaggtggaatttttgtaaactggtgcctgtcatggagctcctgtttcctttcagtaaatgcggccagtcaggagtccttaaactgaagaacaggaaagccctgatcattccagatatcactcaagaaatcgggacagagcgctagtttaggcccccaggtcatatattagtacaatcaacacatgggcaagttatttcactcacttctatagatgataatccctaaccccattgctcagttgtcaacacgtgaaaaacgtaaaggggtagacaaacctatcaccaccctcatataaaaaaactaacgcacattccttacaccgagggagcccagagaaattatctttgtacaccaaagctgaaataatataaacttggaaagcaataggttatgaaaaccctataaatttatgttcaggcttccaaacaatgttcttcttccacccttctcccctccccaataaactgagacataaagtctgggatttgagaattacagctatgatccttgccaaagtgaccaaattacaatcaatgctgaaggcttttggcaccacaaaatttcaacagactagtatctgctgaaccatcacaacccccttcccccaaagtgtttggggaatagccattatctcattaattcttaagaaatatctattaaaaagacagagacagagagggagacggggagagaggaatccttttacatatcttacagaagaggaaacaaacagagatgatttataatttagtcagatcatggcatctcaaaaaaggaggaatattggcagatcatgctgattttcagaatgtcgttgggcaagtttaaaacacaattggaaagtttatcagagcagttctttttttttttttttttttttttttttacaggaaccaggagaaagaatcacagacaatgaaggtggatttctggctccttgtcaaggtgctgacctaccttgctcaggaacaaatgtcacttagagacagtgtaaatatgacatattgacaggggaaactctttatctttcagtgaaaagagactatacaaacacgatatgtactactagatgtccgaatgtatcactaacggaagttgtgggatacttccatgaatatcaacaaacaagaataatctagagattcccatttgcaaatagttttaggaattgacacattaatgctttaagaccttaaaaaccttgggaatcaaagatgtttaagaatttctttccaaagctttcacattagttcataaactaagagattaatgcaaagaatacttaacgtactcttataatttcatattatacttataataaccatattaagggggtgttattcccaatttcgtagagaagaaatcagtgtgagaaggttaaatgactttttctgaatgttacgaaagaaaaaaataagagatagtagcaagtggtggtggttccattgacagctggtatcttgagctctggttcttaatttggttactgccatgtttgtcgtggcagagtggtctagtatcacaaatgagaatggcacctatctaagtatgcaatataaatttgtaataattagtaataaatttattttattatagctaatattttaaatggaattgataaggtcaaagaaaaacaccagctccaaatctatatatgccttttgctggagttacatagaaagcacatctttttactcaaagatttggcttcctattggaagactctgaagaaaaccatggataattacacaatgtaggaaatactttggatatgcagaagtgtggctatattttgttgatgtttttaataatggctactctcattcataaacttcaaataaatcacccgaataaaagttgatactatcaccaaggtggcaagttaccatttaaataaaggggaaatgcagacacatgctgatgaacaagtgttcatcatcatcaatgtcttcccagttaaaagtgtacaaacccctacaagtcactttatctttctcggtcttagtttcttatgtgccatatgagagaaataagatgatgggtaagatttcttctaattcctagactacatgatattacagaacaggatccctgcctagtttgagaagatatacatacatacatacatacatacatacatacatacatacatgcttaaacaagtgccagtgatatgaaatttaaatactattttagtagttgaagctagaaattagtatctgagttccacagactcttgatcattctgtccattacttctgaaatacaaacgtgaaatgtgctgagggatgaagaccagctctatttaagggatattcatggctgggtgcagtggctcacgcctgtaatcccagcactttgggaggccaaggcaggtggatcacctgaggtcaggagtttgagactggcctggacaatgtggtgaaagcccgtctctactaaaaatataaaaattagctgggcgtgatggtgggtgcctgtaatcgtagctacttgggaggctgaggcaggacaatcggcttgaacctgggtggtgggggttgcagtgagccgagatcacaccattgcactccagcctgggcgacaacagtgaaacactgtctcaaaaaaaaaaaaaaaaaaaagacattcatattcacgtttcaatgctggctgaagccctatagccaagattcagaattctggattttgaaatccagtaatgtacccagcactttctcttgttcagtcattataaaaagacctatctggcaagtatcctcctggtcttctcatatgggaaccattccatgatccagctgaaggagttggccttcaatgctgaaactcctcagctgctcaccacctctaaaaccactttcattttcaagaggaaagaaaacaaacatctgactctcagaagagaccaagggatccatcttgatgttggaaatctggccacaggcatggagcaaagattataggaggcaggtttggagttttctggcatcaattcagcttgctattttctttaaaacttaaaacctcagctctaaggtaggacacaaagctcactgaaaactctaagctgcatattaccacaaagctcagtagacccaattttttgcctccacttacagagaaaagcaagcactacacaagtgcacggattccatggggcaatggcaaccaccctgttcagaaaacttaaagagtttaaatgaagtgttattttccccctcagacagagaaacaaaataaatgttatcaagtactaactgccttaaactcctttgttgaacaggcaaactattataagaaaagaaataataaatgaccaaatgctttgatgtttaaaaacaaatattcattcaccaaaacagaagtgaatagttctatgagtaaacaacatgttttcaagcatctggagagaaacaaaaagagtaatagcaatctaagaagcaataaagaacaaaagtaaatttaatacgatcctgcataagaaagcattcagaggagattctggtgagttcaggcaagccttcctgaaagaggcaaactgaagttggctttggaatatacagattttccttttgccattcaggtagaaacaagtcttctgcttctatagatggcatttaaaaagccagcctggctacaaagcaggcttacctccatctcatatgaatctaattgcatgggaatacattctatgtaaatcagctgacctttttttgcccggatttgtctggaacttactatttgtattaatccattttcgcactgctataaagatactaccaacatggcagcaggagagagagggtggggtgagagcggcaccagaaacttatggaacaaccaaatctcgtgagaactcactcactatcaggagaacagaaagggaaatccacccccatgatttaatcgcctcccaccaggtccctcctagacacgtgggtacaatttgacatgatatttgggtggggtcacagagccaatttattagaaaaattcaaattgttccatgcaatatagccttttaaaattttcctttaatacttctttggatatttttctcaagacaacacaattacagtgaccttgagaaacattttgatcatgatttttatccgtaattgaagtcagtgggaaaatctgatttgattaacagaaaactgaattcagacattttccttttttcccctgtaatttgcagctaatttcataatcattacattacttgagaaatgaactgatgatgaaccccatgatgtaatttaacaaggaaacgtagcctggcacggtggctcacgcctgtaatcccagcattttgggagggtgaggtgggcagatcacctgaggtcagaagttcgagaccaacctggccaacttggtgaaaacctgtctctactaaaaatacaaaattagccgggcatggtggtgcatgcctgtaatcctagctactcgggaggctgaagcaggagaattgcttgaaccccagaggcagaggttgcagtgagccgagatcacaccattgcactcccacctagatgacaagagtgagactccgtctcaaaaaaaaaaaaaaaaaaaaaaaaggcagggttgatggtatcattcaatattacatacttttcaaaacactgcctcaaacctgcttagatgtgaatttcacaacatactggtgggtcaggtagattcagatattgttcatctttttttttttttttagacggagttttgctcttgttgcccaggctggggtgcaatgcggcaatctcagctcactgcaacctctgcctcctgggttaaagcgattctcctgcctcagcctcccgagtagctgagattacaggcgcccgccaccacacctggctaatatttgtgtttttagtagagacggggtttcccgaaattggccaggctggtgtcgaactcctgacctcagctgattcacccacctcagcctcccaaagtgctaggattataggcatgagccaccgtacccggcctgtaatccttttttatagagaagggaaaatacgacaaggaagacaaccagcccaagctcacatagcaagtcaatagcaacacagagtactatactttttcctcaacaccatttctgctactattaaaaataagaaaaactaaccaaccaaacaaaaacccactaaaacagggaaatggtagccgtagtagtaacagtagcaaaaacaagagcagctgtcatatgttgagcactgacagtgagccaggcactatgctgagcctgatacatggattaccccattgaataattacttagagaacattatgagcagatatcatctcaggctatggtgcagggacccagacacagagagtgaaaggacctagtaccgttgcctcagatctcacagtcaatgtgtggcagaggtgtgattcgtcctcatggttgtctctgactgcctgacagtcctaaactcattctcttacagaaagctggtgcctctcaagtttttgagtccttgagtcactactcagaagccaccgtcataatgaggtctaccctgaacaccccatttaaaattgcagacctcacccccaccctactaaagtcgaccctccttcccctgcactactatgtgattgacagggtttatgtttagtgtttgttaatataagctccacagggcaaggatttattattattattattattattattttacttttattttttgccctcaacacataccaatgcttaagacagtgctgtccaacagagctttttatacaatggaaatgttttacatctatgctatccaatacagcagccactaggcataagaacaaaattggaaagtcgaaaactggctagccatatgtagaaagctgaaactggatcccttccttacactttatacaaagatcaattcaagatggattaaagacttaaacgttagacctaaaaccataaaaaccctagaagaaaacctaggcattaccattcaggacataggcatgggcaacgacttcatgtctaaaacaccaaaagcaatggcaacaaaagacaaaattgacaaatgggatctaattaaactaaagagcttctgcacagcaaaacaaactaccattagagtgaacaggcaacctacaaaatgggagaaaatttttgcaacctactcatctgacaaagggctaatatccagaatctacaataaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcaaaccagttagaatggcaatcattaaaaagtcaggaaacaacaggtgctggagagcatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgcccaacaatgatagactggattaagaaaatgtggcacatatacaccatggaatactatgcagccataaaaaatgatgagttcacgtcctttgtagggacatggatgaaattggaaatcatcattctcagtaaactatcacaagaacaaaaaaccaaacaccgcatattctcactcataggtggatactgaacaatgagaacacgtggacacaggaaggggaacatcacactctggggactgttgtggggtcgggggggtggggggagggaaagcactgggagatatacctaatgctagatgacgcgttagtgggtgcagcgcaccagcatggcacatgtatacatatgtaactaacctgcacattgtgcacatgtaccctaaaacttaaagtataataaataaataagaagaagaaaaaaaaaagaaggtggttagtccaattaaagaactaaattattttatttaatttcattatttaatagccacgttaccatactggatactgcaggcctggaacaaatgcctagcatggtaaacccctaggaaatacttgttaaatgaatgaatttataaataaaacctattttccatataacctgtagactactttcactaactacaaattaaattttatttttatttcaacagaattaatggctgaaaaagtccagattaaattttgaaaattcagaagatatggccaaaatagcaggcacagatttcatgaactattggctccctttgccatctgccactcaaaaccttctgaaacatttcatgaaaccagggaaagcaccaacagcatgtaatgaattcctatgaatcacacacacacacacacacacacagaatatgtaataaattcctatgatacacacacatatatgtataggtatgtgtgtgtgtgtatatacgatacacacacacacacacacacacacacacacacatatataccatttccctgtataatatataattacagctttgccataatcactcagtacctttttgaccttgtttttcttctcataagtctctgacagaggttttttcttctgttgagttgtgtctttggagaataaatactcaaattcactggggtcccgaatgtcaggttcttctaaggagtcccataaggttggtgtagcattttggcttaaaagagaaaatgacaagttaaccataagaaccaaaacaggaaggaatgtaatacaatgaaatctttctctaatccattttttaatttcatttttctaaaaaaacacataaaactctaataatgcttggagaaaagctttttatgttacgcatttgttaaagtcaaaatatactatagaacattaaaacacacacagacgtatttccaaaaaagtaattgtcattagctacgatcaaagatagagctctacagaaactccttaggactagaaatcctgggattcggattcctgggggcacccaagctgctcctccctcagcctgtggcatttccatgatgtgtaaaaatgggcatcatataaaggctgagaagataaccaatttgagactgtgacaggctaattctgaaggagactgaaaatggagtaccgaagtaaagacctgcctcctctttggactttttcaactacttttaaatacagtttttaggattcatgcaggtaaactcagtgcagcgtccttaatatgtaaacaggctgtgcctattttaaaatacatgattcatagtatctcagtcccctaaacaatactaacaacaaaaaccaaccaaaaacctcctccattgcacctcatgggatatcatctaaagtagccatagggaaactgggctgtttcatcttccagaaacaggggcaccctagttttgaagggaagaaaagctcttgagaatcaggcgtaacagaacagcctccgtgagctgactccagtggtcactcctcagggttccctcagtcagaacacatctcccaaatgtttactttcttatcttaatttcaaacactattaatgtttactggtcaggcatggtagctcacacctgtaatccaagcactttgggaggctgaggtgggcagatcacttggggtcaggagttcaagaccagcctggccaacatggtgaaaccccatctctactaaaaaatacaaaaaattagctgggcgtggtggtgggtgcctgtaatcctagctacttgggaggctgaggcaggagaattgcttgaacccgggaggcagaggttgcgatgaactgagattgtgccactgcactccagcctgggtaacagaacaagagtccatctcaaaaataataataataataaatactatcaatgcccacaaatttcatctatatacttattgtttatcaaacataggtatatgttacaatccataacatctaaaagtatatagctttatttccatacctattttctcaatgaaaactaaaaagataactattattacatggaatggtccacagaattttgtaatactacaggtgattttggtatttaaaacagttggcagccctggctcctcaggtctgcgtgttcacactttgcaatagatctgcctttcccatgatatatgacattttggttttggccacattcacctcttctctcctctactttttattttttaaattatgatttcgccaatagttgaaccatgtaatagtatgacatatggaagttataaagtataacaatagaatgaacacctgggaaaccattacccaacccaagggctagaacatttccagtgaagtacatccatgtatgtgttcctctctcagccatacccctctgctactcacttaacttcaacttgaagcataagcaccacggatgttaagtgcttatctctgtggtgctgggggagacgggggagaagtaggatcttgaagaaggaagtcagctgggaattctggagtgagcatgcggcatgttaagggccactggtctgggccttgggaaggttctgggcagctaaggggtgacgtctagagtgaagtgatgcagagtgtcaggccaactgctcagccccatccccacttcctgcacctgcttggctctagccccacggactctgaggtcaggccagtgtaactagtattataattcacttatattctggagtaaattggctttgggagtcaaccgtgatcagtttaagcacctgatcaccatttacaacactatttctatgggaaaggtatttccaatactgaatgaaagaattttggaacactgcctctcagtgattttgggacagccagcatttggtagggcaataataaggacgtgcttcccaacgaatgacctgccatggtggtcaactgaccactgaacatacaattctagctcaaaaggaaggcagggggagagagagagaaagaggaggaggaaaatgagaaacttactaagaagctgaaaaggtagttagatgaggatttatttttccttaagtgtctcttgcttattctagaaatcacgaaagagacacccaagaaggcaaaacgtcaaaagaaaaaaaatcagttcataccaggagtcaaaagcaatttaggtagatgagaggcagtgtacacataatgctgaaaattcacattttgtttctggcttcccagaagagcaagaccaacatttatgatgcaatcattatataaactacttaatcctctagttgcacaaaatattaaaatatgattttgcctcctttatgagaaggtatcccaaataattgcacttttgctcctaagcaaatactccacaggctctttgagtcattttcatttaaaagcagtagtgctaataggtacaaaaagttggagggacccataataaaagaacttgaatatgtggtaccaccaggaagtgcccgtgttgcagtcttaacacatcatagaggggcagccccccgtgttatgtttcaggttcaaatgcgcaccaagcagggctctcttgatgtcctattcatctacttttcattttgctcaaaagtaaagccctagatttatgatgaaaccagtgagaccttcagtattcaattgcttttcttctcaaaacggccaactaaatgaggaggaaacaatgtagacaatgattgtctccagctttcccgtggtcgtgggtgaagggcccacatctcccagtgggactctttgatggctgctgtggtccacagttacctgttgctcatgaagtctctcagggaaggaagtgaaggcaggctagtgggacacaggtgtggaacagctccccgtgctgtcggacacactcgtccagggcttacaggtgggagctattgccctggaatggctgtgcactaatttgagaacactaatacggaaacatgactcaaaataaatattctgggaaatgattttttaggaaatgtctgagtctttattgggaaaaagggaatactagtactttagttaatggcagaagctattacaggatcatctcacttttttatgaaccattcatttgggaaattacaaagtataattgaattttgtaaaaaagaagtatcaggatgttccaaaaacaaactcttggcccttattttttggtgagaggaaaggggaaaatatgaagcacatatgcttagttttagggtattccccactcctccacagggatttctggttgttttatcattgtgagttgtgtgttattttgtttcatatcctgccttgcctaagcaaagtgttatataaattgaagaatgcattaccacatgacttgggaaaagctgtaaaatgtgtcctatatttgctgtcctttacaaacaaactttaaaggagaaagtggtcaagagacaacttaagatctctttcactgtcctccttccaggctcagaaataaggcagaacaaatcacactcaaatctgtttgaatggatgtttccaagcaactatatcttgctgctttacaaacccagcttaacaatctatacaaatggaagatgctttcagctatccacatactgacactttctctgaagggcatcaagacataaaggaagatgtgagagtacttagcagttaaaagaaacagagttcaagcagagagagtttgtattttaagactctcctctgatctaaagaactaataacttagccatgtctcattcttttaataaaaactgaagaacacccatttctgttaaatatctagattatagggttgattatagtatttaaaaacaagacagtaaaaagaattctaaaaatcctcagtgaacctacagtatggaaatcaggttcaattctttatgattactaatcaattgtagtgatgttggggaaagctttggcttagatccggactcttgtctagtctgtaaaatggaacatttgccttggaaaaaaatctgacactgaaacacatggtttctcccagcatcttcagagaatacagagaggccctgatggagacagacaatctccccaaacatcccaacattgtttatccaagcattcactgtatcacacttgataatgggtgctacactatggagatattgacccggtaagaataaaatatcacttgggccaaatcctaggaattcacatgctgagaatgggataggggagaacttacctcctatcacttatttgtatcctagtccaatataaaggcttcatgggacaactgggctcgatggctggttttcgaggacattgactggaagaagagccaagtccaaagaagagtccagggggaggtgggggtgcaagtcctgggggtggtggagcaggaggaggccctccagggttgggtggggcaggggagttaggaagtgggggtgggggtgggggtggtggaggtccagcacttgaaggtggaggtagaggtggcggtggaggaggcggaggtggtagcggtggcccagcactcacaggtggcattggaggtgcgggagacaaagatccaagtcctgaggggaggggcggagggggagggatggatgcgggaggcggaggcaatgccttctgctgatttgatgccatgccctccattggctggagtgctgcatggatgtctttgtggtcatttgggggtgagagctggcttaaagaggagatattcagctttttgggtactaattgattacttctggttgtcttgctttcactttcacagggcttgaggaaggtctctctgtctgtctggacgcacacatttctgaaggtctttggagggcagtcatcatcggtggaaatgcacacatctttcctctcttcacaaccccctcgccatctgtgttctagctcgtgtttcagattttcaatggtttcttctagtctcgctgttatcattgcatgctcgccccggatatgaaatgcccgaagttcaaactgtgcctataggaaaattcagagggaaagaaagtaatgagtttattaagaacaaacttaagaatttagaaactcaataataccatcatggtgccactgtagcatggcccacataaatgcagggaaatacagagacattcttttaagaatccataaaggtgtaaattgcactctgaattttccagggacctaaacaggcaggagtcaaagcacaatttcaaccagcctgagctcacgggagataattttcatggattaaggcttaaagtacatctattacttaagaactcttacccaatttgcatatcaaacacaaaacttttaataaagttttggacatgcttgaatatctatctgttttacaacttttcgggttggtttcaaaaaagaaaactataaagaaaaaaataggtttagagctcctctggcttagagctgttctcccagtcttccagaatgtctctttcactgagtttccaggacaatacagcagacacagaaagcaagggaagaagccacgataacttacttttttaaagtttccttataaaagcagcccaagatcagtatttgtgtctgtttcataatatagcaataaataaggaacagagaacataaataatgaagatattatagtatgccattttcttctatttacacagcactttaaagtatataagacagtagtagcctttttaatgcttattgcctcagttattttaatgcactgagtctgtaattgtacacttattagcacagagctagtgtactcgcagtcattaaccagcccgttcctcagcattcaaagctattcatcctattacagttaattggaaagcaaatttagaattttattagagttttcaaaatccagtttaacagtaattaaatattttttgtcaatttatttaatttctgcctcccccatgagattataaactccacaagatgaaactggtgacagtattgtctttctatctgtatcccagcaggtagcccaggaagtacatacctcagcagcaatggatggataaaaatcactgggatagttatattcactgtcattgtcactgtcccaagagcctcccttatcaagactctcttcactataatttcagcacaaatatctagaacacctaaagcatgcacaagtacagctcccttttgcattgaaaaagtaaagaaatattttaacagccttggagggaaaggtatacacacaggaagctcatctaccttcattgagataacttttatactatgatgtttgcatagttcagcagattgaattatgaagagatctaccatttgtctggtgttaaaaaaaaaaaagataacttttaactattttttactaggttcaacttttctctaatattcattctcaagagcaaacccctaaagggctatagtcaggagaactgaaaggcgaagtttttcgaaggctcatcttctcatatgtggacacggtctgagccaactctgagggaaggggctagctctggacaccgtctatttctcgtgcagtgcagagcgctgagtgccgagtttggactcacaccacctggttcacgtcttggcttaggcacttgcgagttctatgacctcagacagggaacgctgtgtccctaagcctgagtatcttcaagtgtaaagtataaataatagccatctctaggacttttataaaagtaaaatgagatacttcatataaaatagtaggcattatgcctggaacacagaaacgtttggataaatcttactgttagtttctgttgctaatgctaatgctaatagcagagcaagagactaacaaattcctaattattttttaaaattttcagacaatgctacctttgtagagggacaggcataaacctaggaaaagctcaaaatcaggataagcaaagtactgcaaataccaaagtttacctagccttttgtgagttctactaccgattacctaagtaatttcgagcttcactcaactgtgagatcgagataatctttgtttcaacatcgtatcatttccatcttcatttctctctctctttcctgtccacttccacccacatcttagccctgattaccaccctgaattacccacattttaatttcattctaatgactagttcggttctgtcacaacaaactaactctcagctgttattctcaactaaaccttctttcaagattaagaatcaaatattcaagaagcagtaattttactcaatcctcaacttcttaatgatatgaaagagtttcaaagacatactgcatggtgaaactttccctaataagggaaatatttttggtgaacttattgagtttctgcctcccctatcagattataaactccccaagatgaaatcttgtatctagagcaaaagccctggccccacctcctcttctttctaccactctgtcaacgatcttctaaatctgttgaagctgacatgtaaagctatatatcattttagcagctctgaggtaaggcatttgtttagtgtagtgggcagaacacaaatcgggcagttaagttcacctctctgtacctcagttttttttgtaagctaaatggggataataaaatgtacctgacagagcggatatgccagggaggcaaattaatatacgtaaaagaaaatacagaagagtgtttgcagcatagtaagtgctatttcagtttgccgtcattattattctctctctaatgcctggcagatcagagcccagtggccccattagcttgctcttggctctgggtacgcttcccagccccatgccctctactgtctacatgctctatgcttctaaagcaaaaatagacataccaaaatccttcttaaattcctttagctatggcactttccaaccctacctcttttccttcgcagcagaacttttttgaaaaaagcacttgacccatgctttatttttgtcattcattcactttcacccaattactggctttcatctcccccatcctattgaaactccatgatttgactgttgcattcaatcagcacttttcagtgattttgacctctctgccacatttgttaagagttgactgttgcacaagcattgaaattctgcttccctgaactcgattccacctctctccttttgttctcctcctacttctttgctgtccctagtcaatctgtagactcattcatccttaagtgtggttctcttggcatcttccttgccatttttttccttatcacactatacaatctttctagatgatctcatatactcatataaatgacaccaggtgagtaccttcaaacttggtaccttgagatcatatttccaagtatcctctggattaatctacttaaatatttaaccagctgcctcagatccaacaggttggaaagtgaactcattgttgccgaaccccaatgtgttcctcctctgaaattcctcctcactattaatgcctcatcgcctccagtcagcacatccagaaacctgatgtcatgctgaatttcttgctctctctcatcctcaacatgctatttgtcaagtgttattgatttctcttgtcacccccaccacctcaatctttcactggacaaaggcaatgagcattttcttgactcaaattcaaccactttggttccaagaagattttgaaaaaataaataaataaatgcagatccctagtccttaaaatctcttcaataattagctttacttgcagactaacatgaactttttagcacacacacatcaacagctcttctgatctgttttctgaccaacttctccactattggcttttgtcccttccccagatatgccctggattccagtttcctaaacaggtccatgctctttcatgcatctgggtctttgcaaatactgtcctcttccaatacccttcctctgttgcaaacactcaaggtagggggcagattaccaggcacagactccatgaatgggttcctcacatactgtattcactgatatggagaatgaccaaataagaaggaaaacaatgaatttccatgtaccatacaccaatatgctgcaatgatagtaagaaatctttctggatcactaaaatttaattgcctctctctgcccctcaccccccccaaaaaaacacttgtctttgacctttcctgtttcataatctctcttgatcattacaattttgtcttggttgtgttcatgacctcagtgtggcagagcaactcaaagtgattaaagtaataagcacctcattcattctctgtctgtccatatcataccaattatttcaaattgtgtctgactctattacaaatgaagcatctcaagttcatgcataccatgcatggaagttttgggaaagctaatctttaaacactatttttaattttatttcctgttagtaccacttcactttgtacctggatattatgtgctgttccccctcctttatccagatacacagctagaaagactggtaatgatttggtgattctaatacagagtagaacgttctgttagataatcatgtactcccaatctttgcccaggatcctgggaatcttcaggaagtgtcaaaaccagtcccttacaaaggaaactacagataatgccaggtcaaggaaacaaaatgcctttatatcctgttaactttacttatacattgaacatgtgcttgtaagcagtatccaattataaaccctccatttatttttagaccaatgttctttaggacatataaagaaagtctcaagatttcccctctctcactcttcctgctaaaaatctgctgatttgaccccaatacatcatttgaaaagagacaggtgctgaggtttgatatctttccagtctttaagttttacctaccttcctttactcttaatttgtttgcttcaattgctttcatttttaatcacatcctcttctcacctgcaatagtctgttataatatatgtccatctcttaataagaaagattcaaacttactagctttgagaggacaatgccaattaaaccatcctgttttgattaccccttttttcctagtggcacaatttttacctttctaataaagtggttctcaagccctgctcccattagaatcacctggagagttttgtggatgacactggtgctcaggcccatccccacagaccctcatttaatcaatctgagatgatgcctttgcacaggtgtctttaaagcactgcaagagattccaatgggagccagaggtgaaatcaacaacaactgttcttaatccgtattctgctctaacacagctgagatagtaaaacaacacaatatcaatgggttcttttggcaatgactttcacttaggtcatttcagaatctccaaagtaatgtgttatttggtaaagtccctttcctaattgtgattgcccaataaagggaatgttccttcattgtctagattgagaatagttattctacacagcagacaagcctaaattctttccatgatactcatggctcttcaaaacttggcctctgcctactttcccagatatttccctgctcttttcctatgctataccactacagataaccaacactcatatcttcactctttcacacatgctgtttcatctacttagagaaccttttatccattttcgcctggtgaaagccctgaaaaaaatgaaatcaagctcaactgaatcttctggcttaaacttttcttaattctgcttgacaaaagtattcctttttgtttccaaagaacattctaggttcatgttgcattatactcatttctgtttatcttctttgcaaatctaaaaactccaggcagttggggaccacaatttaatcatatttgaacctccagagcatcacacactgcttgcctagttagccatccacaaatgcttattgatttctttagtgttaaatattaagacttcttcatgcctctgcattacccatccatttataagtgaaactccaaaaaaatttaaggagagataaagatccttttctctttgctattcccatacacagcaaactcttaagacctgttagttgtcaactgttagacattacttacagactaatactgaaactagagcagacatactaaacactcttctgatctcttttctgttacttgctccgcttttggactagaaaactcataaaacatccaaattttttttttaatgaaggtatttctaaaagttgatgttgatcatgttagttttaataattcaaaatacttaacgtagataagaattctcttcacagtcagctcaaaggctattcccatacatatcataaaccacccggtagaaatgaaccacatttgtgattctaatctgattaggaattggactctagcaacttccccaggcctcctttggggatggttctcccttcccctaccaaatcctcattattttttaatatcctccccattaccactgctcagagatatcatcgaaggaacacactgtactaaaacccaagcaacagaggagacttttgcttgtctggtccccacaagcatgtctgtcaaaaagaaggtggaaaagcgcctactgatgaaagacatcgtgttggtgccaagcactgtggaaaaatcatccgttagcattttgttgttaaaaacattctctctaggtggtgctgccagggccaataaaaaatcaggttatctgctgtacaacttaagtcagtcagtcttttccagggactcttccaaattctacatccctaggctggggaaagctaggcagttcctgggggctgcatggaggctcaacaaagctttgtcacctctgaaaagtgcagcgtgagcagaagaaaggaaaggaaagtgaggcttgtgagcacaaaatgcctcgaaggaatgggattcagttcttacagaatgcttaggtaaggcaaggagatggcgattctatggctttggacatgcatacgagtttcttctgttttctttttgaaggctgtccagagacttcaataatcccttagttaattggcttatactagccactgtaaaaacaaaagtttctattaatgaagagaatggcattgggtttgatgagaacccataaattaacaaaagctggttttaattaactattataatttttttgtccttatcagaaatgtaagcacatcaagttacaaccaaaaggccatgtcaaggacacttagaaacatgaggcacatttgacacatttctgtaattagaacttgctgggagggataaagaaatagagaaacagggcaggaaaagaaggggtaaagagtaattgatatgaagctgactccgagtaaaacccaatgaatgcaatgctggagagtacacctgtgtaaaaatggtgctgacctcaagtaatcacctgccatgctgatgctcgagaaacacaagaagagaatccaaaccaacatggcgtgagtgttccaggcactatgctagccttcatccttgtgactctgcaaggcagacattctgggggacgttaatctgtataagatcccacagctgaaaaatagtaacaaggggatttcaatcctggctgatataaaaatttatgctctttctgccttaatattttgaatatcagatgactccctaaattgatatccagtaatactaactcataataattaattagtaaaactacattccacctcttacaatgcatttgcattacatcaatgcatataattataacaacaatctgtgagaatactggtattgtggctgttttccagatgaagaaagagaagcaatgaggaattaagtaaatcgccaataagagatagactaaatctactatccaccttatcactgatcctcaatgattaataatccttcccatgcaatatattttaggaagtcagtatgccaatacacaaaaaaagatactttctagtcacagatgctttcctcaaaatatttgccctccatcctcctgaaaaagatatggaatgattaagtaaataattgatttgaagtttcttggctctcaggtggaaaaagcattgggttcaaagacttgagttctattcctggttatctcaatcattagttacttgctcttagccaattttcaaatttcctctaagcctcattttatatatgtctgaaatgagaggtttaaaatacttagtcattaagatttcctgtagttctaaaacattagtaatttccacacccaagactctcgtatcactttgtttcaaagcttctttgaacacatctctattcataaaagcttcataagagcttaaagcatggtattatctaagcaatataaacagatagtcccaagcctcattatgaatgcaaatgttcacacaaaatcagattcaagaaggtactctgaaaaccagtgataagtatgcaatttagatacaattattctttttttttttttttctgagacagagtctctgtaaccaggctggagtgcatggcacaatctcggctcactgcaacctccgcctcccacgtttaagtgattctcctgcctcagcctcccaagaagctgggactacagatgcatgcccccacgccctgctgatttttttattcttagtagagacagggtttcaccatgttggccaggatggtctcaatctcttgacctcgtgatcccctgcctcagcctcccaaagtgctgggattacaggtgtgagtcactgcacccagcctattcattaattttgaaaggtgatagttaattacaagttttaaggaatacacctttaaaatcagcaaatataaccatggatagtcatccaaggaagtagcaggaaagtaaaacagatgtttgaaatctgcactgaggtttatacttgagacacaaaacaaaattgtagccagagtgcattttatgaaataaaaggcattattactcatcggggaacttcagtaatattttatttctaaattattaatatccaaaatataagtcacaaaatggatatatatccatggaaatgactttcagactctatttttccaaaaagtagttctaaacccaatgagcaaaactaagactgcacattttaggcaatgagccaacatactaattccttctctattaaaagagagaacttgcaattttatgttgtattattattatcactactgaagctgcagccagtccaatgaggcattacacattctagagtatatgcaagcttagaagaaacagatgataaacccaggtccttaatacactgtgacaaactggggttctccaattaattaatcattttaatatttccctctagatgcctcacacacttgtctataaacggatactatcccatggccaatgtccacctgcacaacagtatcattttgaaaaccatgatgcggattcctcagtcaggtttgccttacatactcccaacatttagtacatgtcttaaattggaattcggtaggaaatgaaaaaatgatattaggtcaattatatagaattatcaaatggagtcagttgatataaaaaggggccagctgttgagttctttctggtgtaaaagatgaaacttatacataagactctaggagtactgactagaaaaatagttcccgcaactttacaaatgatacagctctctgggagcaagaaggggctcagaggagtggttggtgatacatcttctgctatgagcttactcttcatagtggtgctgtataaacctggtagaatgcaaacaggttttcatcacaacaaagatggcctccctaccagccaatactcaaacaagctttgatgagcatctgcaaagtaccagatcctgtggaaaataagaaaccattcgcccggcatggtggttcacacctgtaatcccagcactttcggaggctgaggtgggcagatcacgaggtcaggagatcgagaccatcctggctaacatggtgaaaccccgtctctactaaaaaatacaaaaaattagccgggcgtggtggtgggtgcctgtagtcccagctacttgggaggctgaggcaagataacagcgtgaacccgggaggcggagcttgtagtgagcggagattgtgccattgcactgcagcctgcgcaacagagcaagactctgtctcaaaaaaaaaaaaaaaaaaaaaaaagaaaccattcatactttcagaagctcacattctaggtagaaacagtaatatatttgtaagttatgatgaatttccaggacaactgagctggtgtgagttttacagtgctattatttttactattattattcagacataactttttccttgacaactgaagaaaacccaggacctaccatcaaatgcatttgattcatccagcaaaagcataccaaagtcatttgtgttcactgtatcccatgagcagaatgctactccaagcccaaccatgcataaaccaacctccctgaattaatttttgcaagtaagcaaggaggtatttggctttccactttcattacttaaacaaatgaccgatgatgcatgcatggatcacaatcaccttctccttgccactttgagttttaccagggattagtcacttgagaaatctgccattgaatgggttttacgttataggcaaatcgacagggcaaacaaacaaagagggtttgcttgtctttctttatgatttgggttctggcttaggatgcctcctctaaaagaagctaggaggggaagtgttttaaatttccaaaaattgctcaccctagccaaaaggcacactcgttatacaagacataagatgccagaaagggatcacaaaattgaatataatcttaattccttaagaaatggacccaaagagaaatattttctgctagaatttgagtgtctaggtcagtttgaaaaaaaaaaaaacaaaaacctaaaatagggtcacagcacttggctttagctctgcataaggctgctatgtaaccttaaacttgctttatatatctgggttttattttctttacaaaccaggttttctagggatccaaagaggtgcttcagttctgtaaactcagttttcacactatattaaaagaacatttaatcttaaatattgtgatttttaaaactgtacagtattatgccaaaaattttacacatttatataccatcagcagatctactactggggtacttggttaaccattttctgttttgttttgttttatttcagtctttggaataccaaattttctctgatttcctgaatctatgtctctaaaatggtttcattgattagggaaaattataactggtctattttccttccttttcttttttcttcttttaaaattcagactcatgcatatacactttgggaggccaaggaaggcggatctgaggttaggagttcaagatcagcctggccaatggcaaaaccccatctctactagtaacacacaaaaaattagccgggcgtggtgatgcgtgcttgtaaccccagctacccaggaggctgatgcatggaaattgcttgaacccgggaagcggaggttgcagtaagcagagatcgtgccactgcaccccagcctgggcagcagagtgaaactgtgtctcaaaaaagaatgaaatacatttcttataattcatgtttaattttagagctcttttattttattcaattctattcaaaccctgggattttaaaaggaaattttttttcaaaaaatgtttccatttgtaactattttgtaaaatgtgatttttaagattttctgtaactaaaatattacattcaaattaattaaattctgactgggtgcggtggctcacgcctgtaatcccagcactttgggaggcggaggcgggtggatcatgaggtcaggagattgagaccatcctggttaataaggtgaaactgcgtctctactaaaaatacgaaaaaaattagccggcgcggtggcaggcacttgtagtcccagccggtggcaggcacttgtagtcccagctactcgggaggctgaggcaggagaatggtgtgaacccaggaggcggagcctgcagtgagccgagatcgcgccactgcactccagcctgggcaacagagcaagactccatctcaaataataataataataataataataattattattattattattattacattctgtgctaacataagactcaacagcctttgagtcaacttttcagtcaactttgttgtcctcaaaaaagcatcttaatgaaaacacagaagaatatacttaggaccttggattaggcagagttcttacatatgccatcaaaaacatgattcatttagcacaggacagcaaaagcatgattcatttaggatatgttacttagcttgatttaggcattccacaacgtatacacatatcaaaacacaatattgcacacaatgaacatatacaattgttgtcaactaaaaaattcatttttaaaacagcatgatccatttaaaaactgatcaattagacagaccctttcacaattaaaattttctgtttgttgcaagtctctaagccacacagggaaaaaatgttggaaaacaaataacggacacaggacttgtttccagagcatagagagaattcagttaaaacaaaaataaggaaaaaaaaattccctccacgctccaaaaataggtaaaagatctgaacagataatctaccaagagagatatacgaatagcaaataagcacataaaaagatgttcaacatcactagtcatctcaacaggaagacacaaattaaaaccacataagatatcactgcacgcctattaggaggagggaggagagggaggagtgagagaagaaaacagaccaacctgacaataccaaatgctagtgagaatgtggaacaactagaactctcagattgctgatgggaatggacagtggtacagtcactttggaaagcagtttggccatttcttataaagttaaacacacactttccatatcaactatcgatcccactcctacacatttgcccaagtgaaacaaaaacataggttaatatgaaaatccatatactaatgtttttggtagctttatcaataatagcctgtgatggttaactttatgtatcaacttgactgacccccagggtgcccagttatttggccaaacattattctggatgtgtctgtgaaggtgttttggatgagattaacatttaaatctggaggctgggtaaagcagattgccctccctaatgtaggtgggcctcatgcaatctgttacaggcctcaatagaacgaaaagactgactctcccactactaagaaaaaattcctcctgcccagtggccttcgaactgggacataaagactttcctgtctttacacctgaactcttcttgggtcttgagtctgccaggttttgcacaggaactacacccccagccctcctgaatctcaggcctctagacacagaccacagctatactgtcggccctcctagatctccagtttaccctgcagattttggaacttatcagcgtccatcatcatgtaagccaattcttcataataaatctcttcatatacattttaaaatattcacattaatatatatctatatattttacgtatacacgcacacatagacgcacacatcctattacttatgtttctccggaaaaccctgatgaatacattgcccaaaattagaagccacccaaacgttcttcaactggtgaaaaaataaaactgcggaaagtgcaccaagtagaatcctactcagaagtaaaaagaaatggatttcaggtagatgccaacaatatggatgagtctcaaatgcactctgttaagtgaaaggagctgactcaacagactatatattgcatggttctatggatatgacgttctggtaaaatcaaaactgtactgatagaaaacatcaatggatgccaggagcctgagatcagaagaggggttgtcttccaatggacacagggaaattgtttacggtaatggaaatgttctacatcctgattgtagtatgtttacatgactgcacatttttggtgaaacctcagatggtacacttagaacagcaatttttttattacatgtaaaattatatctcatcgaaaaaacctcttaaagattgatattataagtgaaacatatatgttagatgaattaaaaattgtaaaataagtgaacactaatataatgttacataaaagttgggcttccacagcaagattctgtctgcaacaaaatctctctctgttgaaaaaagacattatcacagaaagtagagtaaaatgagtccgaaaagtatctaaagcattactcacgtcttaaagagactcaagtgttcaaatttcttgaggtaaaagtttaacctctttcatcaacactacagcattttgcactactatgacccatcttttagaggtttctctgtcgaggtgaattcagcgctaagacaggatcagtagtaatcctctaagatggtactgccacattcagtatcattcttacattgcagctacgtgggaacatggccaggcaagggggtgaatgacatttaaaagctcaaagtgttaggcacaatgttatgttccatttaacaccgtgatgtctcatttcttcccctgtctctacagcctgttttctaccgcattatacttatgatgagtgtgatttttttcatatttcatccataaatgcttccaaacaaaaaaagtttctgcttttataagaaaaaaagacctactactatcttctattctcaagccagcttgaagatttttttttaagttttgtttttcttaagccagcctccaatgcaaggattaggtttagcttaaaggactactttgggttttttattttcttttatgcaatagattaatattttttcttagttttaaagaacaccacctatcaaacagatagtctgtcccacagtgcaattagcacagtttcctcctatacttaaaagggtctccaagacagataagggctattattccatcaatatagtaagctgcaaattctccctcaggttcctactctgtaaaatgaggatgataatacccaccttgcttcttgatatatttttcatggggagagaaagaaactcagaagaaacttcacaacaaatataaaaacactctgagtaacaatgaaggattaatatcatattggatacaactaacagcaactatttgggattatagtacattatcaatcagaagctatgagcacaacccttacatctacgtatggtttatatgtttgtttagatggtggtggccttagagaaaagcgtgaacacattgtggctaagtgaaattcaacatttttttctacacaaattgcattaagcaggatccatatgtcatgagaatgtaaccttcattgcatcatccaataaaaactaggaaatcacttgtgtacaagacacactgaagttttgttgacattttttgcaagcaattttttaacatatttattgatacgtaggtcttctttcacccctacctaaaaaagtgcttaaggtctccttttctctgtttgttcatccatcaccaaaaaaaaaaaaaaaaaaaaaagaagggcaaaacatttgccttaactctatcccttcttcagaataaaatcccccattgtattcattaacaaatgttgcgcgaaaggattagcagttacttattatctttttatctttaccatacgctctgtgtaatttctccaaaggctggtttaggttgccaccatttgctaaaaatgctcacatagataactaacagcttcctaaactacccaatttggtggattttttcctcattctcctttggaactctgcacagcttatcttgagaacagcctcttggattctctgatagtacaaattcctggtcctcttcctccctttgagattatcctgcctgctgtgctaacgtctcttcctccttccatcttttaaatatgtcaactttatggggactcatgtttttattttttgttcactgatgtatcactgtagcaggggtcactgaatgaatgaattcttccaatatcctagttgactgttagaaatccttaaagctatagtgcccacgactactgggttctgttagcaaaagaaaaccaaggaagaaggaactgtaatattaagtagtgcccatgaacagcctgttacatacatgataaaaactgatttgtatgattactgcaattattcctcagccaggtcacagctgctaagtgcatagctgactgtgactacattcttttcaacaaatctggcactcttaagtccaaattgacaggtctatctccacacagacatggaagtttgttttgtttagtgcccctcccaactgacttatcttacaatatggacagggcccagatgacagtcgatcaattgatctcaaatgggtcaaaataaagatattaatattgccataactgtgaatgcacatcacattttaattggtaagaatttttatagttctaaatatattcccacttcaataacattaaggggccaatgcaggtgttttcgtccatgtgcatccaaatgttaggagttatttttcactgagagacaacaagatgatgggaagaggggtcatgaaaatacgctgagcaacaaaaagagccttgaaacagcacccacgataataggggttatagatttattctttgtggtggcaaggctctttttgagttcctgtatacaggcaattaagcttaccaaaaatatccagttatggatctatccaggaagaggcagaagtttctggagctgcacttgtttcatgtggaatacttgcaattgaggacatataagggctgacagtgtacaaatgataaagtgtatccgttgaggctaagcttatatgcttgaaaacaacagtgagaaccggaataagggtatttttgagtaacaagcaaattctaaaaccccacagagaagattccctgaccacagggcatcaatacccatcatttttacaaatagttttggcaaagtgtcacactgatttatttgaattcacaaagatctgatgtaatatttaaaaacagatctcttctttgtgtaaacatagattaagaaaaatgtaaatctcccatctaggtttattttttaatagaaattttaattatacatgtataaatctagagtgctcaatgccttaaccagttaaaataataaacggaatttggcagaacatttgttctgattactagatgtttaatgatacttggaacatcaagatgcatgtggaattacactctactaagatgaagacagaataacttggaaaagatcagatctcattttgacttgattctcttctcctggaatatagacaaaccacattcttttcctcccccaccttagattatactatattacttttgattgatattcatctccataatttgtgctttttgaaagaataattgttataagaattacgtatttcaggttttctctagtaattggaaggtatgaatttaaatctgacttatttcctaactgatcaaacatggactataatttatgaaatattttcaaaataaacatttaactatcctattcaaacttgaaatgtcacttcaattttagtttgactgagggttatagatggctacatttttttctcccaggcaatttttctattttaaatgttattagctgcccatattaataatgtgaaaaggcagagacaggataaccttaaaactcatacatcattttttcttaagtgtttcaaaggttaatacctaaccataaaggttaatgatacaaggtcagctgtataacatccacatgaaaccacatgaccgctgtagcgtttcataccattgacatgttgctgttttgtggaatgtatttgtcagttacaagagatgacatgcttgtttggtgccatgtaccctttatgaaaaaatgaactggctcaagtatccatgccagtcatgtactccgaataattacaaactacttcacactctaaatatttagatcactaggaatttcaacgttagaccatcacctttcccccgactgcacatcagagcagaaggctttctgactgcctgtccttgaacataacactaacacaacatatgaaactgattaggaggactgaggtgtttgaaagaaaaaaactttgatttttataaagattggcatgaagatcattcttctcagttgaaatttactttgataaaatacacccccttctcaactgcagttgccaagtataaaaacaaatgcctactttcttctgaatcacttttttatatttgtctcatgtatttttcagattttcacatcagtgtaacacaggtaagaataaaagcatagaattaaatccgaatatttacctatgaagaaacacttaacaggccagtactaaaacttggagctcataaaaggggaaacatgtctttctgtcgttgagtataatttagtttcaaaagatggttttttgggtttgctatgcaaaatcctctagcaacagtcacagtttctcagtactggtgttttaaagttctttgctttgggtagtgcctcgttgcaggtttaggagaaaaaaatgttaaaaggtattcctgacagctggcagcctgtctctccagtttttttttttttttttttttctttttttaggtaattaggttgctaataagcagggagtgagtgatgctgttggactccaatgtttgattctaggtcacagtaggacatagtcaatctggacactgacccatagctcacaaatcagaaaaaaatcatctgagaattagaaaataatctaccaagctcctatttgtaaaccctcaatacaattcttaaccttgcagagataaagcgttggggaagaggaagtattttacaaccttttaatcttaaaaaacaataaatttgaaattgagcaaagtatttgaaagaggtggccttactttcctccaactgatttatacattcgtaacagaagcgtgtttgagtttgtgtcatctgaagattctgctcttaaatatgctactttaaacctaagacagcatattctcagtacaactcaccattatgagttgagtgatggtttttctgcccatcacttagactgtagtcaacactttatctttggcagagcaatttccacatggcataaatgatggggcaatggactgggaagaggctcgactttcagtcatggtgcttctatcagtttcctgcctgcgtggtcttgagccctcttgttgctaactagaagtaaccagacggtgaatcttacagggtggccaacttccttggctacaataaaccccgttgttgttgtgatcatgtcacctccctttaatgtattgagaaagttgagaaccattaagctagattctaagaccaactcttttaccctttagctccccatctataaaatgaacaggtttccaaaatatcacaaattcaagtaagtctatgttgcttccacttaagctaacgcaaatcatcatgcaaatgttgtctaaacgcacaacatctgataaatgcacatttaagacagtcagaaacagtaaatgtcattctcccagcagaaagtcataaactgtcaaaaatatcttttaaaaaaccttctggaaacacagtttttccactacagttttcctttgtctctgagtttgaaaaatattacctgtgaaatcactttggtttacatccagtttccactataggggaagaaaggaagaccaaccagtgattaatttatagactaatgcattactgtgatggcagattcaactgtttgttgtttagtgaaagtttatgtccgtcatgtacatgacactggggatggaaggtaggtggaggtacctctgctttcataattataatgtgagaactagtctgctaagtgcctaagtcaattcaaaatttccgaggaggaagccttagggaattagagatggtttcatgtatgatgaggaacccttgcagggcacaaagaattggcaaaggtaaaatgatgattgtgagaaatccaagtgaaagataaaagcatgctggagggaaagtgtagggaaatagcggaagagaaaaccataataattccccaccctttgtagtcaagtgcagtttagccccttcacccgccccccaccaaaagaaagaaagccaagataaattggagggtcttaaataccatgctcaagactttgaacttaacttgacagacagtagtgagccaccagaggtgttttaagagacgggcaacaacctaaataatcgataaggtgggctgaatacacgcaagctatgctcaaggcctatgttaggatgatgggaacaggatgccaagcagtgagtatatatgaaaccacagagcccagattaacataatttggtaatcaactagatgtgaagcagagggtgcaggagttgtcaaggatgcatctgaggtttttggcctagacttttagttttaggagaaccatgacaccgtacatatacagggtagctaagaaagcagattgctttttgtcatgtttacattgggaggggaagaggaggaggattcagaaggagacaagtagatgaaaataaagatccctttctatggtgggcttataaaactttttggatgctctggttttgggaattttaaatttgagatactaaaaatatttcccagtgtagctttccacaaaaacttatctgtaactcaggaagaagtttgaattcaaataaataggtctgaaaagcacttacacagagataagcttgtggcaataagggaaatctccaagagacaaaatataaaaggtcaggtgactaaccagccacaatttggcgtgctgcagaggcaacactgggagggcagcaaagaagatagagaagcacaccgtgaggaagaagaaaaaaactgcagaattcgctgtcccagatgttgagggaggagttcgaggatgtcaacactgactctccaggatcagagcaaagaaagaaagacagataggagacaagtagcacaggacaattacttcatctgtttcagtagagttggaacggaattcaagtggtaagataatttgctacaagtcattaatgtttaagaattttgccagtgagagaaggaatggaaggtcaaagcaacagtatggtcaagagaaaggatttctaatgtaaaggatagctgaatttattactagaaatgggggaaagcacctgctaaaagaacaactgtattagtctgtcctcacactgctgtaaagaactgccccagactgggtaattataaggaaagaggtttaaccgactcacagttacacatgcctgtggaggcctcaggaaacttacagtcgtggtggaaggggaagcaaacatgtccttcttcacatggtggcaggaaggagaagaatgagagtcaagcaaagggagaagccccttacaaaaccatcagatcttgtgataacttactcactctcacgagaatagcatggggtaactgctcccatgatttaattacctcccaccaggttcctcccatgacacgtacggattatgggaactgcaattcgagatttgggcggggacacagccaaaccatagcagcaaccaaacgagaaaagagcagaagcagcagtagatgatatcaaagagaacaggtgaagaaacaccagccacctgcctttcttttcctatgcataaggccaaacctaacaaccaagcaaagaaataaaggcatttatagcccatagacaaaggccctcattctttattttctctcggtttcagaagaaatgccacctctttcttcccagaatctcctgggtccctgatttcgctgtcttctacattctcaggaatactttctcatcaacttattccttctggccagctccctgctttacctatttagatctcttgctggaaatgctggactgctcaggctgtttcctgcaccatctacatctactgcatattgattctcatatgctgcatagtaacttgacaaatattaccctacatgatctaaacaacactgtggtgaaggtaggagccccaaattctggaccatcgaaaatcacaatctagggagcatcagggctgtgattcaaagctgagtcttctgctgcagcctcgtgttctttctcctctgcagggctgtctcttgatgctggtcaagatgcaggcagtagactgtttctatctaaacattacaaacgacttggcttgctgtcagacacctaactttaaatggctaaaatcgcttgataaatggtgtgaaaattttatggtccttccgtcagacaccgtaatttattatcacataatgcacagttagaagaaccaaaagaaaccatcccacaagggcaaacaatgtggaggcagtggccctttgacactcaaaggccacaggcattatatggatccaataagagagctgcttctacgaacaagagaacaacctcttgatcttgcaaaatatttttggacacctaaaggctcttttattactgtggctgattaaaatgaaaagtttaaacgactaaaatgttctttttgatgagtttttaccatgaactatagaccttgtagtccagggggattcaagccctttgatcctgcgtactcacataaattcagagtcataaaacaacattggatttgattttactagtgtagctgatgttgccagatttgtaatgcaatcttgttttctcccctccttgtttttgagcccatccaccattgttttatagcaaaaggaaaggagtttccatttggttttggcaatccagtttcaagactgagccacttttctagaacgttggaattttacagaaaaataatggtcctgtattgtatccatcaaaacgggaatcaatgttagttttgcatgctgaaaataaagtatcaaaaagaaaaccctcttctcattataataatcacagattttcattacttaagatggttagaggatgatgtggttgagaacaatagtataagtatgaagtagaaaaactggtgtgatttagtgtttataaatttccctcaggactaactgaaaataaattagaaatatcaaaagatgcccaatttattcatcaatggcagattatagatcatatcttagtttacaaacttaagaaaaaggactggtatctgtgggagaaataaagaaaatgttcgataagacatatgtttaacaaaaagacatgcagtaaatataacttagatgtttaattcactttcttctaatatcctaatcattttcctgtgtgtatgtgcaatatcatattcctataactcctaagacatgaaatttttactataaagggtctatgagggaataagaagacaattttattaaatctatgttataaagaccataacaatcaatagtgggtcataaaaatcgttcatttttacggagtaaaatatcagtttgggctcagagagatcaatgtatatttagcctattcactagaccaagtaatactaatttaacagttttcactaactttatttttcatggattgcctgaaagatgaaacatttctcgccaagattgttctgtaagtgacacaggacataagggtcatgtgatacttcaacaattctaattggaaaagagtcaccatgtaagggatgcttcattctcctagggacaatgccttgtgacattttcagctgcagtctcttaacacctgctgaggccccagtgaacatttcagaatacgattcattcagagaaatatcattccaatacacattcacttccttgccatttggtatgaatatattacattaagccatataaaattgctgctttataagtcaaataggtcaaatatcagcaatttaatgcagttcaacttataaacttcatttagcaaatttgaaaattatcattgttctatgttttctcagttaatcctttaaattatgtctaaaggatctatttgccatagataagggtcatgccatatatagttttaaaacaaaacaaacagaactgtgttatacagacacctactgcagctttcaaagacagtacaagaaactgccccctgtctacagagacaagtaattgttctggtggtgtgtatatcaaattaagataagagaagtgtatccagttaacaagagctttctcatttcatgctcaaaagggtagtgtgttgtcagcaccttcttcctccctattaattcattcaagaattatttattgtatatttaccatgttccagagggagaatcaagctgtacacatttacagacaagcaacaatgacagttttcatggttccagtttcagcagaagcaaccctcagcaccggtagaaaggtaatgcttgttgtcagagagcgtaaattctctcttgaccctgtcttagagccactacaatctctgacttggacagctgcagtactccctgctgtcctctccacatcctctctgccctcctcaacttgtcctctgcaacagcagccgggggcggggtggggggggtcttttggaaatgcaaatctcctcatgtcacatattcctctgctcagaattagtcagtagattctaactgttctgaagatgaaattgggaaaccttaaaaagatgtacaagacccttccagaatcttgcctcttgcctttctccaccgcactgttttcaacccataggccatcatcgatcagtgagatagcatattaacatatcaatttgtgctttatccagagcatatttagtaagagttgaatatatccgagtatgttacatgcaataaattgttgaatagaactcattcctctctctctctctctctctcacacacacacacacacagacacacacacacacgtaacctgggtctcgatataaattacattgcttattctgggttgtagtataaaaaggttgaaaaaatcctactccagagctacatttcccacctctctcctgtttttcctgtgctttggccacacaaagcttccctgcagttctctccaaacaagccaagcttctcttcactcttcaaacctctgcttaaaggtcagttcctaagagtatccttgtctggacccatggatcttaattagaccccatcagagcagctccacagcactcatcacattatatttattggctggttattttatcaatatctgtttctctgaatggactacaagctccaagagagtggggcctattatctgtcctgctccctcgagcacctagcacagtgcctggcatccaggaagcactcaatcaatacatattgaatgattgagaaagacctctatttccttttgatgattccattcttagatgaaacggatgatcaagttcataaagcattattttaaggtggtcctttgtcatttgttatatagaatgtacctatttacagccataaacatagcatgtactgtctctgtaagtacattaagcactgcctatgagtatggacttatgtgcactttgctgtgcatgtttttctgtaaaataaactaacaatgagttttcatgtgtttaaagcaaaaactcttagtataaaactggaatgtgtttcaatcatcaaaagaaaatgtatctagaaagttaagagaaaaagggtcaaactgacctccagtggtgagattgtggaatgactcctaaagtaattgtaaaatactcagcctatcacacagaagcatatatatatatatgtatatatgcaaaacacatttcttaataatacttcaaattatgtttattataccaatttgcaggagatataggtcatgccatatattgtatcaaaacaagtagaagtgtattacatagacacctgtaacagctttccaagatagtgtatgaaattgccacaatcagaaaatctaagtcttggaaagaatcttagttgagatctgagacctaacatcagcaacttctataaaaagttgataattttaaaatgttaacactcaaaaagtctctccctccattagtctctgcgtaatattaggtcctcagtgtaagctgagtgttatttagcctttatggtataaattctgttttcccaaataaatagtaaatcctctgagtacggaacctatatgaggattaaataaaataatccatggtaaatgctaagtgtagtgtctggcatatagcaatatgcaacaaatgttatctgttattatcatcattattaccatcattactaaatgatgttttatctctagcacatctcttgtatttgacacgtgctcaattggtgtttaccaatcatgagagagataaagtgtaagaagccaagttatgtacatgaaattatagtttagaaaatttgtctttacagcaaaaacaattttaacacgcaattatcttactcagaaccgttccccagatctgtgttttaactcttaggctgcttatacatattcagatgtttccttcataaaactatggcaacagtaatatttcctaggaagaggcaataatggaaatgagcacatcatacttttataacatatgaaaagcaatgctcattggagaattagatataacagtaaatacagaatgtttcttttacctcggcacatagcttatatggaacaaactttaccatccaaaaatacactttgacagccacagacttagagtaaactaaacatgctgctgctcataataaacacaatagttatgatagataggtcatctaccacatgccattgtggcccagtcccacctaagctatcccaacagttgtaatcagtcaaaatgaccaagttacaacattgtcacacccactttaaaggtgagaagctgaagctcagaaaggtttaaataatttcttcaagaccacacatctagtagacagcacaaacaggattcaaactcagggaggattacacacctgtttttctatcccactatcctacctagggttacattgcattttgtttaatgaatggtcacttgacttcattatatgagtttatgcttcagcatgttctgattctaagggccatcactcctaaggacaaatatccacccaaagatagatcagaggcaaaggtcaatccagaatcaaagtcacatcaggaatattctcactaggcaaggacctttaagatcttccagaggcagttcagtgtacagggtaagagggccacctcataatggtgtaatagctcattcactccttatatataaagactggcacatagtaaatgctcaattaagtaccaaatattattattgttattcctccaggacacagaggaagctacaacaaattgcagtgaaatggtcaaagcacacataatgttacgcgcgtatacacacaaacacacaataaattcacactatgaattccaaagtctatgaggttggagttgttagaagcagcaactagtaccatttatcacacatgaacacaccatacaaggaggtggcagcatagagaacacagctgaatcaccccataggcctgttaaggaatcagcagtgttgggtatcagggactatactggagaagattaaagttaaagaacagctgagccccgatgttcaaattacaaaaatcgtaacgaagaagtaaggagctggcaagctgcatagaagtctagccacagtattttcttacccaatttacaatcttggaaattaacttctatgagattcaggtttcaaatctctaagataaatacaggcaaacatcaagattatggtgacaagtattagaggcacttcctcaaactgggctcaggaccagctatgagaaataaagctggaaagagaaatttcccacctgctcctttcttccgtacctcagtagagagaacagaacaccttatttctgaaaccagtgaaataaaagaactctattgtttatttttctttcctaacactacagaaatatcaccgtctttttttttttttttaatcacatggggaacttgtgcagatcatcctttattcctaccttgtacaggtctttgacacaggacgagagaaaaaattaaaacttaaaaaatcattatactaggcagtgaatacatatcaaatttagaaaccaggcagacctggttgatgaatctagccattctactgaccagctgtgaaagctcaggattgcacttgactccgctgggtctcaggtagttcgaaattatctacgtgaagcactgagcatggtacctggcacagagctggtgcttccttctcagtagccaggattataaacatctccaattaagtcaaaaagcatggggtgctcagcatttaatctctcatgtcaacacaatctcttaccatgccttcctgaaaatgttctagaacacagaccatacccaattttttacactaagagctcatctttcacttacacttccaaagctgctgccctttcaattccttcaatagccctttcaggaaaggacagaagagaggaagaaagggaaagggcaagagggaaagaaaagggaaaagaaaagacacaaatgtaaatgtccataaatatctaaaagctcaaggaattctgctttgtattcgtatgttcatgaaaaaaataaatgttactcagcctctttatcctctgtaccagaagtcacaatctcagatgtctacaggctccaggcaatcaacataagtagaggagactggctataagatgatagtaagtgtggggcagtactttggcaactagagcatccatgctttatttgaaaattattcaaaggaagtttttaaatgttattgtgctcaatgaataaacgtctctgggctgtatttgatggtatcacaaatttaagaattctgcagctttcctaatgctaccccccaaatagccttctacctaaatactgtgagtcatgaaaaaatttccagcaatgtccagtcagatcaattaacaactatttattcaatttcagctagttgcctagcactgatctaggtaacatgggaaaagaaaatctcctaggactttggattgagttgggacagatgcaggggcccactcttttcccaggccagaaatgatagaactttgaagctagaaggaaacttacgccagctactccaatgcttttactttacagctgaagaacctaatatttaagagtgatgtgtgattgtatagaatttacagaattattgagtgaggcaggacaagtctggagagaaggaaacactccccgtggtgctctaccatgctttctcccatttcatgaagagtcaaaagcaatggccaacacgcagaaactcaccggttccagcagtagcccgtcacctaaagtcaaaaaacttttgcaataaaaagaaaactgtcttggtccacctgtattgactcatgttcaggggttaagactcagcagaaatgattgaaggctgatggtgcatgaaggaaatgtctaaaaccatcattggcccccatgatacaaatgagcaatcaacattctacaacagcctccttctatatctgaattgtctgaaggcaagacagtatcttgaaggctgagacaaagggctccttttccatgaaaattcaagtccaaatgtacctaccggattctaggtagccagtcgcccaagaggaatctcaacactagtaaaccagtaaatctagtaacctcacaacatttcacagtcacactaaaatgatgaattaacatatttctcaatattgtctattttttcctttttggcatctcagtaatgaattacactaatatcagcacttaggggaataccataagggttttatgaaatcatcacatttcatacttgtgaaagttttgtttattggcctacaaattattccctttccctcacagtattatctgggaattaagagatttaaatgtattgtgttgataatgaagaatacaaaaaaatggaacaggcttgggatttatgcctttataaatttcgttgtatcagctcaaatagagtctgcactcaattctgtttcaacagcaatgtgtaaactattagaaatggatgagtggaatgtgttggccacagtaaaatgaggaagtctacaagtcttaatggaggccagcataccatttcattctcttggggacaaaaaggtacaatgtaagttaattttcagtttggcattgatccctggatcattttgcagtgggagttaccaaactagaaatgtgactgcattgcacaatgagcagggggcctgccagaggccatcgctcagtgaagtttcccctcaattaggaaatatgcatgtgataaatggggtaaacgaaaaagattcccgtaaaggaaatgtcactattggctggttctttgtcttgcatcccacaacccaaagaacattagttaaaaacagatacaacaatctgtcgtttccaagtcctctactttcaaactgcttaaggtgttggtcaaaaacgatattcttaagctaccagctcctcacaagccagacaaagggcatgtacttttctttcttcccctttcaaaattgaagaagtagagatccaaagaagtcctactaatcccatgctcaggcttcccttttgtcataaagatttgggtatcctacagagtttcacttacctttccagagctgcatcccttcacagagtgacacatctgagaagacactggaagattagaggactacattcagagtgtaactgaaaacctaaacacattgctccacagaggcaagtagatggactagagacctgctgactaggaaggagaacttccacgagtaactaaaaggttaaaaacgggaggcagtggctggacgtgatggctcacgcctgtaatcccagcactttgggaggcagaggtgggtggatcatgaggtcaggagatcaagactatgccggctaacacggtgaaatcccgtctctactaaacatacaaaaaattagctgggtgcagtggcggccgcctgtagtcccagctactcgggaggctgaggcaggagaatggcgtgaacctgggaggcagagcttgcagtgagccgagatcctgccactgcactccagcctgggcgacagagccagactccatctcaggaaaaaaaaaaaaaaaaaaggaggcggtgtaaataggaatttagggctgagcatagtggctgacacctgtaaccccaacatttggagagagaggctgaggtgggcagatggctcgtgcccaagagttcgagaccagcctgggcaacatggagaaactccatctttacaaaaacaagataaaataataaataaaggatgcaaccagaactcaggaagtggattatacattgagaaaataagattatattaatcaattagggtagtatcccaaacaatgggtttcttgaagaaaaaggattatgttggaaataagctatacagcattctctttatagttcttccctgtacgtggtaaagctcaaacacagcaatagatatttctcaaatatatttgaccatgaaaacattttgtcaagaggcatttcaaagtatcactgttcagtggattctgtcttgggaaaagctagtttagaccaccctgatataaagcacacaggcacaagtacagcaggaagatcacagacaagtcacccttaaagaataaatccacggccaggcacagtggctcatgcctgtaatcccagcactttgggaggccgagacgggtggatcacttgtggtcaggagttcaagatcagcctggccaacatggccaaaccctgtctcaactaaaaatacaaaaattagctggatgtggtagcacatgcttgtaattccagctactcaagaggctgaggcaagagaaccgcttaaatctgggaggcggaggttgcagtgagccgagatcacagcatttcaatctagcttgggtaacaagagtaagactccgtctcaaaaagaaaaaaaaaagtgtagcaatttacatttaccttccccttatagttcaaaagcaaagatttattgattatttaaatgaatcaatttctggtacacatgtttatacacctttacttaaagtaagtacttggatgattttgccattcaaatctccagcgggagggtggttgcaggtcatttcccatgacttcactgttttatgtcatttataatatccacaacataattcttcagttttgtccaagtgcgtcccccctcatcctcctcctcctcccacttccccccccacctccccccatcctcctcctcctccctcctcctcgagtttagagtggtctttgtgcttttttttttggttgaggacatatttgggacattggactttcctcctcctccccctccccttccgcctcccccttccccctcctcctcctcctcctcttcttttttgatacaaagtctcactccctcgctcaggctggactgcggtggtgcgcgcatgcagcatgctacaccttttgataagctagtagcaggagcagccttgtgccctttccatactgcaccactcaacgaatgctggctgcagagcacacatggaataaaaaccctaagctcccccacttactgcccatggaactacagggtaaaataatcaactgtccaatccaaatattttaggtgatagggcttgcattttgctggtgggggaaactgaacaattaagtgatttcccttcaagtgtatggttaaaacaaaatggaaagttctctgcttatttaggttctctgcttattgaatcatgctgttttctttaaattctatgaaaacattccaaaaagacctaaatgtgatacttatcaattcttgtacatggtgacagaatgagtcactttttcttttgtactttaaaagcatgaaacccttcttattctagaaaggcatgttgaagaagtctggaaacatatctgaattctccataacttgtatatggagaaagaaaatctaacaatgatagctgccaatggaaatcacatgtaaagcatcaacatatttttcccactcactatcttccactaggtctgtgacaaaagatgagtccactacttagtgaaacaaaacaggtaggggtgatattcagtgagtactcacaagtacagctagggtgggtttttgtctgttcgttttacgaacagcatctattttttattgtattgatgccaaaccagttgtctcattttattttcagtatcacccagagtacaggggtaattaatcaggcaggtaaagtggcccagagagcaccctggcaaatgagaggtcatgcatcctggtggaagtgaatgcctgcgacttagccccagcaggttgaagtcatacaagaaaataagtcctttggtgccagcttctccaagttttaaagcagcagctagaaatccaggttttatataaaaatctccatattttaaaatatttattcctagttcaatctttaaaacactgtgtttgccaaatgaaacacttctttgggtcagattagagaagagggttgctggtttcctactgagggttgtccatctgtgactgctagaatagtttaaaactacagctaagtgttcaacatacgaaaatcaataaacacaatccagcatataaacagaaccaaagacaaaaaccacatgattatctcaatagatgcagaaaaggcctttgacaaaattcaacaacacttcatgctgaaagctctcaataaattaggtattgatgggacgtatctcaaaatagtaagagctatctatcaatatcatactgagtggacaaaaactggaagcattccctttaaaaactggtacaagacagggatgccctctctcaccactcccattcaacaaagtgttggaagttctggccagggcaattagacaggagaaggaaataaagggcattcaataggaaaagagaaagtcaaattgtccctgtttgcagatgacgtgattgtgtatctagaaaaccccattgtctcagcccaaaatctccttaagctgataagcaacttcagcaaagtctcaggatacaaaatcaatgtgcaaaaatcacaagcattcttatacaccaataacagacagagagccaaatcatgagtgaactcccattcacaattgcttcaaagggaataaaatacctgggaatccaacttacaaggaatgtgaaggacctcttcaaggagaactacaaaccactgctcaatgaaataaaagaggatacaaacaaatggaagaacattctatgctcatgggtaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaatcctaagccaaaagaacaaagctggaggcatcacactacctgacttcaaactacactacaaggctacagtaaccaaaacagcatggttctggtaccaaaacagagatatagatcaatggaacagaacagagccctcagaaataatgccgcatatctacaactatctgatctttgacaaacctaacaaaaacaagcaatggggaaaggaatccctatttaataaatggtgctgggaaaactggctagccatacgtacaaagctgaaactggatcccttccttacaccttatacaaaaattaattcaaaatggattaaagacttacatgttagacctaaaaccataaaaaccctagaagaaaacctaggcaataccattcaggacataggcatgggcaaggacttcatgtctaaaacaccaaaagcaatggcaacaaaaccaaaattgacaaatgggatctaattaaactaaagagcttctgcaaagcaaaagaaaccaccatcagagtgaacaggcaacctacagaatgggagaaaatttttgcaacctactcatctgacaaagggctaatatccagaatctacagtgaactcaaacaaatttacaagaaaaaaacaaccccatcaaaaagtaggcgaaggatatgaacagacacttctcaaaagaagacatttatgcagccaacagacacatgaaaaaatgctcaccatcactggccatcagagaaatgcaaagcagaaccacaatgagatactatctcacatcagttagaatggcgatcattaaagtcaggaaacaacaggtgctggagaggatgtgaagaaataggaacacttttacactgttggtgggactgtaaaccagttcaaccattgtggaagtcagtgtggcgattcctcagggatctagaactagaaataccatttgacccagccatcccattactgggtacatacccaaaggattataaatcatgctgctataaagacacatgcacacctatgtttattgtggcactattcacaatagcaaaaacttggaaccaacccaaatgtccatcaatgatagactgaattaagaaaatgtggcacatatacaccatggaatactatgcagccataaaaaatgatgagttcatgtcctttgtagggacatggatgaagctggaaaccatcattctcagcaaactatcgcaaggacaaaaaaaccaaacaccgtatgttctcactcataggtgggacttgaacaatgagaacacgtggacacaggaacgggaacatcacacaccagggactgttgtggggtgggggtagcggggagggatagcattaggagatatacctaatgctaaatgatgagttaatgagtgcagcacaacaacatggcacatgtatacatatgtaacaaacctgcacgttgtgcatatgtaccctaaaacttaaagtataataataatattaaaaaaaaaaaactacagctaagtgtataaattggatgtaccacccagatggcaatagtgagccatggtggccatggctttagcaattaggtaaacatcataaatgtggggcaacaacagttgtttaagtgtactagtatcatcaaaagagcagatgatttttttacagatggtttttaaaaatctaaagtatagtttggaacatttttaatctttactactgttaatcacaccttagtctaacctgtattttaagtgcagatcatgatcacaatatactttccttcttccatatactcctcttttccatctccaatcttttcttagtttgagatatataagatcataagacttttgcagagacagaatgagataatgtgcttagaacaatacctagcacacagcaagaattaaaaaactgtaagcatcttctgttaccaagaatattattccactgtcaaagccctcgccaggctggtctacagtttgtggaaagctagggttaactgttacaacttggctgttaacacaacttctgcttacagaatcacttctgttcctgccctctttaggaatctgtgtcttaaattatcccctaccaatttcagttcctctgaggcagctgacaatcttttttcacatcagaacaaagaaaaagaaagagaggtctccctttgtaacaagggagataagggcctccctcctctccttttcttctaggagacagaggtacttttccacttttttgtttctttgtgaaattgactcattttctctccctaactatttaaactctgctggatgggtagggcttgaattcatacaccatactacttatcgaataattttctgctacttgcaataacataacatataatccaatacaccgactcagttatttttaaaagcacattatcattcattgaaaagaaggatgttttcatatatctgataaggggttaatatacaaaaaatatttaaggaattcaaaggcaagaaaacaaacagcctgatttaaaaatgagcaaataatctgaaaatacatttctcaaaagaagacatacaaaagggtcaaccaatatatgaaaaaaatgctccaacatcactaatcatcagggaaatgcaaactaaaaccacgatgagatatcacttcacaactgttagaatcgctattgccaaaaaaagacaaaagattacaagtattggtgaggatatggaaaaagagaacccatgcacactgttggtaggaatgtaaactagtttgtagaaaacagtgtggaggctcttcaaaaaaattaaaactagaattaccatatgacctagaaatcccactactgggtatatatttaaaggaaatgaagtcagtatgttgaagagatatctacactctcatgttgactgcagcgttattcacaaaagccaagatatggaatcaacgttgagtgtccatcaatggacaaatggttaaaaaaaatgtggtttatacacaaaatggaatactctagtctttaaaaagaaaaaaataatcctgtcatttgctacaatatggatgaacctagagaacattatgttacgtgaaatatgccaagcacagaaagacatggcatgacctcatttatgtgagaaatctaaaaaagtcgaactcgcaggaacagggagtagaatggtggttaccaggggctaggggcagagaggggtgaaaagtggggaaggattagggagatgttgatgaaaggagacaaatttcagttagatgtgagaaataaattcaagatgatcttctgtacaacatggtgactatagttcataaccatgttattgtatactttaaaatttctaaaagagcagagttttcgtgttctcaccgcatataaatgataaatatgtgaggcaatgtatgtgagacaaagtatatattaattagctcaatttagttactccacaatatatacatatttcaaaacatgtcatataccgtatatatacaatttctattcgcaaactaacaaatttttagaaaagaaatgtctgatccacagattgattaaattagcagtcatgagttaacattaaatgaggaaaaaatgttactgaaattttgctgtcattctctcctgaagcagggggttactgcagccatcagtaaacaagtctcagtgcctgattcagtatccagttatttgaagttaagattctgaactttctgccacaggcactacaagcaaatgccaaatacagggaaagtcaactagatggcagcacaagggaaatgatccctcagtcattccgggcttcacaagggaggatcaggtcaacaatttcccagcactctctgaggatacggaagggctcagaactcctcctcctccacctcctagggctccttccttaaattttgtaatctgcatcacatcatattgcagggatgtgctaagaaacatacagacatgaacacccgaacaagaggaagctgaacaaaaataacttccatcgtacctagaaaaaaaaacttctactatattttatataacagcagaagtctattccatcttctcttctgctttaaaaataaaataatcattttccaatccaatcaaatgcatttatggtattttttaaaattagaaattgaattctattaaaaacagaatccaagacttttcattccctgtatagacacagtgcctactggcagctgcaagatgcgatgctgtctagtttaacacttcaacttaagaggaatatttacttcagcataggagaaaaccaagtatcagttctatagaacccgttcagtagcatcaaagaggcatacctgcaggttttcaatttcttctttgtgctccctcttcaagtgtaaaatagcagcttggtattctgtaaaatcaaaaaagaggccaattataaagaagtacaaaattaagcacaaaatttatctactggtcctcttagaaataaactgactaaaataaatgccacaatttgacatcaaccttacaagagatgttaaaaattacagaaagataggacaagtagttcagggtaaaaggtaaattccttccttttagcaaacgctgaattacgaaaagacacaaattaagcagatgggatagggttaaaagaaaaaaaaagggatgatgagtgtgttccagataaacactaggtcaggagtttgtatttaaggagttggaaattaagtccccacagaggacaaatacagacatcttaagagcagacagggcaggaaacaaacgaaaactttctatgtgagatcagagcactctatttttaactctgtttcaaaaaagaaaaaaaaaatctccatttgaatgcaaggctaagtaagcacccagggctgattttaatctttatctcagaaagtcaatactatttgtcatttggatgagagattctagggtgaactgaggctgaaaggacaaaaataaatttctggtccaattttaatatgagtctaataatgtttatttcaacaataagtcccaagtgtacgtaagaactccagccaaccactaaaactatcattctgctggcgaagcatgcagctgtcaagacaactttatttccagcagaaattctaggtgtgtggggtcatggaactatacaggctgcagagaaccacaagacaaaaatgctatgagcacacatttttgtgagataagccaattattttacaaatgtgtttggggtcatgagtatgagtaagcaagaagcagtttgacctcattgaaatatgtgtgaaagccaggctatttctccaagtagatttcctaaatcaggcatgaaagtttgtgttttaatttaaaaatggaagaaggaaatcattggcaaagccacgccagaaaagtagtgttgctgctgataattacggctagatagacctctactgttgtggggaaggtgctccactgagctgtgaatccatcagaaagttctgtgggttctaaatccaaatcatacctcgaatggtctggtagtgaccacttgtcattatccccaccagcaccacgataatccaagttaccaccatctccactagattaaagcagtatacttctggtagggtgcctgcttctacttttagcaccactgtaactgatgctcatcaaagcagactgagtgatctacatagacatgaaccagatcatctcatccttggtttttcacgcaattagagtgaaatcagagctctctgttgcagcccataaagacctccatgtcctggttcctacatatctctccctatcatttcataccactccttccccttgttcatcatactccaccgtacactggctttcttgccattccttgaacttgtcaaattattttctatctcaaaatctttgctaatattgaaaacaataataaaggatttcatttgctgactacttactatatatcaggcattattctaagtcttactttatcaactcatttcatctccacaataaccctatgatgtaggtaccattattgtctccattactgatgaagatactaatgcatagagacattaagtagcttgatcaaggaagtagaataattttcaaagccagtaaacatgcttcatttaatgggtgaatgcataaacaaatgatagtatgtccatatgatggaatactactcagcaataaagacgaatatatgcatcaacatggaggaatcttttttttgtttgttttttttgagatggagtttcactcgtttcccaggctaaagtgcaatggcacgatcttggctcactggaacctccacctcccaagttcaagcgattcttctgcctcagcctccagagtagctgggattacagcccaccaccatgcccagctaatttttgtatttttagtagagacagggttttactatgttggccaggctggtttcaaactcctgacctcaggtgattcacccccctcggcttctcaaagtgcctggccaacatgaagaatcttaaaggcactatgcagagtgaaagaagtcagtctcagaaggccaaccactgttcaatagcatttatatgacatctagaaaagacaatctagagggatgaagaacagatcagaatagtagttgccagaggttagagatgggggtttggggagggggttgactgcaaagtggcagcaagcaaaggaattttagggataatgatattagatattattctctgtcctgattatggtggttgttacatgaatccatacacattaagttcaagaaaaagtacaccaaaaaaaggatgttaatttgttttaaatctgacattaaatattatattggtaaatattttccctgtaagattcagcataacacaacaatacctgctactattgttgatattcatcatttttctactgctactagcagatgtaatggatgagaaaaaagacacaaaatctacatagattataaagagaaaaaggaaggtattattctctatgttcatacatctagaaaaatctaaaagatccaactgataaaatattagaatatgcatgtttagcagagttgcttggtattatcaacaaaaatatacaaaaatcctcatagtagcagtttaaaaaagaaaagcataacacttacagtacttctaaaaatacaaaatacccagaaaaaactcaacagaaatatgtaaagacctcatataagaaaatagtaacattttattgacatattttactaaaaaaaaaaaaataaacgcagaaagacaagtgggcaagccatgtttctgatttataagacttcatattgtaaaggtgtgagtcttcccaaactgattccttcaaaatttgagttttgttttgtttgaatataaggagcccattctaaaatgcatgtggaagcatgaaagtgcaaaatgccaataagagccaaggaatgcatgaaaatatagactaagttaagacaacttaccttacctcctaatgagaattatttttaattcttacaatgtaattaacatggcatggtacagacacagggattaacaaataggctaataagatagaatagacagtccagaaagataccatgatttatagggtcacttgatatatgatagaaatagcactgaagatcattagttacacaaagaatgatcttttcaataactattggctgggaaaaaaatattctgttcctttcttatggaaaaagacaaaactggatcctaaccttatactataatctattagaagtcaattaagtgctaaactgtaaaaagcaaaattgtaaatattttataataattatcttataaaatttatcttatagcatagtattttacagcctcaggatagaaaaaagatttcttaatattcacaaagcaatatatatagaggaaaaaacctgataaatttgactacattaaaattaagaacttatttttcttaaaatataccatagagaaacagattgacaatagatcaatctatcatcaatagagataacattccctacagagtgggagaatatacttgcaacaccatcaatcaagatctagtgtaaatatataaatgcatcctacaaaactatagaaaatgaagcccatgtgaaaaatgagcaaaaagcatcaacaggcgctctaaaaagatgatatacaaataataactatgttaaaaggtgctccttattagtaatcaggaatatttaaggtctgacaacagagccttggtgaagatgcagaacaatggaaacttccatacacttcacttacagcaggagtgcaaactggtataatcactatgaacaatgatattttctaataaagttaaagatattaatgctttcttaaccaacaatcctaaccttaggcatacataagtaacaaaactatgaagaaaagcaacctgtcagtggacagcaccaaaggaagcattgtctctcttcccactgctgtcatgtctgcacatcagagtccctcaaagggcctgaacagctgtggaagctcctcatcagagggttgggctttgaaaccaccgataagtgcctgaggaatcattttgagcaatggggaacgctcaagaactgtgtggtaatgagatccaaacaccaggtattccagaggctttgggtttgtctcatatgccaccgtggaggaggcagatgcagccatgaatgcaaggccacacaaggtggatgaagagttgtggaaccaaagagagctgtctaagaagattctcaaagaccaggtgcccactcaactgtgaaaaagacatttgttgctggcattaaagaagacacagaagaacatcacctaagagattattttcaacagtatggaaaaatggaagtgattgaaatcatgactgaccgaggcagtggcaagaaaaggggctttgcctttgtaacctttgacaaccatgactctgtggataagactgtcgttcagaaataccacactgcaaatgaccacaactgtgaaggtaggaaagccctgtcaaagcaagagatggctagtgcttcatccagccaaagaggacatagtagttctggaaactttcgtggtggccatggaggtggttttggtgggaacgacatctttggttatggagaaaacttcagtggtcatggtggctttagtggcagctgtggtggtggaggatatggtagcagtgggggtggctataatgaatttggtaatgatgggagcaacactggaggtggtggaagctacaatgattttggcaattaaaaccaccggtcttcaaatttttgatccatgaagggaaaaaactttggaggcaaaagctctggttcctatgatggtggaagccagtactttgccaaaccacaaaaccaaggaggctataggggtagcactagctatggcactggcagaagattttaattactgccaggaaacaaagcttagtaggagagtagagccagagaagtgacagggaagctataggttgcaacaggtttgtgaactcagcaaagcacagtggtggcacagggcctagctgctacaaagaagacatgttttatacaatactcccgtgtatgggcaaaagagttaaggaccatatttgtgattagttatataacaggttattttaatttctgttctgtggaaagtataaagcattccagccaagggttttaatacagtggtttgtctgcacccatgctatcaattgctaaatgtaatagtctgatcatgaagctgaataaatgtgtcttttatttttaaaaaaagaaagactagcaagcaataatattaacaaaactaagaagaatggtggtttccaggagaagatgaaccaagttgggttgtgattgagcaaggagatgttatatgggtgttaaatgaaaaattattctttaaattggatattttttacgaaattatctttatgcatatctaacattaaatgaaagaaaaaatacttctcttttgaaaactggttacattcgtttcctcaaatatcaatataggcaaaacagaacatctgaattcataaaataagaagcagaaagtgacttagtaagtttaaatcttgtgtaaatgttgagtcctaacccatgtcatgataaatatccaaaccctaaccaattccaagcttctacaaagtagtcaaaggaaagctacttaaaccaagcttcttgtgaaattgatgtcctttgagaatagcatctacattctaaatagaaattatacagactatattttgcaatgattcattttgtgtaaattgtacctatatgggtgtgacagatatcgctatgactaattcattaacaaaccgatgaaggagactactgcaaagctaacatctaggaaagcatgattcatctcctcctttaacaaatatttttaccaagagtcccagtgtgacgggtggcaggaaacacactcccatcccaacaaggatgacagaatccctgggcagcatgtagaaggaggaagctaatgcctttactactggcattggtgaatgctcactttgagagttcacaagagagtagtaagagaatataaaggttacagaataatgtccatgagtcaaaactaagttagtgctttccaaatgtgtcttgttagtggcagccccctgcccccagatgcttcttgaggcttgcagatgcctgagtgtgaggatggggaggcagaggtgtcaactcaagaccaaggatgtgtgtatttgttaaaaagagaacttgaccctagcattggtattcagtagctctgggaccttataagtgtgtgaaaaggaggaacaggaattctacatcagggttgaaaagggcagactcatttgaagtcacattagcccctaatggaagttaataaatcaatttaaataatctattccacaagaaacaagtctaaagaacgtctttttgaaaacaataatgtagtccatgaaagacagagaaaggagtaaggctcctaactggcaggattcaacattttggaggaaaaaaaaatgaaagaactttctctgtacaaataaagctttcttagtctagtatttagctaattggttccttccctttatgttgcacaaaccttcctttttgatcagttcacaataacaaaacatccttcctgccaggtgtcattacaaagtttgtgccctccaatttgtgaagagcagaattacagatgattccacaaacacagaaggcatgcagtaaccactgctgaagtccatcacttactaaatgagtttacctaattacatatgggtacggataacattattgagggttatttttcaggaatagttctaagcactttacacagattaactcctgccatcctcacatcaaattgaaaaggtagaccctatcatatcgagacttactttacagatgagaaaacgcctcaggttgaacagctttcctaaaaccacatgctagttaagtgccaataatatcattcagacccaaagaacgtgtgctggctctgcagagtttttgtttattcccttgttttcgttcttgccgttcttttggttacataagcagcagatgcaaacaaaaccccaagcctctgtaaacttcaaagttgcttgctttatcctattaccagaatcactcgtaaacttggggtaacttttttcataattctgtaaaaggggaatgctaattttaatcacagggaggtttgaagagccaggggtcagagtgaatggtgtgaatttcaatggctggcaccgacaagttctgtgattatgattcgtctgtcttttctaagggaatttcagggcctgtagttactagtttctggttaaatctgattttcatttatgcgctctttcttacacatatatccaagcctccaccgcatcacacacgcacatgacatgggcaaaactggattatgtacagttaggaagtagaaactttctgaattctccactgagtaggaaacatggatctactcctacccgcggatcctgatatgtccggcctgtgcctctcactggcctttacccactacctcacattgttgtattttcaagtacatatgtgacttaaaaaaaaaaatcattcctctgaattatacttggacgatactcaatcagtgcttccaaaacttagcacacacaccggcaaggtcattttttgtaggtatctgaactttttattttgacagttaaatgttttaatgtgcattagggaaaaattatcaaacacacacataaaacccgtgatttcactgataatgcttcccagatagtgttgatcggagtttggtccctggaccaggagcatcagcatcacctggaacatcttagaaatgcaaattctttcctctacggtggatttattgacttggaatctctgaggctactttaccaagcctaccaagtgattataatgcacagcaaagtttgagaaccactgctttaataaggcttatttaagcaaaaacagtaaattcattaaaataacaaattaaataatagtaaaaatagtataaatatgtatcaaatttcaagaagctggtgcataaaggatgacatttgaaaaaatatgctaatcactgacagataaatacaaattcaaacaaactcatccgtgagtgaatgcacaaagcttctctgaccatttctaacattgacaaaaatggtcacagttcatgtaaggcagagtcacaagtcatttattccaaaatctaagaataaaaatcaaatgtgagctttcatatttaataagcttatgaaaccaaagtgtgcagcctggtcttggggccctgcgagtcctctgtttcccttccagatgcttataaacaatgcagtccttagtaactgtgcagtttgaagaaagcataaccggttttgtgtctgtcagaaacagtggaggtagattcaaaggcagtgaagtaaagagaaagtagtcaacagctgccagcagagctttttaactgggtgtctcaggctagcagctggtgagaggctgttacctgtaatgttgatccaacaccttttgtcagcgggccttcaaccagcacacacgtcagcaaaagcacaggaagagatctaactccactgtttgatgattgactcctgacagtttttaagcctcacccctccttcttccccggtgtcccacacacctgggcgatctgatagtaaaggctttgacgcaggagatgtgaaccacacagaccactgcccgcagaagccatagcccagtactgtctgttgaacgccataaaaaccccaagccagttttctacactttctcttgcaagtcatttttggaccagcttgagaggcctgtctcgctttccccagaggtctccttatgtgaataataaatcttttcatgcccttgtgtgtgtgcaaacacataatgcatctgcggtcatcaatattggcatctcaatcaaatttggggtggctggggttcaccctgcctcttcaaaaaggatgaggccgtaccctagaacttaaagcataatttaaaaaaaaaaaagtggttgccaaggccttgggaggagggaggaatcagtggagcgacagggggtttttaggacagtgcaactactctgtatgctactataatagttgatacgggtcatacattattcaaaatccatcttcagtacagagccaattctaatgtaaactgtggactttagttaataataatgtattgggtcaactgtaacaaatgtaccactccaatggagaatgctaatactaagggaaagtgtggtatgtgggcgcagtagacggtgagagggaactctactttccgctcaatttttctatcaacctaaaactactctaaaaatagttgattttttttttcaaaaaagaagtgaattatcagtgagtcaacctactatgttgttcaataacttacagaaaggagcctaatttctatatcagaaaaataaaatattggacaataactgggagaaatcccatgaatttaggaattgtaactgtcaacctttcctcattcaacacataagaatttctttaggcaaaaatataaaaatgtcagtatcaaaagatggggggaaacttctaattctccaagccactagtttcttaccgctatggtttgaatgtttgtgtcctactaaaatccatatgatgggctgggtgcagtggctcacgcccgtaatcccagcactttgggagactgaggcggacggatttcctgaggtcaggagttccagaccagcctggccaacatggcaaaacctagtctctaccaaaaatacaaaaatttgctgggtgtggtggctcgcacctgtaatcccagctactcggggggcagaggtaggagaatcacttgaacccaggaggtggaggttgcagtgagccgagatcacaccactgcactccagcctgggcaacagagcgacactacctctcaagaaaaaaaaaaaaaaaaatttatatgttaaaatcctacccccttaaggtgatggtactaggagatggagcctttgggaggtgatcaggtcatgaaggcagagcccttgtgcatgagattagtgtgtgtgatactgcaaaatatgtatttggcccttgaccccacttcctgacaatttctaaaatccttacactttccaaagtgatgtcttttttttaatcttaatgatcgaccaataactggaagcctttaggtagcttcaggatgggggcaggacacctgaaagaccaagacatgattagagggttgggactttcagttccacctcccaacctatggggagggcagaggagctgaaggttgagtcgctcaccaatggccaatgatttcatcacccatgcgtacataatagagcttccgtgagaacccaagaggactgggttcagaaaccttctggacagctgaacacgaaaaggttcccagagggtggtgcgcccaagaagaaatgtaagctctacggcccttcccccgtaccttgtcctatgcatctcttcatctgtatcctttgtaccattgtgtccggaattggtgtgttcttggtctcactgacttcaagaatgaagctgcggacccttgccatgactgttacggttcttaaaggtggcgtgtccggagtttgttccctctgatgttcggatgtgttcggagtttctcccttctggtgggctggtggtctcgctggcttcagtgaatctgcataccttcgcggttgagtgttacagctcttaaggcagcacgtctggagttgttcgatcctccggtgggttcgtagtctcactggctcaggagtgaagctgcagaccttcctggtgagtgttacagctcataaagacaatgtgggcccaaaggagtgagcagcagcaagatttattgcagagttaaagaacaaagcttccaccatgcggaagaggacctgagcgggttaccactgctggctccggcagcctgcttttattctcttacctggccccacccacatcctgctcattggtccattttacagagagctgattggtctgttttacagagagctgattggtctgttttgacagggtgctgattggtgcattcacaatccctgagctagacacaaaagttctccacctccccactagattagctagatacagagtgtccattggtgtatttacaaaccctgagcgggacacagagtgctgattggtgcatttacaaaccttgagctagatacagagtgccaattggtgcattcacaatcccttagccagacataaagattctccaagaccccaccagactcaggagcccagctggcttcacccagtggatcctgcaccggggccgcaggtggagctgcctgccagtcccacgccgtgcgactcctcagcccttgggcggtcgatgggaccgggcgccctggagtagggggcggcgcttgtcggggaggctctggcagcgcagaagcccggggcggtgcgaaactcaggcatggcgagctggaggtcccgagccctgccctgcaaggaggcagctaagccccggggacaaatcgagcgcagcaccagtgggccagcactgctgggagacccggcgcaccctccgcagctgcttgcctgagtgctaagcccctcactgcccgcggcagggccggcaggccactcggagtgcggggcccgccaagcccatgcccactcggacctctagctggcccgcaagcaccgcgtgcagccctggttcccgtccgtgcctctccctccacacctccccgcaagcggagggagccggctccggcctcagccagcccagagaagggctcccacgggtgcagtggtgggctgaagggctcaagtgtggccagaatgggcgccaaggccgaggaggcaccgagagcgagcgagggctgccagcatgctgtcacctctcactatgctttctagtaaaccaggaaatgtgtttccctgagctctgtgagcaactccagcaaagtaaccaaatctaaagaggctgggggttgtgagaacccctacttgaagttggtcagtcagaaggtctggaagctcagacttgtcactggcatccgaaaggggggcagtcttgcaggacggagccctcaacttgtggtatcaaatactatcgccaggtaaacagtgtcactattgaattggggaatacccagctgctagtgtccactacagaactgactgcttgggaaaccgacccccccaacccccccaccagattcggtcactataagactatgtggccaggcgcggtggctcatgcctgtaatcccagcatttggggaggccgaggtgggtggatgactggaggtcaagagctccagaccagcctgaccaacatggtgaaaccccgtctctactaaaatacaaaaagtagccgggcgtggtggcaggtgcctgtaatcctggctactcaggaggctgaagcaggagaactgcttgaacccaggaggtggagagttgaggtcacgccattgcactccagcctgggagacaagagcgaaactccgtctcaaaaaaaaaaaaaaaaaagacactatgcttagttagcctctttcatgcatgtgctcagtgtctccgtgtgccaggcactgaactaagcattgtgtatataaaagaaacagcacacatttccaaccttaaaaggctttcaggatgtgcatctttgaaatatctaagaacttttggcatttatattccagtattagccctttaagcctgtgttttcttaaaagactttattgtatttcatttgatcattttatatatgttaatgtgaacgactggaactttaacaaatatttaatctgctttcacctctttctttttgggcaatggagaatacttcctatggctttaagccttggccatatgacttgttttggctagtggaatataagctgacgtgatgtaaggagggatttaaatttaattgcatagtttgacttgcctccggtactcctgctatttcatgtaattaaaacatattctgggtggctacaactcactcagcctgggtcccagagaaagatacatggtgcagacttaaaccctagccacagtcagcagtcaagaacagcctgaaaaagcccaaaccagctcagctgaaccttagttgacctttacacctatgctaacaaatgcttgttaccgaaagctgctgaattttagcatggtttgttacacagcattattacagcaatagctgatgaatacacttggtaagttttcagtcaagttaacaatttagagactcatagcattttggatgcttccagcaactggggtggagtctcaccaacttctctctctctctatgcatacacacacacacacacagagaaaaaggtttaaggaaagaggataaaatgggagacatgaataggcttatattgtttaatactcaaaaaattagttcaggacagatattgagtctttatgttctgggatgatgatataaaagaggtacaaaaagtcaggaaattcgtggctatatctctgacttttacctgtattgaaaaggtatgtattcaaggcctgagaccatttgatggacaccttaccatggagaaaactgtcattaagtccaattctagctgccaatcctgggataacctgccttctaccctgttcttttctgttacccttgttttatgttctatcataatagaggtgctaagcagtttaaaattccatgaatatatggtccctaaaacttacaatctcctttctacctatgtggtttttaaaaatcatagtcaacaacagttaaataatggccacaaaacaaatcttctagaaaaggcacacacttaactagaataaaatttcaactacaattgaaagtaaccaactcctgtcactaggtggcagtcacaataaagtcatcccttggtgggagggattggttccaggacctgaggatactaaaatccgtgagtccttatatataaatggtgtagcatttgtgtataacctatgcatatcctactaaatcacctctagattacttataataaatacctaatacaacgtcaatgctatgtaaatacttatcttttttatttgtatgatgttttggtatttttttcccaaatgtttccaatctgaggctagttggatttgcaaatgcagaatccgagaatacagatggtcaattgtacttcatactgaaactcgaagtttgctatcaagtgccacagcaagacttgaaggattgggtatggaggggaggctggggagagacaaggatgagccaaactgaaacaaccacttttccttgatttgaaaagtggactagtatggatatggtaactagctgagaaatatcagaacaaataagaggaacttccaatctgatgttactaaaaaagttaaaagtgtcccaacagacctccagttgttaaaggttcacattttttagctccctcctaagcctatgtaacaatgaaaattataacataaagcaagtaaaagacacagacaagtaccaaagcagaattacgtatttcagaaatagaaatgggacaaaccagtaagtggcacttcaggcctgaagctctggcctgctgtgccccagttcctctggcaggcagggcaggcaggacatcctggagtcaagttactgcagagtaacagggactgacagcactaacgtggggcaggaagccaggcccagacttgttgcctagaaaaagggactgagacacagctgtagttcccagatgggaaagggaagttggaagaggttgtcaactgctgcctgggggtcttggctggggcacagtggctccagcctgtaatccctgtgttttgggtggcagagggtgggaggatctcctgaggccagaagttctaggtggaagtgagctatgatcgcaccactgcactccagcctgggtgacagagcaagaccctgatccccctcccccacccaaaaaaaaaaaaaaaaaagaaaaaaaagaccaaacctcaaatccatctatccctgtcaccagccgactaaatctgcaacattcacataccacctcaggctagtgaacccaatacgctattataagagcgacttagtctgggggtcttacctggtaagacaactgcaaaacaaataagggtaaaggggaaggggagggggaaacttaaaaaaaaaatcatcctatagatcacgagccttcaagccaaactttcaaaacataagaagaaacctaagcatcgagatagataacacaatcaacaattgaaacatgacatcacccaatgcaaatttaaatcttaaacatatgaaaatattttagtaatgtttagaatccttaccaaaataaaggcaagaataataatcatcataaacaataatgatagtagcaacacactaagagacaagaaacaatagtaggtgattgtaaaattctgatatattagaaacaaaatactcaacagacattgaaataaaaggtgcaaaagcttaataaactcaggtacagtcaaggaaggagtttgtgagtaaaagatactgaataattaattgaaagtgcagcatggtgcaagaaaggataataggaaagagcaaatactgaagagaccctggcattgacacagtgatagaaaaaaataccaaaaaatagagtacaaaaggaagcatataaataaagccaagcaacatatggaaacataatacgtgatttgaggttgcattgaaatttgtgggggagggatagactatttttttaaagccacatttaagaaaaatattcatacttcaaaaccattcacaagaatcacttttagtgattcagctatattaaaatataccagaatcgtgtctgttgaaagatggcaggagaaactgataagccacataaatggagaagacatttgcaaagcatataaccaataaaatgttagcatccagaataaagaaatcctataaataaataaaaaggatagcaaccattagaaaaatgaacaaaaggacagtaaatttatggaagataaactccaaatggctaataaacatataaacatacaaaaagacacaatctcacttgtcctcaggacagcgcaaattaaaactacagggaatactatttcacacctatcagatttttttttttttttttttttttttttttttttttttttgagatgtggagtctcgctctgtcgcccaggctggagtgcagtgacgtgatctcggctcactgcaagctccgcctactgggttcatgccattctcctgcctcagcgtcctgagtagccaggactacaggcgtccgccaccacgcctggctaattttttgtatttttagtagagacggggtttcaccgtgttagccaggatggtctcgatttcctgacctcgcaatccgcccacctcggcctcccaaagtgctgggattacaggtgtgagccaccacgcctggcccagatttaaaaatattaattagtctgctaatactaactgctggtgagaatgcattagaattccacacattgttgatgggagcattaactgcaacaatcactttagagaacattttgacaatatctaccaaatgtaaaggcgcacataagtaaaatcagaaattctactctaatgttcatcctctagtgaagcatttacacattaatacaaatattaaaaagaacactatggaaccattgtttctaacagtgaaaaataggaataaacttaaatttccatcaccagcactacagacaagcaattaagatgtacattcactcagagtgatattatgcagatattaacatgaatgaaatagagctatacatacgaatgcagataaatctaacaaacattattttgagagaaaaagctgccaaaaaatacatagtggaagccattttgtagactcatgaaatacataaaaaccatactatccactgttttgagactttatacattattgttataagtataaaacatgggattaataacaattttacccaagtggctggggtagggcatatagaaggcttcaaatatatttgtaatgttttatttcctaagttaagtagtgagtataatcatgaagttgaacacaactaacataatacacttaaaatctatgaagcaaaagaagctgagagaaattcaataacaaaattaatcaaaatgatatgaaatatccctctaccagaaatagatcaagcaaataaaaacataatgactgacacaatcaacaatcttgattatatataccccagaaccaacaaatcaacatgtatctttttcaggaacatatattttcaaaatatatcactgacatatttgcaaaaaattgatgattcacaaagaaaacctttcaaaaattcttcaaatactgtcacacaggccatgcaaaagtaatgctttctataatgcaattaaattaaaatccacaataaaatgataagctaaaaacaattaaaagaaactttaaaaacctaaaattaacaaatctatttcagcaatttgtgaaacccaaccaaccaacaaagcaattatgcggcgtttgttctaagaatgtaggaactatatattatctgaaaatttatcagtggtatctcacattaacatactaatggagaaaacctattgtatctcaaaatctcaaaatgatacagaatgacacagataaggctccacatcattctttgattttaaaaagaaaaaaatcttcttagctaagttagaatagaagagaatcagattcagaatatctttcaagaactttcaacaaactttgaaagtaacgggaaaacttcaggaggcacgatttaaaatgcacaccattacccacattttcctacattaaactagaggcgtgagataatgtgctaagaaaagagatgtaagaattggaaaagaagagataaaactggtaatgtttacaatgatatggctctcaaaacttacactgtgacagcatctgaatggggtttaaaaaacccatgctatatattgcttaggcatacacacacacacacacacacacacacacacacacacagaggttgattgtaaacagcaacccacagagttctgcatggtggtagccacacatgaatgctgggagagttaatcatctctggggaaagaggcagagaaattgaataaagggaggtaacaaaaggggcctcaacactggttttaaaaatctaaagaaaatatgataaaaagcttaagtatagatggttaatatataaatactaactctactttattctatttgtttgaaattattcaggatccttctttataaacattagaggatacgtccaaattttcacacacacacacacacacacacacacacttctgtttataagactaggtttagccttataatcagtgaggaaaaaattgcctacctcaaacagaatgtacactcaaacaatatataaagtacttgtaagaaaaagcatattcctcatataatacatatatgattttatatcatgattatataatgcatatataagcattggttgacttgactgaaaatggtagaagaatctctgtccttagcttgtgctttgactcagtaactgacagagccttttatttaaagctgacaaaatgaacctcaggagagagaggtgaaggtcagtctcttaagaggcaggtgaaagtcagccagatttaactcgacagagagtggaattttctagtaaaccaggccagacaagtacccaggaggccaggctacctgcccaggtttctaagggagacaggacacttgcatttcccacgtggtggaaaagtactccaaaatatgtaacatattgcagctgtcactgggcttactgcctctaagaataaggtcctattttgcattgctcctaccattcaaaatttaagatctgaatttgtgtggagtgtgggggtgctgtttttaaatctgcatctctcaatcctaacactaaagacaagaaagcctaacagacatattttttttttaatgcaaaagtttggaatagaaaactaagaaacagcttcctatagaaatatgggaagaggtaagctcacatcaagagtacacaggccagaaaatacggacagcactctggtcttctagtccagaagcctagcccatacctccacagggtgccaggagatatgagctatacctattttctattttaatttagaaaataaaagtacagggtgctcagttaaatgtaaacttcagaataataacagataattttttagtataagtgtgtcccattcaatatttgaaatatactaagtaattactcattcactcagttcacatcttgtgttttatctggcaactctaggaactcttaagtattcttagtgagaactgtatgcaatgggccaggaatttaaagaaattggggactacatttgcacacaggtggaaacagagccaactagaatcacggacagccagaaacactagttttagacatttcagtttaacgtgcccttttcaaatcttctggggttttgttgttgctttatggtagtagttttagctttgtttttcccccaagtaatctgatctttcctgataaccgactttctcataactgatacagtgagaaacgatctagtgttcaaagtgaacgggataaacaataaaagaacaaatgaaatggagacaacacacacacacgaatatacatacacagcacctgttgtcccttcttgtagagggttagaaatatgacagacaagagcatatgaagaaaagcacacactgattcacagccaaaatacagttgctgctcaaaggttgtactaacaggcttctgaaaatcagtcatccacatctcaccacctgtgatcccgctacagtgttactagcatcaaaatgagaaaagatgaactggagaagcaaccagctcacttgggcaagtcaaaatttctccatgagccagcctatttaatccctacccccataaagcgtttattccagtggctttaaacattgactacatattacaatcacctggggaggtttaaaatttacttatgtctggattccagccctagacatagacttaattggcatgagatgcgtgttaggagctggaatttttaaaagctttccaggtgactctgatagacatccaaagtcaagaactgcatttgtaagttatccccaaacagtgacacctggggaaggccagaaagtgacacgtgtatatagattataaaaagtaagctcctacatttgactctcactccaagctctctgctatccaagttgataaggccacaaaagtgaactttgcagtgagccaagagctaatataaaggaactgggttcttccttaccctacacaagttgccctgaaattctagcaactggaaataatgctcaaatgctggaaaaaacatataaagaactacagaggaaaaaataaaaataaaaataaaaataaataaataaataaaaatttttaaaaaggcaagatacttttggaaatcccactttactggcaaaactcaagataatctgtgagatcatttttgaaatgcaccatctgggcagcatgtgaaggatatcagctcatttcatagaaatgttcggtttcatctggtagcaaacctcaaggggctgctggccacgtgccctatccaatctctggggtagaacctggtcagaaaacacattcttcttccccagatgccccagtctgaggctcaaggcaaactcttgattaactctaatacagaaacaaaatacttcttaagtttcttcaaatgctccctccctcctattgatccgacgctagtccaaacaacaagtcattttcactagtttgaaaataataaaatagaaaacagataaatttgccaccacaaaaagaacacaacttcctggtttctgtgacaagtaagaatgtttcacctaagaaatgacattgtcagaagtaatatctatctgcaaattgaagctgatttgaagaaatacacttaaataataccataaaaatcagaatcttaaggacagagtctcagaggtcacttagactaacccccttcctcaaaatacataaagaaactaagaaatgaatacccaaataaactgactcattcgatttatagcatagagaatctcagctccatatgcaggtggaaacacattttatgaacacacaaggaaaaaaaaaatcacatggctgttcagcagagcacaggtctcctgacctttctaatatattttctaccatactctgaagcctctttatggcttttaaatgaggtcaaatgctcagggtaaagggagagagagagagaactagatgttctgagggagatggaaaatacttgaaatagcagctgttgagagtcgcgtgtagactaggaacacacgctagggatggaggacctgtttgtaactagaaaccacaaatccacacagtggcagaaccttgacagttgtattagttttcctcaatagcttttgtagtccagacaagggtaggaagagccaaacgtttggatctctcaagactagggtttaccacatggctgctatagaaggcaatggggtaaagaaatcaaagatatcaccgagaatgcagcattaaagaatctcagtgtctcagagaaggaagtgaagacagcaagagctgacagacacagagaaaaagatgtctggagttaagcccctgaggaagaagggatctgtggtttgggagaactgtgggaaaaagccagaatgatagaagttggtaggtagaaacaggaatgttataatttatcttttcaaaggccaggtgcggtggctcacgcctgtaatcccagcactttcggagaccgaggcaggcagatcatgaggtcaagagatcaagaccatcctggctaacagggtgaaaccccgtctctactaaaaatacaaaaaaaatagctgggcgtggtggcgggtacctgtagtcccagctactcgggaggccgaggcaggagaatggcgtgaacccgggaggcaaagcttgcagccagctgagattgcaccactgcactccagcctgggcgacagagcaagactccgtctcaaaaataaacaaacaaaaaactaaaactgtgttaagtaaatataagagccagaatgtagatgcagatagtattagctgactgaaatggaaaagaatcaccactggaagtgaggagaggccggaatttggaatgggttatcccagtgttcattaaaagaaaatagagaccagagacctggtaggtcaagagatgaatgtgaccggaaaagttcatcttgaaagtcacataatgtattcctgaatccccaaagaactgaaaaatcacgtcactctgtggatctacgttctgacttactgaagttttgtgttaagagctctcacaatacaaggataagcggcttgcaataaatatgccttattggtttaatggggacattaggatctggtttcagtcacaaaaccaaacaaatgataacactaaaatagaattttatattgccaaaccatgttttaatgtttacaaatgccctatttcttcatatacaagaacaccactgattctaagatgcatcagtatttacataccgaaaagaaagtaaaactgctgttagttataattgtaaaatgcccattgtaaaacacatcctaatttcaggtgtagaaaatgtgtattatacattagataaaatatataaactcaaataatctatataaaccttatgtgggagtttttttattaatatactttaagttctggaacacatgtacagaatgtgcaggtttattacataggtatacacgtgccatggtggtttgctgcacccatgaaccggtcatctacattgggtatttctcctaatgctgtccctcccctagctccccaccccaccccccgacaggccctggtgtgcaatgttcccctccctgtgtccatgtgttctcattgttcaactccctgtgtgggaattattattattattattaccacatccgtgttagaagtaaaaaagatcaaggcacaaacagcttaaatggttgcccaagcttacacaggtaataagaaatacagccaggattcgaacccaggaagcctaactccagaatctatatactcttaatgtccacagcatactatccaaactcaataaatgtccatcgaggaagacaaaaaaccatcatgatacacaagcctaagctttctaccatcaggaggagccagcactgtggagagggtctgcttctgatgcacctgagagcacaaacttcacagaggacttgcaatccacagggcagatctgactcaggcccagtcctctccagaggagctgccccaattagtggtttcctgaaatacagacctcgtggcatgaccagtcagcaccaattcatccccacccacaggtttttttccacttggccattactatccccattaaacctttagcaatatgtactcgtcctcttcttccagttgtcatcatatgcttcatttcatgaaggcaactcctggagccgcgttcacagctgtcccaaataaaggagccacagctgaataagcagccagatgcatccagccatcaggtgatacagcctcaggctgctccattccctctggctctcacgactggcaagctggagggccaggctcatgaaattcacatattcccactgactgcattagttactgtggtaacagatgtcacagaaataggaagtcacagtcatcaagtttctatgtcctataaatatatgaacaaatgttcaaccttgttggtaaacaaataaatattgataaagcagtaatgtatcaattttttgtctacttgtttccaaaatgttttcacatttttatgtcatgaaacccgatgttgtctaaaaatcaataaatgtaatcatgaagtgttacaatcattaacaacaaaaataataattactactgctagaactgttgctaatattaacagttatcgtatgtgttctacgaaccaggaattgtgctaagcattttacctgacttactttctctaatccatggaggttttaaccatagtattccacttgtaggacacttagggtcattagttaggaaagagaaaagcagactaccttttgggaggttgatttggtagctggcatgcaacactaaacgagtacatcatggttttaatgactcattcgttgaatccccctccaataaattctggaatatgttcaaagatgtagatgcaagtattcattacaatgttatttcaatagcaaaaataaatattagcttaaaggttcaaaaacattgaatttcttaaatattatccattaatcttgtaatactccatagttattaaaaagttaagtgaattattttcttctgtttgtgtgtatgcccttgtattttctaatttttctacagaaaactacagatactcctcaacttacattggggttatgtcctgataaactgattgtaaagtcaaaaaatcattaagtcaaaccatcatatgtagaggaccatctctggtgttatttgcacaattaaaataacttatacaaagtattccaggtttatgagcataaccctcggttccaatcaagcattgatgagttgatttcactttacagacagatcatgactactgtagatggagtcacagagctgacgcagtaaagccacacaattaagacaaccgattccatacccagaaggcctggttcaaatcctagctaccatttacaagcagtgggacctgggggggttattttactactgtgtcttgtttcttcatctatatatgggaataatggtgattcctacttcgcaaggtcattgtgaggtttagagttattaagtatttgttcaacgcttagagaagtgcctggcatataggcatgcagtattacatatggctagctgctgttttactattactgtttcgttttcgtttgttttttgtttttaaatggagtctcgctctgtcgcccaggatggagtgcagtggtacgatctcggctcactgcaagctctgcctcctgggttcacgccattctcctgcctcagcctcccgagtagctgggactacaggtgcccgccaccacacgcggctaattttttgtatttttagtagagacggggtttcaccgtgttagccaggatagtcttgatctcctgaccttgtgatccgcccacctcagcctcccaaagtgctgggattacaggcgtgagccaccacgcctggctcatcttcgctcttaactgataactttgcttccaacttcactgatgaaactgaagaacttgcacatcctcccgcctaccacagtccctgtccttggacctattactagaggtggttgtccactttcctatcaaacccaacccctttcttagtacagaagctcttatccctcttactttcttgaaagtatcactctaggtcttccctcttcctacatcaaattttccctctctaccagaaccttctttctggcatacaaaaatgtctttattttttccaccttaattaaaacaaaatgaaatctttcatttgatcgtatttgtcccaccagctacctcatggttttttttttttgttcctttgtagcaaaatctctcaaagtcacctacatactgtctccaattatcattctcttttaaacccactccaaattaaacttttatcccgacacctccaatactctttcattgagaagatcacagtattgtccaggcttccaaattcaatggttaattctcactccttacttcatttgctctatcacgcggcacactccctctctgatacactttcctcacgtagcattcagagctccgtagtctcttagttctcctcctgcctcactggaggctttctcatttctcctcttcatctcagtctctttctgttgcaggtcccctgggtcagtcctggttcttcttctcctctacgttcaccatctcatccagtctcaaagttttaaacaccagttttacatgtacaaatgactccccaatatacatctagagctcagagctccgtttcccaatgccacactcataaatccaaatgtctgctcaacacttcctcatacatgtcaaattgacatctcaagtttaacatatcagaaatgatgcctaatcttccccctaaacatgctccacccacggtcatcttctccagtccatggcaattccatgcttctattgctcaggtcaaataccctgacgtcccagcactttgggaggccaagggttccaggaagactgcttgagcctaggagtttgagaccagcctgggcaacatagaagaccttatttctactaaaagtaaaaaaaaaattagcttggcatagtgtcatgcgcctgtagtcccagctactaaggaagctgaggcagaaggactgcttgagcccagcaggcctaggctgcagtgagctgtgattgcaccactgcactctagcctgggcaacagagagagaccttgtctcaaaacaaataaaacccctgatgtcatcccttactcttctccctgacctccaacagatcaggaaatcctgatggttctgcctcaaaaatccagaatctgattttttttttactacctccatcactacaactacagtccaagccaccacctcctgtgcaaatataatctcttgcctgtattaccataatgatttccttgtaattgctttcctgggcctacttaccctccacaccccctgtgccctcaatctccagttcaacaaagcagccagagggagtctttgcaaatactaggaagatcacatcatgcctctgctcaacattctctaacagctccccatttcacccaacacaaaagccaatctcaaacaatatcctataatgttctaaatcaagggttccttactctgtttgcaccatggattccttttgacagatggcaaaacctacggacccctttctcagaaaaacgtgttttaaatttacaaaataaattacaacaggttacagagagaaccaattcaggtgtcaacatatttttaattgtgatacacatacatatgtactcctttattatcacattaaataacaggatctagtggcaggtgtaaaacctaacataattttgaaatggctctaaacatattttaagatatccacaacaactataacgtgatgtgacagtatctgtgatttcctattgctgacaaagtcatagtctatctatattcatgatggaggaaaatgctaaattttagttagctacgattaaaataaaaaatgatttttttcctatctacattcgatagacccctgaattctgtctacggatgccttagaggtccttagatcccagataaagaacatctggctctgcactgcttctgggagctgttctcctagctaactgctttactgctccagtcatgtacaccacagcactcccaatctgtactcacagcctttgcactggctgttcccttttcctacattcccttacctctccctcttttcttatttggttgctcaaatgtcaacttctcagtgaggcctgcctgccctaaccatcctatttaaaactgcaaccagccctgctatcacaatctcaatcccctgcagcctcttttcttttccatagcatctatccccatctaatatactacacaatgtatttactatgtgctatgatttcactgccccctccaaaactcatgttaaaacatagcccacaatgtggcaatattttgagaggcagggcctttaagaggtgattcgatcagacagccctgacctcatgaatagattaatttattcacggattaatgggttagtgggttaatggactgtcataggagggaagctggtggctttataagaagaggaagagagacctgtgtttgcatgttagcacactcagccccttcaccataccccacaccacctcgggactcctcagcaagaaggctcttaccagatggggtaccttgatcttgaacttctcagcctccataactgcatggaataaatctcttttctttatgaattactcagagtcaggtatcctgttataagcgacatacaacaggctaaaacatgctaagacactacatttctttattgtgtccttaagggcagaaccgtttttctgctttgatacagtgatgtaattcaaatgcctagaagagagcctggtgtgtaggagatactcaagcaatacttcttaataaatgtatacacttgaaataaaattatttgatgagtgcctactatatgacatacttccttcacacataattccatgtaggaataccatgctataaggttttatacattaattatcactgtatatttaatatttacttatttctgttcattccaaagtgaatcctcattcaagtacttagaaatgtccctatatttatgctgaaagaaattagcatggctcccaatgagagctgagatttctgtcagtttaatggtacacaatattggttctggagctaacttccagggttcaaatagtattgactcctctctttactagctttgcagaccaagtagagtttaaaatttctctaagctacaatatctttatcagcaaaatatggataattacctacttcacagggttataataagtattaaaatttaattatttaatccatgtagagcatttagctcatttccaagggcttggcagatgaaaaacacaacgttcagtattgcttgtattatcatcaacgaaacatgaaaatactcacagtgcaagtgccagaatatccatttgtaccatttgagtgcctagtatcctttctcttagaaataaattcatttggcaaatatttttaaattataaaagcaatgagagcatactctatagaatttaggagacaaaggagaatccacccttctaagacacttagcattctgctatatttccttttgttcttttttcctatacacctttatcagtgattcacatctgatttcaaaattgacctggaactcttcagttatgacttcctcaatttctgatccttattataaattatcaaataaaataaattaacagaactcacagttctttcttgctgactcaggccagtcccagagtttgagatgatctgctaggacctcagacaaacacactggacggttttccaggtacatcacaacaggacagaatttttttgtccctggtagagatgcttacagttcccagtctcctgcacagcctcattccttcaaatactctacagctgatctgagtttgggtgaggaggggaaaataaggtgagagatttggggaaggaatacaaaattttgtcggagagcctgtatagactggggctgactccacaggtggaggggtggggtggcgagagaaggcaagttagtgggaagggagttgttggagcaggctcatatatgagggaactggctgtgtcctttgtaaccttaggctctggttataaccactgaaaaccaggcagcaagccacagtgaaagaaaatttgccatgacctggggaaagataaacagcattgacacttttgtagaaaggagccagccactttcacttgctttgccacacagaactgactcaataaatgtcagctgtaatcatgcacattccaggaatctacatttttaacattgtcacaggtgattcggatacagtatttttcaaagtataaactagaacggtgttcttcaaactcttttgcttaaacacttactaagatttttctgaaaaataacatgcatatttttaagttgacatccaaaacttttaattttcagtctaaaaagctgcaaagaataaattctgagtttatgaatactgataccttaaaataaaactattatggttgggtgtggtggctcacgcctataaccataccttgggaggccaaggcaggcagatcacttggtgtcaggagtttgaggccagcctggccaacacggtaaaaccccatctctactaaaaatattatacaaaaattagccaggagcagtggtgcatgcctgtaatcccagctactggggaggctgaggcaggagaatcgcttctatccaggaggaagaggtagcagtgagccgagatcgcaccactgcactccagcctgggcgacagagtgagactccgcctcaaacagtaaaataaaataaaaaataaataaactattacatccctcttttaaatgtagctaattgaatctaagaacactgatttgccgccctgcatcttctgtgtttaaaaatggtgtgacctaatttggagttaacattcagaagttttacatggttctttttcatcccttcaaacgtttcaattttatttttttccatggaattcattgaaaagtaacacagttttatgcttgaatattttctattaatcaccctgtcattatttctgtgggatgcaaatagtaaataagttgttaaaatgtcctgtcatcaaaagaattttaattttaggtttacttctggactgagttataatttttattgcatctaacctatgaaaacaacacgtaagatttaataattagtcaacataaaacaggcgtgttttgtattttaataaagaaggcttcccagataaattatttggaattatccttactttaagtccctgggagtctttacacttgagcaaagtatcatagactcatttggaatgggtgagactttcacctgttgttggaaattggatggaagttccatttaaactaaagagtactaatggaagctgaggatctggaaaagaatttgctcaaaattatccagggttccacgattttctttggagtttccttctgtgtcccccactttgaagacttctaatgtagcaccctcctatatacaaaatgtgtgggtatcttgttaaaaaggcagattcacagactccctccagatatctgaattaaaacaggctccccagattatttttgtttccccactgaagactgagaaaaactgaattgggggataaaacaaacacacacgatgttaaacaatatagtaagatttaaataaaaattcaataaaagagctatcatagtcattatctgattgtcaaaaaattcagaaaaggtaatgggaaagtgagatagccaaagcctttataaaggaagcaaaactggaactgagggaagggtgggtagaattcgaaagataaaggaacagagataattatttaccaaggttgacaggtatgagatattaatttgttggctagattggagcagtcaatgcccttagaaagtatgtgtggctcatcacagagaccctggtagaatagcagtgggtgattttgtctaagtgtagcaaatatgataattacttgttaaaaacataataggttattgaggaaacttattttttatgtaaattgttattagacagctggttttatgaaacgttctgctggaaaattgacctagagctgaatgtatattttacccaagcactggataaactataaaaataataaagactactatatatcacttttaagccctacatctgccccaggccaggcaaataaattagtgtaaattcaaattatctccttctgttcttttaatagccctgacaataggcttagcaagaaaagaggtatgagccatcacctaaaatgaaaccaagaatatctactgatttttattatctctgattccattaccactcggtgtcatgaataataaagattttgaatgtatctgttcataagaaaatagaagtcattggttgcctctatcatctctcctctggactactattagaaaccccaaactggccttcctacttccccactgccgccactcaccttcctcccagactcatatccatccttggtatttctagaggagtcttacagtgttattcccttgcctaaaacctttcagtggctcccccagctgtctacagtccaaagtgctcagcatggcatgccataatctccctccccatggaagacgtggcaccatcccaatctacaggcataatgcccttgtgtatcatttgctttgtctcatgtatatcattcataataaactaaaaacaagtgctactctgtctttgctctgcatgtttgctctaccctgcctctatctgacttactcaaactattgtctccccaagtcagctccggaagcctgtcctaattacttatgtaggactgatgacagtctcctttgtgttccactatatgctaatcactctttctataaccgcacctagaatgtttgattgaacttatttgtgtatttgtaaacattccacctctcccaaccctactctctgtcacctaacccaccttcacagtggcaaaaacaacaaaacagaaaaaaaccattaagtgcttgattccaagtacctgtcaaacttagcagaacctagtagatgcttagtaaatatttgctacataaatgattattatttataacagtggaattaataacagcaccaatgaattagacactaataatatgctaggtattactaaataagagttagatatgatctgggagcaatggtgactctgatgtcacagccatttacttgcaatgtctaagattacaccaccagatagaatatgtgctctaacaaaatcaagggaaatcccccaggagtcatcctagccatgctatgtagctcaacatacaatagcatcttttttatcgaagttcacttctacttatcttgaatagtggtacaatgaaggagtcttcacattaaaataacttcagagattagcacagaggacagatctgaaaaccatttgttattgtttctattttaacaaatctagtgctctactacagagtcactggatactttggtacttaaaatacagaaaatgtctccagtttcctttagttcgccttatcttgaattcaaaaggttgattattttgggctaaggcttttccttatttaaaatggccagaaaaatcagcaagtcaaattcagcatttcatcatgaccaaataaaactcatgtcaagaatgcagaggtggttctaataaatctaaaatataaatcactaaacagattgaaaaaaaaaaatcacatgagtcacatggtcatttcaaatataccagtaattaaataattaaattcaaactacttttcgtgaagaatactttgaagcctaggtctatgatagaagagtattaaccagaaatcttcaacccgtaacacctaactggaaaatatcagaaggaaacctttaaaatcaggagtaacacaataatgtctactattcacttcttgttcagctttcttttgacgttcctcaccagttaaaaaaaaaaaaaaaagactggaaaaaaatagttactattcacttctttttcagctttctttcgacgttcctcaccagtaaacaaaaaaaaaaaagactggaaaaaaatagttaacaatttgtgttttattttctaatgtttacaatctgattaaaaaataggcaaaggacttcaatagacctttcttccaagaagacatacaaatggctaataagcaaatgaaaagatgctcaaccttactaatcattagaggaatgaaaatcaaaaccacatcatctcatacccattaaaacggctattaaaaaaaaacggtaaataagtgttgtcaaggatatgaaaaaattagaacccttgtgcatgattggcagaaatataaatgagggaagatggaagtggcagttgtttaatgcacatagtgtcagttttgcaaaatgaaaaattctggagaaccattgtacaacaatatgaacatacactactgaactatgcaattaaaaatgggaaagatagtaaatttcacagtgttttttttcaccacagctaaaaataaattttaaatcattaagatagtaaacttcatgttatgtatattttaccacaataaaaattaaaaaataaaacataaattgtcatgatgtctacctaaaaaaaatccaatgctctccattgaaaagctagaactaataagagcataaagtcagaattaatagaaacataaaaatcaattgctttggtatataaataaaaccaatgagaaaaaataatgagaaaaatcccatttacaatcaaatatccagaaataaatctaagtgtgcaaaagctataagaagaaaatggtacaagtttactgaaggtcataaaagaaatcttgcagaggcaagttatgctcctggatgggaagacagcattataaggtttccttatattgatctataaatttaatagaattccagtaaaaattacaataggatcatttcatagctcttgagaaaatgaccttaaagctcatatacaagagtgtaagtgcctaagcatccaaacaaaatttagaggaaaaaaacaaattgaggtaatctgaatgatcagatatttaaataactttaaaactacattaattacaaaaacacagatttggcacaatgtttagagaaatacatcagccaaaaatgataaaaggtctatacacagatcagcatataaaagtgatttataaacaagagtgttggtactacacagtctcagagcaagagtgaaggatttagtaaatggtgttggggcaactggtgaacaatttgggaaaaacaaaactgataataacagcttacattactttggtttcacaaggagccagaactatatcattaaatacagaaaagaaccccccaactttttttttttaaacaaaacacatccctgaggcacaaaagggaattaatttgcccagagtcacacagccagtagctgctgaagcctaaaatttgattccatgtcatgggattccatagccccagctccccaatcattataacacactgctaccccttaacatatccttatccataacacaaaaacaaataatggaagcgaaatctaaacatatgcgtgtatatttaaatacagacagtccctgactcaaaatggtttgacttatgatgatttttcaggtttacaatggtgcgaaaatggtaggcattggtagaaactgtactttgaattttgatctcttccctggttagcgctatgtagtacaatacccttttgagaagctgagcagcgagccatggtgcccaatcacaggatcacgaaagtcaacaactgttaaatcaactttagcctaaagctgcctcctccttacgttttcatgtcttaaatgtttttctatacatcatgaactataacaaatggaggtgtaaaccgactgtagcccacacctgtgccaatcactgaattttggccagtcaaatgtagccaactgttctgtgttcaaataagacaaatgccgagctgtaaccaacccagttgttcctgtgtctcacttccatttcctgtacatcacttgccttttgccgtctataactcttgttccaccatgtggctgcgcaagaatctctctaaatctgctgtgattctggggactccctgattcacgaattgttcattgctcaattaaactcctttaactttaatttggctgaagtttttttaacagatggtgtcagaagtgggataaaaagtggcacccaggagtactgtgtaaacaagcaaggtactgatggcagcggcggcctatatggagcggccactgccatgatgctggctgcagttggggaggcatggccagggctacatgctccatgcagccagtgggagccaggaacaggcagaagccccaccccttctaagttggcagggcacagctgcagctgcccagccatggctgtggaaccaggcatccccatgctcttgagggccagaagcagacaaaagccccgccctcctgggtgcagctgcagctgcccaagccatggctgtggacctgggcatctctgcactctcagggacccaggaagtccccctttccctacaggctcaaaggtgcctgctcccactgcccagcctctcccctattctggcacctgctctaatctcagtgcacagttgagaccaagcccaggcattgtcataacctagttgggtatctacacattcagggcagtgctgacatgccagccccctggggccttggtgccctcaagactttgggcaccaatgagcatgggatggaggctgaggaggggctgagggcagcttagcattggcctgcaggtgccccttggcacaaacactctaggttccatgaacagtggcaagaggcagacaggttcctgggtgaaaaggggtaggtccctagtgaggccccaccttcaagctggggaaggtctgaagcctggaggttgggctgccagtcccacagagcacagtgggaacttatgatgctttttccaggcccacctatggccacccatggaccaatcagcatgtatttcctctcctccgaagcccataaaatcccagactcagccagactcaaaaagggacaacaggacaaccatctgtggagagaaactacccaccaaagggtctcctctctgtgagagctgagaagatgacaggatgacctgcctgcggagaggaactactcaccccaggatctcctctctgctgagagctgaaaagggatgagaggatgaccagctgcagagaggagctacccaccccagggtcacctctctactgagagctgaaaggggatgatgagatgaccagctgcaggagctacacacccaagggtcttctctctgctgagagctgaaaagacgacaggatgaccagctgtacagaggagctacccactgtaggtctcctctgagctgctctattgttcaataaagctcctctacaccttgctcccccctccacttgtccatatacctcattcttcctgttgtgagacaagaacttgggacctgccaaatggcagggctgaaagagctgtaacacaaacagggctgaaacatgccccttgcttgccacattgtgggtgacaaggaggagagaaaagagctgccacccttcagggagcccagacctaggagctccccaagccagggctgtgacacctgctttggggctctgcagtttctggcttctcccaagattccaggtgccaccgcattccctgatgccagccgtggaagctgcttgtggtacatagtccagccatagcctcgcagggagtcagcacccatgctcgcacctggagctgcccatcccgctgcagccagcatgcctggctgtgggcagtggctggaccccatgctcacttgtttacacaccctatgccactccacttgcccttggtaggcatggagtccaggccagtagcacctcccgagggcagcctgccaggctgagtgggacctgcagtccagagcaaaactcaggcaaaagcacccctggccacagaggtttctggctgttaagaaatatcccaaaaatcctgtaattgtatctgctggacccacttgtctcctttgatctctcagaggggctggggattgcagtaagttgcctcttggatttcagagctccatggacttatgttttgagctatccaagtttcttcatgcaaatttctgttccaaactggatttggaagccgtgacagaaactggactgggtccaggattgaatctgatctggtaattaactggcttggatccagttagaggccctgtacaactcactgggtcagaaagaaactggtagtaaatggtaatactgcaggggttgaaaagtttggcttttgaaaattcacagggatttttgtgttctaaccctttgtttcatttttcgtgcacatgtaggtaggaaaaaaaatcattggctaaattaatcaagggaacctgaaaacaaagccaatatttcaaataaaaacgggatcccttctgcctgccttggcatcccaaagtgctgggattacaggcgtgagccatcaggcttaaggctcatttttcactgattttcttgatctggcatttaattatgaaataataaaagattcatggatattgttcttgccttgctgaaatggtattagctaagattttaatttattattactgttatataaaatgtatattatatcacatataaatatatattagttctatacttgtgaaaatatcaatctctagagaaatcattcgaataaaaatgtcctcatgtcaaaaaaagaaaattgggatccttaatatctggaaaactgagttccttccagcttacacattaggcctgggaagcagcgagtcttacagaaatggcaaaatgttaataaagataactcacagtgcaatgttctgaatgaacaatgcactgaagtgcatttgaaaatgagggttcccaaattagtctcatctagggatgcctattaatatgcagaagcttctaaaaagatttagaaatgacaggacccatctggggagaagtttgacacttgccagtttgatactgcgtgctaagcagaatggctaatgtctatgttttgtcacaagtattttgctctggccagaaagaaaaatgctaatttggttactctatgcaaccccttggtcagcaacttgcaaaattgaggatgttgcttgcctgtggtttcataatttttctttgtgatgcaggatggaccccagagctatggtatggcaaacagggttgctgggctctcttagggaaagagaacccagaaacctgacatactggcaaaaacgataagaatttcttacaagtcagacttctggtctctctctctgtgcaaactggttgaatgaatggtaaaaatcactgtttatcccctgtaaacttttgattaatggaaaaaatgatttctgaggctagtcaagctgtagccaatctggtgtggtttgtgtgtctttctgcacggttctatcataaggaagaataccgtaggataaaacatgggcttagaacctcataaacccgctgttcaagccagtctggcaaactggtcagtaacaaactttgctgcagttccctgaaacaagcaaaaaactggatgagatctccattttgttttatgtccttgggaacttgatcttgtaaccacatggcagtattttcttttggtctctgacattttacaatggcggtctggcttaggaaatgagtactttctggttaatgtctgtgtggcctttaccatttgctgattcttttcccccaccatgagcatcttctagcttcccttcttatatcttcctttctcttagttacctttgaagattctagattttataaaaactgtttgccacctctttgaaagtacctcatagacttgtggttaagtcataaccttagttcaggcttcttgttttcacctgtgaggttacttttggcaaagtttaaaagcgagaaatattggccactttgtgtgcctaaagttgagtaataagatatttaaaaaaacttttataaacagtgctatatttaaaagtcagcttaattaaagcaaatactcaagttctaacagcctgggacaccttgggaaaagcagaggaagcaccacagaccctgttttgggaaaaacctctgttttcctcataaagcctcagaaattaaaagcaaatagatccctctcgaaatctaaggttttcttcggttttgcatggtgttagctgatgattttgagttatcaagggtatcaggaaatgactttgaagactcccatgggagatgggctgactccctctttttgaaatgcaggttctggtataaagatgggacccttaatttctgaagatctgttttgccttccagctgtgcctgcttattatattaggctgtagaaactgcatactttcctggccctattcctccaaggactccatcctaaagcaagtaatccaattaaaaaaaaacttagaaactagtaaatgaaaaatcttacaactattggatcttcttctgtctgagtagttatatatatatgtgcgcgtgtgtaatctttacataaaagagctctaatttgcttaaagaaaaataagtgcttaaatcaaatattttgaaaaaattaaaaactgtaatgccttttagttcctgtagctttggtaatctttgggaaataaaaagttttaaagattatgggtaaaataaaaatgtcttcaaaatgtaaacgtggtctaaattatgcaggtcagatattaggtttgttaaatgctttaaggtcataaactgcttcttcagcttttgaaaattgttcagttaacctattttggagcataagattctacataaggcctggggacatgtggaattagccatatcccttagctatgcaaagaagttataaagaaatgagattatatataagaaagaatcttgtatggtaaaatcttgtcctaaagtaaaataactggttatttaataagactgatgtttaggacaattcagaaagtccaggcatgttgtagatggtctttgtaagttgtgaaaggattcatgaaaggatatttatgcactaaaagtaaaagtttctaacagttaccattatatcatgtaattgagactactaaaaaaaaagttttacatgcaaggtgcgtaaagaaatacattagtctgttttcatgctgctgataaagatacactcgagactgggcaatttaccaaaaaaaaaaaaaaaaaaccaacagtttaatggacttacagttccacatggctgagaaggcctcacaatcatgacaaaaggcaaggaggagcaagtcacatctcacatggatggcggcaggcaaagagagagtttgtgcagggaaacttccacttataaaaccatcagatttcatgagacttactattatgagaagagcatgggaaggacctgcccccatgattcaactatctcccaccaggtccctcccacaacacatgggaattcaagataagatttgggtgaggacacagccaaactgtatcaggaaagtaaaaggtgcttttagtaaaagattaaaagaagtcatcaaaatgtggattttctttcctaaatttagacggttaaaggattgttttaaattaggtaagataaagctaaaggtttcaacaagttgtggaaggtttgtgaaaaattaatcttgtaaaaaattctctgtgtgaacctattggccagttaccatcattttgtgtgtcaaaacttggtgctaaggccctaagttttggtcacattgtaacctaagtgagaacctaaccagaaagggggaattttttttaaacaaaattatgggaggcccttgttttggacttagctcatgcattaggccccaacagacaaaaccaaacaaaaatgaagtcacttgtggtaaatgtgacattatcaaactgagactttaaggaaacacatagctcctagaccagaacagaccaggtttgttctcctaaaaacaagatgttccaacataaggggataccctctactcaagtccttgttcctacctttgcaaaactcacagttctgtttccagggggtttcaagaccaaattagtaatttatgatggtgatagtgatagtaatgactaaagttttggtcaatctctcaaaattgagaaaatgaccaaaagaggggaattgttaaatcaagtttagtctaaagctaccttcttacatatttaagttcagcctacaggtttttctatacatcgtgaactataacaagtggagatgtaaactgacctcagccaacacctgtgccaatcactgagttttagccaataaaatgtagccaactgtccaaatcgtgttcaaataaggcaaacactaagctctaattaatcccgttgcttctgtacttcacttatgttttctgtacgtcactttccttttgctgtctataattgttgttccaccacatggctgcactggagtctccctgattctgccatgattctaggggctgctcaattcacgaattgtttattgttcaattaaactcctttaaatttaattcagctgaagttttttcttttaacacaaccaatataaccattctatttttcacttctggtacagtattcaacaaattatattagatattcaacactttattacaaaataggctttgtgttcaatgattctgcccaactgttggctaaagtgtgttctgagcatatttaaggtaggcttggctaaggtgatgttcagtaggttaggcgtataacgtgtattttgacttacaatattctcaacttatgtttatcagaacataaccctattgtaagtcaagaagcatctgtatacatattgttaaactttaggttggaaaatgcttcctttagaccagatttcactacataaaacttttgtataatgaaagacaccatgaaagaagagtcatggcaagttagagcctaagattccaatacatacaatgataaaaggattttttttttaatacatagaaagcttcttcaaatcagtaagaaaaatgactaagaacctcattttcaaaaggaccaagaacaccaggaagctcataagaaatccaactggtcaataaatgaaaagatgtccaacaccacttatatcagaaaaatacaaatttaaaaaacagtgtgtgatttttaacccattacataggcataaattaaataaatgctggtgaagtatgagtaatgggcattctttctttggtttaatattctgagaggccaactgtgtagtatctaccaagtaatgggccaggacacaacaattccacttcagtcctatcaaggtactcacaggtatgcataaaccaaatatacaagaatttaatgacagcattatttgcaaacagtgaaagattctgagcaatcaaaaggttcattactacaggcataggtctataaattactactgtatggaatactatgcagccattaaaataatgaggaagagggagagtgccctgtatgcactgacatagaaaggtttcagtatatggtaaaaagcagctcatcttagaacagattttatagtatgaccccacttgtgtggaaatattttgtgatgtgccactcagtgtatacgtattcatgagtgcatatacaagtgtgtgagaagcaatgtaagtaactgttcacaaggaccccccctttaagaaggcagagggatcgggggatatagagtgaaggatgatttttgctttttcctctatatatataccattctctgaattaggtatgatcattccagggtatgttccttggattttttacactgcttccttctatccttcctgagaatcagatgtgtcctctttaatcagaattgaataaaacagtctgggaaaggttaaggtgaattatggctgggctgaaagaaatgggggccacattaaaaatggaaagaaaaaactaaactggaagtcagaagaccaactttctagtcctggttctgttgttacagtaggtagctagtcagacatgagcagggcaggagagggtcccctgccaccaccaggatgtcgggcaaccatcaggtgataggtggttgtgacagtgccgctctaataattggtcacacctggtgccagagaaaggcagtctcccaatagatataaacacctgaaactggtgatcagcagcttcctagtaagatctcaggagttgggtgagtgggctcaagcatgggcatgaagaggcaaaacagcagagtttttagctggtatatgaccttcctctagaaacgcttgactggttagggaaaaatgcctcaagtgagcacgtgtacaactccaataaacacactgtacatgcagcccctcccaagtgctggcaggccactgcacatgctgatagcccactccaagggaggaatccggggagaaggacgcaagaccccggaagcataccaacatataaaaccccaagtcaaaggtcaaacactgcacttgatctctcaagtaacccacttggccctgttctaagtgtattttacttccttttgttccagctctaaagttttttaatcaactttcactcctgctctaaaacttgccttcgtctctcactctgctgccttatgtcccttggtcaaattctttcttctgaggaggaaagaattgaggccgatgctaacactatcactaattagcaaatgtgataacctttctggacatctatttctctgtaataaggagagagctaaacctgatattctccaaggttccttccagttcaaagaacacatgaatactatacataactatgctggtgtcttagccttgagattctagtttcccaactgaaatgtctgaaaatacttgatttaaaatattttattaaaattatcatcagcatgtagccactaaaaatggttactaggaagactacagaaaaaacatggaaaacattgataggataaaaaggaactcgataaaaatgctgggttcagcatggacacaaccatgcaaatacacgtgcatggaatcaaagacttaaacaaatacacaaaaaggaaaacagttacttcacctgtctgatgtctttttctgacaccaaccaattctccaatagcaacaccaattctctgatgtcaactgggtgtcctacaattcaattcaattcaattcaattctgacaccagagttagcatcagactccaggtttacaggctcagccccacaatgatagtgacaggaggcagccaaatacctaggcagataagggtggatccctggtgaaaccccacctcaaagctaaagacagtttaaagcctgaaagccaagctgtaagttaaatccttggaccagactgagaacttatcttcccatttgatgcgttttcctctgattgatccccacccttcccctattttatatacacctacccttttctaattggttttctacactgtcatgcccacctttgagtggtgtctttactttaaccttttttgcatattcacaaaccaatcagcatgcactacccattgtgagtccataaaatgccccagacccaaccacaggcagagaaaccacctgactgtgggggtgtgggatcatcccccactccccacagtcccttctctgctgaaagttgttccattgttcaataaaatcctccactctcatcacccttcaatcgtcagtgtgacctcattcttcttgaacgctggacaagagcttgggacccactgagtgcaggtactctgaaaggctgtagaactaggcctttgccctcactggtggacgccagccaactgctgactgggctgctaacacaccaccatccacccggctgcagacagcagaactaaaaaaactaattagcacactaacattccctctggggctttggggtcgcaggcacccctgcctgggcattgccacattccccttgaggtaacatgcctggtctggcaatgggcactgcacagaagttgctcctatgttggcacttggagctgccagccaaaccctgcactcgttcactcatgtgctcactcccacaaggggctgagtgcagcatgccgagtagacggggtgcccctgctgcaagttcgggaaaggggccaagaagaatcctgcttcaacaagactgccctcattttggaggccaatagcaagtactgggtcctcagaatatccatacatctgactaacttggctacaaacttcggtgttcccacaatactccccatctcaagtttgataatttcctggaaaagactcacagacctaaaaaaaaaatgctgtctgtattgttataatgtattataaagaatacaaatgagctgccaaatggagaggtataggtgaagtccagaagggtctccagtaaagggagtctctgcccctgtggagctgaggcatgctacttttccaacgtgaggatgtgttcgttaactcagaaactctccagatgctatggtttagcgttctttcctttctttgttttcttttttccttttcttttctttctttcggagtttttaatgtagatttcactacgtaggcatgattgagtaagtaaatcactggacactggtgaatgaactcaatctccagtgcctctcctctccctgagagttgaggaggtgctaaaaaatccaaccctctaacgaagatgtgaaccttccggtgtccaacccccatcctgaaactttctaggggccttaccaggagtcatctcatttgcataaactcaagtacagttgaaatgggctcattgaataataaaaaatccacatattactcctatttctcaggaaattcaaagggttttaggagatctgtgcctggaaatagagacaaagaccaaaaatatatttcctactgtacaactaaatatacatttctgcttacactccaccatctcaccaagatgttctttaagagtatttctacaatcctgtaaattaaaaggttagatttttttcatctaaatattcttatatttattaagtcctcaactatgactatggcatcatttcatttttacatgggtttggatcaagtaaaggtgcccttccgcaaaaaaactttcaggatgtaaaaactggttcctgtaagaaaagaaaggcatgatcttaacaatgttgcatccatctatactatttcatactgagaagcaagagcaatctgtttatcaaacccaattaccctttccctcctcttctacatgaaatggtcgcaatagattaggtagagagaaagaaaactaaacactttgcaaacatcaaaaaggagttgaagaaatgagggatcccaccatgaggcagacataaagccaatcacagcttccggaaaatgcaggctgaaattctttccaacagtttttggtgaaagcttttatgtctcagttatttaaaactctatattgcctaattattcatagatcagttctagctacttgtatcttacatggaaatacaaagagctgagagtaaccaaggaacaaggacacattctagcagggtatcataactgattacagagttatagttgtaaaccaaaaataaaatttgaagccctccaacccctgcaaccatctgaatggactctctcctcagccacagcactcaaaaatttaacctgaacaactagttcaggccatgatgggaagtggggattggacaatgcctcattatacccctgcagcattaatatcaatatagaccttaagtctgataaacatctataatctattctctctgaagcctgctatctggaggcttcaactgcatgataaaaccttggtctccacaaccccttatcttaacccagacactcctctctactgataatagtaactctttcaaccaattgccaatcaaaatatgtttaaacctacctatgacctggaagtccccccaccccttcgagttgtcctacccttccagattgaaccaatgaaaaccttacatctatcgattaatgtattacatctccctcaaatgtataaaagcaagctgtaccctgatcaccgtgggtacatgttgtcaggttttgtgtttacacagtcattaagacagtgtgaaactggtacaaggctagacaaagctacagaacagtggaacagaatacagcccagaaggtgaaggtaggcttttcaataaacaattctgggtaatttggacagaaaaacaaatttgactgtacttcaactcatagacaaaaaaaaacaaacaaaaaaatcaacgcccagaatattgcaggtctaaatgacaaatgaagagcactaataatttttaaagataattaaaatatatgtattttcatgattggcttagaaaaataagaaggctcaaaatgccctaaccaataaaaccagattcattagagtaaaactgagaatttatcctaatcaaaaaccactattaagagagagaaaaaacacttgcaacacacttaaccaaagagctcaaatccagcatataaaaataacttctctacaaattaatatgagaaagagagacaattcattaaaattaagtgactcagacaggcacccacgaggatatgcaatggccatgaaaaagtgctcagcctggctggtgatcaaggaaacaccaattaaaaccagaatgagctcaaattagaaaaaccaaacacaccaaatgacaagaatgcggagtaaccagcactgtcatatgctgctggtggatgtataaactgataaaaatccctttgaaacactgtttagcatcatctgctgacatagaatccagatatgccctattaccagcaattctatttccaggtatacacccaaaagaaatgtctccctgtatttaccaaaaggcatgtccaagggtgttcagagtaatgtttgccattaaaagaaaaaccttagccaaattaagtttaacaaagtttaattgagcaaaggacaattcgagaatcaggcagtctcctgggccaaagcaggctgagagaccccagtgcagccatgtggcacagaagatttatagtcagaaaaaggaaaatgacatacagaaaaccaaagtgaggtacagaaacagccagattggttacagctcagtgtttcccttattttaaacacagtttgaacagtaggccccctttgattggccaaaactcagtgactgccacaagagtaggctacagtctgtttacacctccatttgggttacagttcactatgtacatagaaaccttaaggttgaacttaaaatacataaagaggcagccttaggcttaacttgatttagcactgtaacagccacaaactttgaacaacatcagtgtccaccagcattagaactggataaatatgttgcaatatattcatacaatggaatactataggggaatgaaaataaatgaactacaggtacatgtagcaacatatatgattctcacaagcataacgttaacagaaagaagccagacacaaaatgagttaatttatattaagttcaaaagcagatgaaactaggccgggcacagtggctcacacctgtaatcccagcgctttgggaggctgaggcaggcgatcactggaggtcaggaattcaagaccagcctggccaacatggcaaaaccccatctctactagaaatacaaataaattagccaggcacggtggcacacacttgtaatctcagctactcgggaggctgaggcagaagaatgggttgaacacagaagcagtggttgcagtgagctgagatggcaccactgtactccagcctgggtgacagagcgagactccatcttaagaaaagcagataaaactaacctatagtattagaagttaggatagtggttttctttgacggaaagggaaattgtagcaattggaagggggcaagaaggaaccttctgttgtgctaaagatgtactatttattgatctacatagtggttacctgggtgtgttcactttgctataactcagagctatatactcttgtgtacttttctctatttttgttattcttctataaaaactggtttaaaaaaagaaagtcagtggtgctgcagttgaacttcatatatattgtcttatctctacaataattgtttaaaattatcattaccctcctttttagagacaaggatgaaaatccaaacaagtaaattatcttgccacatgtcacagctggcacatgacagagccaagcttcgaactcaagtttagttgatgctcaaacccatgaacccctgcagtaaaagtaatgtcaaacttaattatttcttcaggactttcccggtcctactttcctttccctctgaaatcattttctacctttctcatctcatgttctcaccccttcatcaagtgcttccctttatcttggggggaaaagtgcttccgagtttacctattgcaactttgggtttagttatttctcagaaataatttgttctacaaaagaagaaaaaattgttatttacaatttcccatctggtttctatggagaggggatctgaaagagtgtgctctatttgctgagctagttgatggctataagcacatgaaagcagactgagcggaaggaactaaactgcaagtgaaaagtatgatggggctggtggtggaaaggcgtggcggggctggtagtggaaaggcgtggcgggctggtggtggaaaggtgtggtggggctggtggtggaaaggtgtgatgggggtgctggtggaaaggtgcggcggggctgctggtggaggaggctgaagccaggatggtggagaggtcgcttggtggatgatctggagaaagaacacttggtggctggcaatagatggagatttgcagaacagaagaaaaatgaagccacctggatagaaattatgagaaagacgacgactgaaaaatgtttgtaaaaatgtggtgtggaatatggagtatcgacctcattctaatcttcccaaaagaggactcaaagtagactgaatgcactggttttattttctctaaaacccagtaaaaccactgaaataacaactgttaaaataaaaatgtttgctcatgtacctcccaaaaccatttacatgtacaccatgcattttactacacaaactgtggctcaatgaacggtagttgaatgaacctcaccttaactttccaagaatccacagcctagaagcatttttatttgcttgaaattgcttatgcttcatagcgtaaaaaataccattcactcccttctttgattcctatttgaggaatcaaaagaacagcgtgaaacaaccaagtgagtttttgcagatgagtccagtgagccaggatggcctcatatgctctactttattgttcaggtccactcacttcagatcccgtaatttgtaataacctgcataattttttattgacaaatcatagttgtatacctttacggggtagatgatgcggtgttttgatacaggcataccatgtggtatgattaaattaagctaattaacacatgcatcacctttcttgcgtatcatttgttatggtgagacatttgaaatttattcttattttgaaatacagaatacattattttttactataatcacactgctgtgcaacagatcacaaaatctatttctcctgtttatctaaaatgttgtgccctttgatcaacaactctccattccctccgtctcacatccccagcctctgataaccatcattttattctctacttccatgagttcaactttattagattccacatataagtaagagcatgcaacatttgtctttcttgtgcctggcttatttcacatagcataaggtcctcctgatacatccacattggcacaactgagagaattccccccacccttttaaggctgattggtattccattgtatatatataacatagtttatttatccattcacccactgatgaatacttacactgatttaatgtcttggctattgtgaatagttctacaatgaacatgggagtgcagttctatcttttacatattggtttcagttcctttggatatatgcccagaagtgtgattactcggtcattttgtagttctatttttagttttttcaggaacttccatataattttccataatggccgtactaatttacgttcccacaaaaaatgcttctgatcccatgtattttccttgttggatctttagatactggtacattggcaaaaagatttaaaaaaattttaatccatcactcttcaattttagactatctttatctccaaattataattccaactcataattattacacataatttatcaacagagtattaataagttatgtgtatctttcagcaattcataatctcactactgtcatctgtaaaatgagtaagttaaactaaatgacctaagatgtttgcagctctcagtttttatattctaaaaactgagactctatattttaatctcttgcttctactctcctgagccaaagatctttactagtatctccttgaacacaatatgtgattcttgagtctccagtccgcacttttgattcctctcctaaaagccaagctttagttcccatttatgttgggagagtcagtctcctctagagctcccagctgtgtacatatactaagtggaagcttagcacaatacacttcacctctagtttcccagtaaacctttttctgcacccacaaactgcaagacttttctggtctttagtctgtacagcttccaatttctaggctatcacaatccaatcaactccatgcaagtgatgatagcaggctacaggggtctatgaaagatagtacaatgcacaaacccattccccagacggtgaaagagaaaattaagataatttgtctggacacataactttaaaggaaaatccattgctgactaacgcagcctgttagctatgaatgcagaaattaaaactcaaattatagtaggccaataaagtagtacaaggtgtttataactctctttgactgataaagcaaggatacctgacttatcaggaagggtggcaaatagctctcattttataatgacgtaaattaaaatgagaaacaaaccagaaaataggtggatctttattaaattgaggaatggtttatttctctatttaatttaaaatactctaaatagggatgtttctaaattgctcctaggttctgaggaaagatgtgtctgctggagaggccacatgtcttgacaatttgcttactttcaataactacaatgtattatgctaagttctcttctctacaaaagctatggtcctcacactcagcagggcagtacatctgccattccccagccccaggccagctctgagatgcttcaggtagagagaaaagcttttccagatgcacattgagagagaaaccacatatgcacaattcaactcagaaagcacgagtgtttttcttcaaacttttttctttctcattctgtgagtaattcagtcactgacagttccctaaatgttatcattttaattccgaaaacattaacctcacttcccctgaggattttgagatgtacatcatgacaatgtattttttaaatgtcttaataatgagaaatttcaggtagcccttcataatacaacataggagatggaggcgaaacgaagcccagctttcggttgagtgttcggaacaggttctccctctgaacttccaagtgcccacagatggctgtggggtggggtagaggacctaaaatacatgttaaattcggtgtcatgttttcttctgtgctttctatcattgctagattttaaaggaatctaaaaatatgaagaatcactaaccacagtaaaactgagggaaggtaccacaggtcagtccaaatgtgtccttcacccagtcaagccctgtccctggggagaaaatcacctgcaataaagctagcatgctcgagtcactagaggcttaggagcacattagatttctaagaaaaataaatcacaagaagcaaatccatatcatgtatttatcttttaaaacatatgccagggaagatatttaggaaaaaatacaagatatatacatatatacaaatatatatttatatgtaaataaataccatacatttaatttgctgaatgtcaagaaactttgaatagttttataagacacgctcctcgtgaagttactaaacattatcattcctacctcacattgatttataaactaatacaattccaataaaaattttaagtttttctagaagaatgaatatataaggaaatccaaaaacatttttaaaagtatgcaaaagaaatggaaccgccagattctgagatgtattgtaatgctacaataagatatagtataatatacaaacatatcaaagacaatagaaggcccccaacagtcctaaacaatatagaggaaataattattccaaaagtctggtatggaattaattagcaatttagaaaaaaaagttgtcttcgatctctacctctgactgtataccaaattaaatttttcatatgaaatggagtgacagaaagagagaaaaaaagtagaaagaaaccctttaagaaacgtgaaaacattggtaaacttagatcagagaaagtcttttaagctaaaagaattatcagaaattatataatgaaaggacagatttgattatgtaaatatttaaaacttccacacatcagacaacacagtaaaattaaaaacaaatgataaaaagtaaaataacagtttcaaaaatggtaatttttagggataggtatttagtaagaaaaaacaactatggcaatatggtaatatacatcagaaaccttaaaaaggcatatactcttatgtatagcaattctacctataagcatttatcctaagataaaatacttatagacaaagacttacagtagttatttataatacatcatgtataactcaaatttttataattagtaaaactcatttaaagagtttaaataacagtaggccaggcacggtggctcacacctgtaatcccagcactttgggaggtcgaggcggggggatcacgaggtcaagagatcgagaccatcctggccaacacggtgaaaccccgtctctactaaaaatgcaaaaaaaatagtcgggcatggtggcgggcgcctgtagtcccagctactcgggaggctgaggcaggagaatggcgtgaacctgggaggtggagcttgcagtgagccaagatggtgccactgcactccagcctgggcgacagagtgagactccatctcaaaaaaatagtaataataataatcggaaaagaacagtagtctataatgattcaaattctatttttatttttccacattaaattcataggcctagtttcaaaagtgacaacagtttctctgaaatagaatcatagaaagtttcttttgcttcatgatttttctggatatcttcaaattttactttatttggggaacatttaaaaccttatgagagattttctgagatcagtaaacaaatccctcacattaaaatgaagtagttttctacagagcaagcctcgaataatagctgtatattttctatgaactgattatactagaaaatataaccctcccacaggatgataataacagaagcttgtctttgtgcccttgtactaaactcccgtgtcgtgtggtatgacaacaccagcatgtctgtgcagattcttctccaggagggctttagaagtctctctgcccagggcctgctgggcgcccatggtggtaccataactgtgcaggggatcttctacgtgcttctccaggtctgtgccctttctgggccccggtgacaggcctgaaatgatagcctcaagtggctcccagtctgctgacttctctttgggtttggccaatgggaatgacgatgagggaccagagagtgggatgagaagagatcaggttgtgtgccctcagttcccagcctggcatgtcactatggaccggcggcacctccctgctgagggctgcgggtcctgcccagcagctgcctccacaccactcagcctccctcttaagttctagttttcgatagcgacttctactcttgccccttcaggcttgggtgtggtaaaagcttctccttggtactggccccagagtagcgctctcttactgctttttctaaaccccgtctgtacctctgtgaaaggtctctaataaactctcctcaaatcactccatttgagtgccacctgattcctgattagtacgaccctcattgatacagtcatatatgtaattaccctagagaaaataaagttaagtgcgtttggactaaacaaagcaaaaggaaaaaagtgatctaatgtggtttaggaaattttccattcaagtttgggttaaacagaagtttagccctatgctacttctatgcttcaattacctagaacatccttatgctttctttactgctgtgtctgaattgctctgctcagatgaaacaatcattttccacccttatgctgttcattcttacacaattatgatttttggaaaatcaaatgtgggaaagaagacttaaattgctatacatattttcattaaggatatgagttttcatcctgtaagtcaaacaccacagaaagaaaatgctatgaagtaaccaatgccctgcagaaactgtgtaaatgaaagctagaaatcatctcaagattcaactgccagtgtgttctcaatcactggagtaatttgatattatggaaaaacctactgaaccacccaactttgatctgttcatgtctatcaatgaacaggaatggaaagaagttatttttctataaccagatagatagatagacctcaatgcacacatacacctaataaaaacaacaaatataagccacgtataggtaatctccaaatatcaggaagaaggcagagaggtttcatggatatatacacacacatgcaattcttaatatcttacatacccatcctctaatgctttggtgtcattttacagttcacgtgaaacttccacttaaatagtaaccatatctagattcccatttcatttaaataaattcaagtaaagttcctaggcaggtttccagagagttaggttgctttaaagttggccatgcattaaataaagctttgtctcacaaaagtgaacgagtaactgatacggtatctgtacattcactctgcacaaggttcctttatctcaaaagcattactcgaagacaaacaacaaatcagattacagctctagagaaccatactctgcctcttctagcaacactgccagctcacaaaattgtatgaggaccaaccaccggcttcctgagggatttgcaatctaccttctccatcaggtcccccaaggttctcctacttcacacacattccccctttcattcattccactgcattcatctttcatctttcagaggctcgttaacaataagtgtgcaaaggttcactttaacagcaaaaccaaaaagaaacccttcagcattacattttataatgaaataaaaccccaaattctgagagtcaactaagctagaactaaaagccattgcaggaagagattcattcccgggtccctagcttcctttcacattacctgcttcagtgtacttcagtcccactttttcttctgtgtcttttgtctttgggggtggccagacagcttgaagtctgccaggagtcctgtcatcctgctcagtcaggctgtggtcaggctgttgaaagagcaggcaaatagtaagtggaatgtagtcagagccgattaattcctgaaaaatgacatgctaaacctaattctgaagttaattttaatggctagttgcacattgctctcattcactataattcagatatctcactatagtgtgacccttttccagaagtgtaacgtgatcagttgaggtgaaaatttaaaactacaacaacaaaaaaacctcaaggctaagtatatatcacacaacccttaaaagattatttttattatataattatttgaaaaagcacaaatatactttgacctgaaggtacagacataaatgtactacactgatgtgcatttatgggaatgtttaccaatgtatcccgggactccaggattatttaacacaaagactaatttcaagaacatcagtggtagaccaagacaccctttttcaaacattccacactgctaatttccttttattcctataaacgaatgaatgagatttgccttcatattccagtcatttttatatgtgttgatttttacaactaggagaatgttatattgtgcttggttttttaactgcagtctgagaaattctgccaaagactttcatttttaacattttaactgaatattttaaatatataggaggaatgatagtcatacactgaattgatattaagcaagaaattctatttattgttcttctgatcgtttaagatctactggacaggtacttgctcatctttataaattacctgagttagttttctttgagtaataacagcatctattaattagatgcttcccatgcactgcctttgtttaattctcataacaaccatataaccattttattttcctcattttgcacatgaggagattgaggcttggagattatcaaggttacccagccagtaaatggcagaattagaataaaaacccaggtctcattctaaatccagtgctctaaatctggaagccttccaaccaatgtggaacactctaatcacaccacaaacacatattttgtcaaatggcagactttcaaaggaacgatagactttctgcggaggtataattaaggggtgaggaaaccctgtaaacctgggctatactgccatcttgcatcatttcctcatgctacctagttttataagtgcgtttaccatcaacgtttaaattcacggtgacagttaccctttcctacctgcacatctttgtgtatatccctcttgcaatattccagataaaaatcaggacgcatgaaaagcacttctggttaactccatactccttacaggacaatataatttgactataatcctttttcaactaaaagaatcactaacaggcaactaggattcactttgggaggaaacctggaaagaaatacagcagcaccatattttatgttaaaatgcaaaacccaattctacatacacttttggaatcagaggggccatccgctggcttagaattggaccgttcaaacacagctcttagcgactccttctcatgtctcatcttgcgcttgagagcttccagctcagaggtgtcagctgtggtcccctttctggggggccggatgaatagggctttaaaagcctccagggctgtctctggcgactttggcttgacctcaccaccctgggtttgtggtactccagggccgctctggctctcttggtcagcattgcagcccatctcttctctcctgggcgactcagggtctgctcccttcggttcagttttgggcatgtcaatgttgagcagcagagagagctgctccaggagagtgggagtggccttcggatcagttgctttcttctcactcttcactgtctgcagccctgcctgcactaaggacttctgcacaggctgcgtcaatttgagcaaagctaagtccccatcctttggtttaatttccgtgatggtctctcctccctcagcggtagcccccttcttcagcacacgaagcccactgaaaaaagctggaagttggaatgacttctctccagagacttcttttttagaagaggcactctcagtgataccaacactcgaattctggtttgttactgcaggtaggtcttgggacccttcttctcccacctggtcctggctggggcgacgctctgtctgaagaccaccgttgccagcttccagtttgctgctcatctcaggtggaatcctttgaggatcttctgcacagagctctgcaccattcatttccccagtgacagtattttccctgaaacctcctgggttttctttggactcctgagatggctcagataaaacaccactaggggactttgggccattggtgctgcttccctcctctggctcctggccaccatcatcagagtcagaatcactggtggtgtgcaccagggtcccacgaacacaaatgacatcgtcttttgtccctttcaaagtagacagtggaagcagctcttgagcaaggagagatgtccctgcttcttttctctgacttccctctgattctgtctccacgcttgcaattttctcatcatttccgaggtcaggtgaaacccgagaccctgcttcctgtggatccaagccattgctggaatcatcctgctgagatgtgggattcacgtctaaactatggaatgctttcagcacagcatcttcctcttctggattcacagattctaatttactcgtaaacccaaatagggatttcatagagaacttactcaggatcgactgagccacttcaagtccggcttctggttttgctggttctgacacatcactgccatccagagaattatcaacgttctccatgtctcagtaatgcccttggtggaagttctgacttgtgttaccttctcctgcgctctcagtttatccactccatctgctcttaatttacaggacagagagcaacaggacccgggagtcaggctgtcagccgcacagcaaacacacttgg

SEQ ID NO: 617 - DNA, 429190 bp, Homo sapiens
tggacatgaaaccaagatttattaaaatacccttagcatatttacaattgaaagccatgaatgcaattctctgtaaattccaaaaaatataattctcttaaaacaaattaacagaggtatcaacagattaggataaatataatctatcacagagatagaattttttgaatagacaattgacgtttttctaatcaatatatattatgtacaaaaatacacttgatattgtgaccaagtactgtcaaggaggaaaaaatatatatatataatacacacatttttattatgtacaaatcagtgttggttccttcactctctttttaaaaataaatacttcatttggttgcaaatgacatttataaattcaactcatgagcatttctcagctttgacaaaattaaatatgcaaacaaattagaaatacgtatttttaaaaatgcaaagggaaaaatacctgaatccaatgagcttattatgcttaaaaatatcccaagagcgtgtaaggtttcatgtctttaaagggccttctcctttccccaactgtcttcattactgcctacaatcttttcagattatatctacagactggtctaatacttaattaaacagaaaagcctatgttttaccaggttaaatggctatttaggacatgcttgcacttttaagtgctttcaagagtgtagcagttactgttcatctgaaaataaccaagaagtgtcaacatcctgattcagaacaggggtagatgtttgaatcatgaatagtagtaagaatggagcggcaataaaaatccttatgattcaaagtgtttgcctgcacagaattaagtcaatttgtccagcaccacagaaagttacttgagattcaaaaatctggcgttctgcatcatagctggtgacccggtctgatgtacaaatttatcaagagaatggccttaattagtttaaggtaaaatctatgagaaattgagaaggcctagaataagaaccccccccccaccccgcccaatcttcttaaaataaaataaaaagagacgtattttccatctcttttatggattttcctttttgcttaagtgatgaggtgatgctgacattaacaagaggcagtcacagcagtgtgtctcacatgggctccttggtgacagcggagctccctgtccaaacggctgaggaacggagcacagggtgtgagaggatggaggaggggccaagggagctactcagttgtctatgatgcagaggtgtgaaaaaatctgggtctgggggaaactgtaaagtaggaaagaaatagccatggaatatgaaggaaaaggacgaggaaacagaagtattgaaagaagaaagtgaaacaaagctagaagtcaaaatgacttttgaacaggcatggagtaaacagggtctatggtcaagcagccccatggatctgaaattgttggagctgttaaaccaagcacagaccagtttcactggggtacctgctttcccagtacattggcactgatcaatacaagatcaagggcactcacatttgcctaatacagatgccttgaatttccacggaaaagctgtccacgatacgaccatggcaaaaaatcaccagctccctaacaatgtaatctatcagcaaaacattgcactagcctcgttcaaatttttctcctccatgcgtcctttttttcttgctcatcccattgcttgcaaactcacaagataccagttatatgaagacataaaactgcatggatcaggtgcactttagaaagcagcatccagggtccagggtgtcactaagaaaactaaaccctgaagtacttgaaataatttacatttctgctaggtctgattcatactaggatgttgactgccttcactcaggttctaggcatgcaggccagtgcttattttccaggccaaagcacgatcccctaaatcaaagtccaaggccaccctgcttgccatgctagtctaaatgaaaactcaatgaaagaaaaagactatgataaaccaatgttttctctaaagattcttaaaaattatccaatttctaattttaaaagtttctgcctttttagtattttagattggttctttaaagggaagttctttttattaatgcatactctctttgaagataagacatctagctgacagtagggtcatattacttatgccttgggaaattacagaattgcacaattataaatttaataattttggagtagacctatcccttaggtagatccccaaaacctatttgtgtcattgcgagcaaacagaagaattgatactagactttccctctcactcatggatttgttttcaatggaaatggaagccttccaaatattatgcagaacacaatctcagtggcgctgagctaccttctttatgccttgtggtccaatgtatgaagaaataagattttatctagagacaagttagcatgaagcgaggaaaaaggagatatttataattcacaaaaacatctaaaatgtaaagatttcaaatgtccttttagtcccttactgggaagagcagtataatttttgtatgctataaactcctttttatacatctcctataaagaaatctggaattcaaaatccatgctaagagtttccagagtgttcatccctcaacacttatcatccatgtcatggggaggtagagagtaatttccctgaatagccagtggtctatgggactaacctttcatttgggaaagacagatctggaaagcgaacccagttaacagtcaaaaacacattcgtttcataagaggaaagtggaagaaagcccctgaagagaacaatgaaggaaagcaggtacacgtttgccaaggacattaacaaacaattgctaatgtgtgcctgaaatctgatttccttcttgatgtattaagataatgcattggcagctcacactatacatggagagaaatattcatattaatttaagacgttctcatagtttcaaaggtagagagcccctcagtgtctgcacaggtagaatttaggaaaatgttcagcctatgtgagagctatagtgtggtagaggttgtttaatccatgccaaattctttggacgtgattttctgcctgaaactatagtcttctttgcattttgctggcccaatgtcatcaagtttcacacaaagcttggaaaaatagcccacaagtgtagttggatcagcctttagaaaaggagactagagattctcagtatatttaagagaagatttaaaaatagaaaattacataagcgtagagggaatgtagaaaaataaattgatggctatatctaacaccttcatataaaaatggaataaaagtcaatcttccccacatcaagaacttcagagatgtaatataaagtctggagttcacatgagctcttgactgaaggacacgatcctatcagagaaaggtaagagagaaaaggtcttctatggccctggttatcaccatagttaggagaagggctggggatagaggaggaaatgagttccgtaagttccaccagacagcagacctactgaatgaggcttaatttgcttccctaatctctccattggtagaaattgcatagtggcttaagagacagttagccagctgccattttaatatcttcatgtttccaagttgttaactacacgtttcccaaatcctaactttatatcacagtattggttaagagtcttggaacaaataaggatactgaattggcttcaaatttgacatgttaaaactctcttaaattcatcactttccaacaaagcattgatctggaagttcagtagattgcccattccttgggaagggagatgaagaattgtgaaaccaaaatgcagtgcctctaataaggtgtcaacagcggacaggtgtgcagaaatgacacaaaatgggcttcccagtcacagacaagctgtgtaactgagcccggttatgcctggattcaattgctaatggagagatgaatatcattatgtaagtctaaagaagaaagatatgctaagtcaagtatttgaagatgcttttctttaagccacttctatactaataacagtttccaggcagctggattgtttctctctatagctggaaaatggaaatatatccaagttatttgcattttggaaaggctaaaaattatccactcttttcaaatcccatcagcttggccacacagactggtttcatctgtgttgcagatttctttatgaggtcaaagtagcagacatgaatgaaagttcacttctttattctctccactctcttcagttgtagggtccctaaaggtaaaataactaatacaaaacaaattttaaaaagtggaagctttttctttcctctccactttttggccatttttgtttttattaggacagacaggataaaagaaaaatgaagctcaaatataactgatgcttgttagcaatttaaaaagacaatttaaactgttttataaaatcagatatttaatatttggatcagatatgtgggaggggggaaggctatatatttttggacttcttcctttttgtcatataaagctccaaattgattttatctttgttgtttttgtggatggagatgagtactacaaaattgaccaatttagtatgtcagggaatgaagaggttccccggtcaatgttacagcctggttcctggaaaaagagcctgcaagcgtgcattgctaattcccattcacacactgacttggcgcaatttgctgtgctgttgtatgcaatgatctgcatcaatgacactggccaagggagaagcagaaacagaaatgaggacatgtaactttcaagaaaggaagagtatcattaaaatgaaaatttctctgttgcaaacatcatagagaaaatgtgcaatcccaggccaataagcaaatctttgcccaaaataaacatatttcttctgctacatctcactgcggcccttagaaaaaccgtaccaatgacttatcttactggaggtgttaataccaccaacatattttattccttccttcagtttttccagtttctttaccagcagtatctgaacttttcatttaggaaacaccattcttcatggtgcttatgaaaacaggaggtgcctgaaggaggctgagaagaggtttgcagcttctactgtccttgataggggaggggaggggagactgcatgccatctgatattcaattcctcaaccatactggcaatttgttttggctagaacatttaaaagtgtaatagctccactgggtttccttattccacttctcagatttcagaaaatctttataattcctgagtagttgcagtgagtgtgtagaaagacaccatcatcaacataaggattcaaaaggcaactgttgggcagtaggaccatcacctatgacctctgggcccccaccgtcatcataaacatccacttctgcttggccacactttttcttatttctttttccccagtaagctgccacttattgagataaaagccatacagcacacctcctaacctggtttttgatacttcatgggcctgatgcttttttttttgaaacggagtctcactgtcgcccaggctggagtgcagtggtgctatctcggctagctgcaagctccacctcctgggttcacgccattctcctgcctcagcctcccgagtagctgggactacaggcgcccaccaccacgcccggctaattttttgtatttttagtagagatggggtttcaccgtgttagccaggatggtctcaatctcctgacctcgtgatccgcccccgcttggcctcccaaagtgctgggattataggcatgagccaccacgcccggcccgggcctgatgctttttacctaacgtgtctgtagtgtaatttatgatgtactttgtgtaatttatgtaacttatgatattgtgtgctctgatgctgtcaattgctcatgcaagaatctgaactactgtcaaactgtgtcctcagatttaatgaatattgtctaagaggagacaaagttgtttgtaagttaagggttcttagagttactactaagtcaggtgtgtctggttagatgcagcatagcaaactggttactctcctttctagttcagggagggctatgcctagaacagccacttaaagcctgctggcaggatgtgcttaagctgccaaatggcatcccgatcacctcctctccaggaaaagttcagatcctcctgctacactgaacacaagctcaacagcattttagagggatcattttcaaggcctccagattattttagatgaacttccttgaacaaattgtcattgacctttactgagcatcaatttgagttaaaaatgaaggctgtgtcagcaacgtggtacattggtggacttgggagggggcatcccagatacatgatgcagggttcagaataggtgagaataatgaagattctgccatggtgtcttacaacactaacatcatacatcgactagtgtgacaaaaccactaggtttccccaaccgaggcaggcaaaccttgctttgtagaaataggtattttactgcaaagttttagtctgttcactaggatgaaatccaaagtgggctgtatttgtctaactctcaaattaagtgttctcactcattattcttcagcactggttcctgaagggttacgtggccacagtggcagccctgcttaccttcactgatttctcgtaagcatcctacttacagaccaaagtggactgcaatgagtacacctcaaacctcccgctgctctcaccatcaagcctataaggattgagacttctgctggccccacataactcaaaagagctgaattatatggcatgggtaaaactggcacttttcttgtgcatgataacactagaaggagcatacaatggttataagtggaatcagtttttaattgatccgttcttttggttgtcttcagagttaagtgaaaatgaagagaaactatgtaagaaagcagcataaaaagcttcttgctcacaagcaacttcaagcctttttagtcatgcatgttccttctcggcttttctgttttgcttgtctcgttccttcattgtgaattttaaaaatccaaccatgttaccatattcctttcagttgcaccagtagaaaaggcggttagcacctgcatgaatatggcttctgtgacttgatttgatcctgactgcagtcttcattctcgaagctgacattagattaggatatggtgctgctttcattactggatctattatagaagcattcctgaggggctgctggctggcaggcatatcctgggaagatgctcaggcacctggcaagtccaggggttctggaaagatgctggggcaaggggcaggccacatgtggaggctggatcaggaaggaatttaagatttctgctcatctctggactgtcctccaccaattggggggagaaagctcggcctcttcaaggcctaaaaatgagtctttgatcatattgtccattcatctccagtcctctttcttcacccctcacaagatttcagagacgtggcttaaagacaaaagtgtcagagaggtcaaaggtggtttccttatgtgactcaagagccagggtcagaaagagctgcctgtgaacaatattccacttggaagttttctattaatgtaattactttcattttgatgtaaggaaccttttttctgcccttcagtttttttgacattaaagagtcctgcttcatcctacttcacatgcctatcagccaaggtcatgagcaggtgctgtgagttgcatttgctctcctgtctggaaactgcctcctggggatgggggtcgtccagctgcacagtcacagcacataacgtagaactcggctgcgtatcaacacaacattgcccattcatgaacggtccaaaatgtaaaaggtgctctgccgctgggtctcttgtccaagcacacccaaggctgtgcttgctcaggtattacattttctcctgggagttggggtgcagaatctctgctggcccagaaaaaccacaaaggaccgatgtaaaaacaagaatgggcctcacttaacaactgatgtcaactccttgcatggtaacttgttctccaggatgaagtttatggctatttgtctccctctctccacccaggtatgattctgttttttctccttttcatcacgtaaaccataacaacaaaaaatcatttttttagtctggataatacatgttcttggacctcttcaagaatagttttggtgagttgcaacattattggagagaaagatgctgcaggattttgctgcaacaggatcaaaactaagaccaataatcaaaacagcagtgtgtaacgacaaagacttgaactctcccaaggcaactgtcctcaatgatcttttctctcttctgtgacaatgtgacatatatcaagctttggttataaagctggaaatctcagcttttaaaaaaattttggaaacattttggtatttcttctgctcttagagtggactttgggcttccacaagaaacagtcatcaaatatttctgcaatgttcccttaaatagttttccattgttcctgcggcttaatgagggacttcttaaagaaggcatggggcactctctgcagatgacctcagaaagagatgagcaaaaacaaacatttagtgacacatctttcaagaacgtcctgcaaccctgtggtcacaaagagtatgcgtgcaaggtcctccacctccagtgccatcatttccatgtgtcttcatcttagttagtggtcacactggcttccttctgacgcagtctttctttctgttaaggaaaaaaaaatgaatgtatcattttctttcatctttctcaagttttgatacatttctcaaattttggtctagaatgctgagtttccggaattgtgccaaatggcctagaaatgagagtacctctactgctttccctaagctcttagttatctgcccctccctacctatcacccttactccccagaaaaacaaacaagaaatcaataaccagccaatctaccaactacatccatctaaaacacgggcctttaccatgccagggtggtcttttctgttctcttcttttgtgacaaagaccctaactttgtagtgttactcaaggaccccttccgtccctacctttggctcattgatggaattagagaatgcccaagaagatatgaaaaaaaaaattactatttccaatgatcaacttggcagaactcaacaaaagccatgcaaaatgggagatgaccagatttagtctctgcagaatggcagaagttcccgatttgccatggatgttatgctcttcattctccgagcttcctcctcagagactgccttctaaagggaaggacatggacatctgctgggaagacgtaagaatacacaggagcacactacacagaaacatggacccccatggtatctgtgacactagggaagcacacatatcagtatggtaaggatggtgtgcctgctctgggaggagggtaaatagaaggctaaaatggaaaagggagaagtatactcttttggaatgagcagatgcagagagaagcctttgagaatggatccttagctgcttatgagctatgagatatgatgttgcagtgaattactaaattggcctagatataaacttaagttgatgatttttcgacacccatcctaaatttggaccccatccctaacttgcgaaattgaatcaggaatcagtttacaagctcttccctgatttccacccacccacccacacagacaataaaataagcagccccaacaagcccaggatcacaactgggagcttgctcacaggggaggtcgtaaacccactgtttcccttttgtctatatggctgaccccattctctctgccttgggggaacaagcttggctgtaaaagtctggatagaggcccaaataaaaggtctgaggaagagggagaggctcatgaaggaagaagacaaaaatcagggttcagccgactgccactgaaagtcatacaaatgaatgtcataaatataccatcaaacgggtacaaaggacatgtccggttaggtaggggccatgtgctcaaccatggctttccccgaccaaaaagtatagcccggacttctccatttctcattcatcaacctcatgcaacattcatttagctgctcatggggttgttgggagaaacattatggtcaatcaacagaaataatctcactttgtaacttagaacccatttatattttcaaaggatttgaagcatccagcaaaaaggtactaataatctaaaaggataaagtaagtagttgttggacatcagggcccagagaggacagagtttgaaaaatccgagagaggagggtgatacttccacttcccactcattgccattccccattgcagggtcaaccaaagcagctgaaattcacagcaacaaggaaaacaactaatatttattgagctcttattatgtgttaggcattttacatgtcttttctcagttttctcaaaataaccccaaaaaaaaagtagtatgttcttttcatggaagagaaagaaacaaagtaacttcactaaggttttacaactatttaagtggcagagctgtgatctgaacccaggccatttcattctcggcatcctgggatcctaaccatgtagctattctgactattgtccgtaacacctaggtggagattcattgtgatctctactgaaaactggactttggaggacaacgcaatctcacatataggaaggctggggagactgctggtttccagcatagggagagatgtcaggagacccagaatctggtcctggcttttgttatccacttgctaagtgaccctgggtaggctgtatctttctgcacttcaaattttccaactatcaaaataggagaatccctgcctctttctttaatggggaaaaggaactgaagagaatgaatatatttaaacattttgagaaaaagatactttgagataagggtgactgtactgcgggtagggtgtggaaggatgtgaaatggtaagtgactaaatttggtttatcagaaatgacctatgttgagtttacaggaaaaacatataaagctatgttttgtacctccacccacacatacttttttttttttttttttaaccatatgctactctgggatgggaactgagaatctggatactatgtttcatctctgagctttagcccttcctgggcgcacctcaattttcatgacaatcgttagattatgttgaaaaatatatctcaccaggctagcagtgggattgattttctttgtctccactttcttctctgaagtcaacttgctgactgattcctgagccattttcaatctgaaatagaaatagggaaaagacaggggagagagggaaaagaaaggaagagggaaaaggaaagaagaaaagagttaaggcaggttaaacataaacccaaatgcttttgaattaatccatcagcaatttgaaaatactgaaatgttttttcaatgcttgttattaaattcaaatcctaattaggtgtgaaggcttctctgctttatcaaaatttaattttcttcaccagctgaagcctgtttttgtgaacaatgtggtagtttctgatggatggagtactatgtgcacagagcattatttacttcagtgttatccggcttgtgatccacttagcagataatgagatgattttgaagaatgaagttctgaggaaatgtgaaactacaaatactaaaattcacgaattcacatcaattaagatgtgataacctatagaatgggaaaaaagataacctacggaatgggaaaatataaatatatgtatttttcattctgtaggtttttttccattcaaaaaatatatttatatattatatttatatattacgtatatttatatattatatttatatattacgtataacatataacacatttatatattacgtataacataacatttatatattacgtataacatataacactttatatattacgtataacatataacactttatatattacgtataacataacacatttatatattacgtataacataacacatttatatattacgtataacataacacatttatatattacgtataacatataacacatttacttatatattacgtataatatataatacatttacttatatattatgtataatacatttatatactatgtataatacatttatatattatgtataatataatacatttatttatatattatgtataatatataatacattaattatatattatgtataatatataatacattatatattatgtataatatataatacattatatattatgtataatatataatacattatatattatgtataatatataatacatttattatatattatgtataatatataatacatttattatatattatgtataatatataatacatttattatatattatgtataatatataatacatttattatatattatgtataatatataatacatttattatatattatgtataatatataatacatttattatatattatgtataatatataatacatttattatatattatataatacatttatttatatattatataatacatttatttatatattatataatacatttatttatatattatataatacatatatgtataatatagaaatatatattttatatatatatatatttttttgagacagagtcttgctctgttgctcaggctggagtgcagtgatgcgatctcagctcactgcaacctccacctccagaatgggaaaaatatttttaaatcatatacctgatagaaacttgtgtctggaacacagaaagaactcttacaattcaaataagaagacaaattataccccctcctctaaaaatggacaagggatttgaatagacatttctccaaagctgacatacacatggtcaataagcacgtaaaaagatgctcaacatcattagtcatcagaaaatgcaaatcaaaaccacaatgggataccacttcacatccactaggacggctagaatcagaaaggaagacagtaacaagtactagagatgaagatgtgaagaaactggaacccttatacactgttgatgtgattgtagaattacacagttgctttggaaaacagtttggccgttttccaaaacgttaagcacagaattaccatatgacccagcaattctactgctaggtacataaatatatctataactaagaaaattgaaaagatgtctatataaaaatttgcatatgaatgtttatagaaccactatttatagtaatcaagagtagaagcaaccaaatttccatcacctgatggaaaaattaaatgtggtatatccatacaatggaatactactgagccataaaaaggaatgaatttgctgatacatgctacaacatggatgtacctcaaaaacattgtgctaagtgaaagaagccaatcacaaaaacacatgactctatttatatgaaatgttcagaacaggcaaatccatacagaaagtaggttagcaaaactatgggtttccccatgctggggaaaatggggagttattgctaaccagtcaaagatttcctctaaaatcagatagaggtaatggttgtagacccttgtgaacatactaaaaaccactgtgtagtgaagtgatactaatgtgtatggaattgtacactttaaaagggtgaattttatgatatgtaaattctatctcaatacaacttattaaaaattcattaattcagcatgatagtatttcttacccatcaggttggcaaatgtaaacaattagacaatattaactgtttgtgaggatgcaggggaatgggaagtgccacacagtgcactaaggagaagaaattggtctagttgggtttggcaatatcaagtaaaactgaaagcatgtacactctacgagccatcaagttttcttgtagggagataccaaaaagaattataaacagacacagagctttcactgtggcaatatatgcaatcaagaaaaactacagacaacctaatgaataggttcaacagggtgatatatgagaatagcaaataacaactaacatttattgggtacttaatctgtaccaggtgctgttctacctactgtatttgaattaaacttaattttcacaactctgtgagataggaacttctactattcccatttcataggtcttaaccaccatgcaatgtgcaatgctgcttatgtactgtattcattcaacagaatagggtataacagtgagaaggaatgaactagatctacaaattcaaaaatcacaggaatcagaggcatgatactgagagtgaagaatcctgcagtgatacagtgaatagtccatctgtgatgatggtcaagagctcaggctccaaagcctgattgcagaattaattctcagccctatcacttattaactgtgtgaccctgcacaagggaactctctgtgtgccttatttcctaaaaaacatgacagtaatagtgcatgctacataggatcaataagaggactgagacagtatcagaagcatgtgaaccagagcaactccatcttcaatagaagctgggtaaaatgaggctggaaccttttgggctgcatttccagatgactaaggcattgtaagacacaggaagagacatgaggtcagcacaagatacaggtcataaagaccttgctgataaaataggttgcagtaaagaagctgacccaaactctccaaaaccaagatggccacctagtgacctctggtcgtcctcactgctacactcccattagtgccaagacagtttacaaatgtcatggcaatagtcaggaagttaccctgtatggtcttaaaaaagggaggcatgaataatctatcccttatttagcatgtcatcaaaaaataaccataaaagtgggcagccagcagctctcaaggctgttctgcctatggagtagccattcttttattcctttactttcctgataaacttgctttccctgtactctacagactcaccctgtatcctttcttgtgtgagatccaagaaccctcttttggggtctggattgggaccactttcctgtaacatctttctggcaaccacagaagggactatagtgaggaaacccctgacccaaaggctagctttgggtaaccggtggggtcctgtatcagcagtacagctccaggcaggcggtaatagcagaataaatgtaagctgctattgttactttgcatgcagtatgctacactgtgcgtataattttaaattgaacccatacatacagacatctatctgtatttatatatggatacacacatatgaaagtattcaaaatagactagaaagatactcaataatttcatgatagaggttattgctagaaagatctgggaagagaatgacactggcaataatatgccaagtagaatttcattttatctgtaatacttcatttttaaacttaaaatcttaaagaatatatgatgcatgttaatagttataattctaggtagtgggaatatgggtgtgatatgctatcttttatatttttatttttaaaatttcttcaaaaaatcttcaaaatagtaaatacttaaagatctatcaactcagacatttaaaaaatatgctttttcttccatgcttcaaataaaaatatcttacttaatattaatcacatacttgttggcatctgtaagtggctgagtagcttagctctttatttagctaatgttatacaatttgcttaaaacacacatttagtaatcccatctccctgcccacatgcacacgttagttacaatgaattcaacattcttacttgtgcactggacaataaattaattctactgttgcagtgggaaagcagccatctgaaaaatgcatcaacgaccgggctatgctatgttctgatagattttattgacaaatactggtagtgggccagatccggctcataggctgtagtctgccaattcctggactgtatcataggattcaaaatcttatgcttttggactggcaatacaatctccctgctataaacccagtttacttatcttaccttttcagacccagatctgttgttgtattcgtagtatgctggtttaattagctgagtatccttggataagtcatgtaacccccaaacctcaatttcctcatctctttaaagtgtgaataataccacacctaataacattgttgctataaaaattaaagaaaatactatatgtgattactgatcaagcatcttttccttcacctcactccacgtgttccatgacccacccaaacgacttacattctttgtacatggctttttctcacctttgcatcttgcttttactgttccctcaatgacggtctgagtcatttccatgcatgcaaattcttcccattcttctatttacagcttaagtgtcaaagtcatgaaagcttccttcatctctcttagccagaagtaattgctcttttcttaaatgacaaagcactttgtgcctctcttaaggtacttaaggcatttcatcttagaactgagtaggtgtcttatttttcttaaaccattggaatgacttagggacaacgagcaggatttatccatatttgggacctctccttgttcctttacccagcactgtaccatgctcaagtcagttcttagtatctacgtgacaaatgacatgcattgataacttttgtttttctgacttaaacaatttaaatgtttagtaaatagttataaaatgattgctttttgcatttatccttgggaaaaaactataaaaacatttagaagtgtagttccagttactgattagctgattaagtcttaaacaaggaaaaagaaaagatactcaaggccacccaaatgtgctaaatatttacacgtgtcatcttatgtatagattccaagatacttaaaagtatccacattactttgcccacaaggagactaagactcagtgaggttatgtgactttgtcccaagtctggaatttatttctcccacttaggaggtaagggctttttgcatttaatcaaagaaaatttgctggttagacagtttctagctgcatacacgctcaacctcctcattgtttgtggacttgtttttgtttctggcctaaatgttggctctaatgtccatcagtagatgactggacaaagaaaatgtggatcacatacaccatgaaatactatgcagtcataaaaagaatgaaatcacgtccattgcagcaacatagatggagctgcagatcattatcctaagtgaaataactcagaaagagaaaatcaaatactgcatggtctcacttataagtgggagctaaacagtggttacacatggacatatagagggaaataacagacgctgggggtggggagagtggggaagacagtgagggtcaacaaataatctactgggtacaaggttcactcttcaggtgatggatacagtagaagcccaaaccctgccactatgaaatacatccgtgtaacaaacctgcacaaatccatgtacctcctgaattgataaaaacaaaaaaaaataaaggttatatggcaatccttacaaaagaatttggaaatataggaaacaaacaaacatatcagagaaagaaaatatatattctcaattgataaacgtctcagtaaaatttttgaaaactttatcttttcctctttctcattatcatgcatatgctccctaaggagttattgggagccccagtaaataccaagtgctgccaaagactactgaggaaagacacaagtgtaagatgggaaagtgagtcatgtcctctgatgttcttgcctagtcttgactctgtagaagttgactgtaacctggccgggtgtggtggctcacgcctgtaatcccagcactttgggaggccgaggtgagtggatcatgaagtcagatcgaaaccatcctggctaacacagtgaatccccatctcgactaaaaatacaaaaaattagccagatgtggtggtgggcgcctgtagtcccagctactcaggaggctgaggcaggagaatggcgtgaacccggggtcgggggagcttgcagtgagctgagattgtgccactgcactccagcctgggcgacagagcgagactctgtttcaaaaaaaaaaaaaaaaaaaaaaaaaaaaaaaaaaaaaaaatagttgaagtggcgtggctttccatttagagatttaggctccccactgttatagcctcatcttttgggaaagcctatgggcatactgtgggctttctacaggttagaggcatacagctgcagctaaatcaagtcaattttcagaatctagccatctgtgagactgaggaagtaccaagtctttattcttttgacattcagtatttcactggtttgtgttgtacaaggcagaagatactgaaatcattatgaagtttgtaataacagaagtgcttttatttttgaccacagggattgagcacaccagccaatcaagagataaatgagatatggaggaaatggggcagataagagtgttcaggctgctttacactccttttcactattggaaaatccaatagtttggagcagtgtttgtaaactatttttcaaagagctttaaccttcagcaaaggtgtttcagggagaagaggcagaattaggggatcctccagatgccaatgttggcaagctctgcttcagttagaaaagctttactttgttttatacattgatgatttatgtatgtttttagacaaaaagaggtctgcttttttttttttaacagaactttttgaagctcctagggggaaaaacaaaacaaaacaaaacaaaacaaaacaaaccttcctcttcaggagaaagacaacagaagccaacagaaagcttcttcctaaagaactgtctatgaatatcttagaggtagacaactgatttaagaagaccaaggggatgattcttctgacagccataaccacaagatttcagattttgggctccagtaaaacatcaaatctacaaaaatcacaacatggccagctttcccactctcttctgcttattactttccaggtaagttctaagcctgtgagatcaccagtgtctggcaaatacagacaggcacagtggggacagatccagatgaaccagactgtggaaataagtggggcacccatttatttccctctcataaaggcagagattgcctcacatttcattatgattcattttatttatggtcttttctggaattttgcttgagttccctgatttctgccctatgcaactttccaatgtctatttgcctcctttgcttttaatagcttcagaatgaaaattaaatagagctatcttattacaccttgcctatggcttctcccaacttaattctgtgactgcaattaactttttttggaggggggttcatctgctcatcctcgtttcctttctttcccattcaacgtatctgtgtgaactgtaacaagactgtcaacctgttaacttttgagtaactcttaagtatgatgctaggggtgtgtgtgtgtgtgtgtatacgtacgtgtgtgtgtgtgtgtgtgtgtgtgtgtgtgtgtgtgtgtatatatatatatatatatttttttttttttttttttgtagagatgaggtttcaccatgttgcccaggctggtctcaaactcctgaactcaagcaatccacctgcctcagcctcccaaagtattaggattacaggtgtaagccatcaagcccagacaaaggctaagttatatttataatgaaaaaaaggaatttaggctgatgactggcgtctggacacaacaggtctcaaatcatggttcaggtttgggtttacactctaacctatggaattaattttagtgtttaaaaataggtaactggcccctgaaaattagcgttatcttttaaacacctatgggtgatatgttagaaattctcctaaataatatgattggttcatttcagtcagtacagaaaatacaatctggtaatactatcagggcatttttgttaatacattacttgcttttgtattgtagacaacaggaccaagaagtgacttcaggagcagaggaataaacttttggcctctaatgctactagctttaaaaagaaagccctaccagctacctagtacagtgtgactaaaattaatcaccgctcgactcagatcatgtatgtttcttgatccaagccattaaaagttaatggctttggaaatattggcagacaaaggcaaagaaaagagacacattgagggaatatggttcatgaaaggcatcttgggaaacacatgagatctgaccagctataatatgaatctctttaaaaaaagattttaatatcactcgttgctaaagaaagaagataaaaatggtctaaaaaatggatacggtatgctctgtgtgccaacaggtaatgtgcctttaagtcagcatgccacaggaaatgtccacgttccctaaaaagtaggatgataaaaactgaaggtccaagctgctgcaccactggacttaccctaaatgtaaagacaggagttcagaatctctctaataaatgcaagagctcttcattctcatgactgttcagaaatacatggacgaacatgataaacaaaggaacatgcaaaaaacacatttttaccactggctcagtcaattctggcctatggtcctttggaatggtgaataaggtttccgtggtataaaaaaggtattggccctcactgtagatcacacctgtaaaataaatgactcaccagtctgactacccaatatagctttgctctaccagtcattatcagggacagcttctatgagcaaataatgacactcttatggtctcccttcagaagaaaaagtcagaaaaggggtatatagagcttcaaggatgaaatacaaaaaggagtgaatattcactcctttgccatgatctccttgcagctttgaactaagtcacatcaggccaaggcacaaggaataacatatagactttggggcatcagggaaatggcttccttgcctcagaaagctcaatatcacatggtttatggcattttgaatagagaagattgagggcaacgttttgatctttttctcattaggcttacctgaaacatagatggtattaacgccataagggctgttttaaatatgctttcagagggatatggctgtgtccagccatccctccaaccactgcctggtggcctgaacatcagaagtaaggctctgtccactctatatagtttgttcaggtcttttgatactactcgagtctatacaaggtacagcccccagttcccagagcgaaattgtttctccaggcgaaaacgggctaatgtccaactttgattctaaataagtgagatcgtagagacctgaccagggctgtgaggaccactctcatttctatccatcttgacaacagtcactcacgaggcatttctgaattcctgacataactatcgcacgaggttaactgctataaaagtcaatgaaataagtaaagtcactccctactgtaagaaaaaaacaacaacaaactcattaatttctcaatttaaagggaaattttttccttgctgcagcagctgatgaaaacatcattgactaggctatgtggaatgtttccaaagggtagaaaaataaaactaagagaaaagagccataaacagtaagaaagaatgggtaaccccaagttcatttatcccaggcaggccaacaaggccacatacttagacagacacactcttccatgctcattttctcttcagagtctgaccttcggccctgaccgctctggcaccgaccacctcctgtgcctcccaggtcagtttcactagcagccatgataaaacagaccagcaggaaagtaagaataccagcagaaagtaatcttaggcttagctcctaacacaccagaatttagcctttaaaagttattccagttgggcatggtggctcacacctgtaattccagtgctttgggaggctgaggcaggactgcttgaggctaggagttcaaggccagcctgggcaacacagcaagaccctctcaactaaaaaatgctttttaaaaaatgagttgggcatgatgatgtgtgtctgtagtcctaactagtcaggaggctgaggcaggaggatcacttgatcccaggaattggaggttactatgatgacaccactgcattctagcctgggcaaaagaatgagaccttgtctcttaaaaaaaaaaagttattccatgataaattagcatatcacttctactttgtccaattgtgtactttgtcaaatctaaatctgacaattttccctactctattcctaagatattttcctatttaaaagtaaaaaacttctcttagagactgcatgcatttcaccagctacacagatcagccacttcatagtttttgtgagctatcacttgtatacccaaacatactttgacttcaagtgattaattgcagaacaaagtcctcttccgtttgcagagcttctcccccaggacacaggggagttgaagttggggagccctggacttgccctggaatgcatgatcagttaaagccaatcactctgcacttagtagacataacacccagagccgacccggcgatttaggtgcagagtgaaaggtaacagcatcgcattcatttcctcatttagggagagtagtctgggagacagtttgaaaactgaaatcagccctgtgtcataaatttgcaaatttaattgaaatgcattagtctttggaagacatttccaatcccgataatgaagacatgcatgtgctagcagatgcaagctcccccttttggttttgaaacctctaccacctactgagtctcaccaaaaactagcactgagagcctgtttgcatgggtgactggaacaaaagggtgaggaaacagggaagattgtctggagtaaggagtctctctggcgcccctcaaatcattctacccaggcagccccctgttgcatctctgcccaaggcaggagctgtcaggagtcccacagataagtaatttagaaatattctaggctgaatgaaggagacatactttaggtttccattgttctctgccaagctagggaaatggagtgcggacagatgctctctaaggttttgatttgagctccaaagaggtttgaggcttggcatagccatgaatccaaaggatctccacttccttctttttttctaaacaaactgaaagtaatacagtcaagaacagagctggcgattgttttattccattaactaatctttcttgttctgaacatgtctattctctttaacaaagctattaagattttagattcttgggcaaaagcaacccatatgggatacatttagggacttctaccaccaaaacccaaataaacaagatttttcatctatcagcagcagacagcaaatcttgcaatcaatttcaacatggcaaaaggaaacacaatgattatttatttgttcaacaaatactaactcagcatctactatatatatggaaaaacaaggtgctacagagaaaacaaagtggtacaagacattgtaattatcttctaggggcctatgatttatctaaaagagaaagtgcctataaccaaatgaataaaaaaccaaatcattaaatgacaaaactgaagatacagtaaacccccaaaattctggagatacgatagctcacacagattggagaaagcttcatgaaggacaccgtatgtgatcaataaatttttccagaatagtttcatagtctgtatatcacttgagacataatatttttagattataccattatgtaaatattatagtagttttaaagtagagtcacacactgcataatgacatttcggtcaaagacagacctcatatatgatggtggtcccataaggttataatggagctcaaaaattcctattgcctagtgaagtcatagccaccataatgttgtggcacaactactttattataaaaataaatttagtgtagcctaaatgtacagtgtttataacatctacagaagggtacagtaatattctaggccttcagattcacccaccactgactcactgactcacccagagcaatttccaatcctgcaacctccattcatggttaagcgccctacacaggtgtaccattttctatcttttatactgtatttttactgtaccttttctgtgtttagatatgtttagatacacaaataccattgtgttacaattatattcagtacagtaacctgccgtacaggtttgcagcctaagaacactaggttatgccatacagcctaggtgtgaagtaggctacaccatctaggtttgtgtaagtacactctataatgttcgcacaatgatgaaatcacctaacaatgcgtttctcacaatgtatcccgctagttaagtgacacgattctacgtgtttaaattaagtgctgcaaatttatattataggaatgtgcaaatacacaagagactggagtagaccaagcactcaaaggaggaagcacagaaaagaaggcagttaggctgatcccaggaataacactgcatgattcctccaaacgcatgttcagtcacccaggtccgcctctttatgtctatgtagccaaattcatctgctgtcaatgcccagctcattttctacttaaaatcacaggaagtcagggttggaagagaactgcaagatcacctgagcccaggagtttctaaacttggctgaaggatcactaggaaggtgtcaatctctgatctccaaagcctacctggtacatgtaaacaagaggatggtgaagccaaggcatttattaaggaaactaaacacaaaatgtgttcttgctctgccatctctgtggggagtttctaaaaccacagatttctagactctacactctggtattctgattcagtggatctgtttacatttttacaatgacctccaggtgacttgggagatctgccaggtttgggagctgctgatctctaacactgccctactggcttctgaatctcctctaaaactatctgcttagggtggtcctgattatggctaagtgtcttctcaaagctccctgtagcttccacatttcctttggatcatttcttcctccaaactcttacaccagccaagatcttcaatgctctttcaatatccagctgtgcgctggagaatgcaccatacaagacacagcaaagaacaggcttgtgtcctagaagtggaaagatacacataaactgctaaaataacaagttggaatgaattaaatactaaaggatcgtaagaagaaaatgctgtcagagcccacaggaaaagctaattcttttattaagggagatttcagaacatttctacagaacctggtttctggaggcagcccttgaaagacgactctattttgatcagcaggaaataatggggggaatgcggtatgaagaaattatccagtgagaacacaaggaaagaaagtgcaggtgtgagacagtgagtggtcatagtaggtgcagggagggatgaggctataggaaatgaggctaaagagtgagtttagggcaggttctcagagggccatgctataatttgggagagaatatgaagttcttgaaagaactcaagctttagtgtaaaaaaaaaaaaaaagacctaggttcttatcctcattctgtttattaatgaaactatgacattgaaaattcatttactctctcatgcttagctgtgaaatagcaataaaccttttttttttttccttcagggctgttgtgacaacttaatacattaataaattaaagtaccatccatggctaattatctttcctttatttcatgagcaatggaaaaccacagaatatgtttaaagagataactatgatctaaattctgttttggaaagataattggatgcaatattcagggacacttcaagaggaaatagaaaacctctaggcagagagaagagttagaaggatgtttcaataatccaagtgagagatgatagagtcctgaatcagagcagagacacctcaaatacagggtaaagaacaatcaccattaagggggcaaaactataaagagtcagaaatagatgaaaaataaatcttgtagcagtaaaaataattctcattccagcctgccttttgctaataggaggaggatagtgttgcaattgaaagttagggagcctaagaggaataggccttagttgagatggaataatttccaaccgagacatattgaattgcagatgaaggctgggtatacagtttaatgtgcagtaggaaatgtaggtctaaaacttgggaggccttggcaatgaggtgataggtgaagctgtgaaaatagttgggactaacaaaacagagaatagagcagaaaagaggaacactgagatttaccttggggaaggcccacacttaaggaacagaagaaacagaggaactaaggagggagatgaagaaggggagtagtcaccttcgcagagagacccaatatattatcagagcaacgaggcatttcgagatggaggaaactaccattggtgtcaaaaactagcagtggcacactttgggaggccgaggcgggcagatcacgaggtcaggagattgagaccatcctggctaacacagtgaaacccagtctctaccaaaaaaaaaaaaaaaaaaaattagccgggcgtggtggcagacgcctgtagtcccagctacttgggaggctgaggcaggagaatggcatgaacccggaaggtggagcttgtagtgagccgaaatcgcgccactgcactccagcctgggcgacagagcaagactctgtctcaaaacaaaataaaacaaacaaacaaaaaaaacccaaaaaaactagcagtggcaaagaattagttagaaggagtcatctgatttcagttaggaaatgtgacacagtctagtaacaatctcaatatgcagttctcctgcttcctttagtaaaggaaaccatgagtctttagcagggacatggctcccagctaagcctacatttcctggtctcccttgtgtatggccatgagactaagttctgtccaatgggataaagtggaagtgatgtgtgcaccttccagctcatgctatttaatattaaaaggaaaggttgtgcagtccccttcccactggcaggaactcagcagcaatggtagcagtagacctgacgtgtgcccccttacacgttgggaataaggaccttaccttaaggacggcaaccacaaaagagaagaaaactgggttcctgacatccaaactccttgcattcagattgttatacatgaggaaaattgatttttcctttgtttaagcaacagttattttggcctctgttatggcagccaagacgttatccttactgagacaggaaggagtgtgtggtacgaaaaaggaaataaggaaatgaacgtaaatcattcttttaaaagaagttagaagggaaaaggagacggaatgatgctttcagagagagggccaagaggtgtgtatagttttttaaaccaatgatcctataattcttacagttttttagtttatcctctctccttattcatggcatatttttaattttgcagatgtagttttaaatttattgcttggggaataagcagtttttattatttgtgatttctttttttcttttcttttttttttaaagacagtctcactctgttgcccaggctggagtgcagtggcgcgatctcggctcactgcaaccttcgcctcccaggcttaagtaattttcctgcctcagcctcccgagtagctgggattacaggtgtgcaccaccacacccagccaagttttgtattttttagtagagatgaggtttcaccatgttggccaggctgatcttgaacgcctgacctcaggtcatccacccacctccgcctcccaaagtgctgggattacaggcatgagccactacgcccggctgttctttgtgattatgacaatgttgtttatcagttaggtcttggggcatttactgtttgtgtatttgcacagaaccattttcaaatgtgatttaggaaaattcaaagttttgacaattaattagggggtgattgtattattaagggatttttaaaaataagcagctctttagtggttaaatgaatacaagtcatttaactacataacacagggcaaggaaaagaaagttaacatgttacaagttactgaaattatcatgtatgtatgtcagtaggaaagcagaattcaataaataacaattttatttatggagctttttctaggagtaagtttatcatgtaaagaaaagaattcctgtagtgtctacactgcagtcagtggcttgtggattgagtgacagcatctctaagtccccagctcttggtcctaaagtgacctgagcagtagggagctctgagaacagctttcaggatagcctcacaacagctttgaactatcttctgtaaagggtacagcagttccataatcacccataacagcagcaagtaatagacttaaaacaaaaaccctattggtaggtggctgggtaataaaaaaaacagccccctcgcccccaaaagaaaaaaacaagataactatccattcccctatggtgtaaattatagctatgtgtgtagtgaaatttcttattttcatttcacataaaattcaccaaacttctaattcactcattacttacccattatggggtttttaaatggcacttttaaagtttgctttggctcagggtgaattatatgcccagactttattcctggagtcatgactcccgtaggccttctgtaccttttgcaaattcaaagctcattttgtgggaggcagtgcttcgtgtgcatgcgcgggcatatgtgggggcagtcttaggatatcctaaatggtggaatgttttgtaagtaagggtcctatcacccagaataattcagcagccaaaaaaaataaaaaataaaaaataaaaaagagtaaagaatagccaataaaggtatcagcaaaaattaggttacctacttgcagttatgcatatacttggataatctattgatttaacaggtggaagaaacatgtgtaccaaaaattcattgaatgtttggatatcatgaggtacaaatacaaaagtgcattaaaaggtaaaagtgaggcaaagttgcttctgaggataaaataaaccttggattatgatacatcgtaaatgcaatgttggatacagatgagcagagaaaaaaacgttttgtgtacatgctccataaaaaaacgtgatcttcaagaacaacattaggatcaggcgtggtggctcatgcctgtaatcccagcactttgggaggccaaggcaggaggattgtttgagcccaggagtttgagaccagcctgggcaacatagtgagacaccgtctctacaaaaataaaaaaataaaattagctaggtatggtgatgcacacctgtagtcccagctactcagtaggctaaggcaggaggattgcttgagcccaggaggtcaaggctgcagtaagctatgattgcgtcatggcactctagcctgaatgactcaaaagaaaacaaaacaaaggccaacattagtattttatgagaagaactgggggttcaggtgaggcaaggtagctatagatgtttaccgatttcaagagggcaatgaaaattctttctggcacctaatctctctcccaactcacctgcaagtccttgcttgaaatatcttccaatatagtacctatagctcaagagcaaaggtgaggggcactatggcagaagggaaacacacagctcctcagaaaattagaaccgcagtttctagattcatagagattttgagctagaagagctcatagtcaccatttaattcctgcttcatcctgatacatacattttacagatgtgacaatcgggttcccagtgaataagtgactggcccaagatcacatagccaattaatgggggtgggggggtggcagggtgaagggtaaaaatgcctgttttcagctctctgtctccaggtctttttttacactgctcagcactgcacatattcagaagggataagagaagggactgggatgcttcactgaaagatgagtcctgataccaggggcagcacgatgactgagtgggtcacagactgcacgtctagaaagtggcgcttttggatttgtgcctgggctcagaagtttgctcttttgcttaagattggcttgaatgccaaggaaaattgaaagccattaatataccacgacacagtagattactcttccaaagatatagttaatctccaggtaaaccatattccccagtgaaatattgttccttctgccgaaccacagagttgtgccctgacaccagtttaataagattattgttcactcacaaggcacaagaacttaggacatttttatgtggtcatttgtatgttacagattattctggattttatgaggggaagctgttatcttgttatgaagatgcattcatctcaattttgtatcaaactaatgtgtactcatgaaaactacctaagcaggaaaagtaaatattcaccaccacctaaaattaacctccagtggcctaagtagttttcaacacttccatttcatttggaagtagaatttaaacaaaacagtgttttccatgaaacctgtccctttgaaaatgctagtactgattcttaatttttccaatgattttgagcacttagttggccttccaatatatttaaaaattaagtgagttgaatttttctgatgagatcccaaactagtttttttctttataattacacatcatcaggtttttattttggttatgaattttattttttaggatgcccttgttaatgatgttatgttgtctcctgatgtttagtgttgttgggatatattcggtttctggggaaagtataattgaaactataatatcaaatatcattaaatagatgtcaaaacaaagcaattatagtgttcctcatttaatagaaaaattccagttaatttgcttattttaccataatgaatgtgtgattctaacaggaaagaagctaaaatctttagcagacagagaacactttaacaaagttctcactttaggattttaagaaaaccctggatatcaagcagtttgtttaaatggttgaggagtaatatacataatgtgctaatatttcttaacacacagattttcctaaccatgctgctgcctccagaaatatcttattagccatcatcaactttcagagatgttgttttagggtagaaaccttggtgatccatcctcacagagcatggctggaatgaagggtcccctgaaactgcgaaatgagaagaaccaaaaagggtcttgtgaggtcatgaccctgtaaaggggttggtttacagagtgtgaagcaggcaattcaacagctgcacccaggaagcaatgccacaaacgcccgtggctgggaatcagagatactgtcattttgaaggacttctggataccacctctatgacagactcacaatttctttgatctaacttctatgatacagaacactctttaatgtggaatacagttatttcaacagaagatcattaacatataaagcaattaattgccttctctgttggtcttttgtttgttttagaccatttttagggccccaaggacaaatatactaaggactgtgctcaaaatctgaggtgtaaaaattcttaagcaaaagctgtacattccaggcccactgtgggatgtcccagcctcaaggtgtatggacctggagggcagactggccagctcctatgctgttttaagaatagtattttcgtatgagaattgattccacagaaacttattttagcttactttaaagggctaaataagtgatggcagggcaagaactatgggttgggtgccaagatttttaggattttttttcatgttattatcaacgacctattttctcaacaatggtacttttctctgcttcagttttatctatataatggatatattcagtttaattcccatgttcccaaagaagtactgatgggaagatgtgttgataaacacatctttaacttccttggaaagaaagaaggcctttctctttttttagctccctgagaaaatacttagagactaatactaggtcaaaaatctcacaattttgctcctcttactagtgttttaaggtgaaatatattagggtaggttgtgatgtgtctagaaatatattatgtatatatcttttctttgattacaaagtgaagaataaaaatactgaattatggaatgtcaggcctcacaggttagtaaaaggtagatgctataatgaaatatatcattttccttacgctgaggaattttttgtctccttccactctgttttgaatgccattcttatacatctgttccacaggagtagtagtaagacctgtttgaaatttaaatccatgacaccccttccataacagtggcaacccaatcacaaaaatgatcaggcagaaatgcttttttctgataaataggggcaaattcaatctctctaaggaaaacgcacacacacacacacacacacacacacacacacacacaccccgtctatattcagagttgaggtttttcttctacccccagctaataaaatcgggggctgcaacgaggctgagcggcacgcagtttgatgtccgcagcaggatacagggagtcagaagtggcgctgtaaatccaatgcggggcttccacgctgtgtgaagtgtggcctgagtcacagagattttcctttgatgcaagttcagtatattaatgggaaaagcattcacttttatttgtctatactgtctgcgacagcaaggctgcctcatttagcctgggccaacatgaaaatacacagagaagcaatctgttgcaaattagcacaaccctcctttcatttactagctagtaattggaaggggttaagaaagtgtaacttatcagatcatgtgagcatatctgcctgtgtggacagcaagctttccccgaatttccctacgatccctgaggcaaaaagtccttcccctatgaccacttcatccgaaagaaaacatcgacaggtgtgaaatagacacactttgataggtttaagagtgcagtttcctaggctcctgaaggaggcattaaaatctttttttgaaccttacctttctttagatatgtttttactctcccgtttccaaattgtcttgaagtcactgcagaactcataccacaccataaacacgtagctgggtgtgatctccttctcaccagactttggcttcatcccaaaatatcgtactgttgtttcaaaactgcaacaggtaggggggaaaatggaatgaggtagaggtgagaaattgccaacactaaaatccattagaggggggatgctgggggcagtttctcttgtgtttattttgtaacacagaagctgggggctcatagttactgaagtttattgtaaacctcagaaaatctatttgctcaaactgatttgccaaaaaatggaacttgattgggatgctcctgggcacatcttatctgtataaaatcagcatgtataatttctgggggtgtgtaggtaaaacgtctcgagtttgttcttcatctcaaatccccgtctcttccctgctcttcattttatgtttagtgattacatgcaaggtggatgacacactgactgcagcattagcagcggtcagttcgatagctcattgggaataattaatctgtcaaatgtttcacaaaaaagcaagaaaatccattctatcctttttcgggcatatactggctttgtaatcttgggtcaatcactcagcatctttgactctcaattttctcaagggtaaaataagagatgtagatgatatgatcttcaggagggctaccttttaaagcttaatatgatacaagaatacaaaccactgatgtacaaaaacagatacagttgtaggcatagcaagttttggatgaaaaaccatttctgatcttggaaaaatgatctccagtctggtcagtaaagaatcccaattttccagagtggattcccagatatcagtaagacctatcccagcaaggctcactgcacaccagactacctgggcctcccaagcagcccttcttggaggcactagctttgcagcaatttacagctttgaactcaatctttccccctcacccccacctaccccaagcctcacaagctcatttgccatgagcaagaacacttaaataaatgacccccttttctagggtgttggaaactaatcaaagcaggaatggctggccaggtttattactcaatgctctatcatctgttcagacacagtggttttttttttgtgtgtggccatcctgaatactgattttctaatggaactctattcaatggcgattgtaaaaccctgaagctccgttactattatggagcatactttcatctcattctcggttattgggcaatatgtatctcataagattttatcacatttcacagatgaactgttaattgattccatgggtacgattaggcgagatccaagctggagctgcagctctgagtcccataaattctttgtgcttctgtaaagaataaatctgtttttaatgcaaattaaaactactggtcagggaattttggctcccagttattaaaagactggaaatgtgtaagtggagaaaggcaataactgcagtaatctcttaagggactctattataattccaaacatacataatgttgagaaaaaccgggaagggaagaatgtggcaatgtccactcttgccccagacataacccttatttccatggcagtccaaacactggtaaaaccaaatgtacactctatagcatgtaactttatttcactcaaatgaaaattattttgactatagcatgggaatacataagtagagagttatataacctataggaacaggccattcatttcctacaaagtcacaggactttagaatgggaaggaatttacaggatgacttgcccaaattatcattttataggtgacaaaacagagacctggaaagactgtgtggcattattccctggtagggttgggcctggaattcaggtcccctgattttctgtgaaatgctctgtctgctttatctttctgttgctcatgctcaataacacaggcatttaagagacaaaatagtcgttctaccccacccttttctactttagacacaggtgtcctcctctgtatcacacataacatgcattaccccagggagggcatgtgattattttttctctttcttatgcttaccttctatacagatacatatttatttgagcattcatggggaagggaaagtctttcatttctagtatttagagggacaacttatcttctgattttccagcaaaatatagtgaagtccagttattgtgcttcatggaacacctgacacctctggcatcacctggagtctagattgtgagatcaacatattgcaaatcctggtgcagtttcagagaatgtcaagagtgatttggtggttgttgcacagcctgagaaaaacacatcatcctcctgtgggcctcgattttcccaactctaaactgaagctaaccattgccctccttgcctctctccctggggatttgtgaggtactgcttgcttactctccctgaaagggggagaaacactaaaaaaaatactaaatttcagccttttttttcttatgtgttttggaaactaagaaagcaagtgaacctcttcagaagaaccaaagtacacagactcccagaggatggcctggctttggcactcagcagcttagacaaagataaagtcgcttcaagaatgtgccttatttggccgggcacagtggctcacgcctgtaatcctagcactttgggaggccgaggcgggtgcatcacgaggtcaggagatcgagaccatcctggctaacatgctgaaaccccatctctactaaaaacaaaaacaaaaaaacaaaaacaaacaaacaaaaaaaaattattcaggcgtggtggtaggcacctgcaggcccagccactcaggaagctgaggcaggagaatggcgtgaacctgggaggcagagcttgcagtgagcccagactgcgccactgcaatccagcctgggcgacagaatgagactccgtctcaaaaaacaaacaaacaaacaaaaccagtgtgccttatttgatttcattgttattccactgtttaagaaaatgctaaaagctagaatatgaacctgcaatggtttgataaggcctagactgttgtctttcctagacaaaactccattttaaattcagttttgattcacagagattgaccactgaaaatcttttgcaatttggacaagaaaattgttgatatttaacaaccaggagaattttctctaatatacaggaaacaaaggtcaatcatgcgatttgaaatttctatttgttagcagatagctctaaaatggctctcaaattttagaagattgatttctaatcctatgtttggttttatataactttttcatttcatgcaaactagtccctgaccccttttctctctgctataattccctgtctgatttgtatctttttaattcagccaaacatttttaaagtacagacaatgattacatcaaagagcctgtagcgaagtgaactgttttacttttacagtcctgagatccagagcggaacacatccacttattgtcttacatgcatgccttcagaaactgcttaggaaaagcaaatatgccttagcctcagagtaaattgtttctcttgagaataaaacataagaattcactaatctcacacaaatattgcaacactgaccacaacctccttaaagagtataaccaaacaactgtggtttctacattaaagatgggatctaacatatttcatgtatgacatgaaagctagactaccttcaccacaaagccacggaaaacgctgacaaccagaatttatgactcccctccacagagctaatgcacggcagcagtttcggcccctccacgctgggcccccttttccttcagcaagaatcctgaaaaagtattagaaatttgacatccgccccagaagctgaatttctgtttggcctgacaccaacgtgcccttgttgataatctcttatgtgctggatgtttctataacacagacgtgctagttttatgcattgtgaagggaagcttaacataggaataaggtcaatagagagacacaaactcctaaaaacatagccatggaattatctcagttttgaatgattattatgataggatgataagcacgatttgagaatatgtctgtacttagcaaagtgcaagacttgccttcaccttgctttcaccagcattttaatcttattggtaattacagtgggaagcagggcaagatgttggcacctgtgaaagcagggcagatggcaccgtctatgggatttcagaagtctcggaaattgtggctagacaggaggaaaatggttaatttctacaatctgtttatttgcatttaaattcctaactgggtaactgttcctctcacacatttgtaaagctcatttgtccttagatgctgtctcctacctctacctgtcatctaatttaccagtacttttagaattcgtaccagcaaaatgtatctcaaatttcagccctaaatatgagaataccgctgtctattgccactcactcttctatgagggagggagagccacactgactaacctggtcaactaacaaaaaggaaaaagccctaagggatgagaactgctgatgattaggttccactgggtggagtgaatggttcccatgtgatatctattgagagagtgagcgagcaagaagatgcctgaagtgggtgacatgaatctgaacagaagatctctgaggtgttccccaacttctgggggaaattgtccatacgctgtatgggcatatggacagccccttctccccacctgaacatatggacagccccttctccctacctgccccttgtttataatatcctcctctagaagctgaggaaagacataataagtctcttgggtgtctgcaataattagtttgatctagttgtaatgccaggaaggatcaaactgtccctgacttccatcaagcggttcaggagcagagcaatgcaggacaggcaaacaggcagaatagtgtcatgacacgcatgtgaggcaggtgagtcacttctggatgattcctcacttcctgaggaaaaatattcctaagtcctgctacagtgctttcactccagcttccaagtgaagcttattgcttatggatgcatagtcttaacacatggggccgaaagtagggctagtcaaaccttatgctacaggaaagaagtcagtcacacaaggacaaatactggatgaccccaattgcatgaggtagctaaagtagtcgaagtcacagagacagaaagtagaacggtggttgcctagggacaggggagtggggaatggggaatttgtgtttaaagggtataaagtttcagttggggaagtaaaaatgttttggagatagaactgcatagcaaaatgaatgcacttcataataataatacaaaagaatggctagtcaaagaaagaactggggccaaatcagagctgcttaccttttctgtgcattctccaagtgactttcttccatcttatgctcttttttggctgtaaaagataaatcatgattaaaaattttttcttctgttgtctcctttgcgtaatcttacagcttcaattacacccattcattaccacaggaggtctgaattcggggggggggggggggggtagcctgtaacacatgtcctggcaataacactcaatttgctttatttgctaccactgctttttttttttttaaattatactaagttctagggtacatgtgcactacgtgcaggtttgttacatatgtatacatgtgccatgttggtttgctgcacccatcgactcgtcatttacattaggtatttctaatactatccctcccccagccccccaccccccaacaggccccagtgtgtgatgttccccaccctgtgtccatctgttctcactgttcaactcccacctatgagtgagaacatgcagtgtttggttttctgtccttgtgatagtttgctgagaatgatagtttctggcttcatccgtgtccctgcaaagggcatgaacttacccttttttatgactgcatagtattccatggtgtatatgtgccacattttcttaatccagtctctcattgatggacatttggcttggttccaagtctttgctattgtgaatagtgccacaataaatatacatgtgcatatatctttatagtagcatgatttataatcctttgggtatatatccagtaatgggatcactgggtcaaatggtatttctagttctagatccttgaggaatcaccacactgtcttccacaatggttgaactaatttacactcccaacagtgtaaaagcgttcctatttctccacaccttctccagcatctgttgtttcctgactttttagtgatcgccattctaactggagtgagatggtgtgtcattgtggttttgatttgcatttctctgatgaccagtgatgatgagcattttttcatgtgtctattggctgcataaatgtcttcttttgagaagtgtctgttcatatcctttgcccacttttcgatggggttgtttttttcttgtaaatttgtttttctttgtggattctggatattagccctttgtcagatgggtagattgcaaaaattttctcccattctgtaggttgcctgttcactctgatgacagtttcttctgctgtgcagaagctctttagtttaattagatcccatttatctattttggcttttgttgccattgcttttggtgttttagtcatgaagtcttgataacagacatagctaatagtggccaaataatttattgtttcctctgggatacttttgagagtaatgttaataattacacctaggcaaagacataaattagggaaatcttgggtagatcacgacatgtggtccctcttgcacgtctcatcatgttcccccttactctaaacattataaatccagtagcatttgcagcagtgctgctcagagtcatgggaatcttgccgcatactgcctccacacccacaggcccttttggcagtctagggaagcccatggactcttgtcagaataatgttttcataaggttactaagaaaatcagtgatactaagatacaattctgaatccacaggttaagaacctatgttctttctataggattatcaagaggtttcattttggggtggttcttttatatatccttctctacaatcagaagatatattattatatatgaaaataccactctcacactttaaaatatccagaaaaataggaaagttgttaacataagctacaacataagttgttatgttattatgtaacatgttattatgtaacataagccttcagattcctttaatttagggctacaatgatgtaaaatgaacgaaaataagtaagtctcgtatctaggatctatgctgtgatacttcatgaaagataagggattttgaaacatcacccttttattaaacctggccctaccacttactatctgtatgactttggcaagttagttaagaccaaatgcttagttattgcctcatctgtcccatgagaacagccatagtgaccattatcatacagctgctgtaaagatttaatgagataatacatgcagagtgcttagcacataatgtgtgctcaatataggccatggcaggtattaatactacattaccataatcttcctcattgattttaaaatgtaaaggctcccctgctcaaaaccttccaatggcttgtcttgccatcagccttgacatagtatctacagtcttcaaaatgctctagaaggccctgcacttaagtcggctccctggctgtttggtggcattacctcctctttcccacaccccttcctttccagcttcgctggcagctgcctctggcttgagcgcactgagcgtgcacattggaggatctttgcacttgctgttcctcctctctgggacaccctgaccacagtctgcacgatgggctccctcactgcattgaggtctcagcagaagtatctccttctccagcttccgtaaataaaagaccatcccttgccactcatcatcttcctactacccctccacacacaccctctacccctaccttccttccatagccttcccacagcctctatctacctaacagactattcctttcctcatgtgtttatcatgcaacaactgaatgtaagctctaggagggcagcagcttcacctggcttgctttctgctgtagccttaattgtagaaaactggctatatgttaaagcaatcattttagcttaaaaatgcatatattggataaagcttgcttaaaaagagatatactggctttcctgaaaaaactttatatttagaatatgaacataagctaaagaagattgagaggctaatgttgtataccattatctctaaatgtagtatatttcaactagtaaaacttattttgttttatattaaaatgattcagctttcataagtgcatcattttaggcagacggaagccatggccagggccatcttttgctgtctgatgtccccccatactcttggcaggaatttctgtgaattagtctggtacttagccaatcagatactgagaaatgacctgtgtctctcctaggttatcaagttccccaaaatgtgaaacaaactagtgatctgttcttctccagtgattttaagttatgtgcatagccaaacaggaggaaaaattcctctgaggcccgagtgatcttcttggaccagctctgctctctcagcagatggtttctaactggctacttccaagctgtgtgtgctaagcagagtgtggccaagccataactgtatatgaatttagtgacaagaaataccctattcaaactgaattgagcatcaggtaagattttgcaatacctctgtgaatatggtgatttggagaaacagagtctaaatgtaaaaagaggtattattaagagccaatgcacactgcagaaaactctgagggtttagggaaaagggccttcaggaaaatgagaagaaattagagatttaaatgttccctaattttgcccttgtacagatacaaaaggcatctacctttatggtgtgacttggaagctctaacagcatgaaatatttctcctacttgaatgtgtaaaattttaaaccaggccattacacattttaagtcttcaagatgctctaagcaaaacacaaatacatgacctggaagaaccatgtttaaagactggagtcacaaactcaaattctaataccatcaacaaataaggtcactgtgggccaagtataagaatcccggtgttccaacgttctagttctagcttttcaatacgggaactatatatcatacaattgctccacaagaacaattctgaagttcatagttccacagcctaccaagtgaagcagaaatggctttctattccatggctatgggcccaaggaatgcaaatcagaactcatgataactaactgccaagctttaaccctagctgtgtcacctgagtgtcatgagccaatcacagtgtcctgtgtttcagtctcctgctctgtcaaatggagatgatgatacctaccctcccacatagttgcagccagtctttgcagtcaggtctttgacagttcaacgtcatgccatggctgctgggggttcaagcttccagtgggttggctgttttgccagagttaaatgaagtgtagcatagaggaaagagcttgggttttgcaccaggtggacctgggtttaatttctgctctgatacttattaactgggtgatcgtcagaaaatcacttaactccactgagccttatccgtaaaatgggaataataagatctaccttgcaaagtgcttgtgactatgagatatactgaacgtgtgagattaatctagtgactgacatatgatgggcattccagaatggcagccatttattgtctattggctagaagcaaatgctagtagtcactactctagctttctgactttttggcatggttatcacaaaattgcacacaacatgctttctttagaatgttcataactgctttcagtagacaagaattttggttgttatcatttatgctcaaaactttagtgtttttttttttttcatttcactcactgagctgatgtccttagcatggcctgtaaaaggcttttctacaaaagggtggttccctatgtctgacctaaagtcattttatttgctgtttcagctcattttgttttatttcatcctcaggagaaagagaaaaacttatttataatttaacaaataactgggagtcatgggggtggatgtgaggggagaggtacttaatgattactctcacctgttttttccccttaatgaccatggagttctgtaatctttgacctgattaactggatcacttccccaataccaaataaaagacaatgatacaggagtctttttttgagaggttaagttttctgagagctaagattccttccttaacctctaggctctatatggtgacctgtaacaggttcccctcattgcacagtaaattcaattctctttgttgccaccaaaactgccattttagaaggcaaagtgaactatgccccttttctgcttaatgttctcactggttccccctctgaagacaaagtgcatttgcagttcacagtgtgcccctcacacctgcctcctgccatccccatactatcatccccagagctcctgctgcgtgggactcatggctggtctctggacttaacttgctgcatggtgtctttatttttgggcactttgctccttctgtttctaatgccttctcttccttgcccttctcccttctcctacccttctgtttgaatgtcttctctttctttgaaaaccaagcttgaaaatctcctctgaggggccctccatgcctctcccccataatgtggtgagccgttctttctgtggagatccaaacacactatctccccacaattccttatcacagcacacagaatgctatgtcaaggtcactggcttgcagctggcttttcccactggactctgtgctcctttcagagttgcaaccaaaatctgttttcagagtttttctctcaactattacctagcaggtactcaaatacttatttttttttttcttttgagacagggtcttgttctttcacccaggctggagtgccgtgatgcaatctcagctcactgcaacctccatctcccgggttcaagtgattctccagcctcagcctcccaagtagctgggattataggcacgcaccatggctggctaatttttgtatctttagtagagacagggtttcaccatgttggccaggctggtctcaaactcctgacctcaagtgatccatctgcctcagcctcccaaagtgctgggattacaggcgtgagccaccgtgcccagccttgtgtacttatttgacagatggaaaagtacacaacagaagaacccatgttagcagaacacagtccctactcattaagtgcctgttttttggcacagaaatttctaatcttccatcttttgtttgcaacaaaatagtgaagagtagagtagaactgaaaagcaagagattactatgcccatcctatgtcctgcttttagactgatacattaacacaggcacaaacagcactaacactatagggaggcacaaatagcattaaccctccagtttcgtctgtatcagattgagtctttaaaatatactattttccacagttaactttgaaaaagagaaagtttttataaataaaatgatatttccataaaatattcagactaagaacattcaccatttaaatgtacccaaataaccgaagtttttattctcaagagggtggcattcatacaatgagagtggctgaaggaggaggccactctttaaagaaagtggggcttttatgccaaacgcaattaagtcctatttatggatgcccatctgggaggcagtaaattgtgaaataaggggaagggataagggttggagtatcttcctagtattctttacacagtctattacactttaatataccatggtttatggacctgacatggttggtataaaccaacaggacgcacagttaagaagttgtttttattacagctctacaaatatgggagccgggtgatgctaacgaggaaacaaagggactgcgctctgcttcacgtgggatccgtctgatgtgagtgtggcaatcgttttccatttcttagaaaatccccgttgtgcactttccaggagaaacaaatgctttacaccaacagaggcacagcacgctgacatcggaaagggatggccttttaacatttgagagaagaaaacaacagatatttggaaccagtttgtgatgcagagttcttacccttacatttttccttctggtatgcttgcccatggaggacgatatccttgctggtcttcctaagttattagttttcctggttgtggtgaaattagaagagtgatcatttctggtctgtcagagcaagtgtctaagctggatggtaaagttgaagagtagagggccacctgtgagattttctgtgtaaagtgttatgaggttgtataaagacatgctgtcaaggttcctagtgtagggtgtaggatttccaggtcacttgcctaaggctaaagtggactaggaaactaggcttttggtgaaagtaccaagtaaaggacattgtgtcactacactctgaagaggtcttcagagtcataaaataaaaaaaaaaaatccagttaaaaggagtcttcaaatggtcatctagtctacctcccaggctgatgtgctatcctggatcctcttatttccagtcagactttgcagaccttgtctttttcatcattttatttgctttttttttttttgagacggagtctcgctctgtcactcaggctggagtgcagtggtgcgatctcggctcactgcaacctccgcctcctgggttcaagcgattctcctgcctcagccttctgagtagctgggattacaggcacatgccaccatgcctggctaatttttgtagtttcgccatgttggccaggctggtctgaaactcctgacctcaagtgatccacccacctcagcctctcaaaagtgctgggattacaagcatgagccaccacacccagcctttttcaccattttaatctgccatttctagttgccccttaagtgaattggagtattttatggacactaaacaaacaaacaaacaaacaaacaaacaaacaaaaccacgaaatggtatcacctaacttgggcacctggggctgttctcaaccagggtccttcatctgaactgcagaacacagaaaaggatttgagaagctattttctcagtttccccatatacacatcaccgggaacattctaaatgtctaggacaatgccaactcattacacacaatggcagagatagggcagtacgacttaattcccttacacatagttgaaaatgtgagtcctgaggcaatcaaacttacaagtgacttataatattaagtcatttacacttttatacaggctgagtactccttatctgaaatgcctgaggccagaattgtttccaatttcaatttttgtcccccacattttgggatacttgcatatacataatgtaatacattggggatgggacccaagtctaaagatgaaattcatttatgtttcatatatactttatacatagagcttgaaggtaattttattcttccctcaaggacactgaaaaaactgtctattgtgctcctgcattttggccgagaccgtcacataaagtcaagtgatgggtcttgtcaaaacgcaggtgcgcaacagacagtttattcatgtcatgtcagtgctcaaaaagtttcagattttggagcattttgcattttggattttcagattagagattctcagcctgtatctctaaatctagtacgatgatattcgtaaaatatcttattggtataacaacatgaattacaaagtgctgtttgcatacaatagaaagggtcagaccttctacaatagaaatatttcaggtgtcatgtattcatttatattctctggtgactgtaataataatttgtataggtgacaggtacaatttcagagatcacaatatacagttggccctctgtatctgtgggttatggattccaccaactgcagactgaaaacatttggggaaaaaatggatggttgtgtctgtgctgaacatatacacgctttttttttccttgtcattccctaaacaacacagtctaacaactagttatatagcatttacattgtattaggtatcataagtaatctagagatgatttaaagaatgggtgtaggttatagcaattacgacaccattctatatgagagacttgagcatctgtagagtttaatatccataagggtcctggaaccaatcctccacggatactgagggatgaccataatctcaaacacttaaccacattatacatctagtctgtgatcaatagtaactactgcaaaagtaaacattttatcaagtcacagttctaggaggtaatcggacacaagtataattgggatctaaatgaagtatatttacccacactttttcagaagtaaactcactttttttttcccaatatattttcactagagatgagatgctttgccccaaggtaagtctttcaaccatttacaatactgacaaaacacttggccttcagactttatgaaggattttgttcattcttcttaaaggcaatcatttgatttgtggctgatattctactacttttgttcctctgcttctgtgtagtccagtgaagtccctcaatgctgcacaactacctgtatgcagaaacatcttggcttcgagtgatacagatgcaattccttgatgaagttgataagacagtataaccttaaccttgctataacttagcccaactatttaatctcaacgtggagaaaatggatacccaagtagatgaagcgactatttggattacactaatagtcacagaatccaggccttttgactaataatttaataattttggctaataatgtgactaataatctacattttccaacgctccctgctgcttcccaaggggcagcatttttctccaggattcccaaacaccgaggtggtattttgaagctgcactgtactacacatcttccataggaatagatacatcagagagaaagttccaagatggaatttcagctttcacgctaaatttcctgactcttgatgctttaaaacagaccgtgggggtacaatttcagaatgatctggtgagagactcattaacattaatgggagtcaggtggtcacattctcaaacagggcctgaaattctccaagttataccatcttctagacccatatatgtctttaacttatcaccattaatagaagtgacagatgtcttttgtaaaatgcttttccttagttatttttcacagatatttctaaacaagcatatttataaaatataattttcacttaagggataattatacataaatctatttccttgtaattaaaaaataattatacataaatcctgtttccttgtaatgtctaccttgtctcccagccatctcatttccaacgggaagggtctgaccttatacaatactttagaagtatttcaggtgtcatgtagggaaactaaactctatagcctcatcattcagacagcagacaccatttaggaaatattaggaattgcaaagaagctaaatttttaaaagaaggcttcttgcattttgtttcatcaagaaccttagtgaaatttcaaaagcaatggggtttacaatcacaaggctctggataaccatttggtgataaattgcaggtattctaatttggaggaagctcttctttcccagacaactctgtctcatcttaacattagcactagtctgaaggtgtatagtttctgaaaggcatggactacggcctttttctttcaaactttgtattcaaatgcttagcacttgagactataaacctagtatttataaatcggtaacttgttgctttattaattggtgagaatgtccacaaaagtgtgaatttgtagcaggttcatgagcaaagtggtaataggctgcatgtttattttattttattattattattattatttttgagacagagtctcgctctgtcgcccagactggagtgcagtggtgcgatctcggctcactgcaagctccgcctcccgggttcatcccattctcccgcctcagcctcccgagtagctgggactacaggtgcccgccaccacgcccggctaattttttgtatttttagtagagatggggtttccccgtgttagccaggatggtctcgatctcctgacctcgtgatctgcccgcctcagcctcccaaagtgctgggattacaggcgtgagccatcgcgcccggcctgcatgtttatttttatttcttctttaaagtagtgttcttcaaaagcaactctcatttttttaacctcatagcattttagtactagatattcagcaaatctaaagaaagaaagcacctcatgttaattttttttaatggaagaaaaagttctccaactagcttctttgggtttcccataactgcctctgatgattatctatgatatttagggccaatacttcattcttcagactttaacttgtccatatgtacactagataaaatgaaaccttacacttgaaaactatggagctatacaaaacttaagaaattacctcatataaacccctcatgctatagtttaaaaacaagctaagttaaacaataataggagactgaatagatagtggattttccaataacggaatcacgtactggagtgtgtccccttcccttcaccagccatagctacaactaagatccaaggacagtcaacctaatgcttataaagtagtctaatacaatggcctagcacagtcagattggtggtggtggtggtaatgatggtgatgaacattcactgaatactcagtatgccaggtgctatgatactaaattcttaggttctacactgtggattaacagtggagccgaagcttccaagtgctccattactttctaactattgacactgggtcagttgtttaatgtggctaagactcagttttctcatctataaatgaaagtaatgatagagcctacattcgacagctgtagtaattaaaagagatgtttgtaaggtgctcggccatggcacctggcacattagttaagtaaataccgattatgataatgactaccatcactataattctttgtaatccagtgacatttgcttgtgcagcctttcttgggttcctgtgaaacttctctggggaatttcagcaccctgtttctccttagtaatacgtgtatccctacagtaagctcccaaggattaaagcacacttcctagacccacataccacaaaacgtgcttgcaaaaaatatcacgggaaaatgctatgacaaaattataaataaagaatataaagcagtggcatgatgtgcctaaagttacgtcaaaaggtatatcacacacattatatatatagttatcaaaatattgaatccataaaagagtcagaaggtaacataccaaaatattatggttgctatttctgcctctctggttaagaggatttttgtttttcatttgtttttagttgctttttgaagaaaggggctcatttaatataatcagaaaaagaaacaacagatgctgtttggaggcagctgcagagcactttgaaagcgagtgacctgcctaaggtcatacaaatagttttgggcaaaaaagaaagaagctgtcccctgactcccgactagttttcactaggccacactgtgattctttataggttcctgctgaaaaactgtaaaactgtcatattactacagtggaacaatagagaaataagtcgtaacagaaaaacaaccattgtcacggataagttaaatttcattgggcagtcacccacattaaagtcctttattcacaccttatactcacaggcaacatgaaattctacaatctctataaagtaaccattctacatattttttacaaattgttcagaaggacatccaatattaagaatagtttcaatcacattataaagagtaaaattcagataaaaagctattaggcatggtcagagattttaatggcttaagactgacgttaactaaagaaaaactaagagaagaaagaagccatacttatacatgatttacaatatacagcatcataccttgacaaaggaaatttcttgttctagatctatttacacgaaacctctgacatctgtgtagcttaacacatttgttaaatagctgaagctctccctctagaaaaataattgttcagatgtttagtcataaaaatgaatagactaccagaacgtcctgtaaataatcatgaaatagccattgctatccttaaatcaatcttcttttaaaaccctggcaaaggctaaatgtacttaggaaactgaatttacatggccacagaacccgacaaaagtctaatttccctaatattggctattgcttacaacatcaaattactttttaacccatttttatttcacttggtcaagggtttgtcatagctggaggtttaaaacgggtccactagaaatggtacccaagaattaacacgatgacttcaagagctctgatgttaccaagtatctaggtgtgatgaaggtcataatctgtctcttgggtgatatttgcaggaaaagaaaatgctgagagaactgggattcccaaagaagatgctgcagaagatattttccacattaaagaacatttgatctgttccaccagtagatgaaccattagcagaagcaatcattatcagagccagtaaaaggaaataaagaaatgaggcttggtttttaaagtgaccacactgcttctaagtcaaggtgaaagtgctgacagtgaatttatcagaattccaggtggaatcctccagagtcacctttcaatcataactgtcatcctcagagaaaaagcttttgttgaagaaaaatttgtacaaacattgaataatcacattgatatggtaacaatttaacaatacattcaataagaatgaatgttacagtgggtcactttttccctgctttttatcaaacctttgtattttccccagattttacaagtaataaatcctcattgtagaacatttgagaaagatataaataagaaaataaaagcagtgcataagactttctctgagcaatggccactattaatatgctgattcatttcataaatgtatatatttataatcacacactcatttgtgctttagttatatagttgaaattatattgaatgtaatgtcctttcttgctttttcattttttcccttgcattttatttaacataaaggtataggtataggtcaacttctaaatgaatacttttataatgaatttatatttaaatttacaattattaaaaataattgttgaaaaattagcctttatttcaaagtgagtatggaacctattcaaacaaaacattttctagaaactcatgaaagcatttcagaataattttttgacagttcttcctaaacgagatcttgtaggaaagaagtgtttatgaaggattattaaaatattaccaaatagaattaaggcagatttttatcttttgatttaacttggaaatcatccattgcttcaccctttagtcttcctatttttgcgccttagagaaatgttttacatggctaccagtgcattttaaaatagtgtctaatactgcaaagtaagttgagatttctttatcctgtgcttaaacctaatatatactacttattctgtatttgaaaaatatagtataaagaaaatacccttaatgcaaaaaatattgaggatcagtatattcttggaagcaaatgtgaagcctctgtgtatatgacaagccacacacacaagcacgcattcagtaggaaacagatctccctcgaaatctgagagggtaaaatgttcaaatattatgcaaactggagaagtgccaccatctcctgtacgcaggagcctgaagctaattgtacaagtggcacgaagctgatttcagaaagtaaaaaaaaaaaaaaaggctcatgaaaccagaggcttgaaatgttttactggagaaaaaccatagcattacctcctcctgtgggatgataacaatgatttatgaagctgaagtcattccttgtgattgcacttcagggagattggtttcacatgatctgcgaaggcaggcaaggcgagctgaagaagaaccccacatgttcaactgaggctgagctctgcctcttcaaggggattccagagctccgaggagggggaggaaaacctactgctttctgatccatgcaacccccttccccccaaccaacaagcttattaggtggacatacggctctcttattttctctctccttttaaaaagtattactacttctgctgtgtgggagtagaagcttgttgtaaatgcccagcaggatagtagcaaagccaagattaattccctatggatttatatgggtcgttctcacccacgatgacttgtaccgtttcaaaggtgcttatgctgctgtttttatggctggtcactaactttattctggcatatggtggttggcgccatgacatggagtgaacattttatacctgaattaaagtggatatttgacagtttctgtcagaaagttcagagcaaagaatttgtgggacaagatttattgcatattttatatgggacacatctgtttctttgctagctttgttccttcccacaaaaaaatttaaagacgtttcctaaagaaatataatgactgataggaaaaaaattccaaagcagaagaaaaatatggtcaaaagttgggcatttaggatctaactttataaaaaagaaagaaaaaaaaccacttctcattttgacgaggaaaaatgactcacagtcatgtatagaagctcagtgaaacaatgctgttattattggcaattattttatggttagtttaatgtcatttatataatgaaattaaaaatgtaaatgtattacctaccatttttcgcatacttgaaacaggactggcaagaataatctgcctttgatgtatttttaagattttgccatctcaaatggtggactgaataataagtccagctacatcagtgttaaacaaaataattacagatatttaaacatttaaaactgatatgcctaaagataaacgcagacgacttccaaccaaaatccatcaatacaacctgaagggtgtatataaacttctcatctaaaaactccctgtattgtaaaaagtcaactgagtaacaaagattcatgattacaacgtgaagggtgtatataaacttctcatctaaaaactccctctactataaaaagtgaactgagtaacagagattcatgattacataaaaagcgggctcaacctgaaactttgcgttaacagacaggccactttttcttttaactgcaaagagagaggctttaattctattatgaaactgaaaataaaacttccactcttaaatattttgcaaaattaatccttaactaatttaggttatatgcattctccttataaaaatataaaacattacagataaagtccccctgatagccctctgcatcacaccctctgtctcccccaacacatatatatatatagttatcttctacaactcaagtactgttatcattttgggagtatccttccagaacttctgagtgtccctgtgcaaacatgcaaggtttctctaagacagacatagagaagtagatttgttagtgttatcaggtagacatagttttaatttatttgagactgtcagtcctccacaatgatagtataatttaatactacgaagggctgataattgttttgtcaaacttttaaaattctgcaaattacatagattttggtaccaacccttggttaaatattttgcaaatatattttcccatgcttttgcttgtctattaactttgtttacaacgtttatcatttttaaatttaaatctgaaacagtcaaattcataaatactcttcatgtcttttgctgattaaatcatttgcaagaaggtctcgtctactcccaaggtaataaagaggtctcgtattttaatactgtctatatttttggttttgcttttgtcctttagattattatttgaaattgtgtgaggcagttttgttgttgttgttggagatggataaacactgttcaaatgtcacagattttctaagatacaattttctaagagataatcagattttctaagagataatcagagtatccaaataatggcagattgtcttgtcctctctcaggtttaaatgagtcatttctttttcctttcagctgcctgggtaaagttggtccattcgtgtttattttgattatgaatatatttagattaatcctcatatttattttgtacttttcttcaccaagcttgctggctatttactttttcaccttttcctaacttttgttggattcaccaaactgtctttgcttcatttttcctttactggtttgaacatgataaattctaactttttgactaataaatatttaaatcttttttttttttttttttttgagatggagtcttgctctgtcaccccaggctggagggcagtggcacaatctcggctcactgcaacctctacctcccgggttcaagcaattctctgccccagcctcccaagtagctgggactacaggcgcccgccaccatgcccagctaatttttgtatttttagtagagatggggtttcaccatcttggccaggctgttcttgaactcctgacctcatgatccacctgcctcagcctcccaaagtgctgggattacaggcatgagccaccacatccggctaatacttaaatcttaacacccattatacctgtgattttaaggttatctacagcttattatatctcaataccctaacctggaacaatataagggaggcttgcttttcctttcattctcctcctaaattctacggtcacatccaatgcctcatcccattttgatatcacctgcaattttatttccacattatcaaacacaaatgctttacattttattagtaatgctttaaccattattttataaatgtctttgctcattataccttttgctactccacttcttcctagattcattttcaacttgaagaagtacaacttcaagagaagatctgtgagatacctgtaatcccagcactttgggaggccaaggcaggtgaatcacctgagatcaggagttcgagaccagcctggccaacatggtgaaaccccgcctctactaaaaatacaaaaattagccaggtgtggtggcatgcacctgtaattgcagctactcaggaagctgaggcaggagaatcacgtgaacccaggaggtggaggttgcagtgagccgagattgcagcactgcactccaggcctgggtgacagagtgagagtctgtcacaaacaaacaaacaaacaaaaaagatgatctacgattagtaatctttctaggctctgcgtttctcaaaagaatttacttttctcatttactttaatgacagtttggttaaatttagaattctaggttctgatatttttcccctcagaactttacacttattactccatttttttttcctgcatccagtgttgctgctcagaagcttcttgtctctcagcatttttctaaagccttgatttctcaaggttcattataaagaattaagggtgcacatatgtgtacatttatttttcattgcctctgttggctctttcaataagagatgcaatgtattttcatttctgggaagtaatgttgcattatttgagtatttcttactctcttttaaaaatatttcatcaactcaaattttaatttctatattctctactggattcttttttatgaaggtgtctgtatcttatagttctctgagattataaaacacacatgttctgaatatctgttctgcctacaagcatgttttttcaggtgtaaattctcctgtttgttgagtttcttggctttcctctgttgttgattctggacacggaaccaatcttgctagttgagtctcaccattgggtacaagagtaggacaatatgctgcagctactctatcttggggagaacagaggagggcagaatgttccatggggcagggtactcactcatatcctgagctacccaaggcactgcgccctttctctcctacccacgagcccccattcatggtctgtctcaaagacagagagtttctactgtttttttttttttttttttttttttttgagacagagtcttgctctatcacccaggctggagtgcagtggctcaatctcggctcactgcaagctctgcctcctgggttcacaccattctcctgcttcagcctcccgagtagctgggactacaggcacccaccaccatgcccagttaatttctttttgtatttttagtagagacagggtttcacggtgttagccaggaaggtctcgatctcctgacctcgtgatccgcccaccttggcctcccaaagtgctgggattacaggtgtgagccactgcgcccggccgagagtttctatcgttattgcctacaccaaggtgggcccaaagaggtcatctctgcagaatgagaaaattctcacaaatgccgttattccaagaaaactgcttaaatttcaaaactcaaagttttaagtttcctctcacatacattctatgacagttcttacatgttttgagcatttttaaagatttgtaaaccaacaaaatgctaaagtagcaattttactattatcataaataaggacatggtggtacaatcataaccatttttaaaataccaattttaaaggcactatgtggaaacaaagcccctgaaagctactattccaactcatgctggaggtttagtcacacccctggtccagaatgcttcgtgggtaactttcatattcgaaaagtattcttcacagaacaggcttctgcgaactcacaaggtggaaggcatggagcctggagctgtaacatcctactgcaaacatagggaagaccacattggaacagtgtgcccctgccaaaagccatgtgctcccttctttacaggtctataaaatggcatgtgtgattaaataagatttcactgaagtgctggaagccacacacagttgaaacatggacttggggatggcagcaatgccaccagcaacagatagtgtaatgtaccccccgtgagaggggaaaggtgggaaaggaatttttaaaaatctttggtcacgttattattaatcatgttatttaataactgtgagtactatttaaaaagcaacacgtcccatttccttcataccatgaaagccaagtctgcctgggctggagcgtggagcccaacactggttttcagaggctcagattcttacatggtcctcttagtgcgtgcttacctcacagagtggatagatatccacatgaatttgacagattacacataggtaatgctttagagttttttgaacattttcagaaacagtatttttaaattttatttgcaaggaaaaaatgcttatcagtggcaagtcaggtagggtcatgttcaacattggtcaattatctcacccattctgatcacttgctctgttcccgccactggctcttcttctccctcttaaatatattcaggctccaaggcccgctctctagactcttttctatcttttaagagacaaggtctcactctgtcacctaggctggagcacagtggtgcaatcaaggctcactggagcctccaattcctaggctcaagtgatcctcccacctcagcctcctgagtagctgggactacaggtgtgagccaccgtgccccagccctctgttttataattagctataaattcagctactctcgttctgccgatgaatctcaaatctctatcatcaactccaaactacattctcaacatcagatttgcatttcccctgctctgctgaacatcctgacatgaatagctgtccaggaattccaattattccctgaattgtctaccataacacaaatttgttcctttccttgtctgagtcacctcagtaaatagcatcgacattcactaagatgatcaaaacctgggatttggctcctccttttgtacaactcctacgtttaaatccaattcctgtcttttctacttcgaaaacatagtcttgaattcatccatacttttccatctcaatttccaccagcctggtccaagatgctcatttttcacctgagctacttcagtaacttccttatctacttttgcctctgtgcatttatttgtctacacagcaaccagaataatcttttaaaacatgaatgtagtcaggttactttcattttacaaattcttttaaggcttcctgtagaataaaatccaaattccgtctcatgatcttcagggccctgcctaggtggtctgccctagttctagttgtattcgcccatcttaatctctcagtatgccaagctctcagctgcctcagggctgccaatcatggtgttctttctgcgtacgatgtgtttttcttctatgcttcctataactggctccttcccagacttaaatgtcatcactgttctactctccctactcttttaaagtaggtttcttaataccagccctcttcagccaaacctaaactttccacaatttgtaattatacaatgggttacttatttgctcttttgtctcttgcgcttgctaattataagtttatctgtcctgttcatgactatataaactatgcctggcacagtacctgacacactgctgactctcaaaaatgggctgaagaaattttctctattacccttttcattgccattcccctattatacagttgtctgtttaggattggctctcctgactacgttgtgagatctttaagccgggagaccgtctcttatctttgctcggcacaatatctgacacactgtgggcctattcataaagaatgaatggttaagattaggtactcagtaaccttttccccaaattgtattagacctgacatataaaatcagtgtgcgagatgttgtttagaataagtagttttgagaggtcaaacaacaatgacactggtagtaataacagcacattttggataaggctgtttggataacaaaactcgaatgatggaaatagtagttagaaatcactcaaagtgagactcaagggagctgaccctccctctggatgtcaaaatctatcactgacttagcagtggggtccctagagtgtttctcagaatagtgcttcccacacatgtcaagagggcctaatggctgcttctttcacaagggtggtggggagacacgtgaggtcaagtgtcccacagcccatagagaagcagctctccagggagagtggaagactctccagggccctgcttagcgcagcctgagaggctacaggccaacagtgaaggtgttgaaagacactgagatcgaattccctgggggaaaaacgctgccctgagatttaaggagaaagaggaaacaagccaaaagggtatgctcagaaactgatggaaagggctaatgtcatcagatcaaaccaaaggaaattaaaggaagatttagtgaaaagagggcaaaaacagaatcaaaggaccccagggaagcgcagaccaatttaatgagaaaccaggaaagtagtgagaacaacaagggagtctctcttcatctatgtttaatccagacttcttgccatttaatgctaatgctttgctccattcttaagtcatacccacctaggagtttgctttggagtttgtatgtaggaacgaagagagacccaccttctattagaacactacatgatctcacactatcattacaatattccaggcggcttccagatagcatcttagctgtggaaatgctattctcttatgtccttcccagttttcctagcgctggctctttccaaagctactcattcttatctccttcaactactttctaaataaacaagctgagaaaacacacacaactgatgtttgcctacaactgatgcattcatcttgttctgaaactaagtagaactacaggagaatcagaggaggggattcagggatggcatgtcctcaggcctgttgccacgtctccattaggctctgaatatgcgtttatttttatagctccctttcatgaacaggttgtgtgagacagaagtcttatttccaaggttcactttactgagtggcctccagtcactctttccaagaagaaagatggaaaattatggtccaagcagctttaccgtccatctaggaaccaaggagaatgctggacctcagccactcaccagcttaaactgtcatttatgagcaacaaaatgattgtctttgggtctcggcagcattatcttgagcagagtttgtggcggtaaggcccagctaatcacatttgtctaattttacattcccatcactttcacaaatggattattacctactattcacttaaataaaacaaagaatgatcaaggaatcttgtcgttctagatgaaaatcataacatataagaaaatagcattagttttcatgtttgtaccactttctaacaaaagagttataatcatttcacattattgtcttgttcatctttttaacgacccaatgaagaaaggacatacaggccggacgcggtggctcatgcctgtaatcccagcactctgggaggccgagacaggtggatcatcaggtcaggagatcgagaccatcctggctaacatccgtcgctactaaaaatacaaaaagaaattagcctggcgtggtggcgggcacctgtagtcccagctactcgggaggctgaggcaggagaatggcgtgagtccaggaggtggagcttgcagtgagcggagattgcgccactgcactccagcctgggtgacagagcaagactccgtctcaagaaaaaaaaaaaaaggacatacagattgctggctctcctttatagcagaggtccagaatgatgtgactaacttaagaacatgaagtgaaagaggtatggataaagaaaaacatggtttattcacacaactgaataatgtatagtggttaaaaggaatcggacccaggctgggtgtggtggctcatgcctgtaatcccagcactttggaaggccaaggcaggtggatcacttgaggttgggagtttgaaaccagcctgaccaacatggtgaaatacaaaaattagccggcatggtagcaggtacctgtaatcccagctacgtgggaggctgaagcaggagaatcgtttgaactcaggaggcggaggttgcagtgagcccagattgcaccactgcactccagcctgggcaacagagcaagactctgtttcaaaaagagacaaagtaattagatccatatgtatcaacatcaatagatattaaaaattaggatgcagaatggtaagcccaatatggttcatcctttctgtagtgcagaatgtcagaatttcttcttaatttggtaaattttgattactccaagtcgtacaaagggaaattccattttccaaattaatggagctaattgaaatgtgattttgtaattctttatcatttagcatgttttttttttttctcactgggtttttgtaacagtgaatagactctagcttggctgtaagagctaacaatttggataatagtactgctttgcatctactgcactctgcagaggatgattcaaaaaagaggctactcatctcccctgaggatgaaagataaacatttgcggttaaaatattgtcacgactcagacagaagaagggatttagccctaccacttggctcatgttccctcttaaccaaatcatatttttttagtaacctaataaaattactgggaatagaaagcatacattccgactactagaaatattgatacaacaaaggaacacgttagtagtttcaacgtcttttacttaaggatttcagaattcctcccagtgaacagggagataggtaggtaaaatataatatttcctggtagatgacctaaggcaaaactctttatctgctggcacctatgtatatttgctacacatcgaatgttttgtcatcccctagaggaaagacactggtggatggcaagaatgtcagtatttgtttacttggagcaagaggcaggtcatttggtcacagactcaaaatgcaatgtgcaagaactcagaaactggatagcaaaactccagcccaaatgaagcaaaatttccttctctgctttctcaaggtctactctagttaatattgatgtaactagacaaatacccaataacaaaaatttgccatgcaatatataatctaagatggcacaacagtttatgagaccaagctattattcctactaagttaaaaacatgcgctccggcgaaagttctgtcaaccttacagctctttaaatgcatgcatccaggaggactagacaagccatcttctgcttccagctgctagtgtttctagctggtgaataacacaggcccccaggagaggggggtgaaagatagttttcaaagattggaaaatttcctccaacttacattaaaattaatattaagggctctatatgtggctgctggagtagaatggtgggaatctaatcaagagcccgtgccttcctttgaggccagtttcctaaaattggttctctgtgcctatattgcatgagctgaaagcatatggatgcaatcacattccaagataccttatttggtgttggtatggactgggcatattgtctcagcttacaaaagcaataaggattctctgactcctgccaatccatgtaaatcactcttttacctgtttaaagggtaagattcgtgagtgaggaaaatagttacaactattttgttaccagcatatataaccatgttctatatctagatagaactcttcaagttgtgagacctcagtagtgggaagggagacaagatttagacaaatacccacacagaaatgaggggggacacatttctcccacgtggcagagttaggaggtactgaatccaaattttgtccttatgtagagaccttatgctggttgagaaagcaaaataactaaataaggattacttatatctgcaactcattttaatgtcttctttatttttaaaagcaaatggactagtgaagggaaattcacttctctgaatacaggatcatcccacattcaggctatccaaaatttgggggatctggaaggccaaagaccaaaaataaagtaaaaaaaaaaaagtaaatgaagttattggatatgaaataacaaatgacaggagattaaaatcttctaattcttgtgtctggccatataactgagtgccactgaccattagataaagacagatttttaaaaataatcacccctattgtaagggatagtcactcctgactcattgtcttctcttcttcattagtttgattgtttttccctccagatcacatttttggagttgttcttttggtgagatagtggttgaaatagtttaattttcctttttgagtcctgttttcacctctagatgaatttgcttttatgaaggaattccattccatttatgatctaaatgaggaggaactcctttaaattctttccttttttggacagcttcaacctgtatttcactgagtaccactgcatggtaagtaaagaggatactataaataaagtgtgaaatagacatcttccctctcgtatcagctaagtaatttctcaaatatttaaaaattgaaagaagtgccacagaggtaacagaaagaggggcagttatattattgagtagaaacctaattttcccaggagtatatgtaagaaaagccctccctgtccgaggagacgtcatcatgtgaactcacatatgaagaaaggtggaaatcaattaggggtaggagcagcgagggccctggggagtgttcaagtagtgcaaatgacatctaaagacgggatgaaatgtaacctttcagatcgggagggcaggatccaagccaccaaaaagtctagtggtttgtatcctccaaacaccccccaccactataatctcccgccacttactcaaccactctagtccaaggcaccaaacccccatgctggattcttaacctgtcctgattgaggtcctcctttaagtcacatagatccagcccatctgagttcaatttcctcctttgtaaaatggagataataatagtgctttcctcaagggtttttttattcaatgagaaatgagatattacttagtatcaaacttggctgagagtattaaataaatgttagctaatattatttttactttttttttttgagacagggtttcgctgtgtcaaccaggctggagtgcagtggtatgatctcggctactgcaacctccacctcctggattcaagtgattctcctgcttcagcctcccgagtagctgggaatacaggcacctggctaataccgttgctaataatataacgcacatatcatggaagcttgggaagtttttataaaacaggtggggcttgatggcagttttgaagggtatttgctgcttgcctagaacacgggaagtggagctggcagtccaagctcaaggagccccaggagccagggctttgcagaggctgcaggggaggaaagtgtgtgtggggtggggaggttggtattgcataggtccagggaggcaatcatgagactccctagaccacaggaaaaatcttttgtgggaatagtaagcttggacaagtagactagagactatgaagataatctctcagagactgacacaaataatccactcatgcaaataatctcaaagaatgcagcctttttttttttttttctaacttctgattcttaaggatgaagaatgtgggtggggatgcctgttcccggtgtcagtaagtaaaatcttctggtggggaagtattttgaatatttgcaaagaaagttcaatgctctccaaagtggaggtagaaactggcaccagggatttctgtgtacctgcctagaaatacagggctttaatctacagccaatgtgaacttttgtaactctttaaaacatcatcatttctgagggacttcagactctgttctgtaggtcagcaccagaccaacaatatagagttcctgtgatcacttatgatttgaaacataaactcaggctttgaatgttttaaaaacacccgtataactatgggttgtttaaaaatagctataccccaaagagtttatttccaacatctgacatgaatgcattttgcagcgatttgttatgcaaataatggtagcagggaagacatatgaaaaaacattgacccttctcaaagcccgatggatttaatgcttttgttaattctgaattccaagtctaggggttgtctgtttgtggtgtataaaataaaatactatatgcctgcctcaactttccttctgatgaagctgtaatttgcaaaggagctattgttcctctatggcttccctaatttttcttcacagacaactgtgcttcagtgtggagaggggtttcagtgtattggctgttgagatgatgctgtgagtattttcaaggcagagggggctgggtgcggtggctcacacctgtaatcccagcactttgggaggccgaggcgggcagatcatgaagtcaggagatcaagatcatcttggccaacatggtgaaaccctgtctctactaaaatacaaaaaattagccagacatggtggtgagtgcctgtaatcccagctacttgggagactgaggcaggggaatcgcttgaacccgggaggtggaggttgcagtgagctgagatcgcgccactgcactccagccagcagaaggaagagctttttgagatggagactcaggtagtgcttggaattgctgataatccaaggcctgatgatacgggggttatttgctgaagcttctatttcaactctcctttatgaccccgggttacctaaatatgttgccttctaatgttgttttgtgagaggtaggaagtagggtagacatcatcagtcttagatttgtcaatgggagaaaaccaagggacagacttttttgccgccattttgtccttctaaagtgttagctcctttttcccactttacaactcctcctttctcccctcctcctctgctctgctcttctccaccgccaccactcccagcagctgtttattaaatgcccactgcatgctagctttctaatttcttcttgtctctaatggtcatattttaggatgtcattcctctactgacagctaccacttctagagtaatcctaacctgtaattcttttcttagaggataagtagaaaatacgtaatgggaggtggggggaaatggttttgatcttcaattagtgtaactgatagggaggaaagggcttgggttaagggaatgtcttatgaagcagcagctgttttataagggactcatctggagaagtggggtgtatcctctactgataagggagaagacccacagaaagccaactagcatcaaaacagccccagcatccaagcacagaggaagtgagccttctgacccccatgatctaataagccccaatattagtccatacaggagatgagcaacatcccagggtgagtgagtcagtcactcaagtccccggcccaaaagtgtaatggactttgttttatggtttaatggacatttagctgagttaaaagggttaacaagtctgaacacttctctgaaacctgatgagatatccaagcatcttttttctgaaggtctccattgaaaataccacttatgagtaacttctgtaaagaaaacccatctgaaaataccagagatgaaccagctgcttttttccccctgaactcttagcaaatgatctaagggcttaaacacattaaaggccacaatttcaacttctggaatcaatagggcaaaggaatgtgggcatattcatttaaatatgaatttgctgactccattcttactctcttgggttcctccataagcccagaccttacactaaaaggcagctacttctcacactgcagcaggattttgagaaccatcgccctttgtcatcttcaccctgacccttctcatcattttttctgattctcagaacctcctggcatttatttccaattcagttctgtttcctttcaccaactcaggttagttgaggctggaccctagcatgcctgttttgtcatactctgatgaaaagcaaattaaattcttggatggtaaactcttttcttaaacttctgtctggttctttggaaaaaaattaaaaattatatttctgttaatatcaaccaaaatattgaatccatctcaggatcctacatcccttgaccaacaagctgataaaactgcctagctcatcttagtcaacctcttcctctcacatggtgtgtggaacagaacttggtctcccttgggcttcagtagtagcaaattgaggaagtaagaccttaattacatataaccatgtttccaccctacgttagctctgttcccttgccctttcacatttcaagctgcctcaaggaggaaaaaatcagacagataaaacacaaacaaaagacagaaaacaggagctcaagggctaaatcaagactattaatagttcctccaaacaaagaaaccgactgccatcatccaagctctgttcatctaattcttcctttctccaaatgtggctgaaactcatctcccttttagccttctcttactcccaccgttattattttcagcaatttttccctaagacaaggcagcagcagcaagaagtgagaaaataaaggtaatctaggtagtacctttctttgaacaaatagttttccatctttttcttatttccactgatcttgaaaacagaatcactgtttaaaggggagaagccctagttccctctgatcaccttggttaattttagaatgggtgcttcatattcaccacacagagaaatctaaggcttttattcaggtgaacccttcaaaatgataacattatgacaccaaagcttttaaaagtcttgctgttctgaaactgccattgcagtttggctttgtggctttggatactctcagagggaaggcatcacctttgttagagtttgtgaatttaaattagtttgggtttgtttggaagcagagcaacatcagaaaatccagtccctttctacctaaaagcacaaggctgctagtgagcaggcccatgaggaagagctggaggagagggcaggacacagggatgtcacccagcctagctgggatacgtgtcaggcctgaccacgtaatcacagatactcatgaacaagggaaagcagactattcagatacaatgaaaactgattttaaataagaggcatctcttattttattattttttctaaatcgtggctctaaaaaaataaacttagaattattttcctcttccaaagtgaaatatctttttcttcctggcttagaccaccaaccaggtttctgctgccggaagccgggaaaatactggatattctttgaggaagcctgatcagatgccctattatcccaatttccaaaccaaagatgcttggagatgaagacacacttttttggtgtgtgttctaagttgcaacctcaaaaacttggcagttttctcaccatggactgtgatttccatgatgtgatggtttggaagggtttgttttcaaatagatgttatggggtgattccaagggaattctatttcaatcctcctgagttgacaacctttccttcttaagtgtaactttggtgttcagataaccttgggacacagacaaggaagattcccagtggtaaatgtctgtgtggtacaaaatgggaaggcagaaagtgaagcttgtaaagtcatgaaaataagaaagaaagagcttttcatgcattatctttcacactgttcttctttttctgtttttattttattattattatttttttgagacaggttctcactctgttacccaggccggagtgcagtggcatgatcatggctcgctgcagcctcaatcttctgggctcaagtgttcctcccacctcagcctctctgtacctgggactacagatgcatgctatcatggcccagccagtttttaaaattttttgtaggatgtggcctccctatgttgcccaggctcgtcttgaactcctggcctcaggtgatcctcccactttagcctcccaaagtcctgagattacaggtgtgagcgactgctcacagctgggattacaaggctgctcactagcagccttgtgcttttaggaagaaagggactagatttctgatgtagctctgcttccaaacaaacccaaactcattcaaattcacaaactctaaaaggtgatgccttccctctgagaatgtccaaagtcacaaagccaactgcatggcggtttgggaatggcaaaacttttaaaagcttttggtatcataatttacttttatttaggaggatagtatagttcacattttctcctttttcacaggttctatttagtgtcatttatagtagcaataattcatattctaacttagctttacctcagcaactctttctccccttacttttagtctcagtactacaaatgcccgcatgctttctccccagaaccgaggccttcatatttttctccctaagctgtatatgtcttacaaacttgtaaaatgaatgtaaatgaatgtaaaactttccccttgtttggtgaagaacaagaggatacacccattgcttgagcatacatctccctcagtctctctctttttttttagaatgcaaagtattttctttttaaacttttaaaatctgaaaacaagctagcctatgttaaataacatagtttccaaagctgaacgtgctcacttggagcccagttttctgcttcaaatacaaacacaacttcctgacactcctaggtgggaacactactgtttgacgatctgtgattagatgaactgatcgatctcagtgggtaacattcctttattttttccttggtaaaggtttaaaaattctaaaatagatgcattttttttttttcagttttacactgacaatttcattccaattgtctcctgggagacacagaccatgtacaggaatccatcttcatccttctcactctgctacaatgctgtgtctgttcaccgccaggaggaaggcttgattagcactgagctggaaggaccttctaatgatcttgatgagctcactcaggttgatgtggtccagtacaaggaacattgctttatccaggacgggaagctgcttctcagccttgtatcgttctgttactaccaagattttgggtggatgctgctctcggagaagtcaaacttctactctttgttcaaaggtgtggtgtggcctgaaggtcttctctgatgtcatggtgcagggatctgggtggtggtggcgacataagggttctggcggctcctgggggtggcggtggcagtgaatctaactctggcgacagtgacttctcttgtctccctcagtctctttattatatgcttgatccatcagaaagtctcaaggttctatgcacctcagcaaccccagtgataaggcaaggggttcatggactgagtcctgaagccctcttgtgtttagagattgggaagatgaagaaccagcttaggagattgaggaatgcccatgaagtagagagaagacaaaagagggttaggacctaaagcaagaaggagttttcaatccatcatttgatcagctatatctaatgctcctgaaaggtggagtaagattttgcgtcagatatatagggtcttttagactggaatagtgtctgattcttctttttttcctcagagtctcacatatagtagataacttataaatgctgaatgaacaactgaaaaagaatagtagtgattggtcacagagaatgggatgtgctctctgttaattccttgcccatcaacagatgcccatcctagggcaaaatgggagaaagactatcatttccacagtcctcatgctgaatggatcccaagtgctattgcctcatttatgtagcatgatccagagacacttccagtctgaagaacttcaaaggttttaggaggctgaggtggagggctcggggagcaatgaaggcaagagggaaagggatgaacaaccacaataaaaggccggcacgttcacaacaatgttgggcaaagacagtgattcctgaatatgaaggaatctggagagcgagtcacaagaaactgaaaacataagggggtggaggagatgctgagagaaaacagaaagctatgaaagaaggcagacgctcaaaccgaggtaagagagaaaaaattaaaagcggaaggggagaaagaaaaaaaatcggagaggtgaggccaatgtatggaaaaagagcaaaggaaacacagggccattgtctgatgctgagaacagtctggagactgagcaactggtgcccgatttctgtgcatctcaagaggagataaatggcagattgaagggaccctcttggcattctggatccaagaggaaaacatagcaggcgcagtgaatgctcaagtaaacacaaacagcagcagccgtggggttacgagtgacctgactgcaggctctgtcctctcctggcctccagcctgtgtgtacaacacacatgcccgcttaaagccccgcttaaagcgggagggcaaaaatctcctgcaactgggtgacctctgttgtcagcatttggctaattaaggaaagatattaccctacagatctctatgccttggtcctacttcctgctcattaaaaaatggtttaatgagaaaaaaatcaaggcaacagaatccaaattattattttttctcccaaatgagctgaatgacagtggctgttgccagaacgcttgaacaataggattgtgacacgaagactgaaatctaaacaacatgaagaaatctcgagagcccagcagtccccattatctcatgcttgcacgacgatagtccaaaagatgagtgatgagtctccatttgtgcaagcacagcagcagtccaaggccctgacacagccactaattgcccatctgcttgtttacacagcccagagatggtgactggacaaacagttcatttcccttgaaacgggaccaaactgggaggagcctgtcacatgggacagaggaggactaggaagaactctcatgagaaagtgcccccagatcaaagccaaggaccagcaagccaagcaaagatgggttccagcggctggcttctcacaggcagcttcgggtctaccgctttctgcaccctgcccacccactcccagcagaactggaacccctctccctgaggacaggacattttgaaccattcacgtaaaagtctcaaccacggagcgtcagcaccaacccacccttcaggcgttggcagcaaggacaactgtgttcaggtgaacttctagccctttcagacttcactggatgcttggcatttgctacactagttcccattttagtgttctgcttgtctcgtagactggactgtaaacaacttgagcaccagggacctgaagcccccggattccacagcagggcactttacatgtgaagagccattagccaggaaatgcttatggttgttaatgatgataagctactccaaacatagtttcttttatctgcctacatcagaagcttggcttcttgagacaagagactcagacttctcatttatactcttgacagactgtggaaatcaataatggcttgcacccatcagtgtcctggaagtaggattgagagagaagattctcttgagaaccgatttctcctcaaaataagattaggcttgaaaaaaaaaaaatcaacctccccactgcttagctcacaggtatggtgctaatggcagcaacttagtcatgaaatggggaacaacaatgtaaaaaatccttgttaatttgcttataattatccagaactaactacaggtacactgaagaactgtatacttgatgggagggagatctacaccgctaagtcaataagaccaatttccgatttttccctgtgagcatttatttgcagagccacatattggcaacataagaaactagcgttgaacaaacctaagaagtgatgaatcctccccgggaggagagctgcagccctgaaatccaaagcagaatgggctgggggcagcttgaggtctgtgggcgaaactcagcactcccagtctagggtgctgctcacccattaacttggcctcctcttgccactgttgttttagcccttagtgagcatctgtgtggctcagatttaaccagaccaaaggggctgtggtggtgagagggcagagaaagctggaggaagaaatggctttttttctggagaggagtgaggactaagtcacttcaaggatgatcatattcccaggaggagccatgatatgatattatttgaatatctagctccacgcagctctatttttcccttctcactactagaagattgtaatcacccggtatcagcacattcaagatactaccgaggacctaacagcatgcccaaaacctctcatctctgcacataactgcgtacaaatgactaaaatcactttgcttcaaaaacagagtagctgtgtgaaaggcattttagagcatgtgggattccacacacaggcaagttccagggatctcagaagcttggctatttcgttcagtgccaaggaggcaaagatgaggacaggcagtcgtgtgggtgggaggcagtccttggatgattagcacaggtgtccaggagggaggggagggtatggaaatggtacaaacatgagaggaagctgtgccagtgggtcatcatgccccatttgtacagaacattgagtggactgtaactgtggacaactgaaataccgaaaagaaaatgtgcacacactgtttaaattctaaacagtgggagaatcgttgtttaaagaagaacagataattgctcattccaccctccccagtctttgaaagatagacacaggagtgtcacacagtacaagagtttgtattacacagaaagagggacttacagacagaaacaaaatttaaaaacaaacaaaccaccagcatttatcaccgtttatccagccagtggttttctttatccccttggctattactttagatatttttgcttggaacttctcccccactttttctgacagctcattgatcttgggttggatcatcacagttcgtgggaaacaatacaggctacttttctagcttattccttcttagatgcctcttggatattgtccatttaatatgtttgagaaatatagagagacaaaacacacagtgttttaatctcagagtatatgtagtgtgtccctggagaagaagtctcatatatccaagggaatcattccattattttaaagtaaggcttgtatttcagattgatccacctggaacatgtaatcaaaactcatgaactttaatataaattccagattctggtttcttatctatatttttgggaacataacattggtagataaactaattgaaaaaaatattttcaatgttgatttagaaatggcttttaactatttctacacattccatcactccatctcagaagaagcggagtagaaaactgcagcaaatgggactttatattaaagtcctaggaaatatattctggctgatgtgatggttcttgtgtgtttcagtaggcatgtaacatgtgaatcgctttgtggaactgggttcgtgaggctagtatttatgaagctgtatatttccttctgtgtagtaacacagagagtgattcaggagaatgagaaaatcctgtttcctggaaataccatccatcctgaaggagttacgagaaccagaacagatatgtattttgctatttatctcacacttaaagattatacaatccattttcctagggcaagcacaaatggtcagttttataaatcttgatggactaagtcaagtaaaaaagcccactagttaagagtccagatatcgagagacacaaatctgaggaacgatcaattaggacaccgtggtagcttgtctccaagatgtccatcatcagctctttccttccctgcatgtttgtgctgttctctagttgaacggtggcgtctattcactcccttaaaactggactggactgtgacttctctgaacaacagtgacgtgatgtttcattcccagtgtttgagaggataggaaatttctaatttcttttccttggaacatttgctcaggaaaaagccagtaactatgtaagaaggctaactactgcgagaccaccatgctatgagaaagcgcaagccatgtggagtgactgcacgggctctcagagatgcccagccaagccccaccctccatccacccgagccgaggctctgcagcctacagatgatttcaattccagccataatctaactccaacttcacaggagacctgaagcaagaactagccagttaagtctaatcaactcattaaactgtgagagataggcatacattgttgtagcctactaagttttgagatggttggttatgcactgtggattcctattaccaatcggctataattataaaatatccactggcaaatataagttccagaggcaaagactgtgttccttttgctcatcattgtattcataacatgcagcacagtgcctagaacacagaaagccctaaactaataatacgtaaaagtttgaaaaagtttatctgtactagtatgaaagaaagacccatagtcaaacggctgacattttttagcaagtttgatgggcacaataaccttatggtggtggtattactacctctgtctttgagatgagggaacctcagcttttttttttttttttgaggaagtaagcttcccaagctcagaaaggtaggggagagggccaggcatggtggctcacacctgtaatcctaacactttgggaggccaaggcgggcagatcacctgaggtcgggagatcggggccatcctggccaacatggagaaaccctgtctctactaaaaatacaagaaattagccgggcatggtggcacatgcctgtaatcccagctacttgggaggctgagccaggagaatcgcttgaactcaggaagcagaggttgtggtgagccgagatcacaccattgcactctagcctgggcaacaagagcgaaactctgtctcaaaaagagaaaaaaaaaaaaagaaagaaaggtaggggagagatttgaactcagatttgtgcaattctaaagccagcctgtttattatagtctcccaggagactacaacagaaacaatgagaaaacaatttgaaagagatgcaaaacccaccccttgaatcttacccaggactatggagctccattaattgctgtcaacacgctggaacctatttcacatgaagctcagaccaattacaattaatgccacagtcatgactacaaactagaaaccaatgccagaggaagcttaagttaaagaaagcaacgatcacgcacatatattatgttagcaattaggcttaatcctagaatcgtgaagccaaagagaatatattaaagagagaacagtgccctcctgggaagaagagcaatttcaaatagactttttagtggctttctacattacttacttgaatatattatgctcccctagaattactatattacaattactcacgccacattttatttatttcagcaaggaaatgggatggtgcaatgagctcagtgggcagacggtttggttatttcaatgaataatttgaatgtcaacaagttggtggatgctaagatgaaaggggaagtagtaaatagcaaaggtctcaatgcctgactctgagatggagtaaggatgagctatcaggactggcacttcacttctaaatgttgagcactcaggttttgctaaatttataaaagcacatgaactaactaacatcgcatatttccttaacgagaagaccagtttatctctgtttaaaacagttctgatctactcaaatacacatttttaattttcactgaaaaatgttataaataaatcaaaatttaaataaaaaaactgggagggaaaggtagatctacttctcaattcagaagattaataaaaggattaaggaattaaataatcacattctctagcctcagctcacgactttttcaaggctcagtttctcaataaatggaaaagcaaattctcattattctcccaatctgtttgaaagcagagctggggtgttacagtgattaacagttatcaaggcccattaaagttgttaattatagtggcgttcactatctttttccatcatttttagctattgagacagggtctttgtggatcccaaggatcatgtgtttgcagttcaattcagcagccactaggtggtaatattgttgattttggtagccatgaagtgtgatctatcagacctgccctcttaaatggaattatgtacatcccttatatcatcaagatgtaattatagaaataattatactttaaaatatgtaaaatattttaattgtgaaaaatataatcccttataaaagttccatgcatatctggtaccttttaaacttatgctaattctacttaccttttattctaattatacacatgactatcttcaaattatacatataacaaaaataaagtgtctggtcttaacagaaatccagcttatattcattgcttctggcttatttttagaagagatgaaaaagatgcacataactttccttctaaaattatggccgtcctctgtagtaaataattatttgccacttgaacttggaaccactgctattcgcaccattgggtaagtaaaatttctgtgattaactttctgagacccactgtctgaagcatctgataagatttgacaaaatcacgtaacaacagcagcggctgatatacatagtgccaggttctgagctaactgctccacatacattagtcctgcgttcctactagagctgccacaactcatttaaggccaaatgaactcagcagaagaaacatacccgtattatttgaaggaatgaaaagatctttccagaattggacattgtctgcgaaactatgtattatataacatgtattatgcacaataactcccagaaggcaatacaggtgttaagctctttcattatgaagaagacaataactgtataaatcaaagagaagtcttgtgatagcatctttgatcaatcactgatgaaaaccttgccatagttgtcaagaatccaaagagaaagtggtggctaggccaataattacgtgaggcaatttatcatgagaacaaccattatgcaagatgcagagctcaatactgattccataaaatacttaaatacttgtcactgcaattctttactaattacaatggaaactttgttgttattgttgggaaaggtaaaagaggacctctattaagacctcagaaaaggaatctttgaggttaagctgttacccaaggttaaggcaaatctactattctgatacttttctcctttagatgatgaaacaaatatgcttatttctatttacccctagggtcctgggactcaaaagaaaccaagtggttctctaagttagtaggatggcacagtaacaacgctgggattgagctcaccctgaccctgagtaagttaccaagaccctcagactcagttttcttatctggaaagttaggaatgaaaaaaatcagtttcaaaggattgctgcaaaattaaatgaagtgctatgcacctgttgaagtcaagtatagcatgctccccaatcaccccccaacacacacaccagaactaacaattcaggaaggaaattttcagtatattggtgtttctcacagagggtcaaagtgggacaataagaatgccttaaatgtaacacattgtatttattaaagctttatagtttatatggtggtttcccatgtatgttatctaatttcatcttcataatgacactgtgtactagatattactattcccattttacagacaagaaaaaaaaaaaggccccaagaacttaaaatcctttgcaaaatcacatagaaaggttaagtggtgaacccagtgttcaaacctaggtcttctgacttcaagcacaaagctctctcactacattcagatcacttaaaaacacaacattttattgtgcctatcgttaataagactgtattgcacacttaagaatttgttaaagagggtagaattcatgctaagtattcttactaaaataataaaagttgtatgtatgtagaaaaaagtattgcttaatctaattaaactaaacagcttctgcacaacaaaagaaactagcatcagagtgaacaggcaacctacagaatgggagaaaatttttgcaatctacccatatgacaaaggcctagtatccagaatctataaggaacttaaatttacaagaaacaaccccatcaaaaagtgggcaaaggagatgaacaaacacttctcaagacatttatgcggccaacaaacatgaaaaaaagttcaacatcactgatcattagagaaatgcaaatcaaaaccacaatgagataccatctcccaccagtcagaatggcgattaaaaagtcaagaaacaatagatgctggtgaggctgcagagaaacaggaatgcttttacactgttggtgggaatgtaaattagttcaaccattgtggaagacagtgtggcgattcctcaaggatctagaaccataaatgccatttgacccagcaatcccattactggtatatacccaaaggattataaatcattctgctatagagatgcatgcacacgtatgtttattgcagcactatttacgatagcaaagacttggaaccaacccaaatgcccattgatgatagactggataaagaaaatgtggtacatatataccatggaatactatgcaaccataaaaaaggatgagttcatgtcctcctagtttttccaaaacaaactaatgaaatgtgaaaagggtgaattcacaaggggctatacatagaaagaaagagcctgactgacttggctccatcctctacttctacctggggacatttccaatcatcagaaagaggttaatgcaattgcagctccagagtctcatcaaactatcttggattctgccatgatgaaagggaaatgaggagattacccaataacaccatcatgaggttgtccttagtaatacttcaattcttacatggttgagggcctactcaaagttgtaaaaatcagtttaaggtatagtcccctgttctaccaaagcaagcaaataaactggttccataacgttgaaaagatgtaggggtgtgtgtgtgtgtatgtgtgtgtgtgtgtgtaaatatctgctgctgctctaggaaagaccctgtaagagttaatgatacttatctgacaaataatatcttacctccaaacccaaccactaccatctctcttccactagcatgtagttctgagacagtgtttaaaaacagaagacaaggctgggcgtggtggctcgtgcctgtaatcccagcactttgggaggctggggtgggtggatcacttgaggtcaggagttccagaaaaacaggagacaaactctttaaaaaactaagagttaaggccgggcgtggtggctcatgcctgtaatcccagcactctaggaggccgaggtgggcggatcacaaggtcaggagatcgagaccatcctggctaacgcagtgaaaccccgtctctactaaaaattacaaaaacttagccaggcgtagtggcgggcacctgtagtcccagctactcgggaggctaaggcagaagaatggcatgaacctgggaggcggagcgtgcagtgagctgagatcgcgccactgcactccagcctgggtgacaaagcgagactccatctcaaaaaaacaaacaaacaaaaaaattagagttaaggcctaaaatgcaaatacccacggaagaggtcagatcctgacaatgatctcaagatataaatgactgagatttggttctatgtttgtgattaggtttaaaggatggtctgtgtcggggtaatctgagagaagatctttactctctcattttggcatattcataaaagtgtacattgaagcacctgtgtaatgaagagcccaaatgaaataaagaacaggattatggcaataagaaaaaaaatatgaggaacaggtaaaacaccctacatattagaggcctcttcttgaccataatgtaaattagggttcatgttacatacctaataataacatcacaaaagtgtgacgcctgaaactgaagtgatgatggaagcatgagcaaaataagtgaagtcaatccaagtcaaggagaaagaacggaggggttccagcaggttcatgtgtgtgcacgtgtgtgtgcgtgcacacgtgtgtgtgtattagactgtcttgagctctcaatgcctttaaacatttccttgcattttctcattgactgggaggcttccattagatagagccatctagagcgatgttgaagaaggcagccataggaaacaaaccaaggtactagctcatagatcttgcttgataagggaccttcagatttccttttaagttgtccagttcagcacccaatgaaagtaatgagactgtgagtaagaccatttggtttccaattctaggttcaggtggctaagggaccccagttggtataatgatggagaagcaatgaataggaagcagaatcttagggaaaaatgtgaagtgcgaagtactatagaaaattgtttttcaaaaaaaatttgtttactattttaagaggtactcactggttaaaacacccaaatttataacaaatctgcatacgcctatgaacctcatctgcctattttctacctgctgcagcaatgaacctgtttgattagttttaggagtaatagtctaaatatttaacaataacataggtactaactagcagaacaggcaacctgtatgggtgttatggtgaggaccagctgaatatcagtcttgggttagttctcttttgttttttttttttttttttttttcagagacagagtctcactctgtcacccatgctggagtgcagtggcgcaatctcggctcactgcaagctctgcctcccgggttcatgccattctcctgcctcagcctgttgagtagctgggactacaggcgcttgtcaccacgctcagctaattttttttttttttgtatttttagtagacacggggtttcatcgtgttagccaggatggtctcggtctcctgacctcgtgatctgcccgcctcggcctcccaaagtgctgtgattataggcgtgagccaccgcgcccggccagtcttaggttaattcttatttgttctcactgttaggtagtattcattttttgcttcatttttatctgaatgataaaataatatacctaataataacataactactcttctgacccttgcttttatccacttaaacatatacattagggatcctccaggtcaatacatacagactttttttttaaaaaagatgcttagtattccaatgtatggaaataccataatttcacaactccattactggatagtcattagaaaccgacttcgggggaaaacatacgctctttgcaggaatttctgggaaaaaaaatcccctctagcccttttagataaaagcctacctaatagacctgtgataaaatagctttcttttctttattttttttttggaggagtctcactgtggcccaggctgcagtgcagtggtatgatctcagctcactgcaacctttgcttcctgggttcaagcgattctcctgtctcagcctccagagcagctgggattacaggcgcacaccaccatgtccggctaatttttgtatttttagtagagatggggtttcgccatgttggccaggctggtctcaaactcctgacctcaggtgatccgcctgccttggcctcccaaagtgcagggattacaggcttaagccactgcgcctagccaaatagctttcttcatcttccaaggattactgttctgttacttaagtgatccggaagtcacaagagattatcttaattcttggccatttaatgatctttggaaccacgcctgtcggtattttcttgagtagcagtggagtacacaagaacccattttggctcaggcagagttcatgttctctagccatacttcttctttccacaagctttgtaaaggacgtcagaattatttccctcacaggttacattgttcagattactgacctttcctgatctctgtaaccttagtggttgaatatggtgattcagatagttttgtttctttatttctgggggttgaagtgaagagattatgtaataacctgctcttattttgcaacttagagatttaagtatggcctttgtcaatctaatctgaccaaagtatttactaagaatagattacgtgcatatgcccaacatagaaagatgattctatatccaggaggtctgaccacagaaatgtattatcgaccaaaaatgtacctcttcagattctgggatgattcagcaattctgaaaggatttaaacagaaaacccaaggaggaggaaaaaatagcctctaggtacattacacaattcaagctgtttgttcataaattcaacaaacacttattaacacctatcatgggacaggctgagcctatatgatgttgggacaagtgagtgaacaggacaaaacagacacagtcccagctgtcatggaatacccatctatttatataattccttttgcattcaatgttgaaaatcagaattactgcttttgtttattttaaacctggtaaatttatctattttttactagaaaatagttcttttttttaacttttattttaggtttgggggtacatgtgaaggtttgttacataggtaaactaaaacaatttttgatattaagaatatctctaatctagccaggcgtggtggcaggtgcctgtagtcccagctacttggaggctgaggcaggagaatggcgtgaacccgggaggcagagcttgcagtgagccaagatcgcgccactgcactacagcctgggtgacagagcaagactctgtctcaaaaaacaagacaaaacaaaacaaaacaaaaaaaacagtatctctaatctcagctggtcaaaggaacttagaaaatagtttcatagactagggctagaatggttcatgcagaatcattcagaatttggctccattcatggatgccaagcgaaattaacggagaatgagataaggccaagtgtgggagagtgctgggattagagctagtttaggttccagccctccctgccaaagctataaatacaaatgaccaatttaacagcatgaaaagaccacctacaagatctatacctgggatctaatcagttgctctgtgccttcttttaattataggatccctgccatgtttatgggaacttttaatgtgagcatcacagttttgaaggccatatcattatgaccatgtttgatctgagggtgggaaagcaggagctcacaaaatgcctgcacaaggttattctgaactgagctataaaccagcttcaacaagagcctagtgtggaaaagaaaaaagacacgtaagaaaaaaggcatggatatcatggagtttgcaaccccgccaagtggtgccattaaaattacattcaattcttctcagaaaatgaaattaagaaaaagtaccacagttttgtcaaataacactatataaggacattctgagaagggaagaatgaaaaagacataaggataaacgcatcatctccatctgagtgtggcaacaggatatgatttacagaagaaaaattaaatcatcatgattgttagagctgaattgcagctgatataaaaataatcctgagtcacaacgcacgtgacttctcaggcatacagaacacaattgcttaaaactttataagtgataagactcctaatagagaattagctttcttgcaaaacactctgtataagctgtgctgtagaagtacagaagtatcttttctcagttacatttgttatatgatatcctgtgctcagatactctgatacttcaggtatcgcctcattctacactcttttctttgggctatctcattcattcctatgacttgaacctttgtctcatctagctctctcccatgagcccagcatctctacctgcgcgtctcacatgtacaaagttaacctgtctaaagttgacctcactgtcttccatctcaaatctagtcttatcagtatccaaccagttatccaagcaagaaaaaggagttaccctattctcctctgtttcattttgtacatccaatttattaacctgtcctgtaatgcctaaaacagccctttactgtttacaattatgtcttttccttcttatttttactgccattgctttgtttgtttgtttttgagacagcgtcttgctctgttgctaaggctggagtacggagaatgatagttcactgtagccttgaactcttgggctcaagcaatcctcccacctcagcctcccaagtagctgagactacaggcgccaccactttcaactaatttttggagagatggggtctcactttgttgcccaggctggtttcaaactcctggcctcaagtgatcctcctacctcggctttgccattgcttttgctcaagttcttaattagtctgttacttgtccaatatttttttatattactgttagttataactaacatatttctcagccacaacaaaaagcaaagagatataccccctgcaaaataattgcacaaaccaaaacaatgcaaacaaatccaacatgatcatgtcactcctgtacacattatttttcaatattatctgcggcctgtcagacaaagttcagattctttagcaagtcatattgtgactcttatcaccgttttggtcttgtgttcttctcatttgccttgtgatctagccacaccaagttgcttgccatttcccaaacacatcatgtctttcatccttctgagacttgcagtgttttcctctgcctggaatgccctttgtagcctgtctgctgagaatttctaatcctcaatttcctcatctgtatagcagggcggtaacagtactcacttcaaaggactgtcatggtgactaagtaaaaaggtgatttgttccccatggtatttagcagatagaagcactcagtaaatattaacattatcattgccatcattattattttgttttttcaactctaaacaaaaatatcttctttgctgaaagtcttacctaaaagtgttgggcattcttcctctctgattctatatgcctaattatagtaccacattacaccaactccaaaattgatagaattttcacgttttagagcctctgatattggggtacatcttaagagtctacatgttgtggcttatggcagtaatttttctttttttgtagtacatgtaataatggtatttcttacaataaatagcgtattagatgaaatactataaactgtatgacaattgtcatagaaatttgattatctatggtgaatagtgcctatctgtggcaaatggaaaatcctacattttctacgaatcagtgaaatatctacgcaataaatgaagtactatttggaactctacacagtagagaggagatactccatttgtatatactgcaatttggcaaaaacccagcccctacatcatagcatactgctgtgaactataatgtatttcttaaccacaaaccctaaaccatacatttcagaaatgtagaggtaacagcctgaccaagtagcatgctgtcacctcctttggttacgtagccccacttgagagccaaacaagggccaggcccagagtgggcagggggctagcttgtgaaactctgcattccagtaacttaggattcaagctgagaaggcagggcgacaatgagaagagagtgtaggaatgagctgaggaaagcctacggaacatgcctctagactagcactttctgatagaaatagaatgtgaaccactaatacaatttagattttctagtagccacactcaagaagtagaagaaatataatttagctaatatattttgtcaggttattaacatatttattaacttacctataaatgaatattaatcgttttatttatttaacatatctaaaatgttatcactttaccatgcaatcagtaaaaaaaatcagcaataaaatatttgacatgttttttctgctgagttttcaaaaccccgtgttttaccctcataagacatctcagtttggattagccacatttcagcttctcaaaagccacatgtggctagtgcttgccacatcgaacagcacaattctagactgttttgacaaaatgagttaagtaatgaaataattgtaacaagctatttcaacagtagacttttctaccatacggtattgggaatgtttaagattcctacaatagtatatatatttttatattcttaacttttttaatagaatggtaatgtttccttcaaattcaatctgtgtcatattttggctggttttgtcttaagcatgatttgatgttattcctaatgttacttttacctcatctgtaaagtaggagctgatgagctgattgtcacttttacctcatctgtaagtcaggagctgattggccgggcacagtggctcacgcctgtaatcccagcactttgggaggccgaggcgggtggatcgcctgaggtcaggagttcgagaccagcctggccaacatagtgaaaccccatgtctactaaaaatacaaaaaattggccgggtgtggtggtgggcgcctgtaatcccagctacctgggaggctgaggcagaagaattgcttgaacccgggaggtggaggttgcagtgagccgagatcgcaccactgcactccagcctgggcaatgagggtaaaactccacctcaaaaaaaaaaacaaaaaacaaacaaaaaaaagagctcgttgtattcaattatagatcttttcccattaagatattccttgggacagagtgtaggagtatacaattaatcttagtactcttggtctctaacatagagcctaacctatagcaggctcagaataaatctttgaatacacattaaaaggtgaactaagctagagagtactggctatctgggttccacactggaattacgtggagagtaaaaaaaaaaaaaaaaaaaaaaaaagaaaaaagaaagaaaatctgatgcctggccccaccctgagagatgctgatgatgggtctagagttgggcccgggtatcaagattttaaaaaatctcctaagtgattctagtatgcaagagagttgagaaccactgttttaggactttcttagaacagcttcctatggccatacctttacttccctgtcataagatccagtttccctcatataaattccctttctctgaatagaccagaattgtcttgggagccctagtagagaagaggctaacacattatcccaaatggggatttgcaaattgcttttccaaggtaccaaagaagattctcaaggttttaaatctattcatatttatgtcttttcaacaaaaagaataaaattcacaatataagctggctgctttgcagacgcaggattctaagagcattacagcatgcaggtaaatagtaccctgacatgcacatggcaaaattttctagaaatagaatagcaattaaaaataaagatggaatccaagtacaaatgagcctcatttcaagttaattctgcatatgtaaaaagcagatactattaactggggtcagcaaagggaagtagttcatggttttcttcaggctacttaggttatatttacacagtataattatacagcaatgcattttttgataagtcacttataaaatccatctcctatagtcacatagcacacaagtattggtatctttgctctcaagatggtactttgtctgacagcatttcttccatcatatatgaggttctgtaatggctgagagagaaatctgacttctcctacttcaatacagacaacctttcatcatggagaagggagcaatggtctctgcaccaagggaacagcagctggaatggagttcctctgactcatagactgagaatttccctgctgattctcaagctggtttggccacactttatgcattcaccctgcttaacagtcttttgttgatggtgtggtaacaagtggccttactcagtaatagaaaaagcatgttgagatatcccccaaaggctcctatgtgtgtttcctctagctttccagcagggaaaaaagctgcctgcaacaaccccacacttatttttgttttacatcttaagttaaatttgagaaattagaataggaattatctaaaagacatgatacttccatgttcactaaccctgataaacagaagttccctactcatgccaaaactgtgaaggaaggaaatctgttaagatttcaaagaaagtgtggagtctcatgcataccagcacatcactttcactgactaacccccagagggctgataggtagcaagtgattgatgggtgacattcacttggccctaattttcctatctgaaaaggaatggaaaatataacacaagtttccaagttgctacactcataaaaccaggagggtgatcaccatccacctgtccaggttgaccacaaatgtgaaatgcatgaccacatctgccttacatgtatgtcatttgtcagtaaacacgggctaaggaattccttgagccccatgaagagacaaaaaagtttgtcctcagagaatttacaaaagccagagtaacattcaagaatttaaaatattaaactggatttgaaaggtgatatgaaagctacaggacaactttatctaccgtgagtatgtaaccaccatggaaagatgggctaatgaaatcaccagagctgcctgtggtcagccaggatgccaggggccgtgggcctcagagaaagattcatggaatgaaggatgtttcagggccacgtgtatgtgcggctgacaaagcttcctacctttttggaagaactcctctagtttgtccttgaaaggctggagatactcctttggggactccttgcacaccaccaccatctgtttctcacttgctgtgaagagaaatttagaattagacttaggaacacagatttgctgagctcctgctatgggccaggtactgtgctatgcacttggctatcaattgtgcacactccttgtcaaccactgttggtccaaattccaggattggggggcagggggaacaaaacccagaaataataaacaaaccaacaaaaataattagttcattctacaccactcttgaggaacagggcaatgtacaatccttccatttttcttctagagatccagaaaagtctctgacctgggataggtaaagtattctgcttgtgttctcccaaagataaagagaggcaaaaactacttgaggattagtctcacgaaattaagggcctcagccctcctcagattcacactccaaaagtagagcttgaaaaatatattgcagaaattctcaggcacccaagttgtctagaactaccaacctagtgattggccagggtgacacacgcatcccaacatgagaactaagaccaggtcggggaggaccctgtcagttcttcatgcttcccgttcacctacccttccttttaatcctctactaacacaagggaaataattttacataatttacttcagatagactatctaaaatttgtaatagagtactttttgataatcaggtctgaggtgacttgactttttaaaaatgacctaccttattggatagttacgatttgtctacagggaagccacagtaaatcatagttcaccatcacaaaaggcagttaacccagccaagaggcatctccccaaggttcctatgtgtttgtgccagttacagcatgcactgggaaaagaaaggcttcgtttctacaaagctagagctgagtcaagatcactttcatctgttgaccatggctggaaattagatatgttcttgtccaaaagcctattaataaagcactggatttcaccataaagatatcatgccacctggggttcacaaaatagagaaacatatactacagatcttggagcaatttataaacacacaggtaaggtattttggaagaaggaggttgggaaggagatctttatttacattgggaaattcctatccaataatttggcatatttaaaactagcatctcagaacgtatactgcaggcaaagcaataaacatgtcagttcagaaatagagaaaatgcaaaagacaccacttaaatgttctctgaaattagttatctgacacttttcatttgcaatattgccaactagattgcagaaatcctagacaaccctggggactacaaaacggtgctgaaaatgaaagtacaatttgagggaaccctttgtcattttctgagtcaaggtcagaatcacctacattttcagaggtatctagggatttctcatgatacagggatgctaggtcacaggacaggggtaccgaaattcaagctctatctattgacattgtttcttaaagagtttttatagagctatctagaatatctgctattagctattctgacaaccattccaaggctatctaggaaatcctgtccgttgggaggcaaagactaattttttaaatgacttatcttattgaaaaaatacaaatcttaccttgaaacaactagaacaaattctataaatccagtcaaataatcatttaaaacattcattttttccacatttttttcctttctttgtaagcctttttgtcctctctacaataactactttatagcttctctgctattatgagattacccttcacctcttttgaaatagatggatctgtggccaaatggtaagtatatccttcccactaccattcttttctcaaaataggacactttgcgctagagtagtgtccaaggagcgagagagtagatagagctgggatatattttgcaggtgtaacaaataggtcttgctgattcagtcaaggtagggttgaagcagatggaagggtaaaggagtgggcaatgggttgctggaagtgccatttgctgagatagagaatagtggggaagtatcttgttggattatgtttttttaagagacagaggagatcaagagttaaatttgatgcttaagttttctctagtctctataaattgtaaggcaatcttgtcccctgaaaacaaagggggaaaggtacaaaagaagataaaactattaatgggttctcatcacaaattcaactaaattcaaacttcggggacttggattatttaaggccttttccattatggcatatttcagctctatttcccacatgtatttgactaaccaaaccaaagctgttcaatgttttccagttacattattcggcattcccagttccatgtcttcattcatgtggttctctgctctgctctcatgccatacattctttcaacaatatctgacaaagtcctgttcatcctaaaaagcttctctgagatgccaacattgccacaaagcatttttcaatccaatgtttttgcatctttcaaacatatctatcaccgtctgcacagtgtttatgttttacctttaatatttatgtaaaagtccatacattaatccctgagaagtcatcatgcaggattcatttacttctccccaaacttctctagagagctccatgtatctggcgaaagcatcagatttccttatcttggctgaatgtcgtggttcgcacctgtaatcccagtgctttgagaggccttggtgggaggatcacttgaggccaggagttcaagaccagtctggcaacacagtgagaccttgtctctcaaaaaaaattttttaagttatccaggcatgatggtgcatgcctgtagacccagctacatgggaggctgatctgggagggttttttctgcccaggagttcgaggctgcagtgtcataccattgtactctggcctgggtgatagagtgagacagacagacaagaaaggaaagaaagaatgaaagaatgaaaggaggaaagaaaggcaaaggcaaaggcaaggcaaggcaggagggagggaggaaagaaggaagagagagacaaagagagaaagaaaaagaggaaggaaggaaggaaaaggaaaaaagaaaagggaggaaggaaggaaggaaggaaagaaaggagagaggaagaggtaggaagggagggaggaaggaaagaaggaaggaaggggaaaggaaagaaagaaaggaagaaagggaaaagtagatgaagaaaaaaggtttcttcatcttaactagattctcacgtgtaggaaagtttaaataaaattagcaatgttggcttggcacagtggctcgtgcctctaataccagcactttgggaggccaaggcaggtggatcacttgagcccaggaatttgagacaagcttggccaaagtggtgaaaccctgtttctacaaaaaatacaaatactggctgggcatgggggtgtgcacctgtggtcccaggtattcagaaggcagaggtgagaggatcacctgaacccagggaggtcgacactgcaataagccatgaccacacctctgcactccagcctagtctcacagggtgagaccctgtctcctgtctaaaaaatatatatacatacatattagcaatgttgacccagactccaagtgggctttccagagatgcaatgtgacttgcttgcccttcccctgcaccaaggggtcaccgtctctgtgtctctgtactcctcaaacatggtgaggtgtcccaagatgatctaaggtttgagtgtattttaaagacccccagaaatgtccaccacctcatcccatgagtcataagcaaggtaacaaaggtaacaaagatgattatcctgattgggtagttctcaaggtaggcagggaagcaggaaagacatctgttttaaggaatcagcatttctcaatgaacatttgtggccacataaactttcctgattatttccagctatgattctgagaatacagttaaagaaaagctaggatttcccacaatataaattgggaggagttccttaaattatttaattaaccctctactatattcaaattccaacaatttcatttatatagaattgtttttcatgaacgtagtataaaacatgcctgcaatttactaataggatataatcgaacgcctgacaataactccttcaaggttacttctccctggtgaaagcaaagctgaaggcagagcttgtttccccaattacaaaagcaatactttctcttttgcctgaattcacagggttgatcgctgcagctctccctttgtgctagatgtggtgacagagcccatgcggtgcccatcaaattgctccaattttatgaggccatatcatgggggtggtaaagagcttgtgcttggattgagacccactaggactcaggtgggctgtggcttgtttttctcatctgcaaaatggggacctcccgcaacacaggcatgatatgatatttaagataatacatacatagtgatttgcagaatgcctggcactcacaagcaggctcataaatattatttgttatttttatgtttgactaaaattggttgggaaacatgtcaaggtcagaacagcaagagagtcatggctggggattatttgctacagatgctgggcactgtatttacggaaatatgccacggtgcaaatctcctgtttagaacatagggataatgattttcattcccgtgctgaagttccaccacccattgtgagaattcactgaagaatgcaggcgaagtcttggggaaagacgaagcaaaatgggaaacaattcccctaggcctctgagcttcgcggttttgaaattagaaactgaaaccagtacaaacgagagcagctccactgctgtgctccaaggccctctctgcagccccacgggctgggattcccacgtggcctgtaagaattaaacttccccacatgatcaaaggagagggctgccctccgacggtccccacagagccacgcgccccggaggccaggcagcttgcctgctccaatttattgacttggcttatccgagatgctttctagcagacaaatgggagacctgaaggctaattaatgatgacaccggagactggcagtgcataaaggagagaggtcatggacagatccacaaatgtccttcactgttcaaccggaagactcgcatacgatattgctagaccaccaaggttgcctcaggcgtgggctgtgccaggagctccagttaaaagccaaagtcaccccaggttctctttctgttatttttctctttacacaattttttggcaattaaaaatatattaatttccgaagttagttactactaagtgatcactgtgagacagagatgaaatattaaaaaccaatacatagtgaaataactgagactacatggagaatattttcacttacaggttaaacactggtggagtattttagtgaaaggaaagatatggcctagactattttaatatttcagatattaggctgttaaggtcagaattatctgttttttgtttttcacccctaagaacaagggaataaagcttattaagccacttaaaaagcctaggcaggttagaaaaatgtagcagtaagacccagatataattcatcaaaatcaaatacgtttaattgctttgtaaatcaaatgtatgtgggcaattggtatgaagatatgaaacttgtttctttttgtatgagctgaaggacctgtgggcttagttaagtcagaatacagttttagaggaaaggaaaggtttatcaggctatctgcttttccagagttctctcttcttccctgtctggttacctaagtcttaccccacccttccacagtcctgcgccagttctgcctcttcctcacttttacaagatccatgtcctgttcacaagctccctgctcaaaggaccgccatagaaaatggctgcagcaacatatggaatttttttactaaagcaaattcttgtattatatcaatggggcttagatgagagacataaagtgaagccagagatcaaaagcctagaatgcttggttaaggagtttatcatacaggaatccattcaataaatacatcagttcggctaggcgcggtggctcacgcctgtaatcccagcactttgggaggccgaggcgggcggatcacgaggtcaggagaccatcctgcctaacacggtgaaaccccatctctactaaaaatacaaaaaattagctgggcgtggtggcgggcacctgtagtcccaactcgggaggctgaggcaggagaatggcgtgaacccgggaggcggagcttgcagtgagccgagattgtgccactgcactccagcctgggcgacagagcgagactccatctcaaaataaataaataaataaaataaaataaataaacacatcaattcaacacatgtctactgagcacctactacgtgccataaattgtgtcagatattggggttccatcagcaaaagaaacagactaaattctctgccctcagacattatagtgaatgggtcaccaactaagatttcttaatgggtatggcacgcagtaattattgtttctagtaacttgaactgcaggcaaacctacgagttatttccttccatgttcatcttttctactttaatccctttagtaagaacaggaccgtctagtgcacttcctggtggtggggtgggaggacgtggttagaaaaagtgaatgtccttttagcttcctgcccccaaacacacttttatcaaaacaaatgtaaaaacaaattcagaactcagaatctcaatattagcttaacttgcacaattttcttcttatggcattggccttaaactgactaaggaattacatgaaatgcaatgtaataaaatactaaagttagaacagtaatattttattttggctagcagcaatgcatggacttctatgaaaggggaaaatcatacttacaattaataaaatattagatattttttcatttgcttattaaagcttggcacaaatgagaaggtactattttgtggctatctactgtacacacttttttataaggccatatagaaaaggccacacaaagggaggtttcaagttgatttaagccaaaaacaaatgacagaagcctgcaataaaaagtacctatttcatgttcttgaggtctgatgctacacagcaggagtattttaaatcttggcagggttaagagtagggagtggtattactggaaatcacagggtgaggataactaggagagggcaaaggggaaatctattcaaggagacaccgacataagttagattttgaaagggactgctacacccattttctactaaatagcccttcaaagcccacatttctcagctcaaatcagacaactgtgcattaatgacccatatgtggaaaatctatatgtaaccaaaggtgttttccttctttaaccttggtttggggattcacctgacatcatatgcaaatttttcctcctaatgactctattcatccaaaggcaagacactatatttaaagtggtcaaaaaactccgaattcccagttgtccattcaagttaaaacacaggctttagacacatggaacccaggtcaaaatattatctcagaataatgtagctacatacatggacttagacaaacaagtgcctttttatagacaaacaagtgcctttttatatctacacatacatagtgtctatgcctcaaaagctaattagaacattgtacttagtgaatagagctttagtatactccaagaagtagaaacaatccaaatgcccatccatcgtctgataaatggataaataaaatatactttatacacagaatgaaatatttggccattaaaacaaatgaagtacaagtacatactactacatagaagaacgttgaaaacattatgctaagtaagaaaagccaatcacaagagaccacatatcctatgattctactcacatgaaatgtcccagtaggcaaatctatagagacaaagcggattagtagtggctgaggactaggagagaaagagggagagagagagaggtgacagctaagggggtaagggagaaaagttttccttttggagtaataaaaatttcaaaaaattgattgtggcaatggttgtacaactttgtgaatacaccaaaagtcatcagattgtacactttaaatgggtgaattatgtggaatgtgatttcatcttaataaagctgcctaaagctaattagaaagtcagccttaaactggaactataatgaacagataaatgaagaatgcctcatctgtacttctttatataaggtaaataattttaaaaatcttaggtgcaactatgtcttcattataatacttacaatattactaaactaggaatcaaaagtgggaaatgagtttgagatgcacatgtaattgagaaattaaacatattagtcaatcttcaaaaagtagcaacaaacgttattaaaataaaagacctggccgggcaaggtggctcacgcctgtgatcccagcactttgggaggacaaggcgggcagatcacctgaggttgggagttcgagaccagcctaatcaacatggagaaaccctgtctctactaaaaatacaaaattagccaggcgtggtggcgcatgcctgtaatcccagctactcaggaggctgaggcaggagaatcacctgaacctgggaggcggaagttgtggtaagctgagatcatgccattgcactccagcctgggcaacaagagtgaaactccacctcaaaaaaaaaaaaaaaaataaaataaaataaaatacctactaaaaataactgaactcaataatagaaatacaagtaaagcatttaaattaaaagtgctaacttttggaaaattaaaacaatagctttcgcacattcttaattgtggcatacagctatgtatatatatttacacatatacaccaacaattggtacattagaaaaatttcccctttgaggaacatcacacaacggggcctgttgtggggtggcgggagtggggagggatagcattaggagatatacctaatgtaaatgacgagttaatgggtacagcacaccaacatgacaaatctatacatatgtaacaaacctgcacgttgtgcacatgtaccctagaacttaaagtataataaaaaaaaagaaaaaagaaaaaaaatttcccctttgaactactcttgatttaaagatgcatttattcttagtttttcatacactctatttggctggaaaagttatttaatatctgactcttagtttcttgatacataaaatcttgtgaggactaaataaacatgtgaaaaaaaagcattttgtatgctgaatagtaaaacgctagccaaaatattcttcagctattttaaataatcaaacagtagaaaggctggctagataacatactgtacgcggctttattctttgtttccaagaagagctaaacaataacagcaacctcacaaactctttgaataactgacattcctaatgtttgtgtgtttaataaacaaatcatgttacagtctaatcattttcccagtccaactgtcttttaaaatttgcaatactcactttttcctatttcttgtttcatgacccactgaaatttacttcctccccattgtgacactgagaaagcactctgaagtcactaattaacccatcctgtgggcagtgtcctcattttgtatctccttcgctgacaacccagcaggattctgcatcttgactacttctcctttgtaaaacactttgtcccttagcgtctgtgttccccattgtgggctttcctcctacttctgcctgccctgtttcctatgcagcctcatcttcctatacagagtcattaaacgttaaagttctctagggtttggcataaggctgctcctcctcccatgctatgctctctgtctagacaatgtcatccaggtaaacatttcagtaaccatatctgggatgtgtctcccaagtttacacagctagcccacagtttcacctcctacggaactcctgaattcattactcttcaccaggctgctatagtctcagcctaactgttcttcccatatccaccctgcctctctctgatttgttctccatacctgagtcaaagtgacctttataaaatctcattatgccagtcccctgcttaaacctgcaggcacctctattactctgagaggttgtcttcaatccctcaagctggcctgcaaggccctccatgcgctacgtcttgcctgccttcccagcctcaccctgctctccctgccacagtggcccttctttccattcctcaaacatgctcacttcttcccattatggtgttctcctgctatgccactctccttcacttcctagtaaccaggacctagtcagtgcttagtcatcattacgacctcagctcagaagtctcatcaggttttttttttttgagacggagtctcgctctttcacccaggctggagtgcagtcgtgtgatctcctcggctcactgcaagctccgcctcatgggttcacgccattctcctgcctcagccccctgccccccgctccctgtgcaaaggctaattttttgtatttttagtagagacggggtttcaccatgttagccgggatggtctcaatctcctgacctcgtgatctgcccgcctcggcctcccaaagtgctgggattacaggcgtgagccaccgcgcccggccatcaggatttcttttccaccttccattctgtgatgagagaccctctgttacaaagtcatagcactgtatacctttccccttttcatgattattggattgtctccctcattaggcagaaactgtatttttcttactgttaaatctccagcatctactgtaatgtctatctagtgaaagctgttccatgggtatttgctaaataaatgaataaactaccagttaaaggggagaaacttacacatgtgcagtatggatattagtgtcttgacagaatttggctgtagtacatgtacactcatgtacctcagaatgatgcttctgtcaataatggaccacatataaaacaatggtgccataaaattataatgaagctgaaaaattctgatagtccggtgatgatgtagcctttgtaacactgtagagcaaggcattacctttcctttgtttagatacacaaatgcttaccattgtgttataattgcctacagtattcagcagaatactgaatacagttacagtatagtacagccagtagtactgtaatatactgttaactatattcagtattctactgaataatgttggggactgtaacagtatagaaacctgtgcagatttgtagcgtagacgccataggctataccatctagcttaggtgtgaagtaggctacaccatctatgtttgtgtaagtacactctatgatgtttgcacaatgatgatattgcctaacgacacatttctcagaacatatcccagttgttaagtgacacatgactgtatgtatgtatatgtagacacagacatatgcacatacaccgacacgtgaaaaacatctctcttcatttgtataatacatgtagatggaggcaggggctggagaagacacaagtacactgacattcactcattcacccactttcactcacattcactcattcagatacgagatacacatttttttttaaatccctgtccgggttccataaacattcatacattcaaaatacttaccaagtatctgctgtatgccactgagctaaatgttggggacaaatatttaatgagacctactggtcatttctcctctaaaaaacattcacagtctagcaacaatgagaaacaaggaaatgaacaaattgtgatatagtgtggtgtgatggaacgctgggtataggcctctatttcagactgggccaggagttagtagccaggaaaggctctccaggagagaaaacttatgagttgaactgcaaaggtcaaggaggagctagccctcaaccacagtgaggaaagagaattaaggtgaaatgtcatgaataaaagtaatacatgatgagaacgcacgggccatttgaatgagttaagtggtgtagcatgtctggagctgtgggaccttctctcctcagatcactggtgttctgcattcagattttggtgtaaaggaaagagtgtgcgtaggggagaaaagcttctgggccccaaaggtatcccaggttacacactcaggtgaacggtgaaaaggctggtgaccagcctggttaggaaaagtgtcacagacataaggggcttgcaattttacttaaagtagttaggaaaagtctcactgtgaagctatttgactagagatttaatcagagtaagggagggagtcatgagcaagctcgaggtggaaaatcaaaggtgttatttagagcacattaagtttgaaatgtgaattagacactcaagtatatataaaagtctgcagtctgggactcatggctggagtagacacacatgccaggaagtcattggtataaaattggtatttaaagtgatagcaaaatatgaattgccatggggagaatacagccaaggaagagaaggtgttgcaggacaaaccctggggcatgtgcacagtggaggagaggccagcaatgaacagagaagagctggtcagtaggaaagtgaaggtctggagttacatgacctgagaagaaaacagaattgcaggaaagaaagagcagtcagctctgtgcagaaggatcaagtgagatgaagacagagaaataacactgattctagtgacacagaggtcacttgtaatctcaaaagcagttccagggaagttgggggtgcggggaaaaagccagcttggagaggcgtgaggtaaatggagaaagattctgtagccacttgtttaagaagttaagctacagaaagaacgccaaaatggggaagtcgttggaattaagcctaaaagatagctctagttttcctggtcaagtgctaaagatcaaatgaggccatggaagtgttgttttcttggtgactttaaaactgatttagttcttatctgcctgggatgtttttgatagtttcctttcatggtagtaggactccttagaaagattcttcctttaatttttcaagaaaactcccaaagccatcatgtcataaaaatcattccatacaagaagatattctctagggctactttgatcacgtgcagaagaggtctagccctttacagagcggctgcctctttctccagaggaatgttccataaaaataaacccaccaggaagctggagtccaggggaatcccatgattctgattcactccactgagggaggctgcccaagatcaaattcaccttaatgtaccatgattgggagtgagtattctccatgaaaaaatttaagcagaggtgacagggccaagtgaggacatgctagtgcgctttaggacttttggaaagacttgcaaagctgggccactgactacagcctttgcacggaattgtctaaagcaccattcaaaggtcccgcctaccaaacgtcacagctgagtcagaatttccactgtgatgattatgtggttacggacgcagcctcggtctgcgagacattagcatgaaacatattcattaatcacctacccatgacgaggcctaaatatagatggattgggcatgatttgatttatagggtgttaagcgattcaaacatttattcaaaaacatccctttcactggtccccacaaaaatcgccaccatgagaagccttcccttgaattaaagatggtaactccagaaatttcattagaaatgcatatgtattcgttgaaaaagaaaacattgtcaagaataatttaatgctttagtagaaatgtatttctaagattggtttaggaggtaggggatttcaaaaacaataggtaggaaagttgtgttaacatggaagaaaaaggcacatactgcaagctctggcatcgaggtggactgtgtggcaggggtcctaggcaggcagcccaggcatggaggtaccgggcctctgaaggggaagggaactcatcttcgggaggagagcagcgactaacttctaaaaagtattaggaaggtaacatatacacacaaagacatttgaaaaacatttttaaaacagcagaaaaaacaaatcggtcatgacaccatgaccaaaacacagtcaccatctaagacttgcatactttctctttcagggtctgggcctcggtatcgcgctccttgcccctccatcattttatgggggttgccttacttatatttgataaagaatttttttgtattttgattctttctattaacatatcatgcacacattctcctgttatttcacaaactccacaagcatgtttaacagccatataaaatttcatcaggtaggcatgccatagctcacttaattctcctgtagttggatagtgaaatcctttctaccttattctcatggggagtcaggcttgagccacatctgtgtccatacaaacttattctaggttgagggtcatttctttaggaaatgacctaaagatacaagatacaaagataaaagatacaagaaatgaaattataggtaaaaaggaaaaacctttgtagaattcttgatattagtggtcaaactgtttttggtacaaaatgggttgtaccacaatgggagagatgaaggggagagattttggaaataaaaccattttctgtaccactctgcagaggtggctggctccatgcaagctagaacggtgcctgtcactgtcatgtagggactacggtcatcacattggaagtgcaaaactctggaatggaaaacagtaagaggaccatccatccactgaagtaatttactcaaacacaagaccataactggtgatatatgagagttgatatagaaattggggattaatcacagcataaaactaggtttgaggcctgtgcatgaaagtagctcttttttttttttttgaaaggccctaatgtgtcacgtttaattggaatgtaaattatgctactgtcagcactagcaaagctgtctgaacttgggggaagtgtacagcaaacttacatcaaacactcagagttttgtaatatacatttatataattatgagcacacaaaattttaaatgctcagactttccaatcaacaatatcaagtaatcatttggacatacgattgcaattcaagtcatttgtgaagaacatatagagcctatattttggggcactcccattgaatagtacttcaagaagcatacaggtatcattagtgcaagacaatggttaaaagtcagcaaaggcagagcaaagttgttagctagaacgcctcactcctcccaaaattatagcaacacatcttatccactgctctaatcaggaaaatagtactcctataggaatgcttaaatactaaatatgtcctctgaagtcaaaatgcatattttgtggcaatttttactagaattgaggattctctcacacatacacgtcttgaaggccacaggcctgagcctctttatgaatcaaggaaatcagtaagaggaagaggtattacagcaatgctggtcttaggactagtccccttccagcagtgcaacagctggctacaaagaggccagtgattaagatacacaaggcctattagtaaaaagcaacctgtccccacattgctccaccaggacagctgcaagtcttccacggtttctctgacctctgagcccatgttcccgtttcagccctcgctggttagtcacattaactgtaattttctactctggaaagtgtttacatctaaatgaaccatgagggaataaaggagaaatgacagaaaggcataaagagaagagagggaaaaaaaaaaggatggaaagttatttttaaaacacacaacctaatctggtggatgaattctggtatctagtcttggctccagaatcactggcaaagcatggagctggcagccactgctaatcagtttgccactgtcttcagatttaatgcaatatttggctcagacatttaaaaaaatcctattccagctaaaatatttacacagtcctatgtgtctcacttaatgcctgttaagcaatcgtcttttaaaactccacagacacttgtaaatctgtcgggagaattgtggcctataaacaaggtttcatataaagaaggctgcattgtcaattttgggggagtagggatttcttaggatgtgtttgaaaatagagttgaatatcagaaacagtttagagtgggtaacaaagtggccaatagtctcgcttgctggacgccgttagtggtattaacgggaagcctccagacactgatctcagctatttaaaactgtgctctcctgtaaatctgtcattgatcctacctctctcttgagttatggcgcagggacagtttctggtccagcagcccctggtagtctgcatcctagggcctgtcaggctagagatgatgagctgctggagcctttaacaggaggctattacgtggttatacgtaaagtgagtgtgtgtaagcatctgaggaaggatgggggactgctagaggagagggggagttctgggcagggctgatgttgagaagaacaagacggctgaaatgacaaataaatagtatccactgagaggctaggtgtcacagattctgaaatgcctattaaactctctaacatcttcagccctgatgttaataagactaggtgataaaacttaaagtcatggaggcccctccaagctatctcctgttggcctggggagcgcaaggaatttgtctctgtctttgggatgagtcaggtatatgtaatatgactcagcaaaaccgctccatcattcaattattcctagattagccgcctttttatttttactccatttcattaatgaatacgccattggttatgattcacaattttattttagttgtttttttttttttttttttgatacagagtcttgcactgtcagtcaccaggctgcagtgcaatggcgcgatctcggctcactgtgacctctgcctcctgggttcaagcgattctcctgccttagcctcctgagtagcttggattacaggtgcctgccaccacgcccagctaattttttgtacttttagtagagacgggatttcgctatgttggtcaggctggtctcaaactcctgacctcgtgatctgcctgcctcggcctcccaaagtgctgggattacaggtgtgagccaccaagcccggcctatattagctatatatagcgaatatcaagcccagcttaaacactcaactttgggatttggtggagttaggaaaaggtatgtcatggattgaaaaaaaaattagatgtttgtaattccaaggtatataatgccttgaaaccaaggtggcaagtattagttgattctcttcaggatcacagtcaggaagggctttgcagatgtttttatgaatcttcagaacagctggagggaaaattctatataccttccctctgtttaccctctaacagactgacaagtattatctctgttctcaggtacagtcagattcctgttcctgagcagaagagaaatcagaagtaggaataaatctctcccctagaaaatggggataaaacttacccttaaaatgtgtttataaaggacttgatctttcagtgagtttatttaaaattcgcagtgaactcagtgctaagaataaatatttgctgaacaaattaattgattgaaaaggtcaaacaagatctgtctcgtattctgtagttttttctttgatacccggagatttgatgacactttttaaagaccatcaaaatggtccagaaaaggtttaaaaacacaaccaaattagcactgttagtacattagccattataaatgttccttgggcgtttcccctttctgtttactatggcagaggaaaagtttctggtccagcgggtcctggtcctccatgctgacttggacatattgccatttatctctcactcagtaattccttgaaaacaacaacaaattttcaaactgtataatcaaaagcaaatggcccttaaatggccaagggtgtcttagccctcagcctgctttatgtgttatctcatcttaccctatgaaagttttcctgctattgtcccctttttggtgagtattagtaaagtcacacagacagtaagtagctgagtcaggatctgaatccaggggtaacagaccccctgcccttataatatgccacctcctactttcaccatctacaggaaagttctagaaaaaactatgggacacctatgtgaatgctttgtcaactgtaaggaattaataaaagctaaaaaaatcaccaagtgccaccactgggatcctgtcatttcaaatggggaaaaggcctaccaggtggttaggttagtaagtggcatggcagagactggaaccagggctgtcaatttcctggtaggtctgtgatctttccaggagtattaaaaggtagagtcacagttcatggcccctatccacctaggagccacgctgaggttgagctatctgggaaagaatctacgagagataaggatattggcaaaaactccagtcccctttgcaggggctaaggaggtctccctctaacttcactcatttggttgactgacatgagaagaatctctctgtggattgtgaatcttccacagagtcaaagatatacaacttacttaggcagaaaaagtattttgatattcacaaaactatccactactctatttctgtaaagaaaatgttttgacccaatacaagctcatggtatggtagcttgggcgctggcttggcagtcaaggacctgagttctgtgcctggctgggtgatcccggccatgctgcttcctatctcgaagactctgttttccaagctgcatatgcctgccctactcacttgggaggatgaagcaccataggcaggtaaagtatcaccattataattacaagagtacctttaaaaaaccaaaaaaacaggaaatatcaaggatactttgttaatgaacttgccaaattaatgctattttccagtcctcatacttgattcagtcttccagctatcgagcagaatcctgatcaaaagcacttgtgttgtttctaaacctgtttattcctgttgttctttttattgaaattatgtaatttaatgacttgatggtaaaccagatatatgactgtcaaaaggtactatttctataagttttaatgaaagaagctaaaatattgctgttaaatgtaggtatagaaggccaggggaaactggggaaacatggcaactaaatgcaatgtggtagtcaggattaggtcctggaacagaaaggggacaaaaatggaaaaaccagtgaaatccatataaaaactagcattcagtcaatctaaatgtatcattgccagtttctcagttttaacaaatggatcacagcagtgtgagatgccaagaatggggaaagtaactgagaagagctatatgagaactctctactctttgcaacttttctgcaatttaaaaattattccaaaataaaaattaaagtgtattgtttaaaaagtgtgggaaacacagttttaaaagattgagaacaattataaatatctagaaagattctatggtgatatttgcaagagtctttactgaactttaaaaatacagtagggaaattacagatgctgtcattatggagtatgtagggaagacctataggactgcattcgacagattcataattcaagtaaaagcttcatccctgcatcagaatacagacaaaggatacaacatttaatttgttgtaagttaaagtgttaagggatacaagtgtcattttccatgattcccaattttggccaatttttttccattaacctaccacactggataagcgctctgctctataaagacagatggtatcggctgggcatggtggctcatgcctgtaatcccagcactttgggatgccaaggcaggtggatcacctgaagtcaggagtctgaaaccagcttggccaatatgatgaaaaccagtatctactaaaaatacaaaaaattagctgggcatgctggcgggtgcctgtagtcccagctactttgcaggctgaggcaggagaatcgtttgaacccgggaggcggaagttgcagtgagccgagattgtgccactgcactccagcctgggtggcagaacaatattctgtctcaggaaaaaaaaaaaaaaggatagatggtatcaacacaagaatttttgaggcatgaattaattcaagagattgttcagagtcatttacaaagagaatacctgagatgcaagcctgatataatttgaaagttgactttttaaaaaaaagtcttgcaaatggtcagaattcctaggatttttcagttgttctaattaagtcagtctagggaggaattcaatacagtaacccttcatgaacaaggagaattatagaatgcactgaaatagcatagtaagaataatcatctcagaaattcaggagttggaatataccttcaaaatcatctagcaaactacttgtctaatggtacctcctctacccacccacataatacaatcttccagcaagcagtgggtgaggaacccactactgctcaaggccatcagttttctcttcagacagctttaaaatctgtccctctaaaagattctactcacggatgcttatctgacatctttggccataaggaagtgatctaatttctcactaatagcagagtcagcgattatctgaagttgagtcatttcttccattgttcatttgctcattcattcacccatttaccaaatattgacaacaaatacgtggaaagtgctgaccagcacagtaaatataaacataaaaaaggtcatatatctgccttcatgaagctggtggaggaagagaaaatttacaaacaaataaatagaaaataatatgaaatatgaatatgtgaaagtaatatgaaaaacgaaggctgtaatagacagtgcctattcaaagtgcctcctgaagagtgggtgggcaaggaaggctcagagcatgggcctatctggcagaagggctttctaggagagggacccactactgcaatgatcctagagcaggaacaagtacatcgtgttggaacacaaagaaggcccgtgtggctggagtttagtgggcaggaggggtgagtggtgtgagagaagactggaaaggcagaagtggttaaatcagtttgtacggcatgagtatgaggttggatttgattccaagaggaatgaagatgaaataacagagtgctgtgacctatgcggcaggtggagacaaaggaagaccaagagtggaagcagagaaacctgcttgatatgggccaggtgagaaggtggtagcttggattacaaaagcagtaggtgtggagatggagagcaatgaattgattccagacactttttgaagttaagagtcaacaggactagctgtcagacatgagagcacaaaaggaatcaaggaaaagtatgacacatttggcatatgctatgaaaagggatttcctttgtgggatcccagtaaatcctcttaaacaatcagtggagcaggtagccttacactcatttttatatgaggatactgaaatgtcagggatgaaatgatttgccaagggttacaaagcttgtgaagcaaggatttgaattcaggacttctgacccagacttttctatgattgcagcttttatttcaatattttatgtttcttgtcaaagaaaaaaactcaacaaaacacattctattaaccacgtgtttttataaaatagagggtagaaatagagggtgcaaactgagaggaggaaaccaggacaacataactcatccttcccacctagaaatgtcacaatcacagcttcaaaggaaaacacaaacttcttccattaattaaacggatgaatcaagtttcagtttcctctctcctttctgtacaacttgtctttgaaggcatttcatttgggaaatgtgtgacctttagtcaccatgctcaattaattgaatgctttgcatcaaaagtcaccatgccgatccacattttacacccactgcttttctgaaatacttatcccagttccttaggtctgttttgttgaaatcattttacaaaaataaatcatatcaaagttttttttattatttctaaaactttgcttgcaaaactaaatatttttaacaccatggcaacatggtcaggactctggctaatgtatccagtctcgtaccagagctcagacttagtaaactactgctgtggacaaatgggctgtgaaggaggaaagagctaataaattagacatggtcaataatcattcaagtcatgtcttctggagcttcccaaaaggtgataaattagccagacctgtcctaatgatcaataccctgctctcccttctagaacacaccagcatccattgagtaaagtgcagactgcaaggcctctcaggaatttaagtactacctcacacctcctgaggtacttcctcaggcatcgcctcatctgaccctttcaatatccctttgtgttgggcagaatccagaagtatgatcggctccattttttttttcagttgagagtcacagaggctaagtgatgtggcaaagtgcatggtttatcatgtgataagaggcagaattaactttaaacttacatctcctaaatctcagttcagtactattttcaacacaccagcctctgtcattgaaacttaacaaattcacaaatgctttgtttcattgtgggattttttgtttttatgtatttgtcaaagttatacgtgcacgcagtttaaagaatcagtacattctatgcactttaagaacagcagtcccccatctccaccccaccatttcctcaattcttcctcctcagaggctacctcttttaccaattttatgtgattatttggtgcttagtagtatgtctctaacaagcttctattgttttttttttatttttctctttatcaactataaatgatgtagttctttccttcactcccgcctcttcacttccatcaccccaatatagcacacggtaccatgacttggttagactagcgtttggtgttgacattattatgactttgcaaaaacaactcgcagtcccagctgatatatggaaactctgattattccacatttcccgcacatttcctctttctctcacacttgctctcagaatttttttttctgatttagtttgttttctatgagcttaacgttaaatgaacctcacacttgttactagttgtataaaatctcttgtccaaacgttcagatatattagatgtattaattgtgtattccttaagaaccttctccatgatgcttttgacttaatcaaatctgaaatgttttctttcaatgtctggctgccatcctgggctttttctctgtgctggaggctccattcaccttccttctccactgaatttttatttcctgtgacctatgtcttcctctttaatgggacagcactttctttagtagcatcctgaagataactgtatgggagataagtattttgagaaattgcatgtctcaaaatgtttttaatctgtcctcatatttgactaatagtttggtggatataaggttctggactgggaataatttttcttcagaatcctgatgcatttgtagcttttagtaatgctactgaaaagtctgaagtcattctgtttcctgactgtgtgtgtaatccatccccacatcccacctactcctagaagggggtgagcttttctttttgtcctaagtattctgaaatgttctagtaatagtataaatctgttttacttcccccatattagtcaaatatcacatggtaagtggcagaattaactttaaacttttgtctcctaaatcctagttcagtgctattgtcaacaccccagcctatgccattgaaacttaactgccattcacaaagcttcatttcattgtggggttttttgtttttgcatattttttgtatattttgtatattaatcaaatacgggggagtaaaacagatttatactattattaaaacattaaaactttttaggccttttaaaattaggaactcatccaacatttttagacattttaaatgactgtattaatttatgtacaaatatgtatgactttctgcatgtttgtataaatatgcacaaacttgtggtacatgtaagtcttatagtaaaagttggattgcttctcacctcctatcactcctggattagaattcagctttcttgtttgattaattcatttatcatgtatacatctgtttttgagtttccaaaattttgtggttctctctatgctttaaaattgatgcttttaaagaattctactatcgttctagaaattttcaaaaggaactgaaattccatgagtgttcagtccttgatgagtgttcaatcaatgacgtttccaccaaagtcctccaaaaggtttccaaagtgacttttcccccttactagaaccatattgttgtttatgggccatgttttaattagtaattaaagaaaattttcaccctcatgacaagatctaatttttgtcttttttcctcttacaagaagcatttaaactctcatggagggaaagccacttgaagacaccaggtggcagaggtcattcgttttgcagggtcagggctggtcttgagcacaggaagcatagctcaccctcttatgtgacttgacaagttctggaaaattcccttaccttctcatctacatcaggagcccaatacatctaacttccacacatggaagagataacaaaaccttgcaggttgcccagggatggccctttagtcctctgctattagttcagttagccacatcagactagtatgctttcttttgggtcacgaaggaataaaacagaggctaggtcaatgtcagagagacagagagggagtcagagaaactgaaaaatattgacaggcaggaggtggaaggagagagactacaataggcagactggttgagtggttgtatgtagagacaagagaaagcctgaattcaatccaatttttatctgtagtccctttagaagatgagccacagaacgaagtggggcttattcttcaaactttatcattctggatcacattttttgtgcttttagggtgagcctgcaaactgtaaaggaacaaagtacggcacagataaacctgtttcaaatttcagctttgccagtagtagcaaagtaacttccacttccttactgtaacaacacaggtaataacacttactttgaaggagttttaagaaatagaaatgatgtaagcaaatttgctggtattaagtgctcattaaatggtaagtgttgtcattagtgatggtggaaatggacacacgccacacccttaaccacatttatagaccctttgtccactgtctacactggtagggaggagaattttattgctgccattgtttagaattgctagtgcataatgataataaaaaacgaactgacttctagttgactttattattgcttttagattctctacagacatgccagataaaaaacagtacaccaagttaaattagaatttcagataagaaaaaattttttagtgtaagtgtgtaccatgcaatatttgagatacacttacatttaaaaaaaaaccctgaaagaaaagtattgggcctcctgaattttatttaataaatttgacaaccctaagagtaaggaagaaccattttgcttcctaagataatatcaacaggaaacactttcttaaattctctttggggcccaatagcactgactgactcaggcaagggccacactttcatcggagtggacagatacattgattcctgacagaacaagagccagcatggctgtaagaagccagaatcaaagaggatggtgacgaggcaaacttgcattaaaagctgctgaagagcagggacagaggaaccgtttcccctcccacagtaacacaaagttgaatatccattagattagcaaccagttcttagcattcctccctcctactcatagtcaactcttgatcaactgcagtaataggaagagaaaaggacatcacacataaccccaaatgaaaatgaaaacaaaactgatcaagggtaagatcaggtccagtggtggctcatgcctgtaatcctggcactatgggaggccaaggccggaggatcgcttgagcccaggaaatttgagactagcctaggcaacacagtgagaccctgtctgtacaaaaaatacaatttacaaaattagctgggcgtggtggtatacatctgtagtcccagctgcttaggaggctgaggtaggaggattgctggagctcagaatattgaggtttcagtgagccatgattgtgctgttactctcaagcctgggcaatagagcaagaacctatctcaaaaaaaaaaaaaaaaaaaaaaaaaaaaaaaaagaatgagatcaagcggtaagtaatgacatgtggccttgtttctgctaagtcagacctgccctcccctacgttactagagatcctgactcctgcaggcaggacccagtaatatcatttcaccaacaaccgtgttgctagtacaatcaatatcctttcttcttaaagtaccttttacacaacttatgctctgtaaaaatattactaagtagacaatgaaagggaaaagaaagcaagccaatgtttcatgctttaagttaggaaatgctgttttaaacagcattaaacttttttttaactacagaacttcccagaggctttaataagctcatgtgctttgaatccctaggatatgattttcgtacagagcatgtccaggtttatttgatcatagactctttcagagaacaacagttccagttcacatttcaggtaatatttttaggtgctactatttgacgaatcctacatctatagtttcagcaatgctgcacgcgcatgtgtgtgtttgtgtatgtgtgtgtgtctgtctctggtattaactggtgcaatcagaaagaagagtccactccttggtgtattagtttctgattgctactataataaattagcacaaacttaggaggcttaaaacaccagaaatatatcaccttttagttctatatgttagaagtctgacatgggactcacaggctaaactcaaggtgctgacagggctgtactcccttttagaggctctagggagaatctgttccttgccttttccacttctagaggcttcccacattccttggctcacggcccacttcctccatcttcaaagccagcgacattacatctctctgatcattcttacgtcgttatatctccctctgatcatagccagggaaagtcctcagcgtttaaagactgactttaaagattcatgtgattagattaggcccacttggacggtccaggataatctccccatgtcaacatcagcaaagtccctttttgccatgtaaggcaacatgttcacagattctagggattagggtttggacatccttggggggcattattctgcctaccacatatgggtgggtaagaacaccctgagagttccagccagcaaggacaaagagggagaatgaaagtaactattgccattgtttgtgttttctcaattattgcttacaacttcacagtatcagggaaattgaaattattgtcttgttaagggatgtagaacaataaacaaaatatggaacatgttcccaagcaccaagaacttggttctctctttacaatgtagagaagcaagcacaagtgctctgtgaattagatactccacaaacatagccagctggcctctcagcaacaccggctgattatacaggctgtgcactttccagtgaaaggtacatgcccttaatcagctttattgaagctgccctcactaagaaactgtgcagacattatttcctatgatgcaggtcctataactgtcccattttacaggtgagaaagtgaatactttctacgattatgctacttgacaagctgttactttcactgaaccagtaaaacatacacatctgaactcaaagcctgatcttagtcctatgtaatgtgcctatttgtatgtctatttgacaatccatctacctggacttcttcccctttccaattccaacccaaagcaagttccttcctgtgactctatctgatctgacagtctacatgtgtggttttgggagtgtgtgcacacgtgtgcatgcttgtgtatatatgttcagtaactctaatttttttcttcatgaggcttcacattttgaatgccaaaactttctgtctgatctccaatcagatgtggtgacttctgggtcacaggcgtgatatgtattgaacacatgccttagaagtcgtatctagtttcaaaacttgactagatcatcacctctgaaacactggcaaattacttgagcaccacaaacttcagctttcttatcttgtgagaagtcaaaaatagtatctgcctcacaaggtcactgcagaattaaaagaggtgatatagataaagcacttgatagataataatgacacaataagttgcagttgatactattatcaattccatgctacgtttacctgcataaaaatgccattcaaagttcttgcctctctgaaagatgcttaatgacaacttctacttaaatcagtgacattagtatgaccaataaccataggttaattcacattaggttaaggtgtgttaatactatttttttttttttttaaaagactctgcctgcctggagatctagggcctgatacttcttgaaatttgctaatcacatctggtttagctttagacattttctgggattttgccagcagctacgacactttaatggctacaataaacctcaaagcctcatcaaatctttgctgtatgtgtgaaaattatgtcctcttcaattaaacattcaatctcagctcacaccaaggccttatggaaaaggaggtgaaacctgaatggaaacgttaagatgaaacggaccgccacgattctggccatcttgccagatggtatttagaagaaaaagaaattcattagagaacctacggtgtgtattttctttaaatatttactgggtacctttcatgtgttgaaaacactggcatctctaaagattagcagggcatttttgtttaaatattccatgtgtgtgaggtggggggagtcatttcctcatttgcctttgtggtacttcatgtgttttggtgaagcctggtacaaagaagaaaagtaactgagacaatgttcagttttctttcctaaggccgctctacctgcttcaaaagctcttgtattttcctaaaatcggctgaggaaagtgtcagttgagtactgagagatccggaacgacaattcagagcctccctagacaaaagaaggtgtaccaaagtgaggcgctatgggggaacccttgtctctctgctcgcctcccagttcactcctcttatcctcttgctatttatcatcaaacgtacagggacgtcaaagtgaggcagcccctggaaggagaagggaaaagatcaaacagggatcaggtttcggctcaaagactataggagaggtcaggccaagggtttcacaaggggccaagagacaagagggaatgggcattcaggaacagccgtggagcaaacaagctcccctgccattgctaactcttgctgccacactgaggaccagcctgggccctaattctaccagtggagagggacagacaaaaatgctagctggtagcttactacgctttattacaatattaatcaagctcctcaacttcaacaaggatacaaccgccaattcttcaggagacagaaaataacgaccgcaagttcacatatcgcatttctaaaggaagcatccatttgtttgaattcattcaaccacatcaatgggagaaaaaaaacccacgttcctttaaaaataatatacaagataaaaatattcacctgtaaccattatcctttccatgtaagttttatgcccaaagtaaaaataaatggctctctttgccaccgggagcagatctttcccactttacttccatttccaagctgttctcagcctcagacttaggtttctgagtactctttcacaataaacattttaaaaatgtttactttatgtcttggtcttaaaatattcctggttgaagcccttcatttcctcaagctctgcttctggcactctgggctccatttccacattaacacgctctctaaatcctccgcagagctcttcaattggagttatacaagctccaaggcaagtatttatattcttggacaaggagatgtctccacagtaaaaacacgagactctagaaatgccaaaggaaaattcctgcccaagtgagacatattttcaccttttaaaaaagccaaaaaggggctttcagcattttcttttgactaattaaaaatgtaaattaaactaaaatggaatgtttactgtgggccttaccatcattattagactcatatataaaccaaacatacaggaacatgtgtgtatgtgtacgatatgtatgatatacatatatatttaaagcagcagagtaaactagctaatgtgtaagttctagaaactagaaactagaaaatgtgagttctaattagacagacttgattagacttgattagagctcagtaaatctgtctattactggctgtgtgaacttaacttctctaagcctcatttttctcatctgtaaaatgggtttagtgtagttccagcttattaagattgttatatgagacaacagtaagcatctagtaaatggttactgctattatcattaataatgttataactactaaatgttagaaaatgtagatataacgagatatggatataagaaacaaatgatcaacactaataaaagagaagaatttgaaaatacagtgcctctacacactgtgtagagaaggaaagtttcctgaaagctgtagtgtaccattgctgaactctgcaccaatcccactctatgaaccagacctaaataatcctcttaaaacattttttaaaagtaatcttagctattatcataatagcagaacagttcctattaccttctagttgcctcttcagttttctcaaatcttttatgaggtcttcaaacttgacttgggaggccagaaagaaatcctgtggttccggcaaggggaaaacactcttttctgttccagcttcctaagagatatggtaaacaaaagtacattatacttcccaattgtcactttcagttgaaattccaaagcatcaatgagaaaaaaaaaagcttttttattggatgtctgagtaagaatcatagcaatgctcctctgctattcctaaatttggacttgtgactttgaagtgctttcttgtctttcacaatctctttttggacttattggcaatgaggtcggctatggcatgggccaggttctattttgcctcatgaatcaaagagaaaattgtcaggtcgtcctgatcttggacactccactcccatgaaaaatggaagaggggaacacatgaaagtacttacatttgaagtccccatttgatttacacatgctagcaattagacaagtcatctttggggcataccaatgggtgtgaatcagaaggtgctggataagaaggcactgcaatggaagatacaatcaccctcccatcacctttcctcacctttctctgtggcttaaagctcttctgtgtgcatgcatgatcagattctttgtatatgggtgtatctacacatatacacaggttttttttttttttttttggagatagggccttgctttgtcacccaggcttgagtgcactgacacaatcacggttcactgcagccttgaccttccaggtccaagcgatccttctagttcagcctattagctgggaccacaggtacgtgccaccatacccagctaatttttaattttttgtagagacgggggtctcaccatgttgcctaggctggtctctaactcctgggctcaagcgatcctccagccttggcttccccaaaattcttcatatatttgaaaagcttttgcaaatgttgtctggcttatcttaggagaccgagggcagggtgaagtatagttttaacaagctccactgctatagctaatggagaattctcagctgagaaacatcttgaaggacaaaagcttcaggcacatgagcctcaaatatcttttccagtctagctagctttctccctgagttgtttaacgtaagctttgtatcttgcatgtcttaggccgtcttcaattattcctctctctgcacaggctactttgccagctttccttcacattccatcttccctactgccattaggactaattccaaactctaaaactgctttacaaggcactttatgatctggcctctgtctacatctctggcctcatttttaccttccccctatctccaactccctctagaccttcatgaaataacagaccacaatctcttgcttctaggcctttgtctataaaatggtccctttccgacccttccctagtgcctccttacacttccttgttcatactcatcctttaagtcttaaaacaaacgtccttccttaaagatttcccctaacctccagcacgtgggtgtttctcccctgttctccaaaggcctatgacgcttacattatcacagcatttatcaccattaatttttttcccataagttattggggtagaggtggtatttggttacatgagtaagttctttagtggtgatttgtgaaattttggttcccctatcgcccaagaaatatacactgcaccctctttgtagtattttatccctcatccccctcccactcttatccccaagttcccacagtccattgtatcattcctatgcctttgcatcctcatagcttagctaccacatatcagtgagaacatacgatgtttggttttccattcctgagttactccacttagaataatattctccaatctcatccgggtcgccgaaaatgctgttaattcattcctttttatggctgagtagtattcgattgtatatatatatatcagtttctttaatcactctttgactgatgggcatttgggttggttccatgattttgcaattgtgaactgtgctgctataaacatgcacgtgcaagtatctttttcatataatgacttcttttcctctggatagatacccagtagtgggattgctagatcaaatgacagctctactttcagttctttaaggagtctccacactgttttccatactgactgtacaagtttacattcccacctgcagtgtagaactgttccctgatcatggcatccatgccaacatctgttttctgattttttgattatggccattcttgcaggaataaggcagtatcgcattgtggttttgatttgcatttccctgatcattagtgatgttgagcattttttcatgtttgttggccatttgtatatcttcttttgggaactgtccattcatgtacttcgccgactttttgatgagattgttcttttcttactgatttgagttcactgtagattctggatactagtcctttgtcagatgtatagattgtaaagattttcttctactcttaggttgccccttttgaggtaccaaagctctttggtttaactaagtcccaactacttatctttgtttttattgcatttgcttgtgggttcttggtcatgaaatccttgcctaagccaacatctagaagggtttttccaatgttatcttctagaatttttatagtttgaagtcttagatttaagtccttaatccattgagttgatttttgtgtaaggtgagagatgaggatccagtttcattctcctacatgtggctagccaattatcccagcaccatttgttgaaaagggtgtccttttcccactttatatttttgtttgctttgttgaagatcagttggctgtaagtatttgggtttatttctgggttttctgttctgttccattggtctatgtgcctatttttataccagtaccacgttgttttggtgactgactatggccttatagtatagtttgaaatcaggtagtgtgatgcctccaaatttctcttctgcttagtcttggctcccgccacgtgggttcttttatggttccgtatgagttttagagttctttttcttgagacggagtctcgctctgtcgcccaggctggagtgcagtgatgcgatgttggctcattgcaggctctacctcccgggttcacgccattctcctgcctcagcctcccaagcagctgggaccacaggcacccgccaccacgcccagctaatttatttttagtagagacggggtttcaccatgttagccaggatggtctcaatcgcctgacctcttgatctgcctcggcattccaactgggattacaggcgtgagccaccgtgtccagcctagagttgtttttttctaattctgttaagaatgatggtggtattttgatggagactgcactgaatttgtagattgctttgggcagtatggtcattttcacaatattaattctaccttttcacaatattgatactacccatccatgagcatgggataggtttccatttgtttgtgttgtctacggtttctttcagcaatattttgtagttttccttgtggaggtcttttgactccttaggtatattactatacacacatatatatatatgtatatatttgcagctattgtaaaagaggttgagttcttgatttgattctctgcttggtcactgtcggtgtacagaagagctactaatttgtgtacattaatcttgtatcctgaaactttgctaattattttatcagttataggcgctttctggaggagtctttagggttttcaaggtaaacaatcatatcatcagcaaacagtgacagtttgaactcctctttactgatttggatgcccttcctttctttctcttgtctgattgctctggctaggacttccagtactatgttgaagaggagtggcgagagtgggcatccttgtcttgttccagttctcagagggaatgccttcaacttttccccattcaatattatgttggctgggggtttgtcatagatggcttttattacattgagatatgtcccctgtatgcaaattttgctgagagttttaatcataaaggaatgctggattttgttgaattctttttctgcatctattgatatgatcatgtgatttctgttcttaattctgtttatgtggtgttatcacatttattaacttgcgtatgttaaaaccatccctgcatccctggtatgaaacccacttgatcctggtggattatctttttgatatgttgttggatgcagttagctagtattttgttaaggattttaccatctatgttcaacaaggatatcggtctgtagttttcgtttttggttatgtcctttcctgattttggtattagggtgacgcttgcttcataaaataaattagggaggcttccctctttctctatcttgtggaatagtgtcaaaaggattgttatcaattctcctttgaatgtctggtagaattctgctgtaaatccatctggtcctggacctttttttttgttggtaattttaaaattatcatttaattcttgctgcttgttactggtctgttcacggtatctaattcttcctgatttaagctaggaggattgtatttttccagcaatttatccatctcttctaggttttctagtttatgtatcaccattaatttttaaattgccatgttatcttgtacatcttccccactagactctaaacacctcagaggcagaaactgtgtcttgttcttggtatggtaaacaacatctggcatatcaataagctttatttttggttgatgggcactactacagagggcttgtaaaacatggttctgagatgtatgtacctttagcaggagacatctaatttatcactatgttttcttgtagtttcaggaatcctcttgacccttcctctttaaggccattagctttgttagggatactaggatacagtagttttcttcattttatcagacacaatgtacttttttcccccatcttcatatacttattttactactttaaaatggaagcagtactctcatctgagtgccaagatggaacaacatctaagatcctcactacaaagctccatgctaatctatgctggaagaactcaggcatagtatctctttccattttccaaaactttatcagattcagtcctggttttgattgcgtgtgtgtgtgtgcgcgctcgtgcgcgcgctagaaaaaaggaaatgttgctgagtgtatcaggctggtagcagctcttatgaaagctgcttaattagagttaaaaaggcatgactctacatgggtttctttaaatttcacagaccaagacttggaccaaaaaccaggcatgagaataaggaagcagggagcaggagtcatctttctttagctaattgctcatcaccactaaccaaaaaagtcatcacttaggctcctagaggaaagggccagtttcataaatcacataattctaccctcttgttgagtgaaatgcattttgcacagtaaaagccagaagagcaccacactactgtgggcttatttttcctagactgggccatcccatgtttgaaactgttctcattgtaagattttcctctgtgaagttgattccactgggttcagctcttttcaaccacaactatattccacaggcatatttcagccttcccacacaatgcatttgacttggttggggtaggtactaccaataaatctgcccatgccaacctagggttagaaatgtcaccctcaaagattcttcaggataattcttctgccacactagtacctgctgtcaaaacctagggtatgtgcttatgtgcccgctgctgcttcttaatttcctgaagctaaacatgccttcctcactccaccagaaaacagctctcatctcctcatatctagttctttacagatgccacttattacacgtttgtgaatattaacattatatccagttcagcaagttttatcagacacctgtattacaggcagtaaaaaagagacaatggccaggtatggtggctcatgcctgtaatctcagcactttgggaggccaaggcgggtggatcacttgaggtcaggagttcgagaccagcctggccaacatagtgaaaccccgtttctgctaaaaatacaaaaaaaattaggtgtggtggtgcacacctgtagtcccagctacttggaaggctgaggcacgagaattgcttgaacctgggtggcggaggttgcagtgagccaagattgcaccactgcactgcagcctgggtgacagagcgagactccatctcaattaaaaaaaaaaaaaaagagagacaacaatgaattctgaacctcaaaaaccaatgccaagataataggtaattcctcatatatacatacaaggcagaataagatgcatcttgagaaagattcaaacaaagtacttctcaggcttcaaagccttccttcaaagatcaggatgttaataacgacctcaaaaaagggccatgtaagattagactaagttatttttcactacatcttttttcctgtttacaaaagtgatacatgttcattatgtttagtaatggaaagagagaagacagttaaaaaaaaaaaaacgcttacaatcctaatattcagaaacattttaatgtatttttttcaggttattctgtgtatttatatttatctactacatatttggtattatactatatgttattttgaaacactgcttgtaaattaaaagcagatcaaaattattttctaataccactatattctctcctatacactctccataagagtatattattccagtgtgtgactctagtataatttatttgaccttggtctccatcattgtacacctaccaaaatttttccaatattttgctatcataagctattataagtaaatagtcattaaatccttagttgttttcttagggtagaaatttcttaaaaggttacacgtatttctagggctgttgatacagaaaggttgaaaaccttgcttatgatcctgagattcatgagtgtgatggattgggtgttcgtatgcatgtgtgagatgcgccaccattgaaccttgttaagatatggacacattacctgtctgacatgaagaaaaaaggaaaaaatgaaaaaatgtgggaaaaaagggaaacaaaaagaggaaggaaaaaaaaaaacaaaaacacaaccttgcttgcccataaagcatacatgtataaattaggaaaatgtgttcctgtaggtaggaacagctttatgggcaaacagcttgacaagcacatggcatctttatgtgaattttttaaagtgtgccctttataggatgtataatttggtgaatcaacggcaggctaaatatgagtcccatttgacttagagaccttaaacagagaatatattgatttaccatacatgacagtcctgagaaaggtttgatcaatttacagtgctaattctatatatctagttggcaatttatgtcttctatatgtcttttgtaaattgcctgtgatatattttgccattttttaaaaataaggaagaaagttttttttcttgttaattctcgagttcattgtctattatgttgtaaacattttaccagtacattattttgaatttagttttaagtcatttttgagatactacagtattttaaaattttaattaggaattgaagttttttagttttatgcattgaaagtcatcattctcaccttttatggtttgtgtcttagactgaacacttcgaaaggattttgctacttcaaaatcagtaaactatttacctacacttttgtcatgtcttattgattttatttttcatttatttctacatttatctcttctgttctttaaaactttgctctggtctctggtatgagatctaggagataattcaatttcttcctcttaccaattacttgaaatttctcttttatcacatacttgacacatatttatttagatccatttctgagatttccttttcatgttcttaagttttgtgatgttagtctatcattctacacttttaattattatagctctataatatattagaatatataaatgaatgattctctcttcatttttaaatcctggtcaaatttttgtctaattatttttatacataatatttaaaattattttgtaaacttctaagattgattagaattttgactggtacttccaacagaggacataatgccactccttactgtggtaaaaaacaaacaaaaaaaaccccctataacatgatatctgttctcttaaatttttaagtgtacagtatagtattgttagccatgtgtattattgtacagatctctagaacttcttcatcttacgtgactgaaacgccgtatcctcaattctccatttccccattcccgcatcattcattctactttctgttcctttcagtttgactactttagatacttatttaagtggaatcatgcagtatttgcccttctgtgactggattatattgacttagcataataccttcaaggctgaccccatgttgcagcatacgacagaatttatttcttctttatggttgaataatattccctagtacatatacgcattttctttacctattcatctattgacagacatttagatttgtttccaaatcttagcgattgtgaacaatgtttcaatgaatatgagagggaaaatgtctctttgagatcctggtttcaattcttttggataaatacccagaagtgagattgtctgatcatatggtagttctatttttaattttttgaagaaactccctactgttttccatagcagctccaccattttatattcccactgatggtgctaactggttccattttttctacatccttgtcaacacttgctattttccatgtggtagggttttggttttagtttttattaacagccatcctaaaaggcatgatgggctatctcactgtggttttgatttgcatttccctggatgattagtgatgttggcacctgttggctatttgtttgtcttatttggagaaatgtctattcaagcccattacccaatttttaaaattgggtttttcttttcttcagtctgtttttaaatttttatggctttcagtaaaattacgtgaatgtattcacaaaggtctgtacttgtctggttaagtctgtaacacatatattggtaatgttactgggagactttttcccaaaaaatctttaaatttattatttccagagaggagtaatgagaaaaaaaggaagttttataaaaaggctagagacaaagatactttcagtgagggagaacatcagaagtaaaaacacattagtaagaaagcacagggtgtgtgtggaaaacatcaggtcttgagttggatcacagaatacgtgtagagggaaagtaataaaagcaaggttgtaaaagattggaattaaattcgtagagtcctaattcacttgaaaatggggagccacttctgttttgagtagaaaagcaataggatcagagctgtgtaaagagggtgtgggatggcttagagtggtagaacctcgaaatagagagctgagctggaaagcaagtgaaattctccaagtgagtggtcttaaaacctgggtaagctggggtcggcaggaaaacaaaacaaaaaacaaaacagggaaggacatcagaaacaactcagtggaaggacagagagtagccagagaaggacaaggtttcatgccttaatagccaaaaactatcaaaaactacgatattcttaacagaaatcagggaaaagtttggggggcggggaaacgatgagcctggctgtaggtatattgaaaatagttagataagcccaccaggagggtagaagaaagtattatggagttcatcagtgcctcacttgtcttctggatgaaactgcaggcctattgaaaggccctgagatctctactattcttccctcgatgcttaggaacaattatgcttacatggatggttaagcagaagtcctgacagcatttactttgagacttttactattcatatcgattgctatatttcttaacatcttacaacaatacctttttcttctcaaaattacaactccttgttctcaatttaacaagaaggaataaaatagaaaattctgctcagatggactcacacagaaatgtttatttctaattgcaaatgccctctaagcagaaaagatggatttttcaaattctacatcttcagtctgttcatagattcattactgataaaatattgggtattactgagtcttactttcctaaattttgctttgcatcatcagaatacagtttcaattataaccaattactgagcggatctagatttcacagagaacctcacaatctggccataaagcactgaggcagctaggggtctctctgaagctgtgttatagtcgattgagactcagtagatttacaccactgaataatgcttctcttcataagtcaactaaactctcttggtttcagtgtgctcatctgtaaaccacgctggagagctctcatattctatgttgggcttgcagttcgttcatccatctatccatcatccaacttatgaatgtcaacaatgagtaagaggtgaaacttttccacgtaataccatttcttacctgatcatagtaacgcaggtaatacttaacaacgtagtccaccagattaatcccattatcctaggtttaaaagagaaatgtacatgaaaatcattcccatgagactgtcatgttacacggttgagaggtgaaatctcagttgagaaatttctaattcgtgaaaactggctttctcttcgatgctggcaaggttttccttcctctgctttatcccatccatttattatgctggctacataaagaaatgacactgtactatcctttgtggggaaaaacaaacagataatccataaaacttctgaaataatggctaaaacaaacaaaaaagttgtgtccttgtattttctggcacacagccaagacaggaggtgcggggaatgctaaagggaaccagggcctagaacagaaaagcaccctccctgcccgtctttcaaaaaatgtgcgttcttaatggtgtgaaaaacaatccaggccagcttaaaaggagcaccacaccactttatgaccccgggaggccagtggggagcaggccctcccacaaggcagcctttgtgtcctgctcactggggcctaattctaatttgcctgtgtgtttcccctccctgcacccccctgccccccatgggacgcctagctatgggctgattgtttctaaagaggtagcgccacaggggtgtggagccaagtgataatcaggctcagagagcttgacagtagaccccagcccaattgttgtggcaaaaaattggtgattcaacattgctctgccattcaggaatgagtaaactactagtagccaacactaaactcaaacagcctccagcctttgcaggatcctggtactgtatgctatctgttttgttctctcactgagtagcagttcaatacctgattgtgtatgtcagagcacacgaagatgggaattgagtaattgaaaataaagtctaacgtgaaaaaaaaaaaccaaacaaaactctttattcgaaagtgaaaagaaagcaaacaaaaaaatgcatgctctaatataaatgttgttaaggggaggatagagataaatggaacaatctggaatacgttttttaaaattaaaggtaaagaaagaaaataatggcagatcatgggaacttattatgaaaaataaatacccgacttttgacatccttgagtttgggcagaatttctaagctatatccatcggcttgtccccgagtcctatttcctccattcatataatttccaaaagccaagatgagagctaaaatatccttcacgctcttcacgtgcagcaagtcctgtgatggcaaacaccagttattacggagctgaactccaaatgcacccatgttcattcagtaacaaatatcgactgtgtactcaataggctgtcgggaggcttggtaccaacagaattaacagttgctgaaatgaaaaacacactttactaagccatgagtgtctttacaaacacattaacagccattattttctacccactcaaattaattataaacagtgcatgttttaatacatgaggattaactattggttttatattttcatttgagccagtttaatttttaatacttattttaaagtagaagttgtaaaaagggagttggtatatatagtaaggcttaacctttgatgacttctaggtagaaaggggtttaccttttgaggatgtatttcaggactatttatctagataaccaatacagttaaatgcagagcagatacagaagaagtatgttcttctttatccccggatataattttcagagctaaactacaataatgcattttaaggctgtaggccatctttaataaatttattaaacttactttattaagtgcttgttgtattgtctattaacttttacaatttcaagctgcttaggattttctttgtctccctgtctcatttgtttgtccttttatttattttttacttcaagtacaattttccaattgaaattttttttctttatggtcttaattcacattttatccccctttatttcagggtaaaaaaagtaatggctgggcacggtggctcacgcctgtaatcccagcacgttgggaggccgaggcaggtggattgcctgaggtctggagttcaagaccagcctggccaacatggtaaaaccccatctctactaaaaatacaaaaactagctgggcgtgatggcaggcacctgtaatcccagctacctgggaggctgaggcaggagaatcgcttgagcccttgaggcagaggttgcaatgagccgagatcacgctactgcactccagcctgggcaagaagaatgagactccgtctcaaaaaaaaagaaagaaagaaagaaagaaaaaaaattcagctccaggcagacttctttttctgctcctgcctttcaggtattattagtgcgtgtataattatatttcagtaatatttattctctactgaaatatctcatatcttagaggaaaaaaaatcatttctccaaataaggaacaaagtactacagtatttgtggagaagaataacgtgtccttaagagcatgggtcaactgtgagaaaaaggcaggtgctagaatttaaccttataatgaacaccagtgtagtaaagccaacaaatatttctttgccaatgactcactgtcagtcatttatttcacttatcaagtctctaggatcctcttattaggttgacacatttcagatgatcaaatgtatggatctcaagcaaaatctcttctgcaatccaaattgtaaaataagaaacagaccatgctatttagattggtttttagtggccagtatgtactttggaagatactcagaattttttagaaggaatctgtaaaagtgtcatttttttccctccttctccctcttcatccatctgcatctccttttctctccctctctctcatacacacacacacgggcaagataatcatcaaatttacacttagaaaaacatacaatctgagtccaaaaaggtttctataatggcattaaagtggtctctcccactttcttctttactcttcagagcaaggctatcttttaaattagacagtaaacataccttagaagctcgcgtgatgatctctacctttctgtgcaaggaggtgataccctcagaaaagacagatctgaagattatgcactgggcacgttcagcaaaattaggaatctgggctaactcatgtaaaaatctgtaaaaaagaaaatgtgtcatctaccttcacatataatcacaaggaaaataaaaagacagctgaaaaagacccactttgggaacattccttacctaacaatctcaacaattataaaaggtgtcacataggtagactcaaggaattccaagggcatggtttccattgttgacaacagggctgttttttaaaggagttctagcatgatgaataaatgcatggtatagaaattccttcgggaacagaaagttaacacaagtatactaaacaagttatctatctcctgctgcccaaacaagagactaaacccaaatggaaagccccagtctttaacacacgagaaaaattatgcaataaactccctcataatgcagcattctctaaaggtgtatttatacaggctaagcaaactgaagacttgaggcaaatgtctacagacaagtgatttaaaaaaaaatctcttactaaagtgatattgctactatttttgctcagtgagttacataatggtctataatgatcacattctccagatatttgtttactttttcacattaacttacacacatagacatagtttacaactcagtatttagaacaaagcaggcactcattaagtagacaacctaaagtttccttaaaaatgtggcaagacagatcttaaaagctaaaggtgagtactgacctacacacagtagctcactgtctgagtggttgggcacttgttccctttgcaaaactaagttggaaagagcgacatactctccaggccaaccaccagaggaaggggtataaatgaaaatgggtggaaacagttggacatgaattcagaaaaggagaaaatctactaacagccatttatttcattttggtgttgagatgatgattaactgatatttctgaaagtcttggtcaactcataacgtcattaccaaggaattttgccatctctcaccaaaaatggttttacataggaacaaagctgaagcctacttctttctataccgaaagatattttctttgcttatacaccctgtgctgcctctacctttagggagatttgggttttaattaatttctaacatcaattgatttcgtatttattccacgactaggtcataatccacaatctttttttagatgacatttaatgaaagcaaggaatatccataagagaaaacacaatcttgttttaaagttcaataacccattattatgaaaattatctgatgaagtataaaagtagaaattcataggaattctgcattaggacaagatgaaaaagttaaactctgtgtaaattacttcttaatgaatattaaacaatttattcatttatcatgactgaaatcaggggtatcatcagtctttataaatacataagaagcaaaaagctcacaagactgacagcatttgatcctgtaatgagtctggggaagacgtatttattcagatgctgagctattctgaaagaagggccctgcatttctccccttctaaatgtgacccatgaggcgtcattcaggacccaagttcccagagcatgtacacttcctatcacagtgagcgaagcagttacagacaccacctgggaaaatatacagatcaatgcctcggctcaccaaaaaggacttagatgaaaagcagaaaatgctgaatgaatagttacctataactaatctcaaaagaggaagcataggaccaatatgaggcgacaagaccatagtcttatcaatgtatgttacgcaagaaagggtaggatagaattgcaaggctctctaggattaaagcctttctggggttagggcttgcactggaaaagctcttaaagaatcttaaatgttccaatgtcctctttaagcagaagggtctgcaacccatacgaagagttggaggggggagaaaagatcataattttacattacttttggaaagacttgaaaattcatactagaagatcagtcaccaagaatgtcagtctgtcctttaggaatgtatgaggcatttacagtgtgtcagggaccatgcgaagatctgagaacagagcttaatctacagtcccatcttgataatctgagaagtaaaccaacaattactgtggagtgtgaatgagtgctctcggtgatggatccagaagaggagctaggaaagcaaatgcaggacactcaagtgtcatggggggaacattgtcagctagggtccccggagccctgtgatgctcacgcacaacatgtgagaaactgccgggagagcccagataggctgaatggtatctgtgggggaagtgagtagaaggcagatgctaaaattgtgttctgtattctaaaatacagggtttaaacttctgaacgaatgaagggttctaaacaggaaggtgacagtttctgctttttgttgtagaaaatctccatggcagcagctcagctgattggatgggagaggaaatttgaggctgggagacctcctagaccacagctgtaatcttccaagaggaaaggtaagaggggcttgcagtgtgaatggagaggggcaaatggatgaggaagctgctaaggtaacaagacccagagcaacctactcctaagagatgttgtgaagagtccaggatgactttgcagttttggcgtggatattgggtatagcgaaaatacaaaataataaagaagcaaatttggaggaaaaaaatagagttttatgacccttgccatccaaaaacagccatgcaaggagcaccatagctcctctcttatttatctgctaagctaccagaggtatgggttactttgaaggctgtgaagcaagcatctgacaaatagcttctcttcccctgccctgccccattactgttttatcctctacccacaagagcaaacacagtaactctcttaaatattcccaagcatgggatcttggacactgggccttggtacttctgaatatttatggattgagttccttttgggctagtctaactttacattctaggttcagtaagaaagaagactaaatattcccaaaagaagccacaaatgagggatccttcccttctttctccaatgtaggctaatacttctaggaaggactgcaacttcagcttctaatatatgaaagacgttctgtgtctcacattatttgggttacacatctacagcagcaactcagctgacgggtggaatgaagcaatgtggctcatgtttttaagagactaacatttgatttattatccctaaatttctgaatggtatcacctaaggtgtatgtgcacataggcgatacacatagcataactgaatgttgcaacctgcattcttcgatggaggattacactaacagagtctactgtgtgggggccccaaggcagctgtggaccttcatgaaaatcacaatagactgtgtatagtgttctcaccctaggccatgagaagtgtgtaccaggcctaatcaaacccagtagagcctcacctcacaaccattacccggcagcataagagtcaacggccatccctagagggagtggttctcagacagcctggtcccaaacagatgacacctctgtgggcaatggctttctaaatctggcactggagtgtaagagagttgatgaggtgagtgatgaggccagcctctccatgctctgatttataggactgggcaccacagggctcttaggaaactgcaacgttaaaactataaatgattcatattttccagtatgtaaaacatgcttatagtcgactcacttggagttaatggcaaataagttgccagagaatcagagtggcataaatcaaacaaatgctggtttgtgcaggaggttggtagcaaaggtgaaatgcacccaggtctgaaggcccccatctatccgtgcctcaccctcccgcaactgagcccaggcaagtcacctcaccagcacagcatgacagtcctttttgctgggtttgcgtgttcacgaagccattacaatgaccatttataaacattaaaaatgcttttctatctagatcatcagtagagaaaacaagagtaagttgtgtgttaattacctgctaccattatctaagtcccggcaattagaacaataattaggacagtagcagaaacgcatgatctctccctgcctgttcatttcaccggatcagccattcccatagcttagaacaagggctgctcggtggttaaggggttggcaaattgcagcccacaggccaaaaccaggccaccacttgtttttgtatggcccatgaattaaaagaacgatgtttacgtttctaaattgttgaaaaaagagtcaacagaaggacaacattttatgacatgtaaaaatgacatgaaattcaaatttcagtgttcataagtaaaatgtcattggggcacagcgatacccatttgtttatatactgcctgtggttgctttggcacagcaatggctgacttgaatatttgtaacatcccgtaagccacaaagcctaaaagacttactatctagtcctttacaggaaaggtttgccaactccaggcttagaggagaatattactgtgtaacttggtataaccagcactacccaagtgctttgatatgcccactgtgccccaatacaaccaaatggccttttcagtgttgaaacagcccattattaatcactttactttcagtcattagcaccgtaagagggattcatttgttataataggaaatatgacttggaaataaactataggatcagttgagggtagggattggtaaggaaggtgtctcaagtcagtggaacaagacagcaagggaacctcacttgacttgattcacaatattcctaggctttagaaacctactttgaggggggatcctggaccatgctccatgtgagagcaagtcatccaaggttcccagaaccatcatgtaggtttgtcgtcaactgagtaaacccagaattctcttcccaactcccatcctcagccatttaagatgttttcctgagtctaaatgtccaggcatccatggggactgaggtattctagagcagctgtgcccaacctttttagcacagggaccggtttcgaggaagacaatttttccacaggccaggggttggggttggaggtgggatggtttcaagatgattcaagcacattacatttattgtgcactttatttccattattattacattgtaacatacaatgatataattatacaactcaccataatctaggattagtgggagccctgatggtccctctagcttcctgcaactagatggtcccatctgggggtgatgggagacagtgacagataatcattagattctcataaggagcgtgcaacctggatcgctcacatgcgcagttcacaatagggtttgtgctcctatgagaatctgatgctgctgctgatctgacaggaggcggagctcaggtggtaatgccggcttgtctctcactcacctcctgctgtgtggcctggttcctaacaggccatgggctggtaccagtctgtggcccaggggttggggacccgtttctagaggacccaagggacaaggcatggaactccagtgcaagccggagaaccttggaagtttctagggctgactggtaaccctgatctgatagctccatttctgcttcattttctacacttgcctcatctctagattgagagggttggcctgaactggacaaaaaaaattcaaggtagcaacaggcaaaagaggccctctgaacctgtgtcagaggacacaggtcctctgaacccattttacagtctcacagagtcctaagccctggaaagctgggcagggtcgtggggctgcagagccccgggagcttatctatggcttcgagaccccaagagtcactcagttacaccccggagttctgggtcttcaaagcctatggaacggcatcacaaacaacagagcaagcagccatagatagtgactggagagaaaaacaagcatgtacagagtgagggtgagaaaaagccacatttgggcagagcaggtggagaagtttggggaaaagctagcacattcaggctgcacttactggatatgacctttaggaaaataaacttgaattctgtgactctgatatcatctttttaacttcatcaagagaaccttaaacagaacaatgccttcttccttcctcagttacccttttggtcaaattgtttagtctaggaggaattaacaagttgctagaaaaagaaaggggagtctcttggggtgggggaggggggtgagacacactgtatccaacagcacaaatctcagcgctgcttttcccggcagcagggtcatcctgctgcatgcaacaggtcacaggaatgacggtgttgtgatttagctggctgcacatttagatttggttattctgagctgggagacaagaagacagaaattgcagttctccttttggcctaacagaaaaatgttaagtatccttactgctcaggtttatccagcagcttcagttcttcttctttggatgtctcgtaatactttcttattttaaccagctcatcctcttgggctctctgtatcaaaatagaaaacaaaaccaaaaaaaaaaaaaaaaaaaagggaagtgagactctggctatggcagtgggtctcaaagtctcgaagtgtggttcctagactagcagcatcaacaacatcacctgtcacttgtcagaaatgcaaattattggcccaccctagacacaagaacttggggtgtgggtgggggtggggggatgcaagcccactgggtgattctgatgcatgctcaagtttgagattcaatgcaaatggacctaacaagtacacgcagctggacacagaagtacagctatttgagctctacttttgaatcccccatctcttcctctgtaaggaggctgggggaatattgttcttagaatttgtttccttactcttagaacagccctaaattatatgaactcgcagctctttcatttctagtcaacaacgtccctttttccaaatttcgtaagcactcattgtctgtaccacttattttggcattgagtcacttactttctcaatttatccaactatttcagttgaatgaagcttatctctactgtgagctaacaagcggcaaccatgtgcttagtcctgagctcatggtaacaacacaaagcatctggaaggtactgcctttgacaaagttctttaacatgaaccactgtatcctcattttacagattattccactgaggcttgtactaagcaactgttaaagagcttcagacttggaactccctctttctgcctctataccttgctgacctccaagtattcaagtgcataattagctcccaatggcctggtatttgtgtactttctggtttattaacgaaagctttactagtggaaacgtgagaagttccgacccacttgtactaagtagctcctgatacatataaagatgtgaaaatgagcaaggaattggtgatgccaccaagcctagactattagactatggaaatcttctgtaagaaacttaaggtcccaggggacataaatatgaaacgaatcatcttttgaactggtgaccacagtacactatagagccctagacagcttcctgggaaataccattacttaagagaatgtggttcaatctatgtttttgtagcctaacagtcagtgaaccaaaacaatgaacaatcatgggaattctgactctcctgtgttgtcttctcaagagagcctgacaattctgctggttatgtccacttaaaacccaaatcaaaaaccttatatgtgtacagtcctgttgactttcaaaatacattgctactgctacatatattaaatcctcatttgactaaaaaaaaaaaatcagagcctactataatccccgctatactgatgatcacaacgggattaagaagtttaagtaactagcccaaggtcacttagcaggcaatggtagacacagctggacctcaaacctaagactgtctcattctaaatccaaaacacatacctaccattctacacaccttcccacattcaatatcatcaactcatttggactaagagtaatcatccaagctggtattagcagtcccattcttcagaagtagacaccagtgcacgctatcatttcagtaggcagcttaccttcattcacttggccagcaagtgacaggactgggttccagggcacgtaaatggtgtccacctgagatgccctgccttgcaagtgtgcaatgagatctgctagcccagataccacagtgggagtcaggaatctagtgcttctcacatccactcccattcaagcttgtgtttctatgccttaatctcttccaggccacgtcaaaacccttactaccaaagaacatgaacagctcagtcatttctcaggtagaagataaatatggaaatactagctctgtaagtctttgacactcacgttttcatataaggctgccagggtctccagatcaaccacggagtcatccacattgaaaatggctgccaagcacccaaaaagaaaagaggataagggatttgattaggtcccctgcaccaatgtttactccacatccagcttccaagcaattaacagagtattgcgttttcttacacaagctgtgcctctctgctccccttcctttcgcaccaggggtctcaaatgaaagaaaccaaaatggttcctatcattggcctgagccttggctctgccttgtttaattcctcaggctctgagtcctttctgcagtttaatttaggctccacaggagaagtgtttgtgctttaaaactaaatcagtttgtaggtttgaagcacaattttaaatctttcttcccgatggtaattgaagagatttagtacctaatgcaccagaactgactcttgcccattaccagaaagaaagagagaaaaaagacaatgttggcaaattaaatgaattcaggcatgtgatttcaggcacctttccgtggccactgccaacatcttgtttggattaaaaagacaagaaaaaacaataattgcatcaatagcaaattaagattatggaaacctcccatgagccagtcttcaggcaggctctcattcccatggctttattaggattctacttgttctgtattatttaagattaatttagccgttaactaatatgcttatgatttcatctagagaggtaccttcccatagatactgggatgcaaaaattgagacttaaaatccttaatggatttggctatcgaagtgtttgaaataagcaggtccacatctttaaataattattcaaaactaataaggtttgttccctcaaccctacctcccttccctgactttacattgtgaaattaaccagcacgctagtaaattttctccgtggcaggctaattaattttattaaaccaaccagtgatacttagaatgccttaaaattttgctcgtcaactatttattctgttcatttgcattacaccatggtttttgggaaggtggggaccaaggtaaggggcaggttgtttttgaggtattttgcttcttctgtggtttagaatcacatgaaccctttcatacaattttaacaaagctaaaattaactgagctaagatcatggaacctcacagaacagcaagaaatgtacttaaaattcctttgcaggccaccttctcaaacttaggggttaatcagcaagctattcctagatacatggaacagagagaaaagaggaggttaatatgctagagtcaaagtaagtcacctcagattccaccaagacaaaggaacatcacacatccacaaaggccaatgtgaaaccagtaaagaaaaatgcagtttaaggacagaaagaaaggatttgtcctctcaagactgttattttgtgtgtggagatcacataaatccactaatttgtcagacacaacaggcatttttaaatgtctagtgcgttgaaaaccaaaatagccagaaacaatgtctattttatgtaaatctcagtattctctcacaaaaatcaaccaacatgagcgcataagaaaaggtcaaattctaaacaataatctaccaaaaatgtttacatgttaactaatcatgcatcctgggtaactatatattacaagcttagatataatcaaataatcttaactaatgagaaagagaatgacctgtgagtttcttttcctagtaagtaaatactcagtttttaaaagttaatcagtctggggcccaggcacacagttcctcagatggtattgtcagctgtgccccttccagtgtgttcagtagcagaaaaataacacccagagaggttgggactgagaacaaccatgggctctgaagacatggattcattcattcctccatccagcccttgaataagtatttgttggatgtgtacaggatctgttctaaatactgtggatttttaagttagaagtgcaaagtacttaattaatctcatgaaatttatatcccagtctggggacagaaaataaacaagtaaatacataatttcagataacaatttactatgaagaaagtaaaacagagaaatgtacaacattagacagaaggctcaaggaaggcttctttgggaggtgacatttaagagaagacctgcagagatcagttttgtggctatcttggagaataacgtcccagggagaggtaactgcaaagacaagtttctttttctgaaggaacacattcaaggtatagaaaaaaaaaaatcaaggtgactatcatggacagagcaaaatttactcattgtgtgatcctgacatgttaaattttctgagcttcagcatatctataaaacagctctaataccacttagtgaaaatattaagtgaggtaagatatatgcttagcatagcacgtagaacatggtataagcccaaaatggtatatatgagctattactatcatgatttcaaatatatacattgtaaatgtgttttaatgcttgttaatgccttatcccctttaacatctggaaagagttagagaaagaaaactacaactactgagtgatttgtgctgtaaatgcaaccttcccgaattcttaggtgtttctgatcgcggttactaggaaacccttccagtcctttaaaaccccactcaagacccaacttcagaaagcattattaacaggaaaggtctatgacacagaactctaattacaaaaaataatggatcaagtgtcttaagggaaatgccaggtacctccaagtctgtattatcatatttttatctataatttcaatatttctcatcaatccatccttcattgtaccaaggttactttttaaaaacatggatttcaaaattttactgtgatgcttaacatacctccaatatcttcctttaaacactcggcgaagtctaaactccttggcctggttgttaagctcattccctgcctcgcctcaattacacttccaaactcatctcctaccatgttctccatgcaccatgggttccagtcaccctgtgtccttccccattcctgaacatgccatggcttcctccctttcttcatctctccatggcacagaggtcaaagccctggaaggacatcctttgaccctcacatcattaagtcctcaatcttttcctctgccatggtacctctctcatattttacataaggtgaagatggtatactttaagaatctgtggtatgttgcataactgtttccttctcccagtagactgtgaaagccttgcagtcagcagttgatttcttaagcatcttgataactgtctcccagcatggtaccaggggtgtagcatgtataacatagatgtttgtgggtataattataccatacgactcctgaagactgagtcctgctgatgggaggaaaagcttcttgacaaagagaacatagggtcttaaaaagaaaccagagagcctctaaaggggcacagccttataaggcatgtatctgaatcatggttgtttgcttcttcccaatttgaccctgtccaaaaatcaaggtttggccagcagttacataattgtgcccccaactcacacactcggtgtagattataccgcttgcctgaatactccctaacaaaaataattaacttcaaagatgagttttctcattattagggaatgaataaggaaaatatctttccttattcaaaaaagttttaaatagctgtatctccttaggaaaaatgttgagtaaaagttcaactattatattgctttaggcagacactgaaaacactaatctattaatcaccaataattaagctaaattcatccatgcaatgacaatttgtaagtatgcaatacgtgccagtgaacgtaaactggaaggatacaaaacattccagctagaagcagcagataataggctcacaaaatgtttaggcaatggcaggtagttcaattttggtttgaagagagacttaattaaagggactagaaagatacactccaaacatagtttggggtaaaaccttgtagaattttgaatgccacgatgaacctgtaatacacttgttatacaggagagagctgttgagcagttatgaatggaggagtaaattggacaaaattatattacacacacaaaaagtcaaaatttgaaaagactaatttagaatctattgtaatgggcaagaggtagcaaaaacttgaatagtgtggacagaaaggatagggcaaaaaagaaagacactacagagcactattatagtgacattgctaactagctctggggacttagcctgaaaccactctgaggctttgagcctaggtttaggggaagagctttgtaccatccccccagaaacaggcagaggagtctaagaggtgagcatgactactgatctgtcccccagggactgggaaaggaatggagtagagaggaaaggacaggtaaaagaagtagataaacagatgaacttagggccaatgccaagtattccactgaagtttctcctcttccacggaaggatcttaaaaataaaatctaaaaagtaaaagaaaattcagaggtagcagaagcaatatcaagagattgatactgagcctagaacttatggagattaaattagttgtattatttctaataatattggcctgggaaggttagggtatcagccagaagtctgaaaaataaaaaggcctaccaagtcctaggatgcctaagagaactgccttacatgtacataatcccatgtcttagtcaccaaatatagtttaggttcctagagagccagaatccacacctgataattctattctcaaaatactggaacaacgtattagagaatcaatgaatgctctccgattaagtcattcttgcaagcacttaccattaaacttattagccattacataagcccaattaattagttaactaatttgtaatcataatgatcacaatgtggaaagaagtcagtcttcaactaaactattttcggcgtcacccaagatcagatcgctccctccattttatactttgaaaacactcactttctgtctctgtctcttccacgcatgtgtgtgcacacaggcacaccgctcataaactgaaccaacaaatacaagcctatgcaattttacagcaagcctcaaagctctgatacagtaattccaagtaatcctacttttgtttccatctgtataggtctcattatactaacactcctgcagatggtgtcagaaaggtgaagtgtcaagtccacaaaggggagaccccaacagctcattgctactgcaatatcaatcactgctggtggtttttacttttatctccttccctccttagttgtcccactcacactgtcagttcggttagaatatttcacctacacctcacaatatgtcaaaaggaagtagacacacgctgtgaaaagctggtaattttattagattcctttacctttaaaaatctgttacttggtcaagtctggtttctgggcttcttttttgcagggaaattgaggcaaacatttttatgtggtcctctggtgcctgctctgtaccacaagaattatatacacaaggatcattagagtagtgtttcgcccattaagatataataaccgtcagcagggacaaaaagcagatcagtatcacaaattcaaactaacaggcacacataaaaactatgtgcctgctttagggcacatgcaaggggtcagggtctcatacaacagggaaaattccccctccgggtaagagatggcttttcacaagaccagggttaagtagaaagaacatgcaggattctctcagctctccagccatttttcaaccctgaacacttctctctccaagtgtaccatgcccatataaacaaagaatgcacttgctgttcgaagggcttctaatgagtaaaaagacaggcagagttatttaagggagttgttctctttgactgagggagcacctctgagcaagaagcatgggacacggtggtgagaaaggcataccttgtatagtctgttaagattagccaaagtaaatctggtcatccgaagtgtgggagatgccacaggtaggtagggttgggttggctcaccaggtttcggctgacggtggttttgagaatgatttgtacgtagcctgttttattcttctttttatttccttaagtgactgatgtaagcctcttgcacaaagcgggtatgtaataatgttttgcaaatggactagatatagtctggtccagcccaggaaagcaaagtttgataggattacttgactctattagcagaaattattttgtttacaatgttaactctgcaacagccaaaataaaacttagctgctttgcccaaaatactggtatttttcagaactcgacagaaattcaatcagtaagagaaagagaacagagcagggaaagaaatatagaaggacttggttttttgaaactctcatgtcacctatatcccacaaaactctgacaaacctactccgtgacctctacaaaggcaacgataacatggggttcatgggaagaggcagtagtacaatctgagagttgaggaaagggaaggcagaaacatcttcccacagttttccctcccaacaatgaggtcatccttgagagcaaacaccaagtctatgaaaaaaactgcaagaagtggaaagaaggggagccagtagagaggggtgtggagcgtggaaggaccactcggaggcaaggccaggggaccgtacagatctgctcccgctgaagagctctgtaacaagcctcttcaaaatggtcatagttctcctacaacctataccttgtgtttctcctactggacactaggttccacctccaataagcaccaggcctacctgtgcaaacccagatatgcacaaatcctcactctatgcaagtatccaaatgagacgcttaagggcaccaattaagtagcagcttaaaagaatctctgtccactccaccacagggtgaggacagcaggcagactttattggggattaatacttaataactgatagaatttattggcagcttcctctgtaccaggcattgttctaagtgttttgtatttaatcatatgaggcgggtgcgtttgttgtttctagttttacagatgatgaaactaaggcacaaagtcacactgcttggtttcccaagctcaattcgacaaccaccccaactatcctccaaggcagtggtaatttactggacaaagattgtacttcattttcatagatgtcaggctataaataatcattccacttaaaatccttaccatctaaaaaaagtttcaatgaattaaccaattaagaacaaactacccacaaaaggctacaaagaaaccagggtctctaaatggcatcatatgctttttacattgatcagcaatcccagagtgggaagcacatacagcccatgttatgaaaatttcatttatttagtatatacattcatagttccaccattatttaattcatgctaatacatggttcacttctaatacgctattgcaacatatgcaatgaaatgattaagctttaatctttgttacaaactatttgcagttcttcaaaaataatcaatattgcagctaaggcacagcagacagaatttctttaaaaaaaaaagaaacctggaacttgaaaataccttaccttaaataagaagaaaataaaatctctagtaacataaagtctaattttcttgagtatataacaataattgtaattttacactgcatgccaaaactgactaacaaggaaaactaaggcacacagcacacgaagaaacacaaacaaaagttgcatccaaacagataaaaaaaaaatcaagagactatagtatagtttataatcttatctaaattgctaaatgcctgctattgtgtcatgttaacctgggctctgatggagtaagagacaagtataaaacacacagtgaacaggagctgcctgggtggtggaagaaatggacaatcgcaaaagggatacttatctaatctattacaaaacttcaaaatcactcaatctcataaagcaaaaatccaaattgtctcctaagtccaggcatgtactatgcctcaagttgcccaaggtctccttttacaggcgcaattaagattgtccatggttcaaacctcaaagaagggcacagggcatagaattcacaaaacttccccttctatatcccctctattctccagagggcagtggaatgagaaacagtttgggttaagctgcttctgttcgtccattagttctggttcttttaagccaaaattacattccaggcagattggatggtctcagccagttgcctgaaggtaaagtacaaagaaatgccaccctctgctttctggactcagctctgcgagtgaaggaatgcagaatggtttagaaagggtaggtgggagccccgctgcttaggtgttttagacacagcaggaaggaggaaaaggtggaaaaggaaaggaaaatattagagtgactacttatatttatctaacattttaaaaaatttagctctacctatatttaataagttaattgaaactgcccatttatttagtctgtatgtcagcaggtcagggtcacatggcacttttggtggataaactctttcagacgtggcatgctcacttgttcctttgctttcaacatattgtgatggggggggtattaaatgaagttttcttattctaaaatctggttttaactaaacttcacaaaataaacaagttggcttcaaaagcctcctgcagtgaaaccccagatttaagataatccatcaacaataggaaaatggtagagcagacactttggttgctagtacaaactcttcatcagttatggaagtgggtaaaaacaaggatagccaaatggcacccgccaagaagttgatccccataaacagaatttatcactaaggctacttaaaatgtgggtttaacttcattactgttaataatgagactcattgtaatcgcatattgagccttgagatatcaggctcataagaacccaaagccatcaaaattagcaagacatttaaaaatattactaatcttattttaattcatattttttgcatatattttataacatgcatattagttatgtcctacacttatattttagaaaatagaccttgagaaacatgcactcaaactttttactgttggggtgcacgataaaaaaattctgaagaccaaaagccttttgagtagacactcttctaggctagactgagattgttcctcaggaaagtcctagataagttatgttggatttcagatgcctggtcaaattcattacgttttagacaacttgcataaactttgacaaagatttctggcaattattaaggcaaaaggaaacaaggtccagcgggcattctcagacctgggttttagactctgagcacatagctgacatcccttttgtacactttgaactgagattcccaaacagaaagaaagccaatgttgcagctgatctctcaaactgacgttctgaactagtaagaactaaataaaggatgttttatcttgatgttatttaaatattataaatattaattctgcgtgtatgggaaattccaaatgaatgccaggaggtttctggcatctagtctgttgcaatgcatatgaacgtttatatcaagaatagtcaacagcaattttctatctcccctgggacaagaataagaggaactcactaacatggaatgaaaacactaatttgcaatcatgtaggcagtcactgtgaccaaggatgccaaatgcttttaaatataagtcatcctatctagcagatggaaaaccagcagtaagtagattacttattcagagtctctcctggaccaaatgcaagtgcttttggtattatggtcaccctcctgaaaccattcttcctctacaaccaaggcttttcctttagtgattcagtgttttcacttcagccagcatatggatttggctttcttttacaagacatcaaacactatcttgggtagaaataaagggataaaggttacttttgggagtatgttatgtctaacctagccctatccgcttaccactagcacaaaggtagatttttagatgctcaccgaacactttagctgagatgtttccactcatctcacactcaaatcatccaaaacagaatttacctttatgcttcaagccctgcgtctgcacctgtgttttcagtttctggcttggggcaccattatacacattcctgctgaagccagaaacccaaggtacagccaaaagtcttctgtattactccttgcatctgatgtgagcaaccgtagcaattctctctccaaatatccctcatacgtggtctcttctctacatttctatagacatagcttcagttctgacctttgtcatttatcatctgaacaaacacaatcccttctaaaggatttctccaccttcagtcctatttttctttattcattcaacaggcacttcatgatcatcacctgggtgccagacacaggtgcaaggtgctggggatacatcagtgagcagtctccttctcagagcttatattctcgtggtagatgtaaataaaaacataagtagatgaacaaataaaatattagttgctgtgaaggaaataagagtattaaattaggatgacctgtattagggtgggaggacctaggcaggctctcctaggaggtgacatttaagctgaaacctaaagaaaaacacctagctacatagagagtggggtggaaaagcgtttcaaacagagggagcgtgcagaactgttcattcaaaatgtgttgtgcatgcaatgacaaagagtaagaaaagtacttggcctctgtaagaaatcaaagaccactgtagttggctagagtgcagtgagatgagatgcaggtgggacaaagtgaaataagagatctatgttttggccaagcatggaaaacattagaggccagtcttccatgaacagtgtgatagatattgctgcattcaaaatcagatcacaacatggcccttcttagatttcttgtccccattactgatgcaataatataaacatttcttgtgatgctattcatgatcttcctggtctggatgctgcttgtgtttcttgccttctaccttaaaacaacccacattcatatatacaatctatatactccagctgtgtcttttttttctttttttttttttcgagataagagtcttgctctgttgcccaggctggagtacagtggcgtgatctcggcaacctccacctcctacgctcaagcaattctcccacctcagcctcccaagtagctgggattacaagtttgtgccaccaccatgcctggctaatttttgtgttttttgtagagatggggtttcgccatgttggccaggttggtctcgaactcctgggctcaagcaatccacctgccttggcctcccgaagtcagggattacatgtctgtttttcacgttttgtttcatgctctttcctcaattggaaaagctccatctctgtgtgatgaccactatttcatcctctcagacttaatcttaacttttacaggaagagtcaagatactgctctgttatttcatagccaattctactataatgttgggctgctttacatctctcccaccatcctgggtgtgcctgaggatgttagagcctgatcttatgtgctgttgtagtcatgacacctgatgcggagctggcactctatacagttttatggaaggaaagaaggcaggcaagcaggcagttttgtccaagtgcactggaatagaatacatggcattctgatcctatctagtttaagattaagtctgtattttttaaaaattgaattaaattcaacgaacacttgaatatatgacttttatgcatgacacattagcccagttatttgcaaacaatgcttaatcaccatagaaattcctggcaaagaaatgcataaaggaatgaacactagccctgctccttgttacctgtcagatgttaaggtatagagaagcaaaactcttcctgaatggagagtgtaggctgtgttaaggagagcacagagaagtgctcctcttacaaaagaagaagagaagattgctcttcaacagccaaaccagtaaaagccacatgatctatttgtgggagacaattgcagactgaaacacacaaaactgttatcaaggtgacaaagctgcaatctcagaaaaattgaaatgtcattgccatttggaaaattggaatgcctgaagctatccagaaggcctgtaagtacttctattcctatcaacttaatggtagagttttccaagaatcacgtactgtattttgtctctaaacctgtttatgcctgtttctttgcattcaaaaagatatttaccgtgtgcttattatgcatatgccgaaacagagtgatggaaatgacattttaatggggaaaatggcaggtagaggcaaatgatgtggagaaaacaatcaataaatgtgacaattttttttgttgttgttgtaagaaggaatactctcctctaagtgaatatactggcttgctggtttatacatcagcttcttgtgagtttggaaagtatgagttaatccctctgggctttgtgcatggctaaaggtgaatatacgaccacagggctgaagaacaccctctgaattgtcatttcaccagggctggtcggctgtgagatcttgccaggcggccagctggcctcctccagtcatatctaaccatagcccctctcacattaaaataaactttttaggccaacatcagcacagggagtcctttcaccagggtgacaacacaaggccaagtacattccacacacaaattcagaatgaaatataactgatacagcctgggctcctaatgaccttcagatgccagtgtcagtcaatgactccaaaggaaaactaacctccagttatagcgccatattcatctggaatgcattactaaacgaagaaatggaatggagatgattttttagaacttaggagccaactttgtggtggatcacagaggtgcttgaggaaggaaaacgaacaataaagttcccacaaggactagaagtctgtgatgctacagtcaacattcggacgctgaaatgaaagttcacgtacgcttcacagaagcatgttcttatctagagtataacattggaaaaggtctggatcgacaaatatcttttcaaactcacagtaaacattcaatctaataaggctagaatgccatgggaaagtttacagtcctgagctggtaactggactatcacatggctggaatgacttctatccatggggaaatctgacgcactgcagtaggacatgcttaaaacaaacggaatatagtctaaggttatatggacattgtgaaaactcacatccacagcgttacacatcatggtgatgaaatcaagcacacttgagtttcaccaggctcatggagaccactgtcaagaccgttctgtgatacctgaagaatccctaacttcaataactgcttcaaaacagtcagtcctttaccaaaagactataaactcccctgaaaacatttgtttttgtttttctttttttccctctgctctaacatcacattcttctgatgtgaatttttcagaaactcaattcttctggaagatctaacttgagattcttctaaagtccctgaagaatcccattctaatttcaatgacaggcctatttagccaccctctgccaaactcactgtatctgaggtttcatattcacacttatgtattcagctctgttaatgagcttaaatacgatacagcttatctgaatgctctgtgattatcatttaagatgttttagttttttgtggaatttttaatttttgtaatgtagcgaaattttaagtccctaacaatgctcccttgaatggaaaagtagcaggtgatgtgaaagtaacttaagtgtcttgtaggtcaggacctatgggtattctgctgagtagcaaagtcaaacaactaaacaacatgaactgaaacctaaagggccgtgtggtgtcagatgtttccactgtgaaactcatactaaattctactgaaaccatctaagagattgtattatcactcagcaaatataagtgaaatgtcaatataaagatttacatttgctgggcatagtggctcacgcctgtaatcccagcactttgggaggccaaggcgggtggatgatctgaggtcaggagttcgagaccagtctgaccaacatggagaagccccatctctacttaaaaaattagctgtatgttatggcgtatgcctgtaatcccaggtacttgggaggctgaggcaggagaatcacttgaatccgggaggcagaggttgcggtgagccgagatcacgccactgcactccagcctgggcaataagagcaaaactccgtctcaaaacaaaccaaaccaaaaaccaaaaaaacccccaaagatttacatttaattaattagtgagaaaggggagtattgttttcatgcgagacacagattttgaaaaggtatcatgtgttctggtctacttttctagatactaataaaaaatatgtgcacacaaaatctcttctctttaaatgtcttttatctaaaattgagccaaagataaccaaatagaaataacaacattttgaaaacgaaaggatgaagaaacaatgacgtaaccaaatgaaggaaagtattcctccctagaagtattccagctaataaagaagaaatgatggaattagtacatcattattttgaaaacttctattgaaataataaatccaggcaaagataataagtgctcactaacatcacagataactaaatattatgcacttcttgatagaaaacataatagcatctatgatgtattcttccactcagattaagtctctagatcagacagtttatagaaaacaggggacaggggaacatgataaataaaaacatagcagcatcatcagcaaaacctaaaatgtggggaagtctacaagacaagtgacctggtttcttcaacaagtaaattacaaaaggggaaaaaatggagggtagaaacttctagattaaaataaacttgagagacacgtcaaaggcaatgcatggaatttgtctggatcctcatttaaactaactataaatgaatggatgaattaatgagtatacaaacaacagggacattagaaccacttatgtgatgatactgagtaactacgattaatgtctttgaaggaaggataatggcactgggtggagtattgtttggaaaagtacccctgggccgggcgcagtggctcatgcctgtaatctcagtactttgggaggccaaggtgggcagattgcatgagcccaggagtttgagaccagcctgggcaacatggcaaaaccccacctgtaaaacaaataaataaataaagtatccttattttttagcaatagtactaacatttttaacagatgacttataaagcatctgaaatttgcttcataacctacttggtgagaggggggcattttcagataaaacaagagtgagttgatggttctgtagctgagtattgggtatataggattcattagggcattctaactttgtatgtgtttgacattcttcagaatgaaatgttttttaaaaaatggaaaaagtaaaacaaaagtgatagaaaagacttaccctgttggatatccttcatttctaaatgtaaactagatatcaagattcccacagtttgagatcgttttccatccaacaatttgatgatctaaaattagaaaaaaaaaaaaaagaatacaagctcaaatgaccatgcagtctttcaggacgcacaccaaaaacattaaatttttttagatacactgattgatgaactaaattgatgctgcatgcactctttaaataatacttaattgggaagtaacttatgcacaattatagacatcttacacaatgacagacgttttacaaaacaaacacacaaaattccatcagcctaatacaaacgctaaatctttatatgttactgtgatcattttactcaagtacaaagttataccagcatcaagatgtacagaatgtggtatccatctttttcacttatcactggaatattttcatgttgctactggtgaagtcacttcatagcctccaatctttttagtaatgtcatcttctgagtgatttaggggaaaaagcatgaacagctgagtcagccaccagtgatatggccttggtaaagtgataacctctatgaattgatttcctcatcatgaagggctgactatatttagtctatattttattttgagagaaggtctagctctgtcacctaggctggagtgcagtggtgtgatcagagtttgtctcagccttgacctcctgggtttaagtgattctcctgcctcagccttcagagtagctgggatcacaggcaggcgccaccacacccagctaatttttaaatttttttatagagacaaggtctccataaaaacttcattgcccaggctgatctgatcccaaaccctaaattcaagtgattcttccatttcagccttccaaagtgctggggttacaggcattagtcattgcacctggcctatacatttattttagaaattaaatgactatatgaaaagcacttaatatagttcttgacatatatttatttaaagattttctgtttcagagaggttacttcctatttgttattattaatataaacaatataataccttgcacacaaagctctagttttaaattaatcaattaatttttgagatagtatccagcgccgtcacacaggctggagtagagtgacgcaatcacagctcactgtaattttgaactcctgggctcaagggatccttgcaccctcacgagtagcaagcactataggtgcaggccaccatgcttggctaatttttatttttttgatgttttgtagaggtgaggtctcactatattgccaatgctgctcttacactcctgggcccaagccatcctcccaccttggtctcccaaattattgggattataggtgtgagccaccacacttggccttaaaattattttttataatactatgtatttttacaatcttcatagaaactccacatacctcattgccagttatttcaacctttatgaatattccatggagaagtctacatagttttgtgtttctctacaactagtaaaccaaatcagctccctggtaacatatcacgaagctgccactaagggaaaaaaactctctttcctctcatgtggcagggctacaaaaataaaagagaagcacccacaaaacacaaatcttacaaatgtttttaatgtgctttgctggttaaaatacaaactaggctgaacagctgtgctttccttcccacctaggtacttacagaattgccaaactactgtgaagacaagactaaacagtaacaaacatctacatttgtattattactgtaatagctgagttgcttgctggttgaaaagtaagggacaacaatagtttgttccaataaagatgatctaactgcctaattgtctaactacctgttgattaatcgatcttgaatcaattattgccagatatttttttcctttacctgttcagaatggctactttcatataacgattagacctaaaagatagtaaatactaagtattaatcaagatgtaaaggaaaaaaatctcatttttcagtcaatatgtttaagcatgtcaatattcgccttagaaagattcttgaggcatacagaattttaggagttttaaacagaaatagagaaggtactcagtaattttttatatgaaaggaaaagcaaaaaaaaaaggcaattaagcataatacaatatcttccttaaaaatgcaatttctggctttttcttagagaacccaaatttaaagtcaaatgatttcttcatctaataaaaaaattaagaaaagtcaatttagccatgcacccattcaaaaaatatttactgtacacgttacatgtgcctggcattgctttgtattctggggatgcggaggtgactgagacagatcaagtcgtaagaagtttgctgtagagtcaaaaaggcaaataaaagcatcacctaaactaactggagtgcaaattcaaaaagagaaacgttttgggaattgactagatttattcttaagtgtccaggatggtgactgatacaaccacaaccatggcatacacatcaatgacaaggacacaggaacaggatcaaatttatgacaagatcacagctgggttgcaaaagtttcttcaaatgaacacgcaccaagctatccagttagggctctgaaaactaccagtaatactctgcctacaagaaaggtaatgtacaaatgcacatttctctgttagctaattaaaagaaagcaggagagaaatcacgagagagtaaaagagcaagaaagatattgattctgtctgtccctgagtaaaatgaggcaaatctacccctcaccccattatacaaccagacttaactgtggaaaggatgttatcaccataagccatgcttggaattttgtcgaatgacttggcacaaccaggtatttgctgagtgttacctttactgggactaatgccttaaaacgtttttgtttggaaatctgatgctgatttcctacaaaggggctgggggcagctaagcagtggtgaagttggagcattttgtattctcttccctacctgaaccaaattctctgtctacttttaagtaaattttcaaaaagatccttctatgtttccatgtagccactcttgtgaaataccaccaggtttctcaaaaccaactacaatggtagggacacaatgcgcacagaatgatatgtcctaaatcctcttagtctcttcgtcttttttttctcccatggctttgaaggcttaacactaatttctctttatttttatgaaaagtgcacaacatgaaatgtatcctattaacaaaaatttaaatgtatagtacattattaaccacaagcacaatgttatacagcagatttctagaactttttcaccttgcgtaacagaaattttatacccacagaatagcagatttccaattcgccgttgttccagcccctgggaaccaccattctactttccattcctttgagtttgaccaccacggatacctcatataagtggaatcatgcagcatttatctttttgtgactagattattttcacttagcataatgtcctcaggccaatccatgttgtagcaaatgacaagatttcctttttttttttttgtggtcaagtaatattccactgtatgtacacaccacgttttctttacccatttgcccatcaatggacatttaggttgtctccatctctttgctattgtgaatgctgcaacatgggaatatcttttcaatacagtgacttcaattcttttggataaatatccagaagaaagattaatggatcatatggtagttctatttttaaattttttttttttttttttttttttttgagctggagtctcgttctgtcatctaggctggagtgcagaggcttgatctcgcctcactgcaagctctgcctcccgggttcacaccattctcctgcctcagcctcccaagtagctgggattacaggtgcctgccaccacgcccggctaattttttgcatttttagtagacggggtttcaccgtgttagccagaatggtctctatctcctgacctcatgatctgctcgccttggcctccccaaatgctgggattacaggcgtgagccaccgtccctggtctatttttaaatttttaaagaacttcatactgttttccatagtgactacaccattttacatttccaccaacagtgtacaaaggtcccactttgtctacatcctcaaaaaaacttggtatttttcagtttttttttttttgacagtggccattctgacacgtgtgaggggttatctcattgtgattttgaattgcatttccctggtgattagtgatgttgagcatcttttccttatacatattggccatttgtataccttttttggagaaatgtttggataagtctttagcccatttttatcagacatatggtttgcaaatattttttcccattctgtaagttgtctttttactccgttgattgtttcctttgctgagcagaagctttttcatttaacatagtcccctttgtgcatctgttatttttgctttttttgggggggggcggtctatgcttttcatgctatatccaggaaacaactgccaaaatcaattttagaggacttttccctattttttaaaaaagttttatagtttcaagtctcacatttaagtttctaatctattttgagttgatttttgtatatgttccaagataagggtccaatttcattcttttgtgtgtggatagccagttctcctagcactatctgttggagagactatcctttccacattgtacagtcttggcacccttgtcaaagaacatttgcctgtatatgcttgggtttatttctgggttctctattctgttctattggcctataatgtctgtctttatgccagtaccatactgttttgattactgcagcttggcaatttgttttgaattcagaaagtgtgagttccctagatttgttctttctcatggtggttttggctactcagggtcttctgtggttccatacaaattttaggattgttttttcctatttctgcaaagcagccactgggattttaagaggaactgcactgaatctgtatgttgctttgggggaatacagacattcaataatattaattctttcaatccataaacatgagatgtctttacagttatttgtgtcttcctaaatttttttaagcaatgttttatagttttcaaaactagtctgtactagtcttttaccctcttcagtttattcctaagtatttcatttttttggatgttactttaaatgaaattgttttcttaatttcccttccaggtagttaatatttttgtgttataagaacacaacgaatttttgtttgttgatttggaatcctgtaagtttgctgaatgtttttcatagttcttcacagtttgcttttttgggggaatccttagggttttctacatataagatcatatctgtgaacacagataatcttactatttcatttccaactttgatgccttttatttctctctcttgattaatgtctctatgactttcagcactatgttgaataaagtagcatgaatgagcatccttgtcttgttgctgatcttagtggaaatgcttttggtttttcaaccttgattataatattagctttgaacttttagcatatggtctttatttctttctattccttctaaagaatatttccttctttaggtaatttccttctattcccagtttgatgagtttttatcagaaaacagtgttgagttttttcaaatgctttttctgcatctatcaaaatatttttatcatttgttcttttaatgtaatatatcatattgataaatattcatatgttgaaccttccttgcatttgagagataattgacacttggtgatggtatatgatccttttaatgtgctattaaattatgtttactgggccaggtgcagtggctcatgcctgtaatcccagcactttgggaggccgaggtaggcggatcacttgaggtcaggagttagagaccagcctggccaacatggtgaaaccccgtctctactaaaaatacaaaaaattagctgtgcatggaggcacgtgcctggtagtcccagctacttgggaggctgaggcaggaaaatcacttgaacccgggaggccaaggttgcagtgagctgatattgtgccactgcactccagcctaggaaacagagtgagacaattaagtttactagtactttgttgagaattttaacatctatatttgtaagagctaatgacctgtagttttcttttcttgtaatgtctttggctttggtatcagagtaatgctgttctcataaaatgaatttggaagggtgacctcttcaattttttggaagagtttgagaagcactgcttccctgttaattattctttaaatgtttggtagaattctccactgaagccatctggttctgggcttttctctggaggtttttgatttctaattcaatctccttacttgttacaggtctgttcagattttccacttcatcatgattcagtcctgctaggttgtacatttctaggaattgatctatttctcctaggttatccaattttttggcatgtaattgttcatagtaggttcttataatccttccagttctgtggcatcggttgtaatgtcttctctctcattttgtatatacttgtgttttctttttctccttaatttagctaatgatttgtccattttgtttatcttttcaaaaaaccaactcggttgtgttgactattttcctattgtttttctatactctattttgctttttttctgctgaaatccttatttcatttcttttactaactttgggcttagtttatccttctttttctagttccatgaagtgtagagtcaggttgtttatttgaaatctttttaaacataggtgttcaccctaaaaccttactcttagtactgcttttattgcatcccatatgttttggtatgttgtatttttgtttctgtttgtcacaagatattttccaatttcccttttggtttcttctttgacccactggttgttcaaaagtgtgctgtttaatttccctgtatgtataatgtttccagttttcttcctgctattatttctagtttcatgccattgtggtcagaaaagatacatggtataattccaatttttaaaaatttgttaaggcttgttttctgacataacgtgtgacttatcctggagaatgtgcacttgagaagaatgtgtttcaaaacccaattcctgttgggtggaatggtctatttccattatgtccatttggtatatagtgttgctcaagtcctctgtttccttattgtttatctatcttgttacatcatttatcaaaagtgggttattgaaatctcccattgctgtgttgctgtgtatttctccctttagttctgtaaaaatttgcttcatatatttggcttgtacgttgggtgcacatataactgttatatcttcctggtgaattgacccttttatcattaaatagtgtccttctttttcttttgttagagtttttgacttaaattctaactatggccaccctgctgtcttttggattgtttttagtttagctaaggatgtcagttgttggtttttttaaattaactcttggaatatctttttccatcccttttcactttcagcctgtgtccttgagtctaaaatgactattatagacagcatatagttccatctttttttatccatttagcaattttatgtcttttgactgagaaattttctctatttgcatttaaagtaattactgagaggcaagaacttattattgctaatttgttcattgttttgtagcttttgtagttttgtctttttctatattgatgacttttgtgttttgtttcttacagtgacttgctttgattcttttctttttgttgttgtatctcctataggcattttctttgttgttactatgagacttacataaaacattttataggtataataatctattttaagctaatttcaatcacatatacaaattctactcttacttctccactcccacacttcatgtaattgatataacaaattatattttttctattgtgtatccattaacgtatttttataattatatttgtttttaatatctggcagacataaattctataccagagttaaaagtgatttatccgcatcattatagtattctgtatttatctgtatatatacctttatctacaagctttgcgctttcatatgcttttgtgttgctatgtcatgcccttttcatttcaactttaaaggctttcctgtatcatttcttgtaagtctagtggtcatgaacaccctacacttttatttatctacgaacatctatttctcttttgtttctgaaagacaatttttttccttttttttttttttttttgggtggggaggactgagtctcactctgtcacccaggctggagtgcaatggcgcaatcttggctcactgcaacctccacctcccaggttcaagcgattctcctgcctcagcctcccaagtagctgagattataggcgtcccctgccatgctgggctaatttttgtatttttaatataggtggggtttcaccatgtgggccaggctggtctcaaactcctgacctcaggtgatccacccgcctcggcctctcaaagggctagaattacaggcatgagccactgtatctggccaaaagacaatttttctttttctttttttttttttgagacacagtcttgctctgtcgcccagacagagtgcaatggcatgatctccactcactgcaacctctgcctcctgagttcaagcgattctcctccctcagcctcctgagtacctgagattacaggcacgcaccaccatgcctggctaattttttgtatttttagtagagatggggtttcaccatgttgggaaggctggtctcaaactcctgaccttgtgagtcacctgccttacccttccaaagtgctgggattacaggcgtgagccactgcacccagccgatagacagtttttctagatatagttttcttacttggtaattttctttcattgctttgaatatattaccctatatccttctggtctgcaagttcatgctgagaaatcttctgatagtcttgttggggtgcccttatatgagttgcttttcacctcctgctttcaaaattctcttttttgtctttaacttttgacagtttgattataatgtgctcagtgtggtcttttgagttcttgtaatcgggatccatcgggattcttcaatctgaatgtttatttcttccgccagatatctgaccattatttcttccaatatactttcctcccttcctaccttctccttctgtaactgtcacaatgtgtctattgatctgcttgacggtgttccatacatcccttagactttctttactcttttttttttttgagacggagtcttgctctgtcacccaggctggagtgcaatggcgtgatcttggctcactgtaacctctgcctcccagattcaagcgattcgcctgcctcagcctgctgaatagctgggattacaggcgtgcgccaccccacacagctaatttttgttcttttagtagagatgaggtttcaccacgttgggcatgctggtcttgaactcctgacctcgtgatctgcccacctcagcctcccaaagtgctgggattacaggcgtgagccaccggcacctagcctcctcttcgtttttttctttttgctcctctaaatggatcatttcaaacgacctctctttatctgattcctccttctgcttcattaagtctgctactgaaccccactagtgagcttttaaatttggttattgtattctttagccccaatatttgtttggttcttcataatattttctatttctttgttgatactgtcattttgttcatgtatctttttcctgagctcactgaacatctttatgacatttattttgaattatttgtcaagtaattcatatacatctgtgtctttaggattggtttgatttcttttgttccactggttggtccatgctcccctgtttctttgtgtgctttgttactttgtgttgggatgtgaaaaagaagtcaccattctcattctttacagactgatttcatacagtgaaagacctttgccaatcagcccagctagtgtctctgggggattttcaagcctttttctgtggataaatattctctggacttacgtatgtgaattcccaattagagggattttggtttttcaggagctcataatccctgctctctctagtgtctgtctatggtactgcagtttctctggaggtataagctgtccagctcctttttgttctcatctgcccccaaacatctagagtatgtcaagtcccatgaacacacagagtcaaagaaggaaaaggagaaaggagaaaagaggagggggagtgggaggaagaggagaaggaggaggagaaagaaggaaggaaggagaagaaagaaggaaaggaaggaaggagaagaagaagaaaagaagatgggtgaagatgaagaagagcaagaggaggaggaagcagaggaagaagaaaaaacagttccttggacaacactgtgaaaaggtgaaacactagacacaagctccactcttctttcccctgcagtccatgtgggagaagctgctgagctgtattggcctctgtctactgtactgcaggccacctagctttttgttctcagcagtctccaggcatctagagtatgctgtgtcccatcagcactccaagtcgggcaagacagaaatcagtctcttgggcggccctctgaaaagccagagcattggacggatgctccgactttttccttctccaaggagaagccaggatttggaggtttactctcacttactctgccctgagcaagggtgaggggcaattgcactgaatgcatactaattcatatcatcatctttcttctcagtggttcccaacctggcatctttccctgttagctcttagattcacacacaacagaaaccagtcttcaaagtacctccccaaaagtctgaacattagacataagatccagtcttctctctccctcccaaaggagaagccaggaggtagttttctctaaatcaatgtattgtgccagaaagggagtcagatgagtgagtgccatgaattttcctattagcttcaatacaactggtttcatgctcacctggggtttaggagcctcttaactgatttctgaatttctcacaaagggaactggcccgtgtattattaaattggcatctccatggggcaacaaggatccggtattttctattccaccatcttgatgacattacctccccctttcccacttttagtttctgagaggcaaatgctatgtcatccatggatagagagagaagacaaaagtggctgggttccaccaaatatgctcccagtcacaaagtggctcatatggacatgttggtagtgagagtaagagcagactgatctgagactgagtcaggcttcgctgaaagggggctggcctctccttcataattggaggacagtaccaaacaaactacaaggaaaagaattagaaatgaaggaagagtaacgagaaaaagagtagaagaaacatatattttaaaagatcttccttaagatatgcaaaataactgaaaggaaacaaatggaggacaataacacattagacttgtgaacacacatagaaatggttcagtacaacccaagactttgatatacacttagatctttctgagattggttagaaattgggctagcagggtgtgaggagaatgtattggaagtagacaggaggaaaaaagaaacttgaagactataggagagaaaaagtatacattttgttgcacttttttttttcactgtgtagcgtgtttttttcacgtagaaacacattactgacaacttccttgtcagtgcaggcagagccatttctaaaaacatcacatcatttaagtattcccctactaaaggacaattagaaatcatccaaattttggccaggcaagctgtggctcacacctgtaatcccagcaacttgagaggtcgaggtgggtggatcacttgaggccaggagttcgggaccagcctggtcaacatgatgaaaccccatctctactaaaaatacaaaaattaggtgggtgtggtggcacactcccgtaatcccagctcctcgggaggctgaggcatgagaattgcttgaacccaggaggtggaagttgcagtgagccaagatcaagccactgctcgccagcctgggtgacagagcaaagactctgtctgaagaaatgttccaaattttgtcaattgttaagaatgctacaacgaacaagcaggcagagagatccttagtcatgcaagtttgtattttcataggactcatagaaatcattcaaataatatgcccatttgaaaatttgataaatatttcagaattgtttcttattagacttaccctgccaagtatttgagagcaactgtttttctgttcccacacccactttaggtattaccaattttaaaactgttggctgaaaaacaggtgaaatgtgttttcatgattttattttgcatttttaatgatttttattagtcacatcttatgaattgtctttatattgtttttgctatattttccaattactagatctactaggctggtacaatacaaatacacttaaataagggcttagctaaataagacgaaaaaagatttacaaagagcctgctgtacataaaagtcattttcaaagggaagagggaatagaacgacctgttactacatctccactaagcactggtattgtgttcctctgcacattagccaatccaaatggacagttgtgcactgggggcagtgagtattgcaatactgtaaacctttattcctttagtggccccctgtggactttccagagtgataacaatacttcaggctcaagagtcctgtaaagtatgtatagctatctcactgctggggcattaaagcaagaagcacagctaaccgaatttttacggtaattcattttttatgttcattatcaaatcttacaacctccttacccagatatatacccattaccgaagaatttattgcagagtagtgaggaagaaaatattaaggggaaaaaaagacaagagtgaagaaaactgatgaagagaacaagaaaaagtgataacaaagatgtggaacatgacaaagattttttttttaatttgttatcaaccaatattactacttcgctttctgaatgcttttttagaatcattgttaagtttcaaataaccagaacgtaatttatgttgaaccatctattaactgaaaatttccctagcttttcttttgttggattatattcattattagtaagctaacttttagacagaaaaagtgaatttcaaaaattccccttggaagagaaaaactatatgaagataaactaatattgggtatttagtctcccaaatccattgacatctcttatactgtgcttgaaagaaatcaaattcaacgaatcacaccttccatatctatatatttatttactgaacgctgtggactggtgatcatagtgataatctgggaaatttttagaatcataaattgcctgaaattatcagatacttaatattctgctctttttatggtaggaaatttaatatatatatttacataagcacagatttcaaatacaaaagttataagaaactgataattaactcaaaaacctaattattaagcaccaacccactccttaagcttctgtttgctattagcattctgtgctattttgacaatttttcagttgtttggcctaaggaagaggttcccaacaatatcacaatctaagtagaaatacaaaaactgagaactatagccataaactacaacagtccttccctctagttttcaacctttgcctgctgagctttcatgaatgacctcttggccagctgtggaatgggatcaacatcatgatgtagtaaaccagttattcagagaaaagtcaggagaccagccttcagccttctatttctaggcctgcccttgctcgtcattgtatcaacgctgaaaggcagacagtccaattcaacggtcctcacaatacgcaaattcccatgtctactgcaaacaaaataaaaattgtgtgtgtgtgtgtgtgtgtgtgtgtgtgtgtgtgtgtgtctgttcaatggagttcaaagactagtttaaagagggcaaacatatataaataacggatacaggagctactcataagatcagtaacttaaaagagtttgtaattattctcaggtatacgatccttgaaaatgccaagactcttatttaaaaagggagtttgaaaaaggtggctgtttctagcacaatctttatccacgtaactcaaacacattcccaaaagaatgttacatccagtgcctttttttccgaaacaaaaatccagatctcacttttataaaacctctccatcagagtcttgagagatgataggctctgcagaacatgaaccccaaaagacactgtaactcatggtctgggtgtccaaacagaaaggactcttaccattcttcatggccactagggtaaaggttcttccgggcattaagacccaatagcagcagaggctttcacaaaaccatgaggtcagtttatcacatttgattgttagacgttagtgggattcctgactgtattagcatccagcttcatcatattaaaaggagttagttagcttgccttaggtaaataacaaaggaaaggttccccaaaagccccggcccacaggttagtgccttatccccacgtaacataaaaagcagcctgcgaaaaaaatcaagctgcaggaaccaataatatgaatgtcaaaataattattttccatgtttacgtgaagccagtagatagaatttatgctttaagctcccaacttgattttattccatgtaggttcttggggggaaaagtggctactacaggctgttcaggaaagatagttcagaaaacatttactggagagtgtaagtatttgtaagattttgcttatccaatgttactctggttgaattggattttggagtcatttaacacttagcactgaagaaacctacaaatttcatctaatttatccctctgcctttgggttggcccagaagtccacgtatgtaagtatagaccttactttacaagaatgtgcacacttcattataaaggttacatttagataatgcacacatttatagccattttctctcaaacaatacaacagagcactacttcagctaattgtaaatacaaattaaactgttcattccactcctagtctatgatcccttatcatactcacttttcattcttctttgtcctcatatgcatattacctgatgtgtaataatcctccaagtcattttctagtattaagagacttttggcagtgaactattttacctgatgtttggctcaaattcctcatgctcccattttgaaccatctttttctgctctcagggaaggtaggaaacagctggtcaccatcccctacactaagctccttcagaaacctcaagatcaccatttttttttaaacaagagatgttttatatcagattgttaaaaatcagtttttgagggacgttagcaagccctcactttatctccgccctatctagagtcagctgaacttggcagcacatggctttctcctaggtataattacagtctggaggagaatgcaatttgtgcagcattccactgacctacaagctgaccttgtgcaggggcaaattcacaggttgcgttaaaccctattagacatgcctagtttaaggcaaagcctttccagacccctgccacatgccaggattagggcatgtcacacgtgcgtactattacatcgcctaagggactctcccaatgccttccagagtgggaaaggcaggcccacactgtctaaacctgtacattaagccagtatagacaaattattattattcctcacatatgtgaatttttttaaagcctgcctctgtgaataagaattaagacaaaaatgggaagacagatttgctacactgggaaaatcataccttcaacctcagctagaaaagttctgccagacaggctgagaaagaattcttgtcaggtccagtgggatttttacatctacagaaaatctgtacactgtatatcttcggctttctgcctgagcttggcagacagggccaaaaataaaaataaatggttctgaatagaccacaagtgctggaagtctgctcagccaagtgagtttggcatagctacaaaattaagagaaacacagaagccctcttcttccatggagccttccctgtctgaaaggaagatgattaatttctacatctacacctttgctagacaccaaacacattcatacctataccagatcgagtgcatattttgctctttggcttaagtttcacatttgaacatactcagttccagtcacagggtttccatctccagcacagtcagttttatcctagagcctggcaaataagcagagagttttttcaaatacagccacatgtgctatcaccaatgaatagctgctggcacttcagggaactaagggcatgtgaaagttgctgcttttcctgtctgaatcaactatttcaccccaccaaaaacaaacaaataaatgtagaaaccatatatatatgagtagacatttactttcatgacaatgatatacaggtcgagcatcccaaattcaaaactcaagaactccaaaatacgaagtatttcaaaatccagaactttttcagcgctggtacagtgctcaaggaaaatgctcagtggggtatttcaggtcttggattttcagatttggaatgctcaactggaaaatttgaaatctgaaacgtttctggtctcaaccatttcagataagggatactcgacctgtataccaaatatccacatagggtacacggtcagctatatagaacaagtgtgtaaatgatctggcctttcttggtaagattgaacaacagcgtggagaattcacataaattagacaatctgattctcccaagtacaattctaaaaaatacaacttctatttttgtgccatcaaactagtgttatctcttgcttatgcttcacatcaatactcgctgaattccaccacctggccaaactatggacattaagaggctggttggtaaaaagtagatatgctactgatgacaagtcagcttgtcttagtaacagtcatcccacttctaagtcatgggcttccaaatagataaaggtaccttcataatgactgttatgtttctctttaagacattcttgtggagtgggttggaagacacgtagaatcctatgttagagatgcagaaattgtttcacttattcaagggctacaggctctgatgattgcactgatactttagtttgaatacctccaaattataaattagtatagggtctaaactttagctgcattagagagcagtatctttgtgagatgagagagaatattaagaaggccttaggtttaatttttattctcatttaactgccatccaaatcaaaaaatcttctaagtaatagacatctaattgggaaaacagagtgagagtttcgcaatggaaagaaattccaagaagtgatgcaaaacgatgcaaggcaatgaggtatggtagcctatggatacaggccttatgcacagaaaaaaatcatgggggaaccaactggcagaatccttttatagctgtggctattctagtcccctccctacgatttctaatatggcagtgactacaaatgggacaggtaagcaatgattcctcccagccagtgccagaagggagtgcctggggaaggggaagggcaggaccacagccatcttgctttctctcttacgggagaataaccgcttctttggaaatatgcaattgttacttggcaggtgcccaggagtacaatgctgattcagtttccttggtccccttcttcttccctgctccatcccctgccactctgccatcacacccagaagagctggttggctggctgtgtagtgccatattatgcaatgtcatccgacgtggtgcaaaacagctcttgctgctaatggccagtatggcctggtaggcctctgggaagaagcctctgtcaactggcctgataatgacattaaaataagctttccacatacagctgataatctgtctcattaaatgtttcaaggaaaactaagcttcactgtttagtcaaactgttaggtctgaatctcttccatggccttatttttggggacacataaaattgcttggatgaagtttactttaaggatctaggctcttcaccaagaaatgtgaaaaggcaaattgtcaccctgtcttgagtctgagaacgtatttggcaccccatccccatcctgacgagacagaaaaacccttttcttgtttttcaggctgatgaattccactcagaaggctaatgcggaggccacagcaggtgaaggctatgacagtgtgggggtgtgatgggttggaggggggagggtagggctgtgggcagatttctgattttgtgtaatgtagaagacaaacccccaaacaaaatcacatgctttttcctattgatcatggagtcttgcgggaagaaaagaccaagagacatcagtgcattcactgccttcagacagaaccagagctaccaaagcttggccctgcgaacagctttgattttagacttctagactctagaattatgagacaataaatttttgttgtttcaagtcaacagttggtgacagtttgttaaattagccctaggaaactaatacaggggctgatatttttatatttctaataatcttctaggtgattatgttgctgctggtccatggacattttgaggggtgaagtgactctaaataaatgtattattttgttactgatcattggcacttagcacggtgccaatacatagatatatgtatgtttctataatccctgatttccagaggtttttcccatgagcccctttcagaatatcaatctccacggagtcctttactaaagctattgtactcatttaggaagtattggaagtaactttctcatagaaagccaatcccaagtatacagacagccatagtgccctcctaaaacctctaaataacaaagtttgcatgacctttggacttcctgtcttgtctatataatttctcatctaataataaaaacttcaacccagtctcacacacgtatatctttggtggcttaaatagggctttttctttccaacatgttagagtgttaggcttttggaaagaacacatgctaataattacgccaagctggttagagataatgggcaacagaaaagttattatcttcaatgtcatcatatgtctttgatatgataatcattgcattcaagatatcagaaatgatggatggcctttgatttagagggtatccacgatgcaaattacctggctctttcccactcctgtgtagaggtgaagagccagcaagagtgagcacccctagctgcagtgcctcaagccactggaaggcaaaatctgagacagaactccaagggaaacacttcttcctttaaagatacttagggcacctcacattttccttttgcagacaacttctcgcatagtcttcatttgccgccattgccataatgtacactacttacaacccaagtcactccactctgttaattttctggctaacagctgctgatatgtaagtgccatattgcttccaacaggttcactgagttccttccatgaatataaaataaatattccacgaaatgttggtaaaaagagaaagatgaaatattactgtattttagtagatattttagaactgctgcaagattttgttagggtttgcggtgttatgtcccagcacatttcccccgtaattagtcttatcctccttcttactctcatagcacagctatcacgggaagcaagtgcgtatcatacactatcattcaggctttcaggtgaatggcataacatagtgactgaaaaaacctacccactgccatccatgaagagtgagcgtctacacccatcttgactggaaccatgagcatatgcacccagaggttctcttagatcaacaagggtgtaacacacatggtagatgatttgcccagagatgcctagatgcctgacttctagtcctgtggcctctcccttgaaataattattccagcaaagatgtacattcctaattagtcatattgcaacaagggaatagcctttaagatatgagaatcaaattcacttggaatttggggtggtaaaggcctttcgacttcctcttctcctaaaaaattagcccaaaattatgagacctaatgatttgaaaaataaaatctatcttccataaaactaggggagccctttaagttttaaaacagaaaatgtgaagttggaggactggtaaattcctaggtatagctgtgggaggtagaatgccagacatacacgagtaagaggcatcctgcgttggtggagacaggaatggttaagaagctaaatagaaatgaattgtttcaaagtctgcatatggagcaactaggtgcatgatctgtaattccatctactacaatcaggtagcatagtttctttttattactgattggtaagaattccacaaacattttggataacaattcttattgagctatatgtattacaaatgtcttcaagcatgtggcctatctttttatactcttcaaggtgtcttgatgagcaagagttcatgtcaatgattttattttaatgtagtcacatttcattatttgttttgtgctttccatgtcttttccgtataaggccaaaagataggctcctatattattttcaaaaattattaaatgtttcctttctcattgttacatctggcattgtcttttattcatgaagtgaggtagggatccattttcctttttttgccatatatattcaatttttaaaatacttttattcatagtcaattttgcccactgatctgagataccacatttgtcatgtattagtttccatatatgcatagatttgcttctgagctctcaattcttttcactcattatttatttatttagtttttcctgtgacaattactgccatactatagccactctactagctcttattaccttattttcctttatatgaggtagaatatctcccacttagttttccttttttggagttgttttttgaacatttgttcttgcatgcaaatttttagaataagcttgttaaattccaagtaattcttagattttgattgaaatgactttgaaactagaaatttgggaaaaattaacatctttataatattggctttcccattcatgaagagaattatgtctctctttttatttaggtctattttaatgctttcaataaagttgaataattttctacactgactcgaccatatttgcttagatttattcttattttatgtccctctaatggtatctttattttccaacttaatagtgtataaaaatgcaattgattattgtggtactgatctcatatctactaggtttactctattctctcattttttaaatttgtcaatacagattttctatgctgaaaaatcacaattcatcgtttcatttcttcctttccaatatattttatttgatttctttgccttattacacttgcttagattaaataaaggatgtagaaatgtgtatcatattcctatttcgtactgatctcaaaaagaaagctttcaaattttcaccaaatatgcccttgtcacatgcctgcttcgtggacactctttttgaggctaaagctattcccttacaatcttagttacaaaatttcattataaatcataatcatatttaatcaaatattttgccatcatctttcaattatatagttccccctttaatctattaacattttaattatttataaaaagcatttactaattttgaatcaaatttgccagtctggaataaatcagttaattatcaaacatttttttatatatttctggatttcatttgctaatattctggttaagatcttcatatctatatttatgagagaaattgtcctgtagtttcttttacttctgcccttgtctggttgtgctatcaagattatatatactagtcttgagtttaatattattttctattatctaatattttgtgtaagaaagacatgcttagtgtaataaaataagctggacctcgcattttgtgtgacgattttaaactactaatttaattaaccttaatatttacggaaccattcaggtgatctacttcttgactgttttgatcattcacagtcttctacaaaattatttcatattattttcatttattggcaaaaatttgttcatggtattgtattatacatttctattgcatctgtagttacattcacttttacttccttaatattacttatgcttgttttgctcaatcttgcaaaaagtttttgaatgttattcttttttttcaaagaagaaacttttgtctttaattgatgttctctattaacttaaaaaattccattctcatcttttaaaatgtattaggttaaaccacagaaaattgcaaatatttgacatatttaacctgtaaaaatggctttttcctgctgttcaacctaatatttccttttaatttctttgatttttttgtatttttctagttattgatttaaggcacttaactgatttttgatctatcttttgcttttctaatataaatactcatgactatacatttcagctacatcctatgagtcttatcagtatttttgttttttgctaagtgtttttaaaattccattataattactttcttaactcaatttatttatgggtgtgatcatgtatttttaaaaataaggaagtttttccattttaaaattcatatggtaccaaaaaagagcccgaatagccaaggcaaccctaagcaaaaagaacaaagctggaggcatcacactacctgacttcaaactatactacaaggctacagtaaccaaaagagcatggtactaatacaagaacaaacacatagaccaagtgaacagaacagagaacctattcactgccaccaataagacggcacacctacaactatctgacctttgacaaacttgacaaaaacaagcaatagagaaagaattccctattcaataaatggtcctaggataactggctagccatatggagaagactgaaagtgacccctttttccttacaccatatacaaaaatgaattcaagatggattaaacatttaaatgtaaaacccaaaactataaaaactctagaagacaacctaggcaataccattcaggacacaggcacaggcaaatatttcatgatgaagatgccaaaagcaattacaacaaaagcaaaaattaacaaacgggatgtaattaaactaaagagctcctacacagcaaaagaaactatcaacagagtgaacagacaacctacagaatgggagaaaaactttgcaaactatgcatttgacaaaggttgaatatctagcatctgtaaggaactgaaacaaatgtacaagaaaaaaacaaccccattaaaaagtgggcaaaggacatgaacagacacttttcaaaaaaagacatgcatgaggccaaaaagcatatatatatatatatatatatatacacacatatatatacacacacatatatatacacatacacatatatatatacacatatatatatatatacacatatatatatatatacacatatatatatatatatatatatatattaaaaagctcaacttcactggccattagagaaaaatgcaaatcaaaaccacaatgagataccatcttacaccagtcagaatggctattattaaaaagtcaaaaaataacatgctggcaaagctgtggagaaaaaggaatgcttttacactgttggtgggagagtaaattagttcaactattgtgaaagacaatgtggcaattcctcaaagacctacagacagaactgccattagacccagcaatcctgttactgggtatacacccaaaggagtataagtcattctgttataaagacatatgcacatgtatgttcattaaaacaccattcacaatagcaaagacatggaatcaacctatagatgcccatcaatgacagactggattttaaaaaatgtggtacatatacactatggaataccatgcagccataaaataaaatgagatcatgactttgcaggcacatggatggagctgggggccatactccttagtaaactaacataggaacagaaaaccacatactacattttttcacttgtaagtgggagttaaatgatgagaacacatggacacacagaggagagcaacatacactggggcctattagaaggtggagggtgggaggaggttgagtatcaggaaaaataaccaatgggtactaggcttaatacctgggtgacgaaataatctatgcaacaaacccccatgacacaactttatctatgtaaaaacctgcacgtgtacccctggacttaaaagtttaaaaaatgtagttttcaatactgttagttatctttttgttattgacacgattcctaacttaatttcattttgatcagcagatgtgatctgtatgaaaaattccttgaaattttattgagatttggagaacttttgcttttttttttaaagtcttaatattgcttgactttttaaattctattcatgcattatgttgataaaatttaatcaagtactgtatgaaagttaatgcagtctatttgttaataaagaaaccaacctaaaataacttcatattttaagagcctcacattaccaaaatcggtcattctacatatgtttatttatttatagactatcatgctctccaaagatttaaaaaggtgatattatgttacctgccaatagctggcattcttaaaattgtatcacaaacacaggttaccatgaaagcaaaatacaaatagaactagaaaatggagatacattttaaacttttccttgcattgggtggttttttcttggtacacactgaaggaattcatctctgagaatctggctaaaattcatttgctttaactgcatagctgcgccccagtgggacacacacacacacacacacacacacacacacatccacgcacacacaaataggggaaatggattgtaactagcagcccctggggtccaggaaccataagtgaatgagagatgaggcttctggttaaaattcaacctcttgctttcctttgggatgacactggaggatgtttcattattcttattcccagttctcatggtggcaatgatggtggtaatagcatagtgaaagcaccattgatgtgccaagccccaggccaaacatttcacatactacattttaattttcacaaccacctttgaagcagacattaatattactctttctttacagatgagaaaactgtacgaaggggccttagaaagatgaagggacttgccccatgaatgatgactcagccaggcctgtggggttcaagaagcccctgctgccctaccacactaccaccttccatacttagtctagtggtgactctcaccacactgggcatgctagagaaggcagctggtcagaaactggagctcagccctctgctacagccttgtcactggcttcctatggctctgaggcaaacgcccagatctcagcttgatcttgaattcataggtatgaactctctgtgcaggtctgtgagttctacctccttttccatgcaccttcagcctcagaggctcatcctttcctgcagtggcaactgaatggctgggttttatagggctaagtttttcagatacctccacaccccaagagtatatgtatatacaacaaaaacatcatcatggccaagcctctccaatgtcttactaaagcattctaaacaaagtatgctttaggcgttttactgctacattctgaatcacattcttctccaagcaaccatctcaacgtctcattttttccattagtaagatgattatatacagagtgatctatttataatgagccccagctcaagcagtatagctttcagttggcctcattttatataaatctttctttgttaattaatgtgtcttatcccagtgttgcaaggaacatttatgttcccgaattggacaggaaggaagcaaaccacacccaaggtgaaggctccaaaatctttagagtcaatatgaatgtaataaccgtttgaaaacaaagtttaaagctgggttttgtgcatattttaaactaaggaagttgtacaacagagtccacaagagagtaaaaagtgatgtgataattaggcggccatgaattaaccccctggtacttgcagctctgtactatttttaaagacctccttctcacctcctaagatattttggacatgcaaaatgcctaatgcgactaataaggcacctagcatgaaagttaattaatgaaaatgaaaacacgaaaactcaggttatttagtaataagggcctggagccagatcccaattaaactactcttgtggcgaagggagggatcaaaatgcccaataggttccatctggctgcttctgtgggtcaacgtagagtctcacgtccgtgtcaaattagcttttccaccctcttctttcccttgcagtgagaagctaaaggcagtcctccccacactgtactggggaactcccaggctctcccactcacatgtaaggggcttggcggctaagaaatccagctggaagcgagcgagcatgatttgattcacccgctcttcagagtccaatcccttttgtcattcactccactggaggggccccctaaacctccaatcccgtttgtaccccacctaggagatctgataatggtcctggcagagctgtggcttttcgtaacttctggcaggggcctcgctgacccataacatgacgacacacatgatttcttctcatactgtctttgtaaattgaccatggctaaccttgctgccctaatcagatcaatcagaataacatttttttagctgctgcacacaggaagcctcctgggctgaggcataactcagagtcaggctgggatacagaaggcagatttttgaatttccaatggtctcaggtttcctttgcttttatcacagttggtgagctttgtaaggtccgtgtttacagccatgcaaattagcctcagctggagggaaatcaggtcaggtctaaatgaaatgaagctctgggtcaaaagtattttatcaaaaattggaagtgtggccatagcactggggtccagccagactatcctaggaagtaagtggacagttttgtctggtgtaacctgagctccaggcctctcgaccgtggaaactctgctaggagacggaggaaaaaatggtggagggccaccccagcacaacgggggctggccagttccaccactggctgctgccgccaaatgcatttctgttatgtaaggacaactgcaaagagagaatactgtataccggaaggtgggaacattgtggtttgagtctggtttgcagtatatcccatgccgctcattgactaggtaaaaatctaaattcactgtttcaatcttacacacactcagtttaaaaatgtatgtgggaacgtatccacattcagctaagttctgagattttgcatctggaaagcatatttgcaaattttcactccagatgccatgttaggtatagaagttaaggtcagaggggttacatgactggacatacaacaactacaacaactaatagttaccttcaagacgagatctctggctgctaatttccactgcagttttctctatcatatttccagtacttcaatacccccactacataaaaaacttggtttgtttaaaaataactctccaatatatataccttacatttgggggattattaaaatcagaacaattatttcctgaacccccatgtacctatggctcatacaatatgctactgatggtttgagacagctctatccatctgattaggcctggatctgagcgctaagatattgctcaatgtgtaataccctcatctatctgccttctaaaaataaaatgaaagttggcagatcttgagtgtcttcatctgcaaagaagtcatgaccagatccttggaattcatataattaaagtttatcttttgacagatgagaaacctgagatcggagaatttaaaggacttgttcgggattcgatatttggttagggtcagagtcagaattagaaattatgtttactgacaccaaagctgggcacttttttcactatacaatgaccaaaaaataaaattcagtcttggccaagtgaatttaaagtcagaacttgcagttaaatgcagacgaatgcccatttatcaagtaattaacaacacaaggctgggcacggaggctcacgcctgtaatcccagcactttgggaggtcaaggtgggcggatcacttgaggtcagtagttggagactagcctggccaacatggtgaaaccccatctctactaaaaatacaaaaattagccaggcatggtaggtgtgcctgtagtcccagctactctggaggctgaggcatgagaattgcttgatgaacctgagaggtggaggttgcagtgactaggcaacagagtgagactttttgtctcaaaacaaacaaaaaaataagctgtggggttgttgctggaaacattcctttgctctttagaactatgtggtactacgcaagttgcccaacccctctaaactccagttttctcatgtataaaacaggaacaataataggaaccgtctcactgggtttttgatcaaattagttaatatatgacaggcacttaaccaaaattcctcatttagcagtggcactactagtgatatctttattttttaatctccacttgaatgacatcaaataaatccaaggtcattgagacttctctgttcatattaagcatgtgcctgtgagggcatgtgcaggggctgttctgactatcacatacatgggagatgtgtgtattttgcaaagcacttacaagttcaccttcaaaagcatccatgtgacctggacttgcaaccgaagtatacatatatgatctttccctattcttgttacatcttcacatacttctagcttggaactgaaggccagaggactcactatcaccatcaaggtcccaagcacaggcgctcagcctcatcctgttgtctagctccaaccccgtaacagaatctcagaaaatggcctggattgaggataaatgaatgagatttgggaaaatataggcgagacttcaaaacttccctcaacgagaagataaatattttttaaagcataaatatttagaatggttctctcatagcatatcctgtacttttttgtgttttccaaacagataaccccaaatctatattcaaataaacttttgcttttcactctcttccgatatggaagattttaaagatgtgtgtgcgtgtgcgtgtgtgtgtgtgtgtgcgtgcgcgcacgtgtctgtgtgtgtggtgagaaaggaattccagaatcagtcccaaagacgctaactctaatattccatatatttttatactgcaatcattcattctaagcactggaaccatggctactaatgattttttttctgctaataccttcaagtctttctaatatgcaattgactcccaatactctgtgtgggtaatttgctgtgaaatttggcctcatggtccacaatagagatatgagaagactaaagagagagctgggggcagttactctcttccaggttcctgttctgggggttctaggatccatgcaacttttatctttgtatctcagcattctaaggtgccctcttgtggtgtggggtaggaaaagagcatcctaaatgcagctggctggagacacaaatccagatcaagttactgttgaacagccaacaagagaaacatggttgaactccaagaataatactcagatgcagcattctgaaagaatcattgatattcatatttgacaagtcctaaccactcttttttttttttaaaaaaataagcaaataaaataaacgtacaacttctggggctgtctcatttccaaataaaatttacaaggtggaatttttgtaaactggtgcctgtcatggagctcctgtttcctttcagtaaatgcggccagtcaggagtccttaaactgaagaacaggaaagccctgatcattccagatatcactcaagaaatcgggacagagcgctagtttaggcccccaggtcatatattagtacaatcaacacatgggcaagttatttcactcacttctatagatgataatccctaaccccattgctcagttgtcaacacgtgaaaaacgtaaaggggtagacaaacctatcaccaccctcatataaaaaaactaacgcacattccttacaccgagggagcccagagaaattatctttgtacaccaaagctgaaataatataaacttggaaagcaataggttatgaaaaccctataaatttatgttcaggcttccaaacaatgttcttcttccacccttctcccctccccaataaactgagacataaagtctgggatttgagaattacagctatgatccttgccaaagtgaccaaattacaatcaatgctgaaggcttttggcaccacaaaatttcaacagactagtatctgctgaaccatcacaacccccttcccccaaagtgtttggggaatagccattatctcattaattcttaagaaatatctattaaaaagacagagacagagagggagacggggagagaggaatccttttacatatcttacagaagaggaaacaaacagagatgatttataatttagtcagatcatggcatctcaaaaaaggaggaatattggcagatcatgctgattttcagaatgtcgttgggcaagtttaaaacacaattggaaagtttatcagagcagttctttttttttttttttttttttttttttacaggaaccaggagaaagaatcacagacaatgaaggtggatttctggctccttgtcaaggtgctgacctaccttgctcaggaacaaatgtcacttagagacagtgtaaatatgacatattgacaggggaaactctttatctttcagtgaaaagagactatacaaacacgatatgtactactagatgtccgaatgtatcactaacggaagttgtgggatacttccatgaatatcaacaaacaagaataatctagagattcccatttgcaaatagttttaggaattgacacattaatgctttaagaccttaaaaaccttgggaatcaaagatgtttaagaatttctttccaaagctttcacattagttcataaactaagagattaatgcaaagaatacttaacgtactcttataatttcatattatacttataataaccatattaagggggtgttattcccaatttcgtagagaagaaatcagtgtgagaaggttaaatgactttttctgaatgttacgaaagaaaaaaataagagatagtagcaagtggtggtggttccattgacagctggtatcttgagctctggttcttaatttggttactgccatgtttgtcgtggcagagtggtctagtatcacaaatgagaatggcacctatctaagtatgcaatataaatttgtaataattagtaataaatttattttattatagctaatattttaaatggaattgataaggtcaaagaaaaacaccagctccaaatctatatatgccttttgctggagttacatagaaagcacatctttttactcaaagatttggcttcctattggaagactctgaagaaaaccatggataattacacaatgtaggaaatactttggatatgcagaagtgtggctatattttgttgatgtttttaataatggctactctcattcataaacttcaaataaatcacccgaataaaagttgatactatcaccaaggtggcaagttaccatttaaataaaggggaaatgcagacacatgctgatgaacaagtgttcatcatcatcaatgtcttcccagttaaaagtgtacaaacccctacaagtcactttatctttctcggtcttagtttcttatgtgccatatgagagaaataagatgatgggtaagatttcttctaattcctagactacatgatattacagaacaggatccctgcctagtttgagaagatatacatacatacatacatacatacatacatacatacatacatgcttaaacaagtgccagtgatatgaaatttaaatactattttagtagttgaagctagaaattagtatctgagttccacagactcttgatcattctgtccattacttctgaaatacaaacgtgaaatgtgctgagggatgaagaccagctctatttaagggatattcatggctgggtgcagtggctcacgcctgtaatcccagcactttgggaggccaaggcaggtggatcacctgaggtcaggagtttgagactggcctggacaatgtggtgaaagcccgtctctactaaaaatataaaaattagctgggcgtgatggtgggtgcctgtaatcgtagctacttgggaggctgaggcaggacaatcggcttgaacctgggtggtgggggttgcagtgagccgagatcacaccattgcactccagcctgggcgacaacagtgaaacactgtctcaaaaaaaaaaaaaaaaaaaagacattcatattcacgtttcaatgctggctgaagccctatagccaagattcagaattctggattttgaaatccagtaatgtacccagcactttctcttgttcagtcattataaaaagacctatctggcaagtatcctcctggtcttctcatatgggaaccattccatgatccagctgaaggagttggccttcaatgctgaaactcctcagctgctcaccacctctaaaaccactttcattttcaagaggaaagaaaacaaacatctgactctcagaagagaccaagggatccatcttgatgttggaaatctggccacaggcatggagcaaagattataggaggcaggtttggagttttctggcatcaattcagcttgctattttctttaaaacttaaaacctcagctctaaggtaggacacaaagctcactgaaaactctaagctgcatattaccacaaagctcagtagacccaattttttgcctccacttacagagaaaagcaagcactacacaagtgcacggattccatggggcaatggcaaccaccctgttcagaaaacttaaagagtttaaatgaagtgttattttccccctcagacagagaaacaaaataaatgttatcaagtactaactgccttaaactcctttgttgaacaggcaaactattataagaaaagaaataataaatgaccaaatgctttgatgtttaaaaacaaatattcattcaccaaaacagaagtgaatagttctatgagtaaacaacatgttttcaagcatctggagagaaacaaaaagagtaatagcaatctaagaagcaataaagaacaaaagtaaatttaatacgatcctgcataagaaagcattcagaggagattctggtgagttcaggcaagccttcctgaaagaggcaaactgaagttggctttggaatatacagattttccttttgccattcaggtagaaacaagtcttctgcttctatagatggcatttaaaaagccagcctggctacaaagcaggcttacctccatctcatatgaatctaattgcatgggaatacattctatgtaaatcagctgacctttttttgcccggatttgtctggaacttactatttgtattaatccattttcgcactgctataaagatactaccaacatggcagcaggagagagagggtggggtgagagcggcaccagaaacttatggaacaaccaaatctcgtgagaactcactcactatcaggagaacagaaagggaaatccacccccatgatttaatcgcctcccaccaggtccctcctagacacgtgggtacaatttgacatgatatttgggtggggtcacagagccaatttattagaaaaattcaaattgttccatgcaatatagccttttaaaattttcctttaatacttctttggatatttttctcaagacaacacaattacagtgaccttgagaaacattttgatcatgatttttatccgtaattgaagtcagtgggaaaatctgatttgattaacagaaaactgaattcagacattttccttttttcccctgtaatttgcagctaatttcataatcattacattacttgagaaatgaactgatgatgaaccccatgatgtaatttaacaaggaaacgtagcctggcacggtggctcacgcctgtaatcccagcattttgggagggtgaggtgggcagatcacctgaggtcagaagttcgagaccaacctggccaacttggtgaaaacctgtctctactaaaaatacaaaattagccgggcatggtggtgcatgcctgtaatcctagctactcgggaggctgaagcaggagaattgcttgaaccccagaggcagaggttgcagtgagccgagatcacaccattgcactcccacctagatgacaagagtgagactccgtctcaaaaaaaaaaaaaaaaaaaaaaaaggcagggttgatggtatcattcaatattacatacttttcaaaacactgcctcaaacctgcttagatgtgaatttcacaacatactggtgggtcaggtagattcagatattgttcatctttttttttttttttagacggagttttgctcttgttgcccaggctggggtgcaatgcggcaatctcagctcactgcaacctctgcctcctgggttaaagcgattctcctgcctcagcctcccgagtagctgagattacaggcgcccgccaccacacctggctaatatttgtgtttttagtagagacggggtttcccgaaattggccaggctggtgtcgaactcctgacctcagctgattcacccacctcagcctcccaaagtgctaggattataggcatgagccaccgtacccggcctgtaatccttttttatagagaagggaaaatacgacaaggaagacaaccagcccaagctcacatagcaagtcaatagcaacacagagtactatactttttcctcaacaccatttctgctactattaaaaataagaaaaactaaccaaccaaacaaaaacccactaaaacagggaaatggtagccgtagtagtaacagtagcaaaaacaagagcagctgtcatatgttgagcactgacagtgagccaggcactatgctgagcctgatacatggattaccccattgaataattacttagagaacattatgagcagatatcatctcaggctatggtgcagggacccagacacagagagtgaaaggacctagtaccgttgcctcagatctcacagtcaatgtgtggcagaggtgtgattcgtcctcatggttgtctctgactgcctgacagtcctaaactcattctcttacagaaagctggtgcctctcaagtttttgagtccttgagtcactactcagaagccaccgtcataatgaggtctaccctgaacaccccatttaaaattgcagacctcacccccaccctactaaagtcgaccctccttcccctgcactactatgtgattgacagggtttatgtttagtgtttgttaatataagctccacagggcaaggatttattattattattattattattattttacttttattttttgccctcaacacataccaatgcttaagacagtgctgtccaacagagctttttatacaatggaaatgttttacatctatgctatccaatacagcagccactaggcataagaacaaaattggaaagtcgaaaactggctagccatatgtagaaagctgaaactggatcccttccttacactttatacaaagatcaattcaagatggattaaagacttaaacgttagacctaaaaccataaaaaccctagaagaaaacctaggcattaccattcaggacataggcatgggcaacgacttcatgtctaaaacaccaaaagcaatggcaacaaaagacaaaattgacaaatgggatctaattaaactaaagagcttctgcacagcaaaacaaactaccattagagtgaacaggcaacctacaaaatgggagaaaatttttgcaacctactcatctgacaaagggctaatatccagaatctacaataaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcaaaccagttagaatggcaatcattaaaaagtcaggaaacaacaggtgctggagagcatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgcccaacaatgatagactggattaagaaaatgtggcacatatacaccatggaatactatgcagccataaaaaatgatgagttcacgtcctttgtagggacatggatgaaattggaaatcatcattctcagtaaactatcacaagaacaaaaaaccaaacaccgcatattctcactcataggtggatactgaacaatgagaacacgtggacacaggaaggggaacatcacactctggggactgttgtggggtcgggggggtggggggagggaaagcactgggagatatacctaatgctagatgacgcgttagtgggtgcagcgcaccagcatggcacatgtatacatatgtaactaacctgcacattgtgcacatgtaccctaaaacttaaagtataataaataaataagaagaagaaaaaaaaaagaaggtggttagtccaattaaagaactaaattattttatttaatttcattatttaatagccacgttaccatactggatactgcaggcctggaacaaatgcctagcatggtaaacccctaggaaatacttgttaaatgaatgaatttataaataaaacctattttccatataacctgtagactactttcactaactacaaattaaattttatttttatttcaacagaattaatggctgaaaaagtccagattaaattttgaaaattcagaagatatggccaaaatagcaggcacagatttcatgaactattggctccctttgccatctgccactcaaaaccttctgaaacatttcatgaaaccagggaaagcaccaacagcatgtaatgaattcctatgaatcacacacacacacacacacacacagaatatgtaataaattcctatgatacacacacatatatgtataggtatgtgtgtgtgtgtatatacgatacacacacacacacacacacacacacacacacatatataccatttccctgtataatatataattacagctttgccataatcactcagtacctttttgaccttgtttttcttctcataagtctctgacagaggttttttcttctgttgagttgtgtctttggagaataaatactcaaattcactggggtcccgaatgtcaggttcttctaaggagtcccataaggttggtgtagcattttggcttaaaagagaaaatgacaagttaaccataagaaccaaaacaggaaggaatgtaatacaatgaaatctttctctaatccattttttaatttcatttttctaaaaaaacacataaaactctaataatgcttggagaaaagctttttatgttacgcatttgttaaagtcaaaatatactatagaacattaaaacacacacagacgtatttccaaaaaagtaattgtcattagctacgatcaaagatagagctctacagaaactccttaggactagaaatcctgggattcggattcctgggggcacccaagctgctcctccctcagcctgtggcatttccatgatgtgtaaaaatgggcatcatataaaggctgagaagataaccaatttgagactgtgacaggctaattctgaaggagactgaaaatggagtaccgaagtaaagacctgcctcctctttggactttttcaactacttttaaatacagtttttaggattcatgcaggtaaactcagtgcagcgtccttaatatgtaaacaggctgtgcctattttaaaatacatgattcatagtatctcagtcccctaaacaatactaacaacaaaaaccaaccaaaaacctcctccattgcacctcatgggatatcatctaaagtagccatagggaaactgggctgtttcatcttccagaaacaggggcaccctagttttgaagggaagaaaagctcttgagaatcaggcgtaacagaacagcctccgtgagctgactccagtggtcactcctcagggttccctcagtcagaacacatctcccaaatgtttactttcttatcttaatttcaaacactattaatgtttactggtcaggcatggtagctcacacctgtaatccaagcactttgggaggctgaggtgggcagatcacttggggtcaggagttcaagaccagcctggccaacatggtgaaaccccatctctactaaaaaatacaaaaaattagctgggcgtggtggtgggtgcctgtaatcctagctacttgggaggctgaggcaggagaattgcttgaacccgggaggcagaggttgcgatgaactgagattgtgccactgcactccagcctgggtaacagaacaagagtccatctcaaaaataataataataataaatactatcaatgcccacaaatttcatctatatacttattgtttatcaaacataggtatatgttacaatccataacatctaaaagtatatagctttatttccatacctattttctcaatgaaaactaaaaagataactattattacatggaatggtccacagaattttgtaatactacaggtgattttggtatttaaaacagttggcagccctggctcctcaggtctgcgtgttcacactttgcaatagatctgcctttcccatgatatatgacattttggttttggccacattcacctcttctctcctctactttttattttttaaattatgatttcgccaatagttgaaccatgtaatagtatgacatatggaagttataaagtataacaatagaatgaacacctgggaaaccattacccaacccaagggctagaacatttccagtgaagtacatccatgtatgtgttcctctctcagccatacccctctgctactcacttaacttcaacttgaagcataagcaccacggatgttaagtgcttatctctgtggtgctgggggagacgggggagaagtaggatcttgaagaaggaagtcagctgggaattctggagtgagcatgcggcatgttaagggccactggtctgggccttgggaaggttctgggcagctaaggggtgacgtctagagtgaagtgatgcagagtgtcaggccaactgctcagccccatccccacttcctgcacctgcttggctctagccccacggactctgaggtcaggccagtgtaactagtattataattcacttatattctggagtaaattggctttgggagtcaaccgtgatcagtttaagcacctgatcaccatttacaacactatttctatgggaaaggtatttccaatactgaatgaaagaattttggaacactgcctctcagtgattttgggacagccagcatttggtagggcaataataaggacgtgcttcccaacgaatgacctgccatggtggtcaactgaccactgaacatacaattctagctcaaaaggaaggcagggggagagagagagaaagaggaggaggaaaatgagaaacttactaagaagctgaaaaggtagttagatgaggatttatttttccttaagtgtctcttgcttattctagaaatcacgaaagagacacccaagaaggcaaaacgtcaaaagaaaaaaaatcagttcataccaggagtcaaaagcaatttaggtagatgagaggcagtgtacacataatgctgaaaattcacattttgtttctggcttcccagaagagcaagaccaacatttatgatgcaatcattatataaactacttaatcctctagttgcacaaaatattaaaatatgattttgcctcctttatgagaaggtatcccaaataattgcacttttgctcctaagcaaatactccacaggctctttgagtcattttcatttaaaagcagtagtgctaataggtacaaaaagttggagggacccataataaaagaacttgaatatgtggtaccaccaggaagtgcccgtgttgcagtcttaacacatcatagaggggcagccccccgtgttatgtttcaggttcaaatgcgcaccaagcagggctctcttgatgtcctattcatctacttttcattttgctcaaaagtaaagccctagatttatgatgaaaccagtgagaccttcagtattcaattgcttttcttctcaaaacggccaactaaatgaggaggaaacaatgtagacaatgattgtctccagctttcccgtggtcgtgggtgaagggcccacatctcccagtgggactctttgatggctgctgtggtccacagttacctgttgctcatgaagtctctcagggaaggaagtgaaggcaggctagtgggacacaggtgtggaacagctccccgtgctgtcggacacactcgtccagggcttacaggtgggagctattgccctggaatggctgtgcactaatttgagaacactaatacggaaacatgactcaaaataaatattctgggaaatgattttttaggaaatgtctgagtctttattgggaaaaagggaatactagtactttagttaatggcagaagctattacaggatcatctcacttttttatgaaccattcatttgggaaattacaaagtataattgaattttgtaaaaaagaagtatcaggatgttccaaaaacaaactcttggcccttattttttggtgagaggaaaggggaaaatatgaagcacatatgcttagttttagggtattccccactcctccacagggatttctggttgttttatcattgtgagttgtgtgttattttgtttcatatcctgccttgcctaagcaaagtgttatataaattgaagaatgcattaccacatgacttgggaaaagctgtaaaatgtgtcctatatttgctgtcctttacaaacaaactttaaaggagaaagtggtcaagagacaacttaagatctctttcactgtcctccttccaggctcagaaataaggcagaacaaatcacactcaaatctgtttgaatggatgtttccaagcaactatatcttgctgctttacaaacccagcttaacaatctatacaaatggaagatgctttcagctatccacatactgacactttctctgaagggcatcaagacataaaggaagatgtgagagtacttagcagttaaaagaaacagagttcaagcagagagagtttgtattttaagactctcctctgatctaaagaactaataacttagccatgtctcattcttttaataaaaactgaagaacacccatttctgttaaatatctagattatagggttgattatagtatttaaaaacaagacagtaaaaagaattctaaaaatcctcagtgaacctacagtatggaaatcaggttcaattctttatgattactaatcaattgtagtgatgttggggaaagctttggcttagatccggactcttgtctagtctgtaaaatggaacatttgccttggaaaaaaatctgacactgaaacacatggtttctcccagcatcttcagagaatacagagaggccctgatggagacagacaatctccccaaacatcccaacattgtttatccaagcattcactgtatcacacttgataatgggtgctacactatggagatattgacccggtaagaataaaatatcacttgggccaaatcctaggaattcacatgctgagaatgggataggggagaacttacctcctatcacttatttgtatcctagtccaatataaaggcttcatgggacaactgggctcgatggctggttttcgaggacattgactggaagaagagccaagtccaaagaagagtccagggggaggtgggggtgcaagtcctgggggtggtggagcaggaggaggccctccagggttgggtggggcaggggagttaggaagtgggggtgggggtgggggtggtggaggtccagcacttgaaggtggaggtagaggtggcggtggaggaggcggaggtggtagcggtggcccagcactcacaggtggcattggaggtgcgggagacaaagatccaagtcctgaggggaggggcggagggggagggatggatgcgggaggcggaggcaatgccttctgctgatttgatgccatgccctccattggctggagtgctgcatggatgtctttgtggtcatttgggggtgagagctggcttaaagaggagatattcagctttttgggtactaattgattacttctggttgtcttgctttcactttcacagggcttgaggaaggtctctctgtctgtctggacgcacacatttctgaaggtctttggagggcagtcatcatcggtggaaatgcacacatctttcctctcttcacaaccccctcgccatctgtgttctagctcgtgtttcagattttcaatggtttcttctagtctcgctgttatcattgcatgctcgccccggatatgaaatgcccgaagttcaaactgtgcctataggaaaattcagagggaaagaaagtaatgagtttattaagaacaaacttaagaatttagaaactcaataataccatcatggtgccactgtagcatggcccacataaatgcagggaaatacagagacattcttttaagaatccataaaggtgtaaattgcactctgaattttccagggacctaaacaggcaggagtcaaagcacaatttcaaccagcctgagctcacgggagataattttcatggattaaggcttaaagtacatctattacttaagaactcttacccaatttgcatatcaaacacaaaacttttaataaagttttggacatgcttgaatatctatctgttttacaacttttcgggttggtttcaaaaaagaaaactataaagaaaaaaataggtttagagctcctctggcttagagctgttctcccagtcttccagaatgtctctttcactgagtttccaggacaatacagcagacacagaaagcaagggaagaagccacgataacttacttttttaaagtttccttataaaagcagcccaagatcagtatttgtgtctgtttcataatatagcaataaataaggaacagagaacataaataatgaagatattatagtatgccattttcttctatttacacagcactttaaagtatataagacagtagtagcctttttaatgcttattgcctcagttattttaatgcactgagtctgtaattgtacacttattagcacagagctagtgtactcgcagtcattaaccagcccgttcctcagcattcaaagctattcatcctattacagttaattggaaagcaaatttagaattttattagagttttcaaaatccagtttaacagtaattaaatattttttgtcaatttatttaatttctgcctcccccatgagattataaactccacaagatgaaactggtgacagtattgtctttctatctgtatcccagcaggtagcccaggaagtacatacctcagcagcaatggatggataaaaatcactgggatagttatattcactgtcattgtcactgtcccaagagcctcccttatcaagactctcttcactataatttcagcacaaatatctagaacacctaaagcatgcacaagtacagctcccttttgcattgaaaaagtaaagaaatattttaacagccttggagggaaaggtatacacacaggaagctcatctaccttcattgagataacttttatactatgatgtttgcatagttcagcagattgaattatgaagagatctaccatttgtctggtgttaaaaaaaaaaaagataacttttaactattttttactaggttcaacttttctctaatattcattctcaagagcaaacccctaaagggctatagtcaggagaactgaaaggcgaagtttttcgaaggctcatcttctcatatgtggacacggtctgagccaactctgagggaaggggctagctctggacaccgtctatttctcgtgcagtgcagagcgctgagtgccgagtttggactcacaccacctggttcacgtcttggcttaggcacttgcgagttctatgacctcagacagggaacgctgtgtccctaagcctgagtatcttcaagtgtaaagtataaataatagccatctctaggacttttataaaagtaaaatgagatacttcatataaaatagtaggcattatgcctggaacacagaaacgtttggataaatcttactgttagtttctgttgctaatgctaatgctaatagcagagcaagagactaacaaattcctaattattttttaaaattttcagacaatgctacctttgtagagggacaggcataaacctaggaaaagctcaaaatcaggataagcaaagtactgcaaataccaaagtttacctagccttttgtgagttctactaccgattacctaagtaatttcgagcttcactcaactgtgagatcgagataatctttgtttcaacatcgtatcatttccatcttcatttctctctctctttcctgtccacttccacccacatcttagccctgattaccaccctgaattacccacattttaatttcattctaatgactagttcggttctgtcacaacaaactaactctcagctgttattctcaactaaaccttctttcaagattaagaatcaaatattcaagaagcagtaattttactcaatcctcaacttcttaatgatatgaaagagtttcaaagacatactgcatggtgaaactttccctaataagggaaatatttttggtgaacttattgagtttctgcctcccctatcagattataaactccccaagatgaaatcttgtatctagagcaaaagccctggccccacctcctcttctttctaccactctgtcaacgatcttctaaatctgttgaagctgacatgtaaagctatatatcattttagcagctctgaggtaaggcatttgtttagtgtagtgggcagaacacaaatcgggcagttaagttcacctctctgtacctcagttttttttgtaagctaaatggggataataaaatgtacctgacagagcggatatgccagggaggcaaattaatatacgtaaaagaaaatacagaagagtgtttgcagcatagtaagtgctatttcagtttgccgtcattattattctctctctaatgcctggcagatcagagcccagtggccccattagcttgctcttggctctgggtacgcttcccagccccatgccctctactgtctacatgctctatgcttctaaagcaaaaatagacataccaaaatccttcttaaattcctttagctatggcactttccaaccctacctcttttccttcgcagcagaacttttttgaaaaaagcacttgacccatgctttatttttgtcattcattcactttcacccaattactggctttcatctcccccatcctattgaaactccatgatttgactgttgcattcaatcagcacttttcagtgattttgacctctctgccacatttgttaagagttgactgttgcacaagcattgaaattctgcttccctgaactcgattccacctctctccttttgttctcctcctacttctttgctgtccctagtcaatctgtagactcattcatccttaagtgtggttctcttggcatcttccttgccatttttttccttatcacactatacaatctttctagatgatctcatatactcatataaatgacaccaggtgagtaccttcaaacttggtaccttgagatcatatttccaagtatcctctggattaatctacttaaatatttaaccagctgcctcagatccaacaggttggaaagtgaactcattgttgccgaaccccaatgtgttcctcctctgaaattcctcctcactattaatgcctcatcgcctccagtcagcacatccagaaacctgatgtcatgctgaatttcttgctctctctcatcctcaacatgctatttgtcaagtgttattgatttctcttgtcacccccaccacctcaatctttcactggacaaaggcaatgagcattttcttgactcaaattcaaccactttggttccaagaagattttgaaaaaataaataaataaatgcagatccctagtccttaaaatctcttcaataattagctttacttgcagactaacatgaactttttagcacacacacatcaacagctcttctgatctgttttctgaccaacttctccactattggcttttgtcccttccccagatatgccctggattccagtttcctaaacaggtccatgctctttcatgcatctgggtctttgcaaatactgtcctcttccaatacccttcctctgttgcaaacactcaaggtagggggcagattaccaggcacagactccatgaatgggttcctcacatactgtattcactgatatggagaatgaccaaataagaaggaaaacaatgaatttccatgtaccatacaccaatatgctgcaatgatagtaagaaatctttctggatcactaaaatttaattgcctctctctgcccctcaccccccccaaaaaaacacttgtctttgacctttcctgtttcataatctctcttgatcattacaattttgtcttggttgtgttcatgacctcagtgtggcagagcaactcaaagtgattaaagtaataagcacctcattcattctctgtctgtccatatcataccaattatttcaaattgtgtctgactctattacaaatgaagcatctcaagttcatgcataccatgcatggaagttttgggaaagctaatctttaaacactatttttaattttatttcctgttagtaccacttcactttgtacctggatattatgtgctgttccccctcctttatccagatacacagctagaaagactggtaatgatttggtgattctaatacagagtagaacgttctgttagataatcatgtactcccaatctttgcccaggatcctgggaatcttcaggaagtgtcaaaaccagtcccttacaaaggaaactacagataatgccaggtcaaggaaacaaaatgcctttatatcctgttaactttacttatacattgaacatgtgcttgtaagcagtatccaattataaaccctccatttatttttagaccaatgttctttaggacatataaagaaagtctcaagatttcccctctctcactcttcctgctaaaaatctgctgatttgaccccaatacatcatttgaaaagagacaggtgctgaggtttgatatctttccagtctttaagttttacctaccttcctttactcttaatttgtttgcttcaattgctttcatttttaatcacatcctcttctcacctgcaatagtctgttataatatatgtccatctcttaataagaaagattcaaacttactagctttgagaggacaatgccaattaaaccatcctgttttgattaccccttttttcctagtggcacaatttttacctttctaataaagtggttctcaagccctgctcccattagaatcacctggagagttttgtggatgacactggtgctcaggcccatccccacagaccctcatttaatcaatctgagatgatgcctttgcacaggtgtctttaaagcactgcaagagattccaatgggagccagaggtgaaatcaacaacaactgttcttaatccgtattctgctctaacacagctgagatagtaaaacaacacaatatcaatgggttcttttggcaatgactttcacttaggtcatttcagaatctccaaagtaatgtgttatttggtaaagtccctttcctaattgtgattgcccaataaagggaatgttccttcattgtctagattgagaatagttattctacacagcagacaagcctaaattctttccatgatactcatggctcttcaaaacttggcctctgcctactttcccagatatttccctgctcttttcctatgctataccactacagataaccaacactcatatcttcactctttcacacatgctgtttcatctacttagagaaccttttatccattttcgcctggtgaaagccctgaaaaaaatgaaatcaagctcaactgaatcttctggcttaaacttttcttaattctgcttgacaaaagtattcctttttgtttccaaagaacattctaggttcatgttgcattatactcatttctgtttatcttctttgcaaatctaaaaactccaggcagttggggaccacaatttaatcatatttgaacctccagagcatcacacactgcttgcctagttagccatccacaaatgcttattgatttctttagtgttaaatattaagacttcttcatgcctctgcattacccatccatttataagtgaaactccaaaaaaatttaaggagagataaagatccttttctctttgctattcccatacacagcaaactcttaagacctgttagttgtcaactgttagacattacttacagactaatactgaaactagagcagacatactaaacactcttctgatctcttttctgttacttgctccgcttttggactagaaaactcataaaacatccaaattttttttttaatgaaggtatttctaaaagttgatgttgatcatgttagttttaataattcaaaatacttaacgtagataagaattctcttcacagtcagctcaaaggctattcccatacatatcataaaccacccggtagaaatgaaccacatttgtgattctaatctgattaggaattggactctagcaacttccccaggcctcctttggggatggttctcccttcccctaccaaatcctcattattttttaatatcctccccattaccactgctcagagatatcatcgaaggaacacactgtactaaaacccaagcaacagaggagacttttgcttgtctggtccccacaagcatgtctgtcaaaaagaaggtggaaaagcgcctactgatgaaagacatcgtgttggtgccaagcactgtggaaaaatcatccgttagcattttgttgttaaaaacattctctctaggtggtgctgccagggccaataaaaaatcaggttatctgctgtacaacttaagtcagtcagtcttttccagggactcttccaaattctacatccctaggctggggaaagctaggcagttcctgggggctgcatggaggctcaacaaagctttgtcacctctgaaaagtgcagcgtgagcagaagaaaggaaaggaaagtgaggcttgtgagcacaaaatgcctcgaaggaatgggattcagttcttacagaatgcttaggtaaggcaaggagatggcgattctatggctttggacatgcatacgagtttcttctgttttctttttgaaggctgtccagagacttcaataatcccttagttaattggcttatactagccactgtaaaaacaaaagtttctattaatgaagagaatggcattgggtttgatgagaacccataaattaacaaaagctggttttaattaactattataatttttttgtccttatcagaaatgtaagcacatcaagttacaaccaaaaggccatgtcaaggacacttagaaacatgaggcacatttgacacatttctgtaattagaacttgctgggagggataaagaaatagagaaacagggcaggaaaagaaggggtaaagagtaattgatatgaagctgactccgagtaaaacccaatgaatgcaatgctggagagtacacctgtgtaaaaatggtgctgacctcaagtaatcacctgccatgctgatgctcgagaaacacaagaagagaatccaaaccaacatggcgtgagtgttccaggcactatgctagccttcatccttgtgactctgcaaggcagacattctgggggacgttaatctgtataagatcccacagctgaaaaatagtaacaaggggatttcaatcctggctgatataaaaatttatgctctttctgccttaatattttgaatatcagatgactccctaaattgatatccagtaatactaactcataataattaattagtaaaactacattccacctcttacaatgcatttgcattacatcaatgcatataattataacaacaatctgtgagaatactggtattgtggctgttttccagatgaagaaagagaagcaatgaggaattaagtaaatcgccaataagagatagactaaatctactatccaccttatcactgatcctcaatgattaataatccttcccatgcaatatattttaggaagtcagtatgccaatacacaaaaaaagatactttctagtcacagatgctttcctcaaaatatttgccctccatcctcctgaaaaagatatggaatgattaagtaaataattgatttgaagtttcttggctctcaggtggaaaaagcattgggttcaaagacttgagttctattcctggttatctcaatcattagttacttgctcttagccaattttcaaatttcctctaagcctcattttatatatgtctgaaatgagaggtttaaaatacttagtcattaagatttcctgtagttctaaaacattagtaatttccacacccaagactctcgtatcactttgtttcaaagcttctttgaacacatctctattcataaaagcttcataagagcttaaagcatggtattatctaagcaatataaacagatagtcccaagcctcattatgaatgcaaatgttcacacaaaatcagattcaagaaggtactctgaaaaccagtgataagtatgcaatttagatacaattattctttttttttttttttctgagacagagtctctgtaaccaggctggagtgcatggcacaatctcggctcactgcaacctccgcctcccacgtttaagtgattctcctgcctcagcctcccaagaagctgggactacagatgcatgcccccacgccctgctgatttttttattcttagtagagacagggtttcaccatgttggccaggatggtctcaatctcttgacctcgtgatcccctgcctcagcctcccaaagtgctgggattacaggtgtgagtcactgcacccagcctattcattaattttgaaaggtgatagttaattacaagttttaaggaatacacctttaaaatcagcaaatataaccatggatagtcatccaaggaagtagcaggaaagtaaaacagatgtttgaaatctgcactgaggtttatacttgagacacaaaacaaaattgtagccagagtgcattttatgaaataaaaggcattattactcatcggggaacttcagtaatattttatttctaaattattaatatccaaaatataagtcacaaaatggatatatatccatggaaatgactttcagactctatttttccaaaaagtagttctaaacccaatgagcaaaactaagactgcacattttaggcaatgagccaacatactaattccttctctattaaaagagagaacttgcaattttatgttgtattattattatcactactgaagctgcagccagtccaatgaggcattacacattctagagtatatgcaagcttagaagaaacagatgataaacccaggtccttaatacactgtgacaaactggggttctccaattaattaatcattttaatatttccctctagatgcctcacacacttgtctataaacggatactatcccatggccaatgtccacctgcacaacagtatcattttgaaaaccatgatgcggattcctcagtcaggtttgccttacatactcccaacatttagtacatgtcttaaattggaattcggtaggaaatgaaaaaatgatattaggtcaattatatagaattatcaaatggagtcagttgatataaaaaggggccagctgttgagttctttctggtgtaaaagatgaaacttatacataagactctaggagtactgactagaaaaatagttcccgcaactttacaaatgatacagctctctgggagcaagaaggggctcagaggagtggttggtgatacatcttctgctatgagcttactcttcatagtggtgctgtataaacctggtagaatgcaaacaggttttcatcacaacaaagatggcctccctaccagccaatactcaaacaagctttgatgagcatctgcaaagtaccagatcctgtggaaaataagaaaccattcgcccggcatggtggttcacacctgtaatcccagcactttcggaggctgaggtgggcagatcacgaggtcaggagatcgagaccatcctggctaacatggtgaaaccccgtctctactaaaaaatacaaaaaattagccgggcgtggtggtgggtgcctgtagtcccagctacttgggaggctgaggcaagataacagcgtgaacccgggaggcggagcttgtagtgagcggagattgtgccattgcactgcagcctgcgcaacagagcaagactctgtctcaaaaaaaaaaaaaaaaaaaaaaaagaaaccattcatactttcagaagctcacattctaggtagaaacagtaatatatttgtaagttatgatgaatttccaggacaactgagctggtgtgagttttacagtgctattatttttactattattattcagacataactttttccttgacaactgaagaaaacccaggacctaccatcaaatgcatttgattcatccagcaaaagcataccaaagtcatttgtgttcactgtatcccatgagcagaatgctactccaagcccaaccatgcataaaccaacctccctgaattaatttttgcaagtaagcaaggaggtatttggctttccactttcattacttaaacaaatgaccgatgatgcatgcatggatcacaatcaccttctccttgccactttgagttttaccagggattagtcacttgagaaatctgccattgaatgggttttacgttataggcaaatcgacagggcaaacaaacaaagagggtttgcttgtctttctttatgatttgggttctggcttaggatgcctcctctaaaagaagctaggaggggaagtgttttaaatttccaaaaattgctcaccctagccaaaaggcacactcgttatacaagacataagatgccagaaagggatcacaaaattgaatataatcttaattccttaagaaatggacccaaagagaaatattttctgctagaatttgagtgtctaggtcagtttgaaaaaaaaaaaaacaaaaacctaaaatagggtcacagcacttggctttagctctgcataaggctgctatgtaaccttaaacttgctttatatatctgggttttattttctttacaaaccaggttttctagggatccaaagaggtgcttcagttctgtaaactcagttttcacactatattaaaagaacatttaatcttaaatattgtgatttttaaaactgtacagtattatgccaaaaattttacacatttatataccatcagcagatctactactggggtacttggttaaccattttctgttttgttttgttttatttcagtctttggaataccaaattttctctgatttcctgaatctatgtctctaaaatggtttcattgattagggaaaattataactggtctattttccttccttttcttttttcttcttttaaaattcagactcatgcatatacactttgggaggccaaggaaggcggatctgaggttaggagttcaagatcagcctggccaatggcaaaaccccatctctactagtaacacacaaaaaattagccgggcgtggtgatgcgtgcttgtaaccccagctacccaggaggctgatgcatggaaattgcttgaacccgggaagcggaggttgcagtaagcagagatcgtgccactgcaccccagcctgggcagcagagtgaaactgtgtctcaaaaaagaatgaaatacatttcttataattcatgtttaattttagagctcttttattttattcaattctattcaaaccctgggattttaaaaggaaattttttttcaaaaaatgtttccatttgtaactattttgtaaaatgtgatttttaagattttctgtaactaaaatattacattcaaattaattaaattctgactgggtgcggtggctcacgcctgtaatcccagcactttgggaggcggaggcgggtggatcatgaggtcaggagattgagaccatcctggttaataaggtgaaactgcgtctctactaaaaatacgaaaaaaattagccggcgcggtggcaggcacttgtagtcccagccggtggcaggcacttgtagtcccagctactcgggaggctgaggcaggagaatggtgtgaacccaggaggcggagcctgcagtgagccgagatcgcgccactgcactccagcctgggcaacagagcaagactccatctcaaataataataataataataataataattattattattattattattacattctgtgctaacataagactcaacagcctttgagtcaacttttcagtcaactttgttgtcctcaaaaaagcatcttaatgaaaacacagaagaatatacttaggaccttggattaggcagagttcttacatatgccatcaaaaacatgattcatttagcacaggacagcaaaagcatgattcatttaggatatgttacttagcttgatttaggcattccacaacgtatacacatatcaaaacacaatattgcacacaatgaacatatacaattgttgtcaactaaaaaattcatttttaaaacagcatgatccatttaaaaactgatcaattagacagaccctttcacaattaaaattttctgtttgttgcaagtctctaagccacacagggaaaaaatgttggaaaacaaataacggacacaggacttgtttccagagcatagagagaattcagttaaaacaaaaataaggaaaaaaaaattccctccacgctccaaaaataggtaaaagatctgaacagataatctaccaagagagatatacgaatagcaaataagcacataaaaagatgttcaacatcactagtcatctcaacaggaagacacaaattaaaaccacataagatatcactgcacgcctattaggaggagggaggagagggaggagtgagagaagaaaacagaccaacctgacaataccaaatgctagtgagaatgtggaacaactagaactctcagattgctgatgggaatggacagtggtacagtcactttggaaagcagtttggccatttcttataaagttaaacacacactttccatatcaactatcgatcccactcctacacatttgcccaagtgaaacaaaaacataggttaatatgaaaatccatatactaatgtttttggtagctttatcaataatagcctgtgatggttaactttatgtatcaacttgactgacccccagggtgcccagttatttggccaaacattattctggatgtgtctgtgaaggtgttttggatgagattaacatttaaatctggaggctgggtaaagcagattgccctccctaatgtaggtgggcctcatgcaatctgttacaggcctcaatagaacgaaaagactgactctcccactactaagaaaaaattcctcctgcccagtggccttcgaactgggacataaagactttcctgtctttacacctgaactcttcttgggtcttgagtctgccaggttttgcacaggaactacacccccagccctcctgaatctcaggcctctagacacagaccacagctatactgtcggccctcctagatctccagtttaccctgcagattttggaacttatcagcgtccatcatcatgtaagccaattcttcataataaatctcttcatatacattttaaaatattcacattaatatatatctatatattttacgtatacacgcacacatagacgcacacatcctattacttatgtttctccggaaaaccctgatgaatacattgcccaaaattagaagccacccaaacgttcttcaactggtgaaaaaataaaactgcggaaagtgcaccaagtagaatcctactcagaagtaaaaagaaatggatttcaggtagatgccaacaatatggatgagtctcaaatgcactctgttaagtgaaaggagctgactcaacagactatatattgcatggttctatggatatgacgttctggtaaaatcaaaactgtactgatagaaaacatcaatggatgccaggagcctgagatcagaagaggggttgtcttccaatggacacagggaaattgtttacggtaatggaaatgttctacatcctgattgtagtatgtttacatgactgcacatttttggtgaaacctcagatggtacacttagaacagcaatttttttattacatgtaaaattatatctcatcgaaaaaacctcttaaagattgatattataagtgaaacatatatgttagatgaattaaaaattgtaaaataagtgaacactaatataatgttacataaaagttgggcttccacagcaagattctgtctgcaacaaaatctctctctgttgaaaaaagacattatcacagaaagtagagtaaaatgagtccgaaaagtatctaaagcattactcacgtcttaaagagactcaagtgttcaaatttcttgaggtaaaagtttaacctctttcatcaacactacagcattttgcactactatgacccatcttttagaggtttctctgtcgaggtgaattcagcgctaagacaggatcagtagtaatcctctaagatggtactgccacattcagtatcattcttacattgcagctacgtgggaacatggccaggcaagggggtgaatgacatttaaaagctcaaagtgttaggcacaatgttatgttccatttaacaccgtgatgtctcatttcttcccctgtctctacagcctgttttctaccgcattatacttatgatgagtgtgatttttttcatatttcatccataaatgcttccaaacaaaaaaagtttctgcttttataagaaaaaaagacctactactatcttctattctcaagccagcttgaagatttttttttaagttttgtttttcttaagccagcctccaatgcaaggattaggtttagcttaaaggactactttgggttttttattttcttttatgcaatagattaatattttttcttagttttaaagaacaccacctatcaaacagatagtctgtcccacagtgcaattagcacagtttcctcctatacttaaaagggtctccaagacagataagggctattattccatcaatatagtaagctgcaaattctccctcaggttcctactctgtaaaatgaggatgataatacccaccttgcttcttgatatatttttcatggggagagaaagaaactcagaagaaacttcacaacaaatataaaaacactctgagtaacaatgaaggattaatatcatattggatacaactaacagcaactatttgggattatagtacattatcaatcagaagctatgagcacaacccttacatctacgtatggtttatatgtttgtttagatggtggtggccttagagaaaagcgtgaacacattgtggctaagtgaaattcaacatttttttctacacaaattgcattaagcaggatccatatgtcatgagaatgtaaccttcattgcatcatccaataaaaactaggaaatcacttgtgtacaagacacactgaagttttgttgacattttttgcaagcaattttttaacatatttattgatacgtaggtcttctttcacccctacctaaaaaagtgcttaaggtctccttttctctgtttgttcatccatcaccaaaaaaaaaaaaaaaaaaaaaagaagggcaaaacatttgccttaactctatcccttcttcagaataaaatcccccattgtattcattaacaaatgttgcgcgaaaggattagcagttacttattatctttttatctttaccatacgctctgtgtaatttctccaaaggctggtttaggttgccaccatttgctaaaaatgctcacatagataactaacagcttcctaaactacccaatttggtggattttttcctcattctcctttggaactctgcacagcttatcttgagaacagcctcttggattctctgatagtacaaattcctggtcctcttcctccctttgagattatcctgcctgctgtgctaacgtctcttcctccttccatcttttaaatatgtcaactttatggggactcatgtttttattttttgttcactgatgtatcactgtagcaggggtcactgaatgaatgaattcttccaatatcctagttgactgttagaaatccttaaagctatagtgcccacgactactgggttctgttagcaaaagaaaaccaaggaagaaggaactgtaatattaagtagtgcccatgaacagcctgttacatacatgataaaaactgatttgtatgattactgcaattattcctcagccaggtcacagctgctaagtgcatagctgactgtgactacattcttttcaacaaatctggcactcttaagtccaaattgacaggtctatctccacacagacatggaagtttgttttgtttagtgcccctcccaactgacttatcttacaatatggacagggcccagatgacagtcgatcaattgatctcaaatgggtcaaaataaagatattaatattgccataactgtgaatgcacatcacattttaattggtaagaatttttatagttctaaatatattcccacttcaataacattaaggggccaatgcaggtgttttcgtccatgtgcatccaaatgttaggagttatttttcactgagagacaacaagatgatgggaagaggggtcatgaaaatacgctgagcaacaaaaagagccttgaaacagcacccacgataataggggttatagatttattctttgtggtggcaaggctctttttgagttcctgtatacaggcaattaagcttaccaaaaatatccagttatggatctatccaggaagaggcagaagtttctggagctgcacttgtttcatgtggaatacttgcaattgaggacatataagggctgacagtgtacaaatgataaagtgtatccgttgaggctaagcttatatgcttgaaaacaacagtgagaaccggaataagggtatttttgagtaacaagcaaattctaaaaccccacagagaagattccctgaccacagggcatcaatacccatcatttttacaaatagttttggcaaagtgtcacactgatttatttgaattcacaaagatctgatgtaatatttaaaaacagatctcttctttgtgtaaacatagattaagaaaaatgtaaatctcccatctaggtttattttttaatagaaattttaattatacatgtataaatctagagtgctcaatgccttaaccagttaaaataataaacggaatttggcagaacatttgttctgattactagatgtttaatgatacttggaacatcaagatgcatgtggaattacactctactaagatgaagacagaataacttggaaaagatcagatctcattttgacttgattctcttctcctggaatatagacaaaccacattcttttcctcccccaccttagattatactatattacttttgattgatattcatctccataatttgtgctttttgaaagaataattgttataagaattacgtatttcaggttttctctagtaattggaaggtatgaatttaaatctgacttatttcctaactgatcaaacatggactataatttatgaaatattttcaaaataaacatttaactatcctattcaaacttgaaatgtcacttcaattttagtttgactgagggttatagatggctacatttttttctcccaggcaatttttctattttaaatgttattagctgcccatattaataatgtgaaaaggcagagacaggataaccttaaaactcatacatcattttttcttaagtgtttcaaaggttaatacctaaccataaaggttaatgatacaaggtcagctgtataacatccacatgaaaccacatgaccgctgtagcgtttcataccattgacatgttgctgttttgtggaatgtatttgtcagttacaagagatgacatgcttgtttggtgccatgtaccctttatgaaaaaatgaactggctcaagtatccatgccagtcatgtactccgaataattacaaactacttcacactctaaatatttagatcactaggaatttcaacgttagaccatcacctttcccccgactgcacatcagagcagaaggctttctgactgcctgtccttgaacataacactaacacaacatatgaaactgattaggaggactgaggtgtttgaaagaaaaaaactttgatttttataaagattggcatgaagatcattcttctcagttgaaatttactttgataaaatacacccccttctcaactgcagttgccaagtataaaaacaaatgcctactttcttctgaatcacttttttatatttgtctcatgtatttttcagattttcacatcagtgtaacacaggtaagaataaaagcatagaattaaatccgaatatttacctatgaagaaacacttaacaggccagtactaaaacttggagctcataaaaggggaaacatgtctttctgtcgttgagtataatttagtttcaaaagatggttttttgggtttgctatgcaaaatcctctagcaacagtcacagtttctcagtactggtgttttaaagttctttgctttgggtagtgcctcgttgcaggtttaggagaaaaaaatgttaaaaggtattcctgacagctggcagcctgtctctccagtttttttttttttttttttttctttttttaggtaattaggttgctaataagcagggagtgagtgatgctgttggactccaatgtttgattctaggtcacagtaggacatagtcaatctggacactgacccatagctcacaaatcagaaaaaaatcatctgagaattagaaaataatctaccaagctcctatttgtaaaccctcaatacaattcttaaccttgcagagataaagcgttggggaagaggaagtattttacaaccttttaatcttaaaaaacaataaatttgaaattgagcaaagtatttgaaagaggtggccttactttcctccaactgatttatacattcgtaacagaagcgtgtttgagtttgtgtcatctgaagattctgctcttaaatatgctactttaaacctaagacagcatattctcagtacaactcaccattatgagttgagtgatggtttttctgcccatcacttagactgtagtcaacactttatctttggcagagcaatttccacatggcataaatgatggggcaatggactgggaagaggctcgactttcagtcatggtgcttctatcagtttcctgcctgcgtggtcttgagccctcttgttgctaactagaagtaaccagacggtgaatcttacagggtggccaacttccttggctacaataaaccccgttgttgttgtgatcatgtcacctccctttaatgtattgagaaagttgagaaccattaagctagattctaagaccaactcttttaccctttagctccccatctataaaatgaacaggtttccaaaatatcacaaattcaagtaagtctatgttgcttccacttaagctaacgcaaatcatcatgcaaatgttgtctaaacgcacaacatctgataaatgcacatttaagacagtcagaaacagtaaatgtcattctcccagcagaaagtcataaactgtcaaaaatatcttttaaaaaaccttctggaaacacagtttttccactacagttttcctttgtctctgagtttgaaaaatattacctgtgaaatcactttggtttacatccagtttccactataggggaagaaaggaagaccaaccagtgattaatttatagactaatgcattactgtgatggcagattcaactgtttgttgtttagtgaaagtttatgtccgtcatgtacatgacactggggatggaaggtaggtggaggtacctctgctttcataattataatgtgagaactagtctgctaagtgcctaagtcaattcaaaatttccgaggaggaagccttagggaattagagatggtttcatgtatgatgaggaacccttgcagggcacaaagaattggcaaaggtaaaatgatgattgtgagaaatccaagtgaaagataaaagcatgctggagggaaagtgtagggaaatagcggaagagaaaaccataataattccccaccctttgtagtcaagtgcagtttagccccttcacccgccccccaccaaaagaaagaaagccaagataaattggagggtcttaaataccatgctcaagactttgaacttaacttgacagacagtagtgagccaccagaggtgttttaagagacgggcaacaacctaaataatcgataaggtgggctgaatacacgcaagctatgctcaaggcctatgttaggatgatgggaacaggatgccaagcagtgagtatatatgaaaccacagagcccagattaacataatttggtaatcaactagatgtgaagcagagggtgcaggagttgtcaaggatgcatctgaggtttttggcctagacttttagttttaggagaaccatgacaccgtacatatacagggtagctaagaaagcagattgctttttgtcatgtttacattgggaggggaagaggaggaggattcagaaggagacaagtagatgaaaataaagatccctttctatggtgggcttataaaactttttggatgctctggttttgggaattttaaatttgagatactaaaaatatttcccagtgtagctttccacaaaaacttatctgtaactcaggaagaagtttgaattcaaataaataggtctgaaaagcacttacacagagataagcttgtggcaataagggaaatctccaagagacaaaatataaaaggtcaggtgactaaccagccacaatttggcgtgctgcagaggcaacactgggagggcagcaaagaagatagagaagcacaccgtgaggaagaagaaaaaaactgcagaattcgctgtcccagatgttgagggaggagttcgaggatgtcaacactgactctccaggatcagagcaaagaaagaaagacagataggagacaagtagcacaggacaattacttcatctgtttcagtagagttggaacggaattcaagtggtaagataatttgctacaagtcattaatgtttaagaattttgccagtgagagaaggaatggaaggtcaaagcaacagtatggtcaagagaaaggatttctaatgtaaaggatagctgaatttattactagaaatgggggaaagcacctgctaaaagaacaactgtattagtctgtcctcacactgctgtaaagaactgccccagactgggtaattataaggaaagaggtttaaccgactcacagttacacatgcctgtggaggcctcaggaaacttacagtcgtggtggaaggggaagcaaacatgtccttcttcacatggtggcaggaaggagaagaatgagagtcaagcaaagggagaagccccttacaaaaccatcagatcttgtgataacttactcactctcacgagaatagcatggggtaactgctcccatgatttaattacctcccaccaggttcctcccatgacacgtacggattatgggaactgcaattcgagatttgggcggggacacagccaaaccatagcagcaaccaaacgagaaaagagcagaagcagcagtagatgatatcaaagagaacaggtgaagaaacaccagccacctgcctttcttttcctatgcataaggccaaacctaacaaccaagcaaagaaataaaggcatttatagcccatagacaaaggccctcattctttattttctctcggtttcagaagaaatgccacctctttcttcccagaatctcctgggtccctgatttcgctgtcttctacattctcaggaatactttctcatcaacttattccttctggccagctccctgctttacctatttagatctcttgctggaaatgctggactgctcaggctgtttcctgcaccatctacatctactgcatattgattctcatatgctgcatagtaacttgacaaatattaccctacatgatctaaacaacactgtggtgaaggtaggagccccaaattctggaccatcgaaaatcacaatctagggagcatcagggctgtgattcaaagctgagtcttctgctgcagcctcgtgttctttctcctctgcagggctgtctcttgatgctggtcaagatgcaggcagtagactgtttctatctaaacattacaaacgacttggcttgctgtcagacacctaactttaaatggctaaaatcgcttgataaatggtgtgaaaattttatggtccttccgtcagacaccgtaatttattatcacataatgcacagttagaagaaccaaaagaaaccatcccacaagggcaaacaatgtggaggcagtggccctttgacactcaaaggccacaggcattatatggatccaataagagagctgcttctacgaacaagagaacaacctcttgatcttgcaaaatatttttggacacctaaaggctcttttattactgtggctgattaaaatgaaaagtttaaacgactaaaatgttctttttgatgagtttttaccatgaactatagaccttgtagtccagggggattcaagccctttgatcctgcgtactcacataaattcagagtcataaaacaacattggatttgattttactagtgtagctgatgttgccagatttgtaatgcaatcttgttttctcccctccttgtttttgagcccatccaccattgttttatagcaaaaggaaaggagtttccatttggttttggcaatccagtttcaagactgagccacttttctagaacgttggaattttacagaaaaataatggtcctgtattgtatccatcaaaacgggaatcaatgttagttttgcatgctgaaaataaagtatcaaaaagaaaaccctcttctcattataataatcacagattttcattacttaagatggttagaggatgatgtggttgagaacaatagtataagtatgaagtagaaaaactggtgtgatttagtgtttataaatttccctcaggactaactgaaaataaattagaaatatcaaaagatgcccaatttattcatcaatggcagattatagatcatatcttagtttacaaacttaagaaaaaggactggtatctgtgggagaaataaagaaaatgttcgataagacatatgtttaacaaaaagacatgcagtaaatataacttagatgtttaattcactttcttctaatatcctaatcattttcctgtgtgtatgtgcaatatcatattcctataactcctaagacatgaaatttttactataaagggtctatgagggaataagaagacaattttattaaatctatgttataaagaccataacaatcaatagtgggtcataaaaatcgttcatttttacggagtaaaatatcagtttgggctcagagagatcaatgtatatttagcctattcactagaccaagtaatactaatttaacagttttcactaactttatttttcatggattgcctgaaagatgaaacatttctcgccaagattgttctgtaagtgacacaggacataagggtcatgtgatacttcaacaattctaattggaaaagagtcaccatgtaagggatgcttcattctcctagggacaatgccttgtgacattttcagctgcagtctcttaacacctgctgaggccccagtgaacatttcagaatacgattcattcagagaaatatcattccaatacacattcacttccttgccatttggtatgaatatattacattaagccatataaaattgctgctttataagtcaaataggtcaaatatcagcaatttaatgcagttcaacttataaacttcatttagcaaatttgaaaattatcattgttctatgttttctcagttaatcctttaaattatgtctaaaggatctatttgccatagataagggtcatgccatatatagttttaaaacaaaacaaacagaactgtgttatacagacacctactgcagctttcaaagacagtacaagaaactgccccctgtctacagagacaagtaattgttctggtggtgtgtatatcaaattaagataagagaagtgtatccagttaacaagagctttctcatttcatgctcaaaagggtagtgtgttgtcagcaccttcttcctccctattaattcattcaagaattatttattgtatatttaccatgttccagagggagaatcaagctgtacacatttacagacaagcaacaatgacagttttcatggttccagtttcagcagaagcaaccctcagcaccggtagaaaggtaatgcttgttgtcagagagcgtaaattctctcttgaccctgtcttagagccactacaatctctgacttggacagctgcagtactccctgctgtcctctccacatcctctctgccctcctcaacttgtcctctgcaacagcagccgggggcggggtggggggggtcttttggaaatgcaaatctcctcatgtcacatattcctctgctcagaattagtcagtagattctaactgttctgaagatgaaattgggaaaccttaaaaagatgtacaagacccttccagaatcttgcctcttgcctttctccaccgcactgttttcaacccataggccatcatcgatcagtgagatagcatattaacatatcaatttgtgctttatccagagcatatttagtaagagttgaatatatccgagtatgttacatgcaataaattgttgaatagaactcattcctctctctctctctctctctcacacacacacacacacagacacacacacacacgtaacctgggtctcgatataaattacattgcttattctgggttgtagtataaaaaggttgaaaaaatcctactccagagctacatttcccacctctctcctgtttttcctgtgctttggccacacaaagcttccctgcagttctctccaaacaagccaagcttctcttcactcttcaaacctctgcttaaaggtcagttcctaagagtatccttgtctggacccatggatcttaattagaccccatcagagcagctccacagcactcatcacattatatttattggctggttattttatcaatatctgtttctctgaatggactacaagctccaagagagtggggcctattatctgtcctgctccctcgagcacctagcacagtgcctggcatccaggaagcactcaatcaatacatattgaatgattgagaaagacctctatttccttttgatgattccattcttagatgaaacggatgatcaagttcataaagcattattttaaggtggtcctttgtcatttgttatatagaatgtacctatttacagccataaacatagcatgtactgtctctgtaagtacattaagcactgcctatgagtatggacttatgtgcactttgctgtgcatgtttttctgtaaaataaactaacaatgagttttcatgtgtttaaagcaaaaactcttagtataaaactggaatgtgtttcaatcatcaaaagaaaatgtatctagaaagttaagagaaaaagggtcaaactgacctccagtggtgagattgtggaatgactcctaaagtaattgtaaaatactcagcctatcacacagaagcatatatatatatatgtatatatgcaaaacacatttcttaataatacttcaaattatgtttattataccaatttgcaggagatataggtcatgccatatattgtatcaaaacaagtagaagtgtattacatagacacctgtaacagctttccaagatagtgtatgaaattgccacaatcagaaaatctaagtcttggaaagaatcttagttgagatctgagacctaacatcagcaacttctataaaaagttgataattttaaaatgttaacactcaaaaagtctctccctccattagtctctgcgtaatattaggtcctcagtgtaagctgagtgttatttagcctttatggtataaattctgttttcccaaataaatagtaaatcctctgagtacggaacctatatgaggattaaataaaataatccatggtaaatgctaagtgtagtgtctggcatatagcaatatgcaacaaatgttatctgttattatcatcattattaccatcattactaaatgatgttttatctctagcacatctcttgtatttgacacgtgctcaattggtgtttaccaatcatgagagagataaagtgtaagaagccaagttatgtacatgaaattatagtttagaaaatttgtctttacagcaaaaacaattttaacacgcaattatcttactcagaaccgttccccagatctgtgttttaactcttaggctgcttatacatattcagatgtttccttcataaaactatggcaacagtaatatttcctaggaagaggcaataatggaaatgagcacatcatacttttataacatatgaaaagcaatgctcattggagaattagatataacagtaaatacagaatgtttcttttacctcggcacatagcttatatggaacaaactttaccatccaaaaatacactttgacagccacagacttagagtaaactaaacatgctgctgctcataataaacacaatagttatgatagataggtcatctaccacatgccattgtggcccagtcccacctaagctatcccaacagttgtaatcagtcaaaatgaccaagttacaacattgtcacacccactttaaaggtgagaagctgaagctcagaaaggtttaaataatttcttcaagaccacacatctagtagacagcacaaacaggattcaaactcagggaggattacacacctgtttttctatcccactatcctacctagggttacattgcattttgtttaatgaatggtcacttgacttcattatatgagtttatgcttcagcatgttctgattctaagggccatcactcctaaggacaaatatccacccaaagatagatcagaggcaaaggtcaatccagaatcaaagtcacatcaggaatattctcactaggcaaggacctttaagatcttccagaggcagttcagtgtacagggtaagagggccacctcataatggtgtaatagctcattcactccttatatataaagactggcacatagtaaatgctcaattaagtaccaaatattattattgttattcctccaggacacagaggaagctacaacaaattgcagtgaaatggtcaaagcacacataatgttacgcgcgtatacacacaaacacacaataaattcacactatgaattccaaagtctatgaggttggagttgttagaagcagcaactagtaccatttatcacacatgaacacaccatacaaggaggtggcagcatagagaacacagctgaatcaccccataggcctgttaaggaatcagcagtgttgggtatcagggactatactggagaagattaaagttaaagaacagctgagccccgatgttcaaattacaaaaatcgtaacgaagaagtaaggagctggcaagctgcatagaagtctagccacagtattttcttacccaatttacaatcttggaaattaacttctatgagattcaggtttcaaatctctaagataaatacaggcaaacatcaagattatggtgacaagtattagaggcacttcctcaaactgggctcaggaccagctatgagaaataaagctggaaagagaaatttcccacctgctcctttcttccgtacctcagtagagagaacagaacaccttatttctgaaaccagtgaaataaaagaactctattgtttatttttctttcctaacactacagaaatatcaccgtctttttttttttttttaatcacatggggaacttgtgcagatcatcctttattcctaccttgtacaggtctttgacacaggacgagagaaaaaattaaaacttaaaaaatcattatactaggcagtgaatacatatcaaatttagaaaccaggcagacctggttgatgaatctagccattctactgaccagctgtgaaagctcaggattgcacttgactccgctgggtctcaggtagttcgaaattatctacgtgaagcactgagcatggtacctggcacagagctggtgcttccttctcagtagccaggattataaacatctccaattaagtcaaaaagcatggggtgctcagcatttaatctctcatgtcaacacaatctcttaccatgccttcctgaaaatgttctagaacacagaccatacccaattttttacactaagagctcatctttcacttacacttccaaagctgctgccctttcaattccttcaatagccctttcaggaaaggacagaagagaggaagaaagggaaagggcaagagggaaagaaaagggaaaagaaaagacacaaatgtaaatgtccataaatatctaaaagctcaaggaattctgctttgtattcgtatgttcatgaaaaaaataaatgttactcagcctctttatcctctgtaccagaagtcacaatctcagatgtctacaggctccaggcaatcaacataagtagaggagactggctataagatgatagtaagtgtggggcagtactttggcaactagagcatccatgctttatttgaaaattattcaaaggaagtttttaaatgttattgtgctcaatgaataaacgtctctgggctgtatttgatggtatcacaaatttaagaattctgcagctttcctaatgctaccccccaaatagccttctacctaaatactgtgagtcatgaaaaaatttccagcaatgtccagtcagatcaattaacaactatttattcaatttcagctagttgcctagcactgatctaggtaacatgggaaaagaaaatctcctaggactttggattgagttgggacagatgcaggggcccactcttttcccaggccagaaatgatagaactttgaagctagaaggaaacttacgccagctactccaatgcttttactttacagctgaagaacctaatatttaagagtgatgtgtgattgtatagaatttacagaattattgagtgaggcaggacaagtctggagagaaggaaacactccccgtggtgctctaccatgctttctcccatttcatgaagagtcaaaagcaatggccaacacgcagaaactcaccggttccagcagtagcccgtcacctaaagtcaaaaaacttttgcaataaaaagaaaactgtcttggtccacctgtattgactcatgttcaggggttaagactcagcagaaatgattgaaggctgatggtgcatgaaggaaatgtctaaaaccatcattggcccccatgatacaaatgagcaatcaacattctacaacagcctccttctatatctgaattgtctgaaggcaagacagtatcttgaaggctgagacaaagggctccttttccatgaaaattcaagtccaaatgtacctaccggattctaggtagccagtcgcccaagaggaatctcaacactagtaaaccagtaaatctagtaacctcacaacatttcacagtcacactaaaatgatgaattaacatatttctcaatattgtctattttttcctttttggcatctcagtaatgaattacactaatatcagcacttaggggaataccataagggttttatgaaatcatcacatttcatacttgtgaaagttttgtttattggcctacaaattattccctttccctcacagtattatctgggaattaagagatttaaatgtattgtgttgataatgaagaatacaaaaaaatggaacaggcttgggatttatgcctttataaatttcgttgtatcagctcaaatagagtctgcactcaattctgtttcaacagcaatgtgtaaactattagaaatggatgagtggaatgtgttggccacagtaaaatgaggaagtctacaagtcttaatggaggccagcataccatttcattctcttggggacaaaaaggtacaatgtaagttaattttcagtttggcattgatccctggatcattttgcagtgggagttaccaaactagaaatgtgactgcattgcacaatgagcagggggcctgccagaggccatcgctcagtgaagtttcccctcaattaggaaatatgcatgtgataaatggggtaaacgaaaaagattcccgtaaaggaaatgtcactattggctggttctttgtcttgcatcccacaacccaaagaacattagttaaaaacagatacaacaatctgtcgtttccaagtcctctactttcaaactgcttaaggtgttggtcaaaaacgatattcttaagctaccagctcctcacaagccagacaaagggcatgtacttttctttcttcccctttcaaaattgaagaagtagagatccaaagaagtcctactaatcccatgctcaggcttcccttttgtcataaagatttgggtatcctacagagtttcacttacctttccagagctgcatcccttcacagagtgacacatctgagaagacactggaagattagaggactacattcagagtgtaactgaaaacctaaacacattgctccacagaggcaagtagatggactagagacctgctgactaggaaggagaacttccacgagtaactaaaaggttaaaaacgggaggcagtggctggacgtgatggctcacgcctgtaatcccagcactttgggaggcagaggtgggtggatcatgaggtcaggagatcaagactatgccggctaacacggtgaaatcccgtctctactaaacatacaaaaaattagctgggtgcagtggcggccgcctgtagtcccagctactcgggaggctgaggcaggagaatggcgtgaacctgggaggcagagcttgcagtgagccgagatcctgccactgcactccagcctgggcgacagagccagactccatctcaggaaaaaaaaaaaaaaaaaaggaggcggtgtaaataggaatttagggctgagcatagtggctgacacctgtaaccccaacatttggagagagaggctgaggtgggcagatggctcgtgcccaagagttcgagaccagcctgggcaacatggagaaactccatctttacaaaaacaagataaaataataaataaaggatgcaaccagaactcaggaagtggattatacattgagaaaataagattatattaatcaattagggtagtatcccaaacaatgggtttcttgaagaaaaaggattatgttggaaataagctatacagcattctctttatagttcttccctgtacgtggtaaagctcaaacacagcaatagatatttctcaaatatatttgaccatgaaaacattttgtcaagaggcatttcaaagtatcactgttcagtggattctgtcttgggaaaagctagtttagaccaccctgatataaagcacacaggcacaagtacagcaggaagatcacagacaagtcacccttaaagaataaatccacggccaggcacagtggctcatgcctgtaatcccagcactttgggaggccgagacgggtggatcacttgtggtcaggagttcaagatcagcctggccaacatggccaaaccctgtctcaactaaaaatacaaaaattagctggatgtggtagcacatgcttgtaattccagctactcaagaggctgaggcaagagaaccgcttaaatctgggaggcggaggttgcagtgagccgagatcacagcatttcaatctagcttgggtaacaagagtaagactccgtctcaaaaagaaaaaaaaaagtgtagcaatttacatttaccttccccttatagttcaaaagcaaagatttattgattatttaaatgaatcaatttctggtacacatgtttatacacctttacttaaagtaagtacttggatgattttgccattcaaatctccagcgggagggtggttgcaggtcatttcccatgacttcactgttttatgtcatttataatatccacaacataattcttcagttttgtccaagtgcgtcccccctcatcctcctcctcctcccacttccccccccacctccccccatcctcctcctcctccctcctcctcgagtttagagtggtctttgtgcttttttttttggttgaggacatatttgggacattggactttcctcctcctccccctccccttccgcctcccccttccccctcctcctcctcctcctcttcttttttgatacaaagtctcactccctcgctcaggctggactgcggtggtgcgcgcatgcagcatgctacaccttttgataagctagtagcaggagcagccttgtgccctttccatactgcaccactcaacgaatgctggctgcagagcacacatggaataaaaaccctaagctcccccacttactgcccatggaactacagggtaaaataatcaactgtccaatccaaatattttaggtgatagggcttgcattttgctggtgggggaaactgaacaattaagtgatttcccttcaagtgtatggttaaaacaaaatggaaagttctctgcttatttaggttctctgcttattgaatcatgctgttttctttaaattctatgaaaacattccaaaaagacctaaatgtgatacttatcaattcttgtacatggtgacagaatgagtcactttttcttttgtactttaaaagcatgaaacccttcttattctagaaaggcatgttgaagaagtctggaaacatatctgaattctccataacttgtatatggagaaagaaaatctaacaatgatagctgccaatggaaatcacatgtaaagcatcaacatatttttcccactcactatcttccactaggtctgtgacaaaagatgagtccactacttagtgaaacaaaacaggtaggggtgatattcagtgagtactcacaagtacagctagggtgggtttttgtctgttcgttttacgaacagcatctattttttattgtattgatgccaaaccagttgtctcattttattttcagtatcacccagagtacaggggtaattaatcaggcaggtaaagtggcccagagagcaccctggcaaatgagaggtcatgcatcctggtggaagtgaatgcctgcgacttagccccagcaggttgaagtcatacaagaaaataagtcctttggtgccagcttctccaagttttaaagcagcagctagaaatccaggttttatataaaaatctccatattttaaaatatttattcctagttcaatctttaaaacactgtgtttgccaaatgaaacacttctttgggtcagattagagaagagggttgctggtttcctactgagggttgtccatctgtgactgctagaatagtttaaaactacagctaagtgttcaacatacgaaaatcaataaacacaatccagcatataaacagaaccaaagacaaaaaccacatgattatctcaatagatgcagaaaaggcctttgacaaaattcaacaacacttcatgctgaaagctctcaataaattaggtattgatgggacgtatctcaaaatagtaagagctatctatcaatatcatactgagtggacaaaaactggaagcattccctttaaaaactggtacaagacagggatgccctctctcaccactcccattcaacaaagtgttggaagttctggccagggcaattagacaggagaaggaaataaagggcattcaataggaaaagagaaagtcaaattgtccctgtttgcagatgacgtgattgtgtatctagaaaaccccattgtctcagcccaaaatctccttaagctgataagcaacttcagcaaagtctcaggatacaaaatcaatgtgcaaaaatcacaagcattcttatacaccaataacagacagagagccaaatcatgagtgaactcccattcacaattgcttcaaagggaataaaatacctgggaatccaacttacaaggaatgtgaaggacctcttcaaggagaactacaaaccactgctcaatgaaataaaagaggatacaaacaaatggaagaacattctatgctcatgggtaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaatcctaagccaaaagaacaaagctggaggcatcacactacctgacttcaaactacactacaaggctacagtaaccaaaacagcatggttctggtaccaaaacagagatatagatcaatggaacagaacagagccctcagaaataatgccgcatatctacaactatctgatctttgacaaacctaacaaaaacaagcaatggggaaaggaatccctatttaataaatggtgctgggaaaactggctagccatacgtacaaagctgaaactggatcccttccttacaccttatacaaaaattaattcaaaatggattaaagacttacatgttagacctaaaaccataaaaaccctagaagaaaacctaggcaataccattcaggacataggcatgggcaaggacttcatgtctaaaacaccaaaagcaatggcaacaaaaccaaaattgacaaatgggatctaattaaactaaagagcttctgcaaagcaaaagaaaccaccatcagagtgaacaggcaacctacagaatgggagaaaatttttgcaacctactcatctgacaaagggctaatatccagaatctacagtgaactcaaacaaatttacaagaaaaaaacaaccccatcaaaaagtaggcgaaggatatgaacagacacttctcaaaagaagacatttatgcagccaacagacacatgaaaaaatgctcaccatcactggccatcagagaaatgcaaagcagaaccacaatgagatactatctcacatcagttagaatggcgatcattaaagtcaggaaacaacaggtgctggagaggatgtgaagaaataggaacacttttacactgttggtgggactgtaaaccagttcaaccattgtggaagtcagtgtggcgattcctcagggatctagaactagaaataccatttgacccagccatcccattactgggtacatacccaaaggattataaatcatgctgctataaagacacatgcacacctatgtttattgtggcactattcacaatagcaaaaacttggaaccaacccaaatgtccatcaatgatagactgaattaagaaaatgtggcacatatacaccatggaatactatgcagccataaaaaatgatgagttcatgtcctttgtagggacatggatgaagctggaaaccatcattctcagcaaactatcgcaaggacaaaaaaaccaaacaccgtatgttctcactcataggtgggacttgaacaatgagaacacgtggacacaggaacgggaacatcacacaccagggactgttgtggggtgggggtagcggggagggatagcattaggagatatacctaatgctaaatgatgagttaatgagtgcagcacaacaacatggcacatgtatacatatgtaacaaacctgcacgttgtgcatatgtaccctaaaacttaaagtataataataatattaaaaaaaaaaaactacagctaagtgtataaattggatgtaccacccagatggcaatagtgagccatggtggccatggctttagcaattaggtaaacatcataaatgtggggcaacaacagttgtttaagtgtactagtatcatcaaaagagcagatgatttttttacagatggtttttaaaaatctaaagtatagtttggaacatttttaatctttactactgttaatcacaccttagtctaacctgtattttaagtgcagatcatgatcacaatatactttccttcttccatatactcctcttttccatctccaatcttttcttagtttgagatatataagatcataagacttttgcagagacagaatgagataatgtgcttagaacaatacctagcacacagcaagaattaaaaaactgtaagcatcttctgttaccaagaatattattccactgtcaaagccctcgccaggctggtctacagtttgtggaaagctagggttaactgttacaacttggctgttaacacaacttctgcttacagaatcacttctgttcctgccctctttaggaatctgtgtcttaaattatcccctaccaatttcagttcctctgaggcagctgacaatcttttttcacatcagaacaaagaaaaagaaagagaggtctccctttgtaacaagggagataagggcctccctcctctccttttcttctaggagacagaggtacttttccacttttttgtttctttgtgaaattgactcattttctctccctaactatttaaactctgctggatgggtagggcttgaattcatacaccatactacttatcgaataattttctgctacttgcaataacataacatataatccaatacaccgactcagttatttttaaaagcacattatcattcattgaaaagaaggatgttttcatatatctgataaggggttaatatacaaaaaatatttaaggaattcaaaggcaagaaaacaaacagcctgatttaaaaatgagcaaataatctgaaaatacatttctcaaaagaagacatacaaaagggtcaaccaatatatgaaaaaaatgctccaacatcactaatcatcagggaaatgcaaactaaaaccacgatgagatatcacttcacaactgttagaatcgctattgccaaaaaaagacaaaagattacaagtattggtgaggatatggaaaaagagaacccatgcacactgttggtaggaatgtaaactagtttgtagaaaacagtgtggaggctcttcaaaaaaattaaaactagaattaccatatgacctagaaatcccactactgggtatatatttaaaggaaatgaagtcagtatgttgaagagatatctacactctcatgttgactgcagcgttattcacaaaagccaagatatggaatcaacgttgagtgtccatcaatggacaaatggttaaaaaaaatgtggtttatacacaaaatggaatactctagtctttaaaaagaaaaaaataatcctgtcatttgctacaatatggatgaacctagagaacattatgttacgtgaaatatgccaagcacagaaagacatggcatgacctcatttatgtgagaaatctaaaaaagtcgaactcgcaggaacagggagtagaatggtggttaccaggggctaggggcagagaggggtgaaaagtggggaaggattagggagatgttgatgaaaggagacaaatttcagttagatgtgagaaataaattcaagatgatcttctgtacaacatggtgactatagttcataaccatgttattgtatactttaaaatttctaaaagagcagagttttcgtgttctcaccgcatataaatgataaatatgtgaggcaatgtatgtgagacaaagtatatattaattagctcaatttagttactccacaatatatacatatttcaaaacatgtcatataccgtatatatacaatttctattcgcaaactaacaaatttttagaaaagaaatgtctgatccacagattgattaaattagcagtcatgagttaacattaaatgaggaaaaaatgttactgaaattttgctgtcattctctcctgaagcagggggttactgcagccatcagtaaacaagtctcagtgcctgattcagtatccagttatttgaagttaagattctgaactttctgccacaggcactacaagcaaatgccaaatacagggaaagtcaactagatggcagcacaagggaaatgatccctcagtcattccgggcttcacaagggaggatcaggtcaacaatttcccagcactctctgaggatacggaagggctcagaactcctcctcctccacctcctagggctccttccttaaattttgtaatctgcatcacatcatattgcagggatgtgctaagaaacatacagacatgaacacccgaacaagaggaagctgaacaaaaataacttccatcgtacctagaaaaaaaaacttctactatattttatataacagcagaagtctattccatcttctcttctgctttaaaaataaaataatcattttccaatccaatcaaatgcatttatggtattttttaaaattagaaattgaattctattaaaaacagaatccaagacttttcattccctgtatagacacagtgcctactggcagctgcaagatgcgatgctgtctagtttaacacttcaacttaagaggaatatttacttcagcataggagaaaaccaagtatcagttctatagaacccgttcagtagcatcaaagaggcatacctgcaggttttcaatttcttctttgtgctccctcttcaagtgtaaaatagcagcttggtattctgtaaaatcaaaaaagaggccaattataaagaagtacaaaattaagcacaaaatttatctactggtcctcttagaaataaactgactaaaataaatgccacaatttgacatcaaccttacaagagatgttaaaaattacagaaagataggacaagtagttcagggtaaaaggtaaattccttccttttagcaaacgctgaattacgaaaagacacaaattaagcagatgggatagggttaaaagaaaaaaaaagggatgatgagtgtgttccagataaacactaggtcaggagtttgtatttaaggagttggaaattaagtccccacagaggacaaatacagacatcttaagagcagacagggcaggaaacaaacgaaaactttctatgtgagatcagagcactctatttttaactctgtttcaaaaaagaaaaaaaaaatctccatttgaatgcaaggctaagtaagcacccagggctgattttaatctttatctcagaaagtcaatactatttgtcatttggatgagagattctagggtgaactgaggctgaaaggacaaaaataaatttctggtccaattttaatatgagtctaataatgtttatttcaacaataagtcccaagtgtacgtaagaactccagccaaccactaaaactatcattctgctggcgaagcatgcagctgtcaagacaactttatttccagcagaaattctaggtgtgtggggtcatggaactatacaggctgcagagaaccacaagacaaaaatgctatgagcacacatttttgtgagataagccaattattttacaaatgtgtttggggtcatgagtatgagtaagcaagaagcagtttgacctcattgaaatatgtgtgaaagccaggctatttctccaagtagatttcctaaatcaggcatgaaagtttgtgttttaatttaaaaatggaagaaggaaatcattggcaaagccacgccagaaaagtagtgttgctgctgataattacggctagatagacctctactgttgtggggaaggtgctccactgagctgtgaatccatcagaaagttctgtgggttctaaatccaaatcatacctcgaatggtctggtagtgaccacttgtcattatccccaccagcaccacgataatccaagttaccaccatctccactagattaaagcagtatacttctggtagggtgcctgcttctacttttagcaccactgtaactgatgctcatcaaagcagactgagtgatctacatagacatgaaccagatcatctcatccttggtttttcacgcaattagagtgaaatcagagctctctgttgcagcccataaagacctccatgtcctggttcctacatatctctccctatcatttcataccactccttccccttgttcatcatactccaccgtacactggctttcttgccattccttgaacttgtcaaattattttctatctcaaaatctttgctaatattgaaaacaataataaaggatttcatttgctgactacttactatatatcaggcattattctaagtcttactttatcaactcatttcatctccacaataaccctatgatgtaggtaccattattgtctccattactgatgaagatactaatgcatagagacattaagtagcttgatcaaggaagtagaataattttcaaagccagtaaacatgcttcatttaatgggtgaatgcataaacaaatgatagtatgtccatatgatggaatactactcagcaataaagacgaatatatgcatcaacatggaggaatcttttttttgtttgttttttttgagatggagtttcactcgtttcccaggctaaagtgcaatggcacgatcttggctcactggaacctccacctcccaagttcaagcgattcttctgcctcagcctccagagtagctgggattacagcccaccaccatgcccagctaatttttgtatttttagtagagacagggttttactatgttggccaggctggtttcaaactcctgacctcaggtgattcacccccctcggcttctcaaagtgcctggccaacatgaagaatcttaaaggcactatgcagagtgaaagaagtcagtctcagaaggccaaccactgttcaatagcatttatatgacatctagaaaagacaatctagagggatgaagaacagatcagaatagtagttgccagaggttagagatgggggtttggggagggggttgactgcaaagtggcagcaagcaaaggaattttagggataatgatattagatattattctctgtcctgattatggtggttgttacatgaatccatacacattaagttcaagaaaaagtacaccaaaaaaaggatgttaatttgttttaaatctgacattaaatattatattggtaaatattttccctgtaagattcagcataacacaacaatacctgctactattgttgatattcatcatttttctactgctactagcagatgtaatggatgagaaaaaagacacaaaatctacatagattataaagagaaaaaggaaggtattattctctatgttcatacatctagaaaaatctaaaagatccaactgataaaatattagaatatgcatgtttagcagagttgcttggtattatcaacaaaaatatacaaaaatcctcatagtagcagtttaaaaaagaaaagcataacacttacagtacttctaaaaatacaaaatacccagaaaaaactcaacagaaatatgtaaagacctcatataagaaaatagtaacattttattgacatattttactaaaaaaaaaaaaataaacgcagaaagacaagtgggcaagccatgtttctgatttataagacttcatattgtaaaggtgtgagtcttcccaaactgattccttcaaaatttgagttttgttttgtttgaatataaggagcccattctaaaatgcatgtggaagcatgaaagtgcaaaatgccaataagagccaaggaatgcatgaaaatatagactaagttaagacaacttaccttacctcctaatgagaattatttttaattcttacaatgtaattaacatggcatggtacagacacagggattaacaaataggctaataagatagaatagacagtccagaaagataccatgatttatagggtcacttgatatatgatagaaatagcactgaagatcattagttacacaaagaatgatcttttcaataactattggctgggaaaaaaatattctgttcctttcttatggaaaaagacaaaactggatcctaaccttatactataatctattagaagtcaattaagtgctaaactgtaaaaagcaaaattgtaaatattttataataattatcttataaaatttatcttatagcatagtattttacagcctcaggatagaaaaaagatttcttaatattcacaaagcaatatatatagaggaaaaaacctgataaatttgactacattaaaattaagaacttatttttcttaaaatataccatagagaaacagattgacaatagatcaatctatcatcaatagagataacattccctacagagtgggagaatatacttgcaacaccatcaatcaagatctagtgtaaatatataaatgcatcctacaaaactatagaaaatgaagcccatgtgaaaaatgagcaaaaagcatcaacaggcgctctaaaaagatgatatacaaataataactatgttaaaaggtgctccttattagtaatcaggaatatttaaggtctgacaacagagccttggtgaagatgcagaacaatggaaacttccatacacttcacttacagcaggagtgcaaactggtataatcactatgaacaatgatattttctaataaagttaaagatattaatgctttcttaaccaacaatcctaaccttaggcatacataagtaacaaaactatgaagaaaagcaacctgtcagtggacagcaccaaaggaagcattgtctctcttcccactgctgtcatgtctgcacatcagagtccctcaaagggcctgaacagctgtggaagctcctcatcagagggttgggctttgaaaccaccgataagtgcctgaggaatcattttgagcaatggggaacgctcaagaactgtgtggtaatgagatccaaacaccaggtattccagaggctttgggtttgtctcatatgccaccgtggaggaggcagatgcagccatgaatgcaaggccacacaaggtggatgaagagttgtggaaccaaagagagctgtctaagaagattctcaaagaccaggtgcccactcaactgtgaaaaagacatttgttgctggcattaaagaagacacagaagaacatcacctaagagattattttcaacagtatggaaaaatggaagtgattgaaatcatgactgaccgaggcagtggcaagaaaaggggctttgcctttgtaacctttgacaaccatgactctgtggataagactgtcgttcagaaataccacactgcaaatgaccacaactgtgaaggtaggaaagccctgtcaaagcaagagatggctagtgcttcatccagccaaagaggacatagtagttctggaaactttcgtggtggccatggaggtggttttggtgggaacgacatctttggttatggagaaaacttcagtggtcatggtggctttagtggcagctgtggtggtggaggatatggtagcagtgggggtggctataatgaatttggtaatgatgggagcaacactggaggtggtggaagctacaatgattttggcaattaaaaccaccggtcttcaaatttttgatccatgaagggaaaaaactttggaggcaaaagctctggttcctatgatggtggaagccagtactttgccaaaccacaaaaccaaggaggctataggggtagcactagctatggcactggcagaagattttaattactgccaggaaacaaagcttagtaggagagtagagccagagaagtgacagggaagctataggttgcaacaggtttgtgaactcagcaaagcacagtggtggcacagggcctagctgctacaaagaagacatgttttatacaatactcccgtgtatgggcaaaagagttaaggaccatatttgtgattagttatataacaggttattttaatttctgttctgtggaaagtataaagcattccagccaagggttttaatacagtggtttgtctgcacccatgctatcaattgctaaatgtaatagtctgatcatgaagctgaataaatgtgtcttttatttttaaaaaaagaaagactagcaagcaataatattaacaaaactaagaagaatggtggtttccaggagaagatgaaccaagttgggttgtgattgagcaaggagatgttatatgggtgttaaatgaaaaattattctttaaattggatattttttacgaaattatctttatgcatatctaacattaaatgaaagaaaaaatacttctcttttgaaaactggttacattcgtttcctcaaatatcaatataggcaaaacagaacatctgaattcataaaataagaagcagaaagtgacttagtaagtttaaatcttgtgtaaatgttgagtcctaacccatgtcatgataaatatccaaaccctaaccaattccaagcttctacaaagtagtcaaaggaaagctacttaaaccaagcttcttgtgaaattgatgtcctttgagaatagcatctacattctaaatagaaattatacagactatattttgcaatgattcattttgtgtaaattgtacctatatgggtgtgacagatatcgctatgactaattcattaacaaaccgatgaaggagactactgcaaagctaacatctaggaaagcatgattcatctcctcctttaacaaatatttttaccaagagtcccagtgtgacgggtggcaggaaacacactcccatcccaacaaggatgacagaatccctgggcagcatgtagaaggaggaagctaatgcctttactactggcattggtgaatgctcactttgagagttcacaagagagtagtaagagaatataaaggttacagaataatgtccatgagtcaaaactaagttagtgctttccaaatgtgtcttgttagtggcagccccctgcccccagatgcttcttgaggcttgcagatgcctgagtgtgaggatggggaggcagaggtgtcaactcaagaccaaggatgtgtgtatttgttaaaaagagaacttgaccctagcattggtattcagtagctctgggaccttataagtgtgtgaaaaggaggaacaggaattctacatcagggttgaaaagggcagactcatttgaagtcacattagcccctaatggaagttaataaatcaatttaaataatctattccacaagaaacaagtctaaagaacgtctttttgaaaacaataatgtagtccatgaaagacagagaaaggagtaaggctcctaactggcaggattcaacattttggaggaaaaaaaaatgaaagaactttctctgtacaaataaagctttcttagtctagtatttagctaattggttccttccctttatgttgcacaaaccttcctttttgatcagttcacaataacaaaacatccttcctgccaggtgtcattacaaagtttgtgccctccaatttgtgaagagcagaattacagatgattccacaaacacagaaggcatgcagtaaccactgctgaagtccatcacttactaaatgagtttacctaattacatatgggtacggataacattattgagggttatttttcaggaatagttctaagcactttacacagattaactcctgccatcctcacatcaaattgaaaaggtagaccctatcatatcgagacttactttacagatgagaaaacgcctcaggttgaacagctttcctaaaaccacatgctagttaagtgccaataatatcattcagacccaaagaacgtgtgctggctctgcagagtttttgtttattcccttgttttcgttcttgccgttcttttggttacataagcagcagatgcaaacaaaaccccaagcctctgtaaacttcaaagttgcttgctttatcctattaccagaatcactcgtaaacttggggtaacttttttcataattctgtaaaaggggaatgctaattttaatcacagggaggtttgaagagccaggggtcagagtgaatggtgtgaatttcaatggctggcaccgacaagttctgtgattatgattcgtctgtcttttctaagggaatttcagggcctgtagttactagtttctggttaaatctgattttcatttatgcgctctttcttacacatatatccaagcctccaccgcatcacacacgcacatgacatgggcaaaactggattatgtacagttaggaagtagaaactttctgaattctccactgagtaggaaacatggatctactcctacccgcggatcctgatatgtccggcctgtgcctctcactggcctttacccactacctcacattgttgtattttcaagtacatatgtgacttaaaaaaaaaaatcattcctctgaattatacttggacgatactcaatcagtgcttccaaaacttagcacacacaccggcaaggtcattttttgtaggtatctgaactttttattttgacagttaaatgttttaatgtgcattagggaaaaattatcaaacacacacataaaacccgtgatttcactgataatgcttcccagatagtgttgatcggagtttggtccctggaccaggagcatcagcatcacctggaacatcttagaaatgcaaattctttcctctacggtggatttattgacttggaatctctgaggctactttaccaagcctaccaagtgattataatgcacagcaaagtttgagaaccactgctttaataaggcttatttaagcaaaaacagtaaattcattaaaataacaaattaaataatagtaaaaatagtataaatatgtatcaaatttcaagaagctggtgcataaaggatgacatttgaaaaaatatgctaatcactgacagataaatacaaattcaaacaaactcatccgtgagtgaatgcacaaagcttctctgaccatttctaacattgacaaaaatggtcacagttcatgtaaggcagagtcacaagtcatttattccaaaatctaagaataaaaatcaaatgtgagctttcatatttaataagcttatgaaaccaaagtgtgcagcctggtcttggggccctgcgagtcctctgtttcccttccagatgcttataaacaatgcagtccttagtaactgtgcagtttgaagaaagcataaccggttttgtgtctgtcagaaacagtggaggtagattcaaaggcagtgaagtaaagagaaagtagtcaacagctgccagcagagctttttaactgggtgtctcaggctagcagctggtgagaggctgttacctgtaatgttgatccaacaccttttgtcagcgggccttcaaccagcacacacgtcagcaaaagcacaggaagagatctaactccactgtttgatgattgactcctgacagtttttaagcctcacccctccttcttccccggtgtcccacacacctgggcgatctgatagtaaaggctttgacgcaggagatgtgaaccacacagaccactgcccgcagaagccatagcccagtactgtctgttgaacgccataaaaaccccaagccagttttctacactttctcttgcaagtcatttttggaccagcttgagaggcctgtctcgctttccccagaggtctccttatgtgaataataaatcttttcatgcccttgtgtgtgtgcaaacacataatgcatctgcggtcatcaatattggcatctcaatcaaatttggggtggctggggttcaccctgcctcttcaaaaaggatgaggccgtaccctagaacttaaagcataatttaaaaaaaaaaaagtggttgccaaggccttgggaggagggaggaatcagtggagcgacagggggtttttaggacagtgcaactactctgtatgctactataatagttgatacgggtcatacattattcaaaatccatcttcagtacagagccaattctaatgtaaactgtggactttagttaataataatgtattgggtcaactgtaacaaatgtaccactccaatggagaatgctaatactaagggaaagtgtggtatgtgggcgcagtagacggtgagagggaactctactttccgctcaatttttctatcaacctaaaactactctaaaaatagttgattttttttttcaaaaaagaagtgaattatcagtgagtcaacctactatgttgttcaataacttacagaaaggagcctaatttctatatcagaaaaataaaatattggacaataactgggagaaatcccatgaatttaggaattgtaactgtcaacctttcctcattcaacacataagaatttctttaggcaaaaatataaaaatgtcagtatcaaaagatggggggaaacttctaattctccaagccactagtttcttaccgctatggtttgaatgtttgtgtcctactaaaatccatatgatgggctgggtgcagtggctcacgcccgtaatcccagcactttgggagactgaggcggacggatttcctgaggtcaggagttccagaccagcctggccaacatggcaaaacctagtctctaccaaaaatacaaaaatttgctgggtgtggtggctcgcacctgtaatcccagctactcggggggcagaggtaggagaatcacttgaacccaggaggtggaggttgcagtgagccgagatcacaccactgcactccagcctgggcaacagagcgacactacctctcaagaaaaaaaaaaaaaaaaatttatatgttaaaatcctacccccttaaggtgatggtactaggagatggagcctttgggaggtgatcaggtcatgaaggcagagcccttgtgcatgagattagtgtgtgtgatactgcaaaatatgtatttggcccttgaccccacttcctgacaatttctaaaatccttacactttccaaagtgatgtcttttttttaatcttaatgatcgaccaataactggaagcctttaggtagcttcaggatgggggcaggacacctgaaagaccaagacatgattagagggttgggactttcagttccacctcccaacctatggggagggcagaggagctgaaggttgagtcgctcaccaatggccaatgatttcatcacccatgcgtacataatagagcttccgtgagaacccaagaggactgggttcagaaaccttctggacagctgaacacgaaaaggttcccagagggtggtgcgcccaagaagaaatgtaagctctacggcccttcccccgtaccttgtcctatgcatctcttcatctgtatcctttgtaccattgtgtccggaattggtgtgttcttggtctcactgacttcaagaatgaagctgcggacccttgccatgactgttacggttcttaaaggtggcgtgtccggagtttgttccctctgatgttcggatgtgttcggagtttctcccttctggtgggctggtggtctcgctggcttcagtgaatctgcataccttcgcggttgagtgttacagctcttaaggcagcacgtctggagttgttcgatcctccggtgggttcgtagtctcactggctcaggagtgaagctgcagaccttcctggtgagtgttacagctcataaagacaatgtgggcccaaaggagtgagcagcagcaagatttattgcagagttaaagaacaaagcttccaccatgcggaagaggacctgagcgggttaccactgctggctccggcagcctgcttttattctcttacctggccccacccacatcctgctcattggtccattttacagagagctgattggtctgttttacagagagctgattggtctgttttgacagggtgctgattggtgcattcacaatccctgagctagacacaaaagttctccacctccccactagattagctagatacagagtgtccattggtgtatttacaaaccctgagcgggacacagagtgctgattggtgcatttacaaaccttgagctagatacagagtgccaattggtgcattcacaatcccttagccagacataaagattctccaagaccccaccagactcaggagcccagctggcttcacccagtggatcctgcaccggggccgcaggtggagctgcctgccagtcccacgccgtgcgactcctcagcccttgggcggtcgatgggaccgggcgccctggagtagggggcggcgcttgtcggggaggctctggcagcgcagaagcccggggcggtgcgaaactcaggcatggcgagctggaggtcccgagccctgccctgcaaggaggcagctaagccccggggacaaatcgagcgcagcaccagtgggccagcactgctgggagacccggcgcaccctccgcagctgcttgcctgagtgctaagcccctcactgcccgcggcagggccggcaggccactcggagtgcggggcccgccaagcccatgcccactcggacctctagctggcccgcaagcaccgcgtgcagccctggttcccgtccgtgcctctccctccacacctccccgcaagcggagggagccggctccggcctcagccagcccagagaagggctcccacgggtgcagtggtgggctgaagggctcaagtgtggccagaatgggcgccaaggccgaggaggcaccgagagcgagcgagggctgccagcatgctgtcacctctcactatgctttctagtaaaccaggaaatgtgtttccctgagctctgtgagcaactccagcaaagtaaccaaatctaaagaggctgggggttgtgagaacccctacttgaagttggtcagtcagaaggtctggaagctcagacttgtcactggcatccgaaaggggggcagtcttgcaggacggagccctcaacttgtggtatcaaatactatcgccaggtaaacagtgtcactattgaattggggaatacccagctgctagtgtccactacagaactgactgcttgggaaaccgacccccccaacccccccaccagattcggtcactataagactatgtggccaggcgcggtggctcatgcctgtaatcccagcatttggggaggccgaggtgggtggatgactggaggtcaagagctccagaccagcctgaccaacatggtgaaaccccgtctctactaaaatacaaaaagtagccgggcgtggtggcaggtgcctgtaatcctggctactcaggaggctgaagcaggagaactgcttgaacccaggaggtggagagttgaggtcacgccattgcactccagcctgggagacaagagcgaaactccgtctcaaaaaaaaaaaaaaaaaagacactatgcttagttagcctctttcatgcatgtgctcagtgtctccgtgtgccaggcactgaactaagcattgtgtatataaaagaaacagcacacatttccaaccttaaaaggctttcaggatgtgcatctttgaaatatctaagaacttttggcatttatattccagtattagccctttaagcctgtgttttcttaaaagactttattgtatttcatttgatcattttatatatgttaatgtgaacgactggaactttaacaaatatttaatctgctttcacctctttctttttgggcaatggagaatacttcctatggctttaagccttggccatatgacttgttttggctagtggaatataagctgacgtgatgtaaggagggatttaaatttaattgcatagtttgacttgcctccggtactcctgctatttcatgtaattaaaacatattctgggtggctacaactcactcagcctgggtcccagagaaagatacatggtgcagacttaaaccctagccacagtcagcagtcaagaacagcctgaaaaagcccaaaccagctcagctgaaccttagttgacctttacacctatgctaacaaatgcttgttaccgaaagctgctgaattttagcatggtttgttacacagcattattacagcaatagctgatgaatacacttggtaagttttcagtcaagttaacaatttagagactcatagcattttggatgcttccagcaactggggtggagtctcaccaacttctctctctctctatgcatacacacacacacacacagagaaaaaggtttaaggaaagaggataaaatgggagacatgaataggcttatattgtttaatactcaaaaaattagttcaggacagatattgagtctttatgttctgggatgatgatataaaagaggtacaaaaagtcaggaaattcgtggctatatctctgacttttacctgtattgaaaaggtatgtattcaaggcctgagaccatttgatggacaccttaccatggagaaaactgtcattaagtccaattctagctgccaatcctgggataacctgccttctaccctgttcttttctgttacccttgttttatgttctatcataatagaggtgctaagcagtttaaaattccatgaatatatggtccctaaaacttacaatctcctttctacctatgtggtttttaaaaatcatagtcaacaacagttaaataatggccacaaaacaaatcttctagaaaaggcacacacttaactagaataaaatttcaactacaattgaaagtaaccaactcctgtcactaggtggcagtcacaataaagtcatcccttggtgggagggattggttccaggacctgaggatactaaaatccgtgagtccttatatataaatggtgtagcatttgtgtataacctatgcatatcctactaaatcacctctagattacttataataaatacctaatacaacgtcaatgctatgtaaatacttatcttttttatttgtatgatgttttggtatttttttcccaaatgtttccaatctgaggctagttggatttgcaaatgcagaatccgagaatacagatggtcaattgtacttcatactgaaactcgaagtttgctatcaagtgccacagcaagacttgaaggattgggtatggaggggaggctggggagagacaaggatgagccaaactgaaacaaccacttttccttgatttgaaaagtggactagtatggatatggtaactagctgagaaatatcagaacaaataagaggaacttccaatctgatgttactaaaaaagttaaaagtgtcccaacagacctccagttgttaaaggttcacattttttagctccctcctaagcctatgtaacaatgaaaattataacataaagcaagtaaaagacacagacaagtaccaaagcagaattacgtatttcagaaatagaaatgggacaaaccagtaagtggcacttcaggcctgaagctctggcctgctgtgccccagttcctctggcaggcagggcaggcaggacatcctggagtcaagttactgcagagtaacagggactgacagcactaacgtggggcaggaagccaggcccagacttgttgcctagaaaaagggactgagacacagctgtagttcccagatgggaaagggaagttggaagaggttgtcaactgctgcctgggggtcttggctggggcacagtggctccagcctgtaatccctgtgttttgggtggcagagggtgggaggatctcctgaggccagaagttctaggtggaagtgagctatgatcgcaccactgcactccagcctgggtgacagagcaagaccctgatccccctcccccacccaaaaaaaaaaaaaaaaaagaaaaaaaagaccaaacctcaaatccatctatccctgtcaccagccgactaaatctgcaacattcacataccacctcaggctagtgaacccaatacgctattataagagcgacttagtctgggggtcttacctggtaagacaactgcaaaacaaataagggtaaaggggaaggggagggggaaacttaaaaaaaaaatcatcctatagatcacgagccttcaagccaaactttcaaaacataagaagaaacctaagcatcgagatagataacacaatcaacaattgaaacatgacatcacccaatgcaaatttaaatcttaaacatatgaaaatattttagtaatgtttagaatccttaccaaaataaaggcaagaataataatcatcataaacaataatgatagtagcaacacactaagagacaagaaacaatagtaggtgattgtaaaattctgatatattagaaacaaaatactcaacagacattgaaataaaaggtgcaaaagcttaataaactcaggtacagtcaaggaaggagtttgtgagtaaaagatactgaataattaattgaaagtgcagcatggtgcaagaaaggataataggaaagagcaaatactgaagagaccctggcattgacacagtgatagaaaaaaataccaaaaaatagagtacaaaaggaagcatataaataaagccaagcaacatatggaaacataatacgtgatttgaggttgcattgaaatttgtgggggagggatagactatttttttaaagccacatttaagaaaaatattcatacttcaaaaccattcacaagaatcacttttagtgattcagctatattaaaatataccagaatcgtgtctgttgaaagatggcaggagaaactgataagccacataaatggagaagacatttgcaaagcatataaccaataaaatgttagcatccagaataaagaaatcctataaataaataaaaaggatagcaaccattagaaaaatgaacaaaaggacagtaaatttatggaagataaactccaaatggctaataaacatataaacatacaaaaagacacaatctcacttgtcctcaggacagcgcaaattaaaactacagggaatactatttcacacctatcagatttttttttttttttttttttttttttttttttttttttgagatgtggagtctcgctctgtcgcccaggctggagtgcagtgacgtgatctcggctcactgcaagctccgcctactgggttcatgccattctcctgcctcagcgtcctgagtagccaggactacaggcgtccgccaccacgcctggctaattttttgtatttttagtagagacggggtttcaccgtgttagccaggatggtctcgatttcctgacctcgcaatccgcccacctcggcctcccaaagtgctgggattacaggtgtgagccaccacgcctggcccagatttaaaaatattaattagtctgctaatactaactgctggtgagaatgcattagaattccacacattgttgatgggagcattaactgcaacaatcactttagagaacattttgacaatatctaccaaatgtaaaggcgcacataagtaaaatcagaaattctactctaatgttcatcctctagtgaagcatttacacattaatacaaatattaaaaagaacactatggaaccattgtttctaacagtgaaaaataggaataaacttaaatttccatcaccagcactacagacaagcaattaagatgtacattcactcagagtgatattatgcagatattaacatgaatgaaatagagctatacatacgaatgcagataaatctaacaaacattattttgagagaaaaagctgccaaaaaatacatagtggaagccattttgtagactcatgaaatacataaaaaccatactatccactgttttgagactttatacattattgttataagtataaaacatgggattaataacaattttacccaagtggctggggtagggcatatagaaggcttcaaatatatttgtaatgttttatttcctaagttaagtagtgagtataatcatgaagttgaacacaactaacataatacacttaaaatctatgaagcaaaagaagctgagagaaattcaataacaaaattaatcaaaatgatatgaaatatccctctaccagaaatagatcaagcaaataaaaacataatgactgacacaatcaacaatcttgattatatataccccagaaccaacaaatcaacatgtatctttttcaggaacatatattttcaaaatatatcactgacatatttgcaaaaaattgatgattcacaaagaaaacctttcaaaaattcttcaaatactgtcacacaggccatgcaaaagtaatgctttctataatgcaattaaattaaaatccacaataaaatgataagctaaaaacaattaaaagaaactttaaaaacctaaaattaacaaatctatttcagcaatttgtgaaacccaaccaaccaacaaagcaattatgcggcgtttgttctaagaatgtaggaactatatattatctgaaaatttatcagtggtatctcacattaacatactaatggagaaaacctattgtatctcaaaatctcaaaatgatacagaatgacacagataaggctccacatcattctttgattttaaaaagaaaaaaatcttcttagctaagttagaatagaagagaatcagattcagaatatctttcaagaactttcaacaaactttgaaagtaacgggaaaacttcaggaggcacgatttaaaatgcacaccattacccacattttcctacattaaactagaggcgtgagataatgtgctaagaaaagagatgtaagaattggaaaagaagagataaaactggtaatgtttacaatgatatggctctcaaaacttacactgtgacagcatctgaatggggtttaaaaaacccatgctatatattgcttaggcatacacacacacacacacacacacacacacacacacacagaggttgattgtaaacagcaacccacagagttctgcatggtggtagccacacatgaatgctgggagagttaatcatctctggggaaagaggcagagaaattgaataaagggaggtaacaaaaggggcctcaacactggttttaaaaatctaaagaaaatatgataaaaagcttaagtatagatggttaatatataaatactaactctactttattctatttgtttgaaattattcaggatccttctttataaacattagaggatacgtccaaattttcacacacacacacacacacacacacacacttctgtttataagactaggtttagccttataatcagtgaggaaaaaattgcctacctcaaacagaatgtacactcaaacaatatataaagtacttgtaagaaaaagcatattcctcatataatacatatatgattttatatcatgattatataatgcatatataagcattggttgacttgactgaaaatggtagaagaatctctgtccttagcttgtgctttgactcagtaactgacagagccttttatttaaagctgacaaaatgaacctcaggagagagaggtgaaggtcagtctcttaagaggcaggtgaaagtcagccagatttaactcgacagagagtggaattttctagtaaaccaggccagacaagtacccaggaggccaggctacctgcccaggtttctaagggagacaggacacttgcatttcccacgtggtggaaaagtactccaaaatatgtaacatattgcagctgtcactgggcttactgcctctaagaataaggtcctattttgcattgctcctaccattcaaaatttaagatctgaatttgtgtggagtgtgggggtgctgtttttaaatctgcatctctcaatcctaacactaaagacaagaaagcctaacagacatattttttttttaatgcaaaagtttggaatagaaaactaagaaacagcttcctatagaaatatgggaagaggtaagctcacatcaagagtacacaggccagaaaatacggacagcactctggtcttctagtccagaagcctagcccatacctccacagggtgccaggagatatgagctatacctattttctattttaatttagaaaataaaagtacagggtgctcagttaaatgtaaacttcagaataataacagataattttttagtataagtgtgtcccattcaatatttgaaatatactaagtaattactcattcactcagttcacatcttgtgttttatctggcaactctaggaactcttaagtattcttagtgagaactgtatgcaatgggccaggaatttaaagaaattggggactacatttgcacacaggtggaaacagagccaactagaatcacggacagccagaaacactagttttagacatttcagtttaacgtgcccttttcaaatcttctggggttttgttgttgctttatggtagtagttttagctttgtttttcccccaagtaatctgatctttcctgataaccgactttctcataactgatacagtgagaaacgatctagtgttcaaagtgaacgggataaacaataaaagaacaaatgaaatggagacaacacacacacacgaatatacatacacagcacctgttgtcccttcttgtagagggttagaaatatgacagacaagagcatatgaagaaaagcacacactgattcacagccaaaatacagttgctgctcaaaggttgtactaacaggcttctgaaaatcagtcatccacatctcaccacctgtgatcccgctacagtgttactagcatcaaaatgagaaaagatgaactggagaagcaaccagctcacttgggcaagtcaaaatttctccatgagccagcctatttaatccctacccccataaagcgtttattccagtggctttaaacattgactacatattacaatcacctggggaggtttaaaatttacttatgtctggattccagccctagacatagacttaattggcatgagatgcgtgttaggagctggaatttttaaaagctttccaggtgactctgatagacatccaaagtcaagaactgcatttgtaagttatccccaaacagtgacacctggggaaggccagaaagtgacacgtgtatatagattataaaaagtaagctcctacatttgactctcactccaagctctctgctatccaagttgataaggccacaaaagtgaactttgcagtgagccaagagctaatataaaggaactgggttcttccttaccctacacaagttgccctgaaattctagcaactggaaataatgctcaaatgctggaaaaaacatataaagaactacagaggaaaaaataaaaataaaaataaaaataaataaataaataaaaatttttaaaaaggcaagatacttttggaaatcccactttactggcaaaactcaagataatctgtgagatcatttttgaaatgcaccatctgggcagcatgtgaaggatatcagctcatttcatagaaatgttcggtttcatctggtagcaaacctcaaggggctgctggccacgtgccctatccaatctctggggtagaacctggtcagaaaacacattcttcttccccagatgccccagtctgaggctcaaggcaaactcttgattaactctaatacagaaacaaaatacttcttaagtttcttcaaatgctccctccctcctattgatccgacgctagtccaaacaacaagtcattttcactagtttgaaaataataaaatagaaaacagataaatttgccaccacaaaaagaacacaacttcctggtttctgtgacaagtaagaatgtttcacctaagaaatgacattgtcagaagtaatatctatctgcaaattgaagctgatttgaagaaatacacttaaataataccataaaaatcagaatcttaaggacagagtctcagaggtcacttagactaacccccttcctcaaaatacataaagaaactaagaaatgaatacccaaataaactgactcattcgatttatagcatagagaatctcagctccatatgcaggtggaaacacattttatgaacacacaaggaaaaaaaaaatcacatggctgttcagcagagcacaggtctcctgacctttctaatatattttctaccatactctgaagcctctttatggcttttaaatgaggtcaaatgctcagggtaaagggagagagagagagaactagatgttctgagggagatggaaaatacttgaaatagcagctgttgagagtcgcgtgtagactaggaacacacgctagggatggaggacctgtttgtaactagaaaccacaaatccacacagtggcagaaccttgacagttgtattagttttcctcaatagcttttgtagtccagacaagggtaggaagagccaaacgtttggatctctcaagactagggtttaccacatggctgctatagaaggcaatggggtaaagaaatcaaagatatcaccgagaatgcagcattaaagaatctcagtgtctcagagaaggaagtgaagacagcaagagctgacagacacagagaaaaagatgtctggagttaagcccctgaggaagaagggatctgtggtttgggagaactgtgggaaaaagccagaatgatagaagttggtaggtagaaacaggaatgttataatttatcttttcaaaggccaggtgcggtggctcacgcctgtaatcccagcactttcggagaccgaggcaggcagatcatgaggtcaagagatcaagaccatcctggctaacagggtgaaaccccgtctctactaaaaatacaaaaaaaatagctgggcgtggtggcgggtacctgtagtcccagctactcgggaggccgaggcaggagaatggcgtgaacccgggaggcaaagcttgcagccagctgagattgcaccactgcactccagcctgggcgacagagcaagactccgtctcaaaaataaacaaacaaaaaactaaaactgtgttaagtaaatataagagccagaatgtagatgcagatagtattagctgactgaaatggaaaagaatcaccactggaagtgaggagaggccggaatttggaatgggttatcccagtgttcattaaaagaaaatagagaccagagacctggtaggtcaagagatgaatgtgaccggaaaagttcatcttgaaagtcacataatgtattcctgaatccccaaagaactgaaaaatcacgtcactctgtggatctacgttctgacttactgaagttttgtgttaagagctctcacaatacaaggataagcggcttgcaataaatatgccttattggtttaatggggacattaggatctggtttcagtcacaaaaccaaacaaatgataacactaaaatagaattttatattgccaaaccatgttttaatgtttacaaatgccctatttcttcatatacaagaacaccactgattctaagatgcatcagtatttacataccgaaaagaaagtaaaactgctgttagttataattgtaaaatgcccattgtaaaacacatcctaatttcaggtgtagaaaatgtgtattatacattagataaaatatataaactcaaataatctatataaaccttatgtgggagtttttttattaatatactttaagttctggaacacatgtacagaatgtgcaggtttattacataggtatacacgtgccatggtggtttgctgcacccatgaaccggtcatctacattgggtatttctcctaatgctgtccctcccctagctccccaccccaccccccgacaggccctggtgtgcaatgttcccctccctgtgtccatgtgttctcattgttcaactccctgtgtgggaattattattattattattaccacatccgtgttagaagtaaaaaagatcaaggcacaaacagcttaaatggttgcccaagcttacacaggtaataagaaatacagccaggattcgaacccaggaagcctaactccagaatctatatactcttaatgtccacagcatactatccaaactcaataaatgtccatcgaggaagacaaaaaaccatcatgatacacaagcctaagctttctaccatcaggaggagccagcactgtggagagggtctgcttctgatgcacctgagagcacaaacttcacagaggacttgcaatccacagggcagatctgactcaggcccagtcctctccagaggagctgccccaattagtggtttcctgaaatacagacctcgtggcatgaccagtcagcaccaattcatccccacccacaggtttttttccacttggccattactatccccattaaacctttagcaatatgtactcgtcctcttcttccagttgtcatcatatgcttcatttcatgaaggcaactcctggagccgcgttcacagctgtcccaaataaaggagccacagctgaataagcagccagatgcatccagccatcaggtgatacagcctcaggctgctccattccctctggctctcacgactggcaagctggagggccaggctcatgaaattcacatattcccactgactgcattagttactgtggtaacagatgtcacagaaataggaagtcacagtcatcaagtttctatgtcctataaatatatgaacaaatgttcaaccttgttggtaaacaaataaatattgataaagcagtaatgtatcaattttttgtctacttgtttccaaaatgttttcacatttttatgtcatgaaacccgatgttgtctaaaaatcaataaatgtaatcatgaagtgttacaatcattaacaacaaaaataataattactactgctagaactgttgctaatattaacagttatcgtatgtgttctacgaaccaggaattgtgctaagcattttacctgacttactttctctaatccatggaggttttaaccatagtattccacttgtaggacacttagggtcattagttaggaaagagaaaagcagactaccttttgggaggttgatttggtagctggcatgcaacactaaacgagtacatcatggttttaatgactcattcgttgaatccccctccaataaattctggaatatgttcaaagatgtagatgcaagtattcattacaatgttatttcaatagcaaaaataaatattagcttaaaggttcaaaaacattgaatttcttaaatattatccattaatcttgtaatactccatagttattaaaaagttaagtgaattattttcttctgtttgtgtgtatgcccttgtattttctaatttttctacagaaaactacagatactcctcaacttacattggggttatgtcctgataaactgattgtaaagtcaaaaaatcattaagtcaaaccatcatatgtagaggaccatctctggtgttatttgcacaattaaaataacttatacaaagtattccaggtttatgagcataaccctcggttccaatcaagcattgatgagttgatttcactttacagacagatcatgactactgtagatggagtcacagagctgacgcagtaaagccacacaattaagacaaccgattccatacccagaaggcctggttcaaatcctagctaccatttacaagcagtgggacctgggggggttattttactactgtgtcttgtttcttcatctatatatgggaataatggtgattcctacttcgcaaggtcattgtgaggtttagagttattaagtatttgttcaacgcttagagaagtgcctggcatataggcatgcagtattacatatggctagctgctgttttactattactgtttcgttttcgtttgttttttgtttttaaatggagtctcgctctgtcgcccaggatggagtgcagtggtacgatctcggctcactgcaagctctgcctcctgggttcacgccattctcctgcctcagcctcccgagtagctgggactacaggtgcccgccaccacacgcggctaattttttgtatttttagtagagacggggtttcaccgtgttagccaggatagtcttgatctcctgaccttgtgatccgcccacctcagcctcccaaagtgctgggattacaggcgtgagccaccacgcctggctcatcttcgctcttaactgataactttgcttccaacttcactgatgaaactgaagaacttgcacatcctcccgcctaccacagtccctgtccttggacctattactagaggtggttgtccactttcctatcaaacccaacccctttcttagtacagaagctcttatccctcttactttcttgaaagtatcactctaggtcttccctcttcctacatcaaattttccctctctaccagaaccttctttctggcatacaaaaatgtctttattttttccaccttaattaaaacaaaatgaaatctttcatttgatcgtatttgtcccaccagctacctcatggttttttttttttgttcctttgtagcaaaatctctcaaagtcacctacatactgtctccaattatcattctcttttaaacccactccaaattaaacttttatcccgacacctccaatactctttcattgagaagatcacagtattgtccaggcttccaaattcaatggttaattctcactccttacttcatttgctctatcacgcggcacactccctctctgatacactttcctcacgtagcattcagagctccgtagtctcttagttctcctcctgcctcactggaggctttctcatttctcctcttcatctcagtctctttctgttgcaggtcccctgggtcagtcctggttcttcttctcctctacgttcaccatctcatccagtctcaaagttttaaacaccagttttacatgtacaaatgactccccaatatacatctagagctcagagctccgtttcccaatgccacactcataaatccaaatgtctgctcaacacttcctcatacatgtcaaattgacatctcaagtttaacatatcagaaatgatgcctaatcttccccctaaacatgctccacccacggtcatcttctccagtccatggcaattccatgcttctattgctcaggtcaaataccctgacgtcccagcactttgggaggccaagggttccaggaagactgcttgagcctaggagtttgagaccagcctgggcaacatagaagaccttatttctactaaaagtaaaaaaaaaattagcttggcatagtgtcatgcgcctgtagtcccagctactaaggaagctgaggcagaaggactgcttgagcccagcaggcctaggctgcagtgagctgtgattgcaccactgcactctagcctgggcaacagagagagaccttgtctcaaaacaaataaaacccctgatgtcatcccttactcttctccctgacctccaacagatcaggaaatcctgatggttctgcctcaaaaatccagaatctgattttttttttactacctccatcactacaactacagtccaagccaccacctcctgtgcaaatataatctcttgcctgtattaccataatgatttccttgtaattgctttcctgggcctacttaccctccacaccccctgtgccctcaatctccagttcaacaaagcagccagagggagtctttgcaaatactaggaagatcacatcatgcctctgctcaacattctctaacagctccccatttcacccaacacaaaagccaatctcaaacaatatcctataatgttctaaatcaagggttccttactctgtttgcaccatggattccttttgacagatggcaaaacctacggacccctttctcagaaaaacgtgttttaaatttacaaaataaattacaacaggttacagagagaaccaattcaggtgtcaacatatttttaattgtgatacacatacatatgtactcctttattatcacattaaataacaggatctagtggcaggtgtaaaacctaacataattttgaaatggctctaaacatattttaagatatccacaacaactataacgtgatgtgacagtatctgtgatttcctattgctgacaaagtcatagtctatctatattcatgatggaggaaaatgctaaattttagttagctacgattaaaataaaaaatgatttttttcctatctacattcgatagacccctgaattctgtctacggatgccttagaggtccttagatcccagataaagaacatctggctctgcactgcttctgggagctgttctcctagctaactgctttactgctccagtcatgtacaccacagcactcccaatctgtactcacagcctttgcactggctgttcccttttcctacattcccttacctctccctcttttcttatttggttgctcaaatgtcaacttctcagtgaggcctgcctgccctaaccatcctatttaaaactgcaaccagccctgctatcacaatctcaatcccctgcagcctcttttcttttccatagcatctatccccatctaatatactacacaatgtatttactatgtgctatgatttcactgccccctccaaaactcatgttaaaacatagcccacaatgtggcaatattttgagaggcagggcctttaagaggtgattcgatcagacagccctgacctcatgaatagattaatttattcacggattaatgggttagtgggttaatggactgtcataggagggaagctggtggctttataagaagaggaagagagacctgtgtttgcatgttagcacactcagccccttcaccataccccacaccacctcgggactcctcagcaagaaggctcttaccagatggggtaccttgatcttgaacttctcagcctccataactgcatggaataaatctcttttctttatgaattactcagagtcaggtatcctgttataagcgacatacaacaggctaaaacatgctaagacactacatttctttattgtgtccttaagggcagaaccgtttttctgctttgatacagtgatgtaattcaaatgcctagaagagagcctggtgtgtaggagatactcaagcaatacttcttaataaatgtatacacttgaaataaaattatttgatgagtgcctactatatgacatacttccttcacacataattccatgtaggaataccatgctataaggttttatacattaattatcactgtatatttaatatttacttatttctgttcattccaaagtgaatcctcattcaagtacttagaaatgtccctatatttatgctgaaagaaattagcatggctcccaatgagagctgagatttctgtcagtttaatggtacacaatattggttctggagctaacttccagggttcaaatagtattgactcctctctttactagctttgcagaccaagtagagtttaaaatttctctaagctacaatatctttatcagcaaaatatggataattacctacttcacagggttataataagtattaaaatttaattatttaatccatgtagagcatttagctcatttccaagggcttggcagatgaaaaacacaacgttcagtattgcttgtattatcatcaacgaaacatgaaaatactcacagtgcaagtgccagaatatccatttgtaccatttgagtgcctagtatcctttctcttagaaataaattcatttggcaaatatttttaaattataaaagcaatgagagcatactctatagaatttaggagacaaaggagaatccacccttctaagacacttagcattctgctatatttccttttgttcttttttcctatacacctttatcagtgattcacatctgatttcaaaattgacctggaactcttcagttatgacttcctcaatttctgatccttattataaattatcaaataaaataaattaacagaactcacagttctttcttgctgactcaggccagtcccagagtttgagatgatctgctaggacctcagacaaacacactggacggttttccaggtacatcacaacaggacagaatttttttgtccctggtagagatgcttacagttcccagtctcctgcacagcctcattccttcaaatactctacagctgatctgagtttgggtgaggaggggaaaataaggtgagagatttggggaaggaatacaaaattttgtcggagagcctgtatagactggggctgactccacaggtggaggggtggggtggcgagagaaggcaagttagtgggaagggagttgttggagcaggctcatatatgagggaactggctgtgtcctttgtaaccttaggctctggttataaccactgaaaaccaggcagcaagccacagtgaaagaaaatttgccatgacctggggaaagataaacagcattgacacttttgtagaaaggagccagccactttcacttgctttgccacacagaactgactcaataaatgtcagctgtaatcatgcacattccaggaatctacatttttaacattgtcacaggtgattcggatacagtatttttcaaagtataaactagaacggtgttcttcaaactcttttgcttaaacacttactaagatttttctgaaaaataacatgcatatttttaagttgacatccaaaacttttaattttcagtctaaaaagctgcaaagaataaattctgagtttatgaatactgataccttaaaataaaactattatggttgggtgtggtggctcacgcctataaccataccttgggaggccaaggcaggcagatcacttggtgtcaggagtttgaggccagcctggccaacacggtaaaaccccatctctactaaaaatattatacaaaaattagccaggagcagtggtgcatgcctgtaatcccagctactggggaggctgaggcaggagaatcgcttctatccaggaggaagaggtagcagtgagccgagatcgcaccactgcactccagcctgggcgacagagtgagactccgcctcaaacagtaaaataaaataaaaaataaataaactattacatccctcttttaaatgtagctaattgaatctaagaacactgatttgccgccctgcatcttctgtgtttaaaaatggtgtgacctaatttggagttaacattcagaagttttacatggttctttttcatcccttcaaacgtttcaattttatttttttccatggaattcattgaaaagtaacacagttttatgcttgaatattttctattaatcaccctgtcattatttctgtgggatgcaaatagtaaataagttgttaaaatgtcctgtcatcaaaagaattttaattttaggtttacttctggactgagttataatttttattgcatctaacctatgaaaacaacacgtaagatttaataattagtcaacataaaacaggcgtgttttgtattttaataaagaaggcttcccagataaattatttggaattatccttactttaagtccctgggagtctttacacttgagcaaagtatcatagactcatttggaatgggtgagactttcacctgttgttggaaattggatggaagttccatttaaactaaagagtactaatggaagctgaggatctggaaaagaatttgctcaaaattatccagggttccacgattttctttggagtttccttctgtgtcccccactttgaagacttctaatgtagcaccctcctatatacaaaatgtgtgggtatcttgttaaaaaggcagattcacagactccctccagatatctgaattaaaacaggctccccagattatttttgtttccccactgaagactgagaaaaactgaattgggggataaaacaaacacacacgatgttaaacaatatagtaagatttaaataaaaattcaataaaagagctatcatagtcattatctgattgtcaaaaaattcagaaaaggtaatgggaaagtgagatagccaaagcctttataaaggaagcaaaactggaactgagggaagggtgggtagaattcgaaagataaaggaacagagataattatttaccaaggttgacaggtatgagatattaatttgttggctagattggagcagtcaatgcccttagaaagtatgtgtggctcatcacagagaccctggtagaatagcagtgggtgattttgtctaagtgtagcaaatatgataattacttgttaaaaacataataggttattgaggaaacttattttttatgtaaattgttattagacagctggttttatgaaacgttctgctggaaaattgacctagagctgaatgtatattttacccaagcactggataaactataaaaataataaagactactatatatcacttttaagccctacatctgccccaggccaggcaaataaattagtgtaaattcaaattatctccttctgttcttttaatagccctgacaataggcttagcaagaaaagaggtatgagccatcacctaaaatgaaaccaagaatatctactgatttttattatctctgattccattaccactcggtgtcatgaataataaagattttgaatgtatctgttcataagaaaatagaagtcattggttgcctctatcatctctcctctggactactattagaaaccccaaactggccttcctacttccccactgccgccactcaccttcctcccagactcatatccatccttggtatttctagaggagtcttacagtgttattcccttgcctaaaacctttcagtggctcccccagctgtctacagtccaaagtgctcagcatggcatgccataatctccctccccatggaagacgtggcaccatcccaatctacaggcataatgcccttgtgtatcatttgctttgtctcatgtatatcattcataataaactaaaaacaagtgctactctgtctttgctctgcatgtttgctctaccctgcctctatctgacttactcaaactattgtctccccaagtcagctccggaagcctgtcctaattacttatgtaggactgatgacagtctcctttgtgttccactatatgctaatcactctttctataaccgcacctagaatgtttgattgaacttatttgtgtatttgtaaacattccacctctcccaaccctactctctgtcacctaacccaccttcacagtggcaaaaacaacaaaacagaaaaaaaccattaagtgcttgattccaagtacctgtcaaacttagcagaacctagtagatgcttagtaaatatttgctacataaatgattattatttataacagtggaattaataacagcaccaatgaattagacactaataatatgctaggtattactaaataagagttagatatgatctgggagcaatggtgactctgatgtcacagccatttacttgcaatgtctaagattacaccaccagatagaatatgtgctctaacaaaatcaagggaaatcccccaggagtcatcctagccatgctatgtagctcaacatacaatagcatcttttttatcgaagttcacttctacttatcttgaatagtggtacaatgaaggagtcttcacattaaaataacttcagagattagcacagaggacagatctgaaaaccatttgttattgtttctattttaacaaatctagtgctctactacagagtcactggatactttggtacttaaaatacagaaaatgtctccagtttcctttagttcgccttatcttgaattcaaaaggttgattattttgggctaaggcttttccttatttaaaatggccagaaaaatcagcaagtcaaattcagcatttcatcatgaccaaataaaactcatgtcaagaatgcagaggtggttctaataaatctaaaatataaatcactaaacagattgaaaaaaaaaaatcacatgagtcacatggtcatttcaaatataccagtaattaaataattaaattcaaactacttttcgtgaagaatactttgaagcctaggtctatgatagaagagtattaaccagaaatcttcaacccgtaacacctaactggaaaatatcagaaggaaacctttaaaatcaggagtaacacaataatgtctactattcacttcttgttcagctttcttttgacgttcctcaccagttaaaaaaaaaaaaaaaagactggaaaaaaatagttactattcacttctttttcagctttctttcgacgttcctcaccagtaaacaaaaaaaaaaaagactggaaaaaaatagttaacaatttgtgttttattttctaatgtttacaatctgattaaaaaataggcaaaggacttcaatagacctttcttccaagaagacatacaaatggctaataagcaaatgaaaagatgctcaaccttactaatcattagaggaatgaaaatcaaaaccacatcatctcatacccattaaaacggctattaaaaaaaaacggtaaataagtgttgtcaaggatatgaaaaaattagaacccttgtgcatgattggcagaaatataaatgagggaagatggaagtggcagttgtttaatgcacatagtgtcagttttgcaaaatgaaaaattctggagaaccattgtacaacaatatgaacatacactactgaactatgcaattaaaaatgggaaagatagtaaatttcacagtgttttttttcaccacagctaaaaataaattttaaatcattaagatagtaaacttcatgttatgtatattttaccacaataaaaattaaaaaataaaacataaattgtcatgatgtctacctaaaaaaaatccaatgctctccattgaaaagctagaactaataagagcataaagtcagaattaatagaaacataaaaatcaattgctttggtatataaataaaaccaatgagaaaaaataatgagaaaaatcccatttacaatcaaatatccagaaataaatctaagtgtgcaaaagctataagaagaaaatggtacaagtttactgaaggtcataaaagaaatcttgcagaggcaagttatgctcctggatgggaagacagcattataaggtttccttatattgatctataaatttaatagaattccagtaaaaattacaataggatcatttcatagctcttgagaaaatgaccttaaagctcatatacaagagtgtaagtgcctaagcatccaaacaaaatttagaggaaaaaaacaaattgaggtaatctgaatgatcagatatttaaataactttaaaactacattaattacaaaaacacagatttggcacaatgtttagagaaatacatcagccaaaaatgataaaaggtctatacacagatcagcatataaaagtgatttataaacaagagtgttggtactacacagtctcagagcaagagtgaaggatttagtaaatggtgttggggcaactggtgaacaatttgggaaaaacaaaactgataataacagcttacattactttggtttcacaaggagccagaactatatcattaaatacagaaaagaaccccccaactttttttttttaaacaaaacacatccctgaggcacaaaagggaattaatttgcccagagtcacacagccagtagctgctgaagcctaaaatttgattccatgtcatgggattccatagccccagctccccaatcattataacacactgctaccccttaacatatccttatccataacacaaaaacaaataatggaagcgaaatctaaacatatgcgtgtatatttaaatacagacagtccctgactcaaaatggtttgacttatgatgatttttcaggtttacaatggtgcgaaaatggtaggcattggtagaaactgtactttgaattttgatctcttccctggttagcgctatgtagtacaatacccttttgagaagctgagcagcgagccatggtgcccaatcacaggatcacgaaagtcaacaactgttaaatcaactttagcctaaagctgcctcctccttacgttttcatgtcttaaatgtttttctatacatcatgaactataacaaatggaggtgtaaaccgactgtagcccacacctgtgccaatcactgaattttggccagtcaaatgtagccaactgttctgtgttcaaataagacaaatgccgagctgtaaccaacccagttgttcctgtgtctcacttccatttcctgtacatcacttgccttttgccgtctataactcttgttccaccatgtggctgcgcaagaatctctctaaatctgctgtgattctggggactccctgattcacgaattgttcattgctcaattaaactcctttaactttaatttggctgaagtttttttaacagatggtgtcagaagtgggataaaaagtggcacccaggagtactgtgtaaacaagcaaggtactgatggcagcggcggcctatatggagcggccactgccatgatgctggctgcagttggggaggcatggccagggctacatgctccatgcagccagtgggagccaggaacaggcagaagccccaccccttctaagttggcagggcacagctgcagctgcccagccatggctgtggaaccaggcatccccatgctcttgagggccagaagcagacaaaagccccgccctcctgggtgcagctgcagctgcccaagccatggctgtggacctgggcatctctgcactctcagggacccaggaagtccccctttccctacaggctcaaaggtgcctgctcccactgcccagcctctcccctattctggcacctgctctaatctcagtgcacagttgagaccaagcccaggcattgtcataacctagttgggtatctacacattcagggcagtgctgacatgccagccccctggggccttggtgccctcaagactttgggcaccaatgagcatgggatggaggctgaggaggggctgagggcagcttagcattggcctgcaggtgccccttggcacaaacactctaggttccatgaacagtggcaagaggcagacaggttcctgggtgaaaaggggtaggtccctagtgaggccccaccttcaagctggggaaggtctgaagcctggaggttgggctgccagtcccacagagcacagtgggaacttatgatgctttttccaggcccacctatggccacccatggaccaatcagcatgtatttcctctcctccgaagcccataaaatcccagactcagccagactcaaaaagggacaacaggacaaccatctgtggagagaaactacccaccaaagggtctcctctctgtgagagctgagaagatgacaggatgacctgcctgcggagaggaactactcaccccaggatctcctctctgctgagagctgaaaagggatgagaggatgaccagctgcagagaggagctacccaccccagggtcacctctctactgagagctgaaaggggatgatgagatgaccagctgcaggagctacacacccaagggtcttctctctgctgagagctgaaaagacgacaggatgaccagctgtacagaggagctacccactgtaggtctcctctgagctgctctattgttcaataaagctcctctacaccttgctcccccctccacttgtccatatacctcattcttcctgttgtgagacaagaacttgggacctgccaaatggcagggctgaaagagctgtaacacaaacagggctgaaacatgccccttgcttgccacattgtgggtgacaaggaggagagaaaagagctgccacccttcagggagcccagacctaggagctccccaagccagggctgtgacacctgctttggggctctgcagtttctggcttctcccaagattccaggtgccaccgcattccctgatgccagccgtggaagctgcttgtggtacatagtccagccatagcctcgcagggagtcagcacccatgctcgcacctggagctgcccatcccgctgcagccagcatgcctggctgtgggcagtggctggaccccatgctcacttgtttacacaccctatgccactccacttgcccttggtaggcatggagtccaggccagtagcacctcccgagggcagcctgccaggctgagtgggacctgcagtccagagcaaaactcaggcaaaagcacccctggccacagaggtttctggctgttaagaaatatcccaaaaatcctgtaattgtatctgctggacccacttgtctcctttgatctctcagaggggctggggattgcagtaagttgcctcttggatttcagagctccatggacttatgttttgagctatccaagtttcttcatgcaaatttctgttccaaactggatttggaagccgtgacagaaactggactgggtccaggattgaatctgatctggtaattaactggcttggatccagttagaggccctgtacaactcactgggtcagaaagaaactggtagtaaatggtaatactgcaggggttgaaaagtttggcttttgaaaattcacagggatttttgtgttctaaccctttgtttcatttttcgtgcacatgtaggtaggaaaaaaaatcattggctaaattaatcaagggaacctgaaaacaaagccaatatttcaaataaaaacgggatcccttctgcctgccttggcatcccaaagtgctgggattacaggcgtgagccatcaggcttaaggctcatttttcactgattttcttgatctggcatttaattatgaaataataaaagattcatggatattgttcttgccttgctgaaatggtattagctaagattttaatttattattactgttatataaaatgtatattatatcacatataaatatatattagttctatacttgtgaaaatatcaatctctagagaaatcattcgaataaaaatgtcctcatgtcaaaaaaagaaaattgggatccttaatatctggaaaactgagttccttccagcttacacattaggcctgggaagcagcgagtcttacagaaatggcaaaatgttaataaagataactcacagtgcaatgttctgaatgaacaatgcactgaagtgcatttgaaaatgagggttcccaaattagtctcatctagggatgcctattaatatgcagaagcttctaaaaagatttagaaatgacaggacccatctggggagaagtttgacacttgccagtttgatactgcgtgctaagcagaatggctaatgtctatgttttgtcacaagtattttgctctggccagaaagaaaaatgctaatttggttactctatgcaaccccttggtcagcaacttgcaaaattgaggatgttgcttgcctgtggtttcataatttttctttgtgatgcaggatggaccccagagctatggtatggcaaacagggttgctgggctctcttagggaaagagaacccagaaacctgacatactggcaaaaacgataagaatttcttacaagtcagacttctggtctctctctctgtgcaaactggttgaatgaatggtaaaaatcactgtttatcccctgtaaacttttgattaatggaaaaaatgatttctgaggctagtcaagctgtagccaatctggtgtggtttgtgtgtctttctgcacggttctatcataaggaagaataccgtaggataaaacatgggcttagaacctcataaacccgctgttcaagccagtctggcaaactggtcagtaacaaactttgctgcagttccctgaaacaagcaaaaaactggatgagatctccattttgttttatgtccttgggaacttgatcttgtaaccacatggcagtattttcttttggtctctgacattttacaatggcggtctggcttaggaaatgagtactttctggttaatgtctgtgtggcctttaccatttgctgattcttttcccccaccatgagcatcttctagcttcccttcttatatcttcctttctcttagttacctttgaagattctagattttataaaaactgtttgccacctctttgaaagtacctcatagacttgtggttaagtcataaccttagttcaggcttcttgttttcacctgtgaggttacttttggcaaagtttaaaagcgagaaatattggccactttgtgtgcctaaagttgagtaataagatatttaaaaaaacttttataaacagtgctatatttaaaagtcagcttaattaaagcaaatactcaagttctaacagcctgggacaccttgggaaaagcagaggaagcaccacagaccctgttttgggaaaaacctctgttttcctcataaagcctcagaaattaaaagcaaatagatccctctcgaaatctaaggttttcttcggttttgcatggtgttagctgatgattttgagttatcaagggtatcaggaaatgactttgaagactcccatgggagatgggctgactccctctttttgaaatgcaggttctggtataaagatgggacccttaatttctgaagatctgttttgccttccagctgtgcctgcttattatattaggctgtagaaactgcatactttcctggccctattcctccaaggactccatcctaaagcaagtaatccaattaaaaaaaaacttagaaactagtaaatgaaaaatcttacaactattggatcttcttctgtctgagtagttatatatatatgtgcgcgtgtgtaatctttacataaaagagctctaatttgcttaaagaaaaataagtgcttaaatcaaatattttgaaaaaattaaaaactgtaatgccttttagttcctgtagctttggtaatctttgggaaataaaaagttttaaagattatgggtaaaataaaaatgtcttcaaaatgtaaacgtggtctaaattatgcaggtcagatattaggtttgttaaatgctttaaggtcataaactgcttcttcagcttttgaaaattgttcagttaacctattttggagcataagattctacataaggcctggggacatgtggaattagccatatcccttagctatgcaaagaagttataaagaaatgagattatatataagaaagaatcttgtatggtaaaatcttgtcctaaagtaaaataactggttatttaataagactgatgtttaggacaattcagaaagtccaggcatgttgtagatggtctttgtaagttgtgaaaggattcatgaaaggatatttatgcactaaaagtaaaagtttctaacagttaccattatatcatgtaattgagactactaaaaaaaaagttttacatgcaaggtgcgtaaagaaatacattagtctgttttcatgctgctgataaagatacactcgagactgggcaatttaccaaaaaaaaaaaaaaaaaaccaacagtttaatggacttacagttccacatggctgagaaggcctcacaatcatgacaaaaggcaaggaggagcaagtcacatctcacatggatggcggcaggcaaagagagagtttgtgcagggaaacttccacttataaaaccatcagatttcatgagacttactattatgagaagagcatgggaaggacctgcccccatgattcaactatctcccaccaggtccctcccacaacacatgggaattcaagataagatttgggtgaggacacagccaaactgtatcaggaaagtaaaaggtgcttttagtaaaagattaaaagaagtcatcaaaatgtggattttctttcctaaatttagacggttaaaggattgttttaaattaggtaagataaagctaaaggtttcaacaagttgtggaaggtttgtgaaaaattaatcttgtaaaaaattctctgtgtgaacctattggccagttaccatcattttgtgtgtcaaaacttggtgctaaggccctaagttttggtcacattgtaacctaagtgagaacctaaccagaaagggggaattttttttaaacaaaattatgggaggcccttgttttggacttagctcatgcattaggccccaacagacaaaaccaaacaaaaatgaagtcacttgtggtaaatgtgacattatcaaactgagactttaaggaaacacatagctcctagaccagaacagaccaggtttgttctcctaaaaacaagatgttccaacataaggggataccctctactcaagtccttgttcctacctttgcaaaactcacagttctgtttccagggggtttcaagaccaaattagtaatttatgatggtgatagtgatagtaatgactaaagttttggtcaatctctcaaaattgagaaaatgaccaaaagaggggaattgttaaatcaagtttagtctaaagctaccttcttacatatttaagttcagcctacaggtttttctatacatcgtgaactataacaagtggagatgtaaactgacctcagccaacacctgtgccaatcactgagttttagccaataaaatgtagccaactgtccaaatcgtgttcaaataaggcaaacactaagctctaattaatcccgttgcttctgtacttcacttatgttttctgtacgtcactttccttttgctgtctataattgttgttccaccacatggctgcactggagtctccctgattctgccatgattctaggggctgctcaattcacgaattgtttattgttcaattaaactcctttaaatttaattcagctgaagttttttcttttaacacaaccaatataaccattctatttttcacttctggtacagtattcaacaaattatattagatattcaacactttattacaaaataggctttgtgttcaatgattctgcccaactgttggctaaagtgtgttctgagcatatttaaggtaggcttggctaaggtgatgttcagtaggttaggcgtataacgtgtattttgacttacaatattctcaacttatgtttatcagaacataaccctattgtaagtcaagaagcatctgtatacatattgttaaactttaggttggaaaatgcttcctttagaccagatttcactacataaaacttttgtataatgaaagacaccatgaaagaagagtcatggcaagttagagcctaagattccaatacatacaatgataaaaggattttttttttaatacatagaaagcttcttcaaatcagtaagaaaaatgactaagaacctcattttcaaaaggaccaagaacaccaggaagctcataagaaatccaactggtcaataaatgaaaagatgtccaacaccacttatatcagaaaaatacaaatttaaaaaacagtgtgtgatttttaacccattacataggcataaattaaataaatgctggtgaagtatgagtaatgggcattctttctttggtttaatattctgagaggccaactgtgtagtatctaccaagtaatgggccaggacacaacaattccacttcagtcctatcaaggtactcacaggtatgcataaaccaaatatacaagaatttaatgacagcattatttgcaaacagtgaaagattctgagcaatcaaaaggttcattactacaggcataggtctataaattactactgtatggaatactatgcagccattaaaataatgaggaagagggagagtgccctgtatgcactgacatagaaaggtttcagtatatggtaaaaagcagctcatcttagaacagattttatagtatgaccccacttgtgtggaaatattttgtgatgtgccactcagtgtatacgtattcatgagtgcatatacaagtgtgtgagaagcaatgtaagtaactgttcacaaggaccccccctttaagaaggcagagggatcgggggatatagagtgaaggatgatttttgctttttcctctatatatataccattctctgaattaggtatgatcattccagggtatgttccttggattttttacactgcttccttctatccttcctgagaatcagatgtgtcctctttaatcagaattgaataaaacagtctgggaaaggttaaggtgaattatggctgggctgaaagaaatgggggccacattaaaaatggaaagaaaaaactaaactggaagtcagaagaccaactttctagtcctggttctgttgttacagtaggtagctagtcagacatgagcagggcaggagagggtcccctgccaccaccaggatgtcgggcaaccatcaggtgataggtggttgtgacagtgccgctctaataattggtcacacctggtgccagagaaaggcagtctcccaatagatataaacacctgaaactggtgatcagcagcttcctagtaagatctcaggagttgggtgagtgggctcaagcatgggcatgaagaggcaaaacagcagagtttttagctggtatatgaccttcctctagaaacgcttgactggttagggaaaaatgcctcaagtgagcacgtgtacaactccaataaacacactgtacatgcagcccctcccaagtgctggcaggccactgcacatgctgatagcccactccaagggaggaatccggggagaaggacgcaagaccccggaagcataccaacatataaaaccccaagtcaaaggtcaaacactgcacttgatctctcaagtaacccacttggccctgttctaagtgtattttacttccttttgttccagctctaaagttttttaatcaactttcactcctgctctaaaacttgccttcgtctctcactctgctgccttatgtcccttggtcaaattctttcttctgaggaggaaagaattgaggccgatgctaacactatcactaattagcaaatgtgataacctttctggacatctatttctctgtaataaggagagagctaaacctgatattctccaaggttccttccagttcaaagaacacatgaatactatacataactatgctggtgtcttagccttgagattctagtttcccaactgaaatgtctgaaaatacttgatttaaaatattttattaaaattatcatcagcatgtagccactaaaaatggttactaggaagactacagaaaaaacatggaaaacattgataggataaaaaggaactcgataaaaatgctgggttcagcatggacacaaccatgcaaatacacgtgcatggaatcaaagacttaaacaaatacacaaaaaggaaaacagttacttcacctgtctgatgtctttttctgacaccaaccaattctccaatagcaacaccaattctctgatgtcaactgggtgtcctacaattcaattcaattcaattcaattctgacaccagagttagcatcagactccaggtttacaggctcagccccacaatgatagtgacaggaggcagccaaatacctaggcagataagggtggatccctggtgaaaccccacctcaaagctaaagacagtttaaagcctgaaagccaagctgtaagttaaatccttggaccagactgagaacttatcttcccatttgatgcgttttcctctgattgatccccacccttcccctattttatatacacctacccttttctaattggttttctacactgtcatgcccacctttgagtggtgtctttactttaaccttttttgcatattcacaaaccaatcagcatgcactacccattgtgagtccataaaatgccccagacccaaccacaggcagagaaaccacctgactgtgggggtgtgggatcatcccccactccccacagtcccttctctgctgaaagttgttccattgttcaataaaatcctccactctcatcacccttcaatcgtcagtgtgacctcattcttcttgaacgctggacaagagcttgggacccactgagtgcaggtactctgaaaggctgtagaactaggcctttgccctcactggtggacgccagccaactgctgactgggctgctaacacaccaccatccacccggctgcagacagcagaactaaaaaaactaattagcacactaacattccctctggggctttggggtcgcaggcacccctgcctgggcattgccacattccccttgaggtaacatgcctggtctggcaatgggcactgcacagaagttgctcctatgttggcacttggagctgccagccaaaccctgcactcgttcactcatgtgctcactcccacaaggggctgagtgcagcatgccgagtagacggggtgcccctgctgcaagttcgggaaaggggccaagaagaatcctgcttcaacaagactgccctcattttggaggccaatagcaagtactgggtcctcagaatatccatacatctgactaacttggctacaaacttcggtgttcccacaatactccccatctcaagtttgataatttcctggaaaagactcacagacctaaaaaaaaaatgctgtctgtattgttataatgtattataaagaatacaaatgagctgccaaatggagaggtataggtgaagtccagaagggtctccagtaaagggagtctctgcccctgtggagctgaggcatgctacttttccaacgtgaggatgtgttcgttaactcagaaactctccagatgctatggtttagcgttctttcctttctttgttttcttttttccttttcttttctttctttcggagtttttaatgtagatttcactacgtaggcatgattgagtaagtaaatcactggacactggtgaatgaactcaatctccagtgcctctcctctccctgagagttgaggaggtgctaaaaaatccaaccctctaacgaagatgtgaaccttccggtgtccaacccccatcctgaaactttctaggggccttaccaggagtcatctcatttgcataaactcaagtacagttgaaatgggctcattgaataataaaaaatccacatattactcctatttctcaggaaattcaaagggttttaggagatctgtgcctggaaatagagacaaagaccaaaaatatatttcctactgtacaactaaatatacatttctgcttacactccaccatctcaccaagatgttctttaagagtatttctacaatcctgtaaattaaaaggttagatttttttcatctaaatattcttatatttattaagtcctcaactatgactatggcatcatttcatttttacatgggtttggatcaagtaaaggtgcccttccgcaaaaaaactttcaggatgtaaaaactggttcctgtaagaaaagaaaggcatgatcttaacaatgttgcatccatctatactatttcatactgagaagcaagagcaatctgtttatcaaacccaattaccctttccctcctcttctacatgaaatggtcgcaatagattaggtagagagaaagaaaactaaacactttgcaaacatcaaaaaggagttgaagaaatgagggatcccaccatgaggcagacataaagccaatcacagcttccggaaaatgcaggctgaaattctttccaacagtttttggtgaaagcttttatgtctcagttatttaaaactctatattgcctaattattcatagatcagttctagctacttgtatcttacatggaaatacaaagagctgagagtaaccaaggaacaaggacacattctagcagggtatcataactgattacagagttatagttgtaaaccaaaaataaaatttgaagccctccaacccctgcaaccatctgaatggactctctcctcagccacagcactcaaaaatttaacctgaacaactagttcaggccatgatgggaagtggggattggacaatgcctcattatacccctgcagcattaatatcaatatagaccttaagtctgataaacatctataatctattctctctgaagcctgctatctggaggcttcaactgcatgataaaaccttggtctccacaaccccttatcttaacccagacactcctctctactgataatagtaactctttcaaccaattgccaatcaaaatatgtttaaacctacctatgacctggaagtccccccaccccttcgagttgtcctacccttccagattgaaccaatgaaaaccttacatctatcgattaatgtattacatctccctcaaatgtataaaagcaagctgtaccctgatcaccgtgggtacatgttgtcaggttttgtgtttacacagtcattaagacagtgtgaaactggtacaaggctagacaaagctacagaacagtggaacagaatacagcccagaaggtgaaggtaggcttttcaataaacaattctgggtaatttggacagaaaaacaaatttgactgtacttcaactcatagacaaaaaaaaacaaacaaaaaaatcaacgcccagaatattgcaggtctaaatgacaaatgaagagcactaataatttttaaagataattaaaatatatgtattttcatgattggcttagaaaaataagaaggctcaaaatgccctaaccaataaaaccagattcattagagtaaaactgagaatttatcctaatcaaaaaccactattaagagagagaaaaaacacttgcaacacacttaaccaaagagctcaaatccagcatataaaaataacttctctacaaattaatatgagaaagagagacaattcattaaaattaagtgactcagacaggcacccacgaggatatgcaatggccatgaaaaagtgctcagcctggctggtgatcaaggaaacaccaattaaaaccagaatgagctcaaattagaaaaaccaaacacaccaaatgacaagaatgcggagtaaccagcactgtcatatgctgctggtggatgtataaactgataaaaatccctttgaaacactgtttagcatcatctgctgacatagaatccagatatgccctattaccagcaattctatttccaggtatacacccaaaagaaatgtctccctgtatttaccaaaaggcatgtccaagggtgttcagagtaatgtttgccattaaaagaaaaaccttagccaaattaagtttaacaaagtttaattgagcaaaggacaattcgagaatcaggcagtctcctgggccaaagcaggctgagagaccccagtgcagccatgtggcacagaagatttatagtcagaaaaaggaaaatgacatacagaaaaccaaagtgaggtacagaaacagccagattggttacagctcagtgtttcccttattttaaacacagtttgaacagtaggccccctttgattggccaaaactcagtgactgccacaagagtaggctacagtctgtttacacctccatttgggttacagttcactatgtacatagaaaccttaaggttgaacttaaaatacataaagaggcagccttaggcttaacttgatttagcactgtaacagccacaaactttgaacaacatcagtgtccaccagcattagaactggataaatatgttgcaatatattcatacaatggaatactataggggaatgaaaataaatgaactacaggtacatgtagcaacatatatgattctcacaagcataacgttaacagaaagaagccagacacaaaatgagttaatttatattaagttcaaaagcagatgaaactaggccgggcacagtggctcacacctgtaatcccagcgctttgggaggctgaggcaggcgatcactggaggtcaggaattcaagaccagcctggccaacatggcaaaaccccatctctactagaaatacaaataaattagccaggcacggtggcacacacttgtaatctcagctactcgggaggctgaggcagaagaatgggttgaacacagaagcagtggttgcagtgagctgagatggcaccactgtactccagcctgggtgacagagcgagactccatcttaagaaaagcagataaaactaacctatagtattagaagttaggatagtggttttctttgacggaaagggaaattgtagcaattggaagggggcaagaaggaaccttctgttgtgctaaagatgtactatttattgatctacatagtggttacctgggtgtgttcactttgctataactcagagctatatactcttgtgtacttttctctatttttgttattcttctataaaaactggtttaaaaaaagaaagtcagtggtgctgcagttgaacttcatatatattgtcttatctctacaataattgtttaaaattatcattaccctcctttttagagacaaggatgaaaatccaaacaagtaaattatcttgccacatgtcacagctggcacatgacagagccaagcttcgaactcaagtttagttgatgctcaaacccatgaacccctgcagtaaaagtaatgtcaaacttaattatttcttcaggactttcccggtcctactttcctttccctctgaaatcattttctacctttctcatctcatgttctcaccccttcatcaagtgcttccctttatcttggggggaaaagtgcttccgagtttacctattgcaactttgggtttagttatttctcagaaataatttgttctacaaaagaagaaaaaattgttatttacaatttcccatctggtttctatggagaggggatctgaaagagtgtgctctatttgctgagctagttgatggctataagcacatgaaagcagactgagcggaaggaactaaactgcaagtgaaaagtatgatggggctggtggtggaaaggcgtggcggggctggtagtggaaaggcgtggcgggctggtggtggaaaggtgtggtggggctggtggtggaaaggtgtgatgggggtgctggtggaaaggtgcggcggggctgctggtggaggaggctgaagccaggatggtggagaggtcgcttggtggatgatctggagaaagaacacttggtggctggcaatagatggagatttgcagaacagaagaaaaatgaagccacctggatagaaattatgagaaagacgacgactgaaaaatgtttgtaaaaatgtggtgtggaatatggagtatcgacctcattctaatcttcccaaaagaggactcaaagtagactgaatgcactggttttattttctctaaaacccagtaaaaccactgaaataacaactgttaaaataaaaatgtttgctcatgtacctcccaaaaccatttacatgtacaccatgcattttactacacaaactgtggctcaatgaacggtagttgaatgaacctcaccttaactttccaagaatccacagcctagaagcatttttatttgcttgaaattgcttatgcttcatagcgtaaaaaataccattcactcccttctttgattcctatttgaggaatcaaaagaacagcgtgaaacaaccaagtgagtttttgcagatgagtccagtgagccaggatggcctcatatgctctactttattgttcaggtccactcacttcagatcccgtaatttgtaataacctgcataattttttattgacaaatcatagttgtatacctttacggggtagatgatgcggtgttttgatacaggcataccatgtggtatgattaaattaagctaattaacacatgcatcacctttcttgcgtatcatttgttatggtgagacatttgaaatttattcttattttgaaatacagaatacattattttttactataatcacactgctgtgcaacagatcacaaaatctatttctcctgtttatctaaaatgttgtgccctttgatcaacaactctccattccctccgtctcacatccccagcctctgataaccatcattttattctctacttccatgagttcaactttattagattccacatataagtaagagcatgcaacatttgtctttcttgtgcctggcttatttcacatagcataaggtcctcctgatacatccacattggcacaactgagagaattccccccacccttttaaggctgattggtattccattgtatatatataacatagtttatttatccattcacccactgatgaatacttacactgatttaatgtcttggctattgtgaatagttctacaatgaacatgggagtgcagttctatcttttacatattggtttcagttcctttggatatatgcccagaagtgtgattactcggtcattttgtagttctatttttagttttttcaggaacttccatataattttccataatggccgtactaatttacgttcccacaaaaaatgcttctgatcccatgtattttccttgttggatctttagatactggtacattggcaaaaagatttaaaaaaattttaatccatcactcttcaattttagactatctttatctccaaattataattccaactcataattattacacataatttatcaacagagtattaataagttatgtgtatctttcagcaattcataatctcactactgtcatctgtaaaatgagtaagttaaactaaatgacctaagatgtttgcagctctcagtttttatattctaaaaactgagactctatattttaatctcttgcttctactctcctgagccaaagatctttactagtatctccttgaacacaatatgtgattcttgagtctccagtccgcacttttgattcctctcctaaaagccaagctttagttcccatttatgttgggagagtcagtctcctctagagctcccagctgtgtacatatactaagtggaagcttagcacaatacacttcacctctagtttcccagtaaacctttttctgcacccacaaactgcaagacttttctggtctttagtctgtacagcttccaatttctaggctatcacaatccaatcaactccatgcaagtgatgatagcaggctacaggggtctatgaaagatagtacaatgcacaaacccattccccagacggtgaaagagaaaattaagataatttgtctggacacataactttaaaggaaaatccattgctgactaacgcagcctgttagctatgaatgcagaaattaaaactcaaattatagtaggccaataaagtagtacaaggtgtttataactctctttgactgataaagcaaggatacctgacttatcaggaagggtggcaaatagctctcattttataatgacgtaaattaaaatgagaaacaaaccagaaaataggtggatctttattaaattgaggaatggtttatttctctatttaatttaaaatactctaaatagggatgtttctaaattgctcctaggttctgaggaaagatgtgtctgctggagaggccacatgtcttgacaatttgcttactttcaataactacaatgtattatgctaagttctcttctctacaaaagctatggtcctcacactcagcagggcagtacatctgccattccccagccccaggccagctctgagatgcttcaggtagagagaaaagcttttccagatgcacattgagagagaaaccacatatgcacaattcaactcagaaagcacgagtgtttttcttcaaacttttttctttctcattctgtgagtaattcagtcactgacagttccctaaatgttatcattttaattccgaaaacattaacctcacttcccctgaggattttgagatgtacatcatgacaatgtattttttaaatgtcttaataatgagaaatttcaggtagcccttcataatacaacataggagatggaggcgaaacgaagcccagctttcggttgagtgttcggaacaggttctccctctgaacttccaagtgcccacagatggctgtggggtggggtagaggacctaaaatacatgttaaattcggtgtcatgttttcttctgtgctttctatcattgctagattttaaaggaatctaaaaatatgaagaatcactaaccacagtaaaactgagggaaggtaccacaggtcagtccaaatgtgtccttcacccagtcaagccctgtccctggggagaaaatcacctgcaataaagctagcatgctcgagtcactagaggcttaggagcacattagatttctaagaaaaataaatcacaagaagcaaatccatatcatgtatttatcttttaaaacatatgccagggaagatatttaggaaaaaatacaagatatatacatatatacaaatatatatttatatgtaaataaataccatacatttaatttgctgaatgtcaagaaactttgaatagttttataagacacgctcctcgtgaagttactaaacattatcattcctacctcacattgatttataaactaatacaattccaataaaaattttaagtttttctagaagaatgaatatataaggaaatccaaaaacatttttaaaagtatgcaaaagaaatggaaccgccagattctgagatgtattgtaatgctacaataagatatagtataatatacaaacatatcaaagacaatagaaggcccccaacagtcctaaacaatatagaggaaataattattccaaaagtctggtatggaattaattagcaatttagaaaaaaaagttgtcttcgatctctacctctgactgtataccaaattaaatttttcatatgaaatggagtgacagaaagagagaaaaaaagtagaaagaaaccctttaagaaacgtgaaaacattggtaaacttagatcagagaaagtcttttaagctaaaagaattatcagaaattatataatgaaaggacagatttgattatgtaaatatttaaaacttccacacatcagacaacacagtaaaattaaaaacaaatgataaaaagtaaaataacagtttcaaaaatggtaatttttagggataggtatttagtaagaaaaaacaactatggcaatatggtaatatacatcagaaaccttaaaaaggcatatactcttatgtatagcaattctacctataagcatttatcctaagataaaatacttatagacaaagacttacagtagttatttataatacatcatgtataactcaaatttttataattagtaaaactcatttaaagagtttaaataacagtaggccaggcacggtggctcacacctgtaatcccagcactttgggaggtcgaggcggggggatcacgaggtcaagagatcgagaccatcctggccaacacggtgaaaccccgtctctactaaaaatgcaaaaaaaatagtcgggcatggtggcgggcgcctgtagtcccagctactcgggaggctgaggcaggagaatggcgtgaacctgggaggtggagcttgcagtgagccaagatggtgccactgcactccagcctgggcgacagagtgagactccatctcaaaaaaatagtaataataataatcggaaaagaacagtagtctataatgattcaaattctatttttatttttccacattaaattcataggcctagtttcaaaagtgacaacagtttctctgaaatagaatcatagaaagtttcttttgcttcatgatttttctggatatcttcaaattttactttatttggggaacatttaaaaccttatgagagattttctgagatcagtaaacaaatccctcacattaaaatgaagtagttttctacagagcaagcctcgaataatagctgtatattttctatgaactgattatactagaaaatataaccctcccacaggatgataataacagaagcttgtctttgtgcccttgtactaaactcccgtgtcgtgtggtatgacaacaccagcatgtctgtgcagattcttctccaggagggctttagaagtctctctgcccagggcctgctgggcgcccatggtggtaccataactgtgcaggggatcttctacgtgcttctccaggtctgtgccctttctgggccccggtgacaggcctgaaatgatagcctcaagtggctcccagtctgctgacttctctttgggtttggccaatgggaatgacgatgagggaccagagagtgggatgagaagagatcaggttgtgtgccctcagttcccagcctggcatgtcactatggaccggcggcacctccctgctgagggctgcgggtcctgcccagcagctgcctccacaccactcagcctccctcttaagttctagttttcgatagcgacttctactcttgccccttcaggcttgggtgtggtaaaagcttctccttggtactggccccagagtagcgctctcttactgctttttctaaaccccgtctgtacctctgtgaaaggtctctaataaactctcctcaaatcactccatttgagtgccacctgattcctgattagtacgaccctcattgatacagtcatatatgtaattaccctagagaaaataaagttaagtgcgtttggactaaacaaagcaaaaggaaaaaagtgatctaatgtggtttaggaaattttccattcaagtttgggttaaacagaagtttagccctatgctacttctatgcttcaattacctagaacatccttatgctttctttactgctgtgtctgaattgctctgctcagatgaaacaatcattttccacccttatgctgttcattcttacacaattatgatttttggaaaatcaaatgtgggaaagaagacttaaattgctatacatattttcattaaggatatgagttttcatcctgtaagtcaaacaccacagaaagaaaatgctatgaagtaaccaatgccctgcagaaactgtgtaaatgaaagctagaaatcatctcaagattcaactgccagtgtgttctcaatcactggagtaatttgatattatggaaaaacctactgaaccacccaactttgatctgttcatgtctatcaatgaacaggaatggaaagaagttatttttctataaccagatagatagatagacctcaatgcacacatacacctaataaaaacaacaaatataagccacgtataggtaatctccaaatatcaggaagaaggcagagaggtttcatggatatatacacacacatgcaattcttaatatcttacatacccatcctctaatgctttggtgtcattttacagttcacgtgaaacttccacttaaatagtaaccatatctagattcccatttcatttaaataaattcaagtaaagttcctaggcaggtttccagagagttaggttgctttaaagttggccatgcattaaataaagctttgtctcacaaaagtgaacgagtaactgatacggtatctgtacattcactctgcacaaggttcctttatctcaaaagcattactcgaagacaaacaacaaatcagattacagctctagagaaccatactctgcctcttctagcaacactgccagctcacaaaattgtatgaggaccaaccaccggcttcctgagggatttgcaatctaccttctccatcaggtcccccaaggttctcctacttcacacacattccccctttcattcattccactgcattcatctttcatctttcagaggctcgttaacaataagtgtgcaaaggttcactttaacagcaaaaccaaaaagaaacccttcagcattacattttataatgaaataaaaccccaaattctgagagtcaactaagctagaactaaaagccattgcaggaagagattcattcccgggtccctagcttcctttcacattacctgcttcagtgtacttcagtcccactttttcttctgtgtcttttgtctttgggggtggccagacagcttgaagtctgccaggagtcctgtcatcctgctcagtcaggctgtggtcaggctgttgaaagagcaggcaaatagtaagtggaatgtagtcagagccgattaattcctgaaaaatgacatgctaaacctaattctgaagttaattttaatggctagttgcacattgctctcattcactataattcagatatctcactatagtgtgacccttttccagaagtgtaacgtgatcagttgaggtgaaaatttaaaactacaacaacaaaaaaacctcaaggctaagtatatatcacacaacccttaaaagattatttttattatataattatttgaaaaagcacaaatatactttgacctgaaggtacagacataaatgtactacactgatgtgcatttatgggaatgtttaccaatgtatcccgggactccaggattatttaacacaaagactaatttcaagaacatcagtggtagaccaagacaccctttttcaaacattccacactgctaatttccttttattcctataaacgaatgaatgagatttgccttcatattccagtcatttttatatgtgttgatttttacaactaggagaatgttatattgtgcttggttttttaactgcagtctgagaaattctgccaaagactttcatttttaacattttaactgaatattttaaatatataggaggaatgatagtcatacactgaattgatattaagcaagaaattctatttattgttcttctgatcgtttaagatctactggacaggtacttgctcatctttataaattacctgagttagttttctttgagtaataacagcatctattaattagatgcttcccatgcactgcctttgtttaattctcataacaaccatataaccattttattttcctcattttgcacatgaggagattgaggcttggagattatcaaggttacccagccagtaaatggcagaattagaataaaaacccaggtctcattctaaatccagtgctctaaatctggaagccttccaaccaatgtggaacactctaatcacaccacaaacacatattttgtcaaatggcagactttcaaaggaacgatagactttctgcggaggtataattaaggggtgaggaaaccctgtaaacctgggctatactgccatcttgcatcatttcctcatgctacctagttttataagtgcgtttaccatcaacgtttaaattcacggtgacagttaccctttcctacctgcacatctttgtgtatatccctcttgcaatattccagataaaaatcaggacgcatgaaaagcacttctggttaactccatactccttacaggacaatataatttgactataatcctttttcaactaaaagaatcactaacaggcaactaggattcactttgggaggaaacctggaaagaaatacagcagcaccatattttatgttaaaatgcaaaacccaattctacatacacttttggaatcagaggggccatccgctggcttagaattggaccgttcaaacacagctcttagcgactccttctcatgtctcatcttgcgcttgagagcttccagctcagaggtgtcagctgtggtcccctttctggggggccggatgaatagggctttaaaagcctccagggctgtctctggcgactttggcttgacctcaccaccctgggtttgtggtactccagggccgctctggctctcttggtcagcattgcagcccatctcttctctcctgggcgactcagggtctgctcccttcggttcagttttgggcatgtcaatgttgagcagcagagagagctgctccaggagagtgggagtggccttcggatcagttgctttcttctcactcttcactgtctgcagccctgcctgcactaaggacttctgcacaggctgcgtcaatttgagcaaagctaagtccccatcctttggtttaatttccgtgatggtctctcctccctcagcggtagcccccttcttcagcacacgaagcccactgaaaaaagctggaagttggaatgacttctctccagagacttcttttttagaagaggcactctcagtgataccaacactcgaattctggtttgttactgcaggtaggtcttgggacccttcttctcccacctggtcctggctggggcgacgctctgtctgaagaccaccgttgccagcttccagtttgctgctcatctcaggtggaatcctttgaggatcttctgcacagagctctgcaccattcatttccccagtgacagtattttccctgaaacctcctgggttttctttggactcctgagatggctcagataaaacaccactaggggactttgggccattggtgctgcttccctcctctggctcctggccaccatcatcagagtcagaatcactggtggtgtgcaccagggtcccacgaacacaaatgacatcgtcttttgtccctttcaaagtagacagtggaagcagctcttgagcaaggagagatgtccctgcttcttttctctgacttccctctgattctgtctccacgcttgcaattttctcatcatttccgaggtcaggtgaaacccgagaccctgcttcctgtggatccaagccattgctggaatcatcctgctgagatgtgggattcacgtctaaactatggaatgctttcagcacagcatcttcctcttctggattcacagattctaatttactcgtaaacccaaatagggatttcatagagaacttactcaggatcgactgagccacttcaagtccggcttctggttttgctggttctgacacatcactgccatccagagaattatcaacgttctccatgtctcagtaatgcccttggtggaagttctgacttgtgttaccttctcctgcgctctcagtttatccactccatctgctcttaatttacaggacagagagcaacaggacccgggagtcaggctgtcagccgcacagcaaacacacttggtctctttcgggtcacagtgccctccttccggtttgtgcgatgatgtgttccagggcaactgtgaaaaatctgtggagtctatgcccagaagcagccgaggctgcgcaccttactacacacggaccagggaggctgctcttctgaaacttccgtatttattcccggggacaaaagcctttttgtcatagggaaagtcagcctgccctgtaatcccaacccaggacttcacgaggagctccgccccaggccggcggttctcctggtggcattcaacttcctcattggtgagcaagtgaaggcttctgaaagtgctgagccggcaagctgatactgagggcacttagccactgcccagagcagcctaagggaatcagaagtaaatcagcagaaaacaactgaaatacttctgacacaggccttctttttcatctggattatgatcagagaggcctggggcatccaggccaaaaaactagcagtacacccagatcagcagccacttacgaagccgcaatcaaggaaacaaattaaagaaagcaatagatcatctcaaaagtgcctagaactctcaaagcagttaatttactgcccttgaagctttttttaagtgctttcttccgcttccctgcaggtttcatctggaatgcagattttagctcctaaagcccgtgagggataacccacacgactggtttcagatgactgctgttttagctctgccctagctgtctcagtgctctacaaacaggtattaggcaagcacacccaccacacccagtgtccaccagcaacagggtggcagagtaaacagcccaggctccgcaggaatgattaccctctacactccctgtgccaaccgcaggcttctttctgctcagcagctgtgacttcctggctgccttagaaatcctggcagcagcaggacacgcctctccccctttggtgtcccagccaactaaatgaaacctggcatgacacagtgtaacacacaacctgccctattagacaaaacaatttgaagatccccaaggatccacgttctcctaaagggcaaaacatctgaaaagtctctatcagtcagatctctatcacagacccaatttgcctcaacaaaaacaggacagacaaaacaacctccaaacatcagcccagtgtagtttctaccactctatttatatgctgggaaactggcaacaaaggatgggggtaaaaattgcagccctgtttcctagctgcatagctgcctcttgggacagctccctatctacctgaaggcctcaagtgttttccaaatccagtcccactaagcaggcatgcagtgagtgcctgggatggacaggacactgttctggttggagaggcaagtcaaactggctgaacagtaattgccatctctgtttgagcaaaggtccaagaagattgtggtcaagtgttaaacacaaacagtaattccttctgcaaaatggaaatggtagccataaggaaaatgacagtcttgctttatctgcaggagtgggtggctgcatgtcacacattgataacttgagccatgttcttcagtactaaaaacaatctaagcatcaatactgagaaattctgattgcaaaaatacatttctagcaatgtattcaaaaggaacgctcacacaaataaaaacgcatcattgcatcccatcaaccactaagggtaagtaaaacactttctaaatcttgatttgatcttgtgttttaaacaggtacttctctgtttgctcctgatcatagtatttttgggaattattaactgaggcacttaatcaaaaagccaccaggacactgcagaaaaattcaatggtgtcttttaagtctaagaacaagattcttgtctagaggaaatacccattgattaaaatcagacatctgcttcttcaagattgtagaaagaagaaatgatcacaacagatcataagatcagtctttctctttttttttttttttttttttttttttttgagaccgagtttcgctcttcttgcccaggctggagtggaatggtgcaatctccgctcaccacaacccccgcctcccgggttcaagtgattcttctgcctcggcctcctgagtagctggaattacaggaatgcgctagcacacccggctaattttgtatttttagtagagacaaggtttctccatgttggtcaggctggtctcgaactcgtggcctcaggtgatccgcccgcctcggcctcccaaagtgctaggattacaggcatgagccaccgcgcccggcctaagatcagtcttcttacgagcaatgcagatcatccaattctaatatggcagggggcagtgggagagggcacgtatttggtcttttttttttttttttttatgaactgaaaagactcaatttctcagacataactaattattgatttctggaataagcttccaggcccctctatagatttgggcaaaatggaacagatgctggaaggggctactggcccttctgcaccatggcatggagcagaattataaggtttcagtatcccctcaatactcatagatgccaacacaatttcatgggaagtgggtcaagtctttggtcccaggagattatctgatttcatccccttggctctaggtaagtaaggtattattaggcccatttttaaaggtaagcaaccatagctgagagaaggtaacttgccaaacttaacacagctagtaagtggggaataacatcatctaagatttgagggttgaccatgtgccaagcacaattttaggtgctccacacatattaactcacttaatacagataacaaccatattatgagttgttattattattattctctttttcctgctagagaaccgaggcacagaagattaaaagtcttgccagtccacagaaacagtggatggtggaagtataatgtgaatccatgcaggcaggctccagcatccacactctcaaccactcttcgaaagcccagaggctccacttccttcccgaatagaagaccacacacagcgaggtgcaaaggtttcagcccagttcattggtggtctttaactgggatgtgaagtatactttatcctcttaaatgacacagaagacaaacatcaccaaaaacaaacaaacaaacaaaaaacaacaaccttatactgaggatgactgttcttttcttttgcataacttggggaaaaatctacaagttttcttaggaaaaaatggagagagaggaaagaaaaatcaagcaaaaattccagtaaacctagctggcctatctatctaacacagaagagacacggaatcctctgggctcaaacacatcaaggttttccagtttgcccctaccattctccttcatttatgaagcatgacttctattaagaagacttcttcatccaatgtcataaatgagcaccaacaatgaatgaggctgtgaggacataagaatgaagatagccctgccttccacctccatgaaatgtgtagtttagttggagatctctatttagaaagaggagactcttgtttacagactgtaaccaaggactttatcccccaggttcagtctaatagtaatagctagacctgaaacaattttgaatgaaagccagcagtgaccatttaaatatgaacacgagtaacaggagcacgagtaagattcaaagagatcttttaacacggactctttcaagccactggttctcatgaccataaaaaatgttaccactgctggtcactcagggaatgagagtgtttcagattgtaatattcaaataagcaacctacaaattcaatctaaattggtcttgaaaaatgaatctctttaaagctttaacattttcagggaggatagtaatcacttctcttggacattatctcagtatctatgtgctgaaataagcacctattacacaaaaccagcagaagcgaaggctttcatcctttacaacctacctcaactgattctcttttgtcttgtcttaacctcaagacaaactctctaactgccacatctgtgcaaaaatgatcttcaccaaaacaaacaaacaaacaaaaaaacaaccttatactgaggatgaccattcttttcttttgagtaacttggggaaaaatctacaaaaaataatctgtgccagattaaaaatgatccacctcagacaacccacgtttgaactgtatgggttcacctatacaatatgttttcaaccaaaagaagatggaaaatgcagtcttcatgagatgtgaaacctgcacatatgaagggttgacttttcaacttttcctgtaagtggattcccagagcctcctgtgggacttgggtatgagaggatttgggtatatgggtgatcaatcttccaagtagatggagggacaactctaagtcaaaggatacatgagaaataggtagcatttgacctacgtgatattctgttataactctgttaaaaacaatcagtacctagctacttaaaaatgtgagcatagtatttgtggagaatttactagcagtgaattcttcatttctcccatctcactgtcctctcagctgtacacagattgaaggtggagccaattgtaccccatggcaaaaagaacatcagtctaggctgggcacagtagctcacgcctgtaatcccagcactttgggaagccaaggcaggtggattacctgaggtcaggagttcaagactagcctggccaacatggcgaaatcctgtctctactaaaaatataaaaattagccaggcatggtggtgggcacctgtaatcccatctacttgggaggctgagggaggagaatcacttgaacccatgaggtggaggctgcagtgagccgagatgcaccccctgcactccagcctgggcaacagaacaagactccatctcaaaaaaaaaaaaaaacaaaaacagaacatcagtctagtaagtgtatacctagtgagataagaacaattgcaataaaaggcacattatctcctataggcagtagagcctagctccttgactttcctaatattaggagatcagcaataaaaatttttaaatatcgttttgcgaaaactggacactgaaagaaacttctctaagggcccccttactctttgtagcacttctcgctattactcagtttggataattcacccccacattctcatcagacttcagaaaggcaacgtgaaagtaaagcaaacaggatcgcatctcactgttaggctacttgtcatgattctccttgtccaacttatttcaagttctgggcctgattttaatgacaaattgcttctagcttcccaaagtagttcaaatagcttcatgcgaaaaccgtttgaaacaaaaagtagaaagtgtagttaaacttagtaagggtaaataagagtgaggaaactatttctgcaggtgaaaaaaagttaagagcaatgtactgggaaaaataagtaagttctgaataaagatatgggtaggttaatgggtgaaatcctggtttcttggttcaggaagcgtgttttaattcaacaaacggcatcttgaacaagaggggagagctgaggaaattataacatcataaggagtcaaaaaaatgtctgtaaaatgaggggtcatataaaaggagtacaagattatggaataatttgggtagaatccagttgttgtaaggttgaatgggaccttagaaatagtagaaatttacctagcttgttttttttttttttttgagacagggtctcactgcgttacccaggctgaagtacagtggcacaatcactgctcaggcagccttcacctccccttgctcaaatgattctcccacctcagcctcctgagcacctgggattatagttgcgtgtcaccacgaccgactaatttttgtattttttctagagacggggtttcaccatgttacccaggctggtctcaaactcctggcttcaagtaatctgcccacctcggccccccagtgtactggggctacaggcatgagccactgcctccggcctggcttgaccttttgttttaaagatgaaggcatttgaggtcaagggaagcggaacaactggcaccagttcatactgctcaagtgcagcacccagatggggaaaaaggcatcccatctcctgttcacccacatcacatcaccctgctgctatgctgtgggatcttaccttcttcctgatcagcatcttcgttatactcattttccacatctttgaaatggagacaacaccttgcttctacctaattcacaggaatataaagccaaacaaaagaaaaagccagagatacccttacacatctagttttgtagcactttccctgccttcatgctgtggcgttcctctgccaatgcaacgcttacaacagcctctctgggtcatcccatcaaaagcctgcagctgttttcactaattggttaaaaagaaaacaggcagcacctgcctcttgcaaggactgtgattaagggcttttttctctgttgaaaagtcttaagagtaaaatatttataagactggttccactgggcagtatcaaagcttctgtagaaatggattgaatatagataacaaactagaagaatctaaaaggaaaggagaaaggctgggacatcttgtgaagcttgaacaaaggaagacagcagtgggtatgtaatcttgtgatgaccaaggaacacgggcagtgtgcatagttaagaacaggacctcagccgggtgcagtggctcacgcctgtaatcctagcactttgggaggctgaggcaggcggatcacttgaggccaagagttcaagaccagcctggtcaagatggtggaactccgtctctactaaaaattcaaaaaaattagccaggcgtggtggtggtgtgcgcctgtagtcccagctactcgggaggctgaggcaggagaatcgcttgaacctgggaggtggaggttgcagtgagccgagatggcactactgcactccagcctgggcaactgagcaagattccatctcaaaaaaaaaaaaaaaaaaaaaaaaaaagaacagaccttgagtcctgggctcacaccatgctccactcctacaagagacttaccctggggcaagttatatataagctccctgtgctgcagctccctcacctggaaactggtaagaacagtacctacacttcatgaattgttacgcggcatacactattatgtgtttggccctcattaataacctgcagtaagtaggatatgttttcccaggaaaggaacagcttccttagggacaccaaccatcatctaacagatgtttttagcattctcattataaaacaagtatttactgatgaactaacagcccaagcaggaagttttcttctcccaactccctctgatatatgcacttgggcagaaggactacatacaacacacctccgcatgccccagccgcaaccatgccacaaggaaactgagctccaaagaaaattcttccaagggatccctttgggtgttgcagggccagtgttttctggattggattcttccatctgtgtcacttgagaagagaataaagttttctcaagtggccactgcataaggtgacaaagtttgccctgttctttattttgtttcccaagctccaacatgatttttaaaccaactcagttatttgagagaaaaaaaaaatccatgaatttggggtttcttccatccttttctcatgagaaaaagcatgctgaaaatgagactaggtgccttagcactgacattttcccttctttggggaaggactcttctgagacaatgagcaagcctgggtcctccatagcagagcaccagccattttatttattcatttatttttggtttggggtcaattcattagacttcaaaagtgctgcttcattacaaatgaaataaaagattacagacatgaaaatcaactttgaaatagttattacattactggctagaatcctactctcaaatatttctaagactgggttgttccaccaaccagtgtcaaaggtcctctagaaatggatttaatattgatgacaaagtaaaataatgtaaaaggggagagaaaggctgtgacttctgaagctggggggcagggggatgagggttggtgggtagcagtctttaaagtacagaatttcctgggatgtgtttcagaagagctttgagctttcccaaagtgaaggcataatattgctgttccatatggctaatgacagcagaaggcatggagtctatggtgaaagcatttcattgtgactaagttgctcctgataaaagatgaagacctggaatttattagactacttatgcctgttgcctatattcccttcttctcatgcagtaaagcgaggcacttcatggctactgctataactttttcttttccttaatttttttaaagtaaaagttatcttgagaatattagttcgaactccaaagatccaggtatcatttcaaaatatttttaaaggggacaaaagaaaatctagggaaggtggggatttacccaaaagaaaatgaagatggatgggaggagcatgcatgctgttccaagtaggcaccatgctcggttctttatgcaagttttcttgcagcctcaccctctccataactctatgagaaagatgtcattaattgcatttgacagattattactgtccaatgaaactttctgcaataaagccagcatttgcactggatccatctgattctaaatgtttcttttcatgacaataaataaaaaaaactacggtattttataacagttttctttcctactaaacataggaagggaggcaaaatagatctgctggttactcagaaccaaatggctactgaaattagaggtttacagagggtagaaaggtcacaaatgaatcctgaatcagcaatgattctttgatcctaatacccacatgattaattcagacatttaaaaagaaaactgttgaaacaaatgtcaatgcactaaaattgcaaaggagaaggtaagtcaggcattgccacagctatgatccaatttttttgagacagagtcttgctctgtcgcctaggctggagtgcagtgggggcaatctcagttcaccacaacatctgcctcccagggcgcaagccatcttcctgcctcagccccgagtagctgggaccacacgtgcatgccaccatgcctggctaatttttgttttgttttgttttctagagatagggtttctctatgttgctcaggctggtttcaaactcctgggctcaagcgatccacctgccttggcctcctaaagcactgggattacaagtgtgagccactgcgcccggcccatccttttttttttttttaatatatatatatatattttttttattatactttaagttctagggaacatgtgcacaacatgcaggtttgttacatatgtatacatgtgccacgttggtgtgctgtacccaataactcgtcatttaccttaggtatatctcataatgctatccctcccccttcccctgactccacaacaggccccggtgtgtgatgttccccttcctatgtccatgtgttctcactgttcaattcccatccatgagtgggaacatgcagtgtttggtttttttctccttgcaacagtttgctgagaatgatggtttccagcttcatccatgtctctacaaaggccatgaattcatcattttttatggctgcatgggagaaaatttttgcaacctactcatctgacaaagggctaatatccagaatctacaaagaactcaaacaaatttacaaaaaaaaaaaaaaacatcaaaaagtgggcaaaggatatgaacagacacttctcaaaagaagatatttatgcagccaaaagacacatgaaaaaatgctcatcatcactggccatcagaaaaatgcaaatctaaaccacaatgagataccatctcacaccagttagaatggcgatcattaaaaagttaggaaacaacaggtgctggagaggatgtggagaaataggaacaccaattcttaaacagagagcagagaaaaagtagaggcaataaggctatgtctttgaaaagggacatattggggtttagcatgagatattactagtcacacactagctttttgtcacttgaggcaggttctttaacgtctctaagatagcatccacgcgtaaaatgggaaaaataatacttaactcatagaatagttcaagaattaaatgtgctaatattcttaaccaagtgcttgcttgattccccacaggagctaaataaatgtgaccatcattattatggagcatgtgcaggtggtggggaggaaccatttttccatggttttgaaatgtattcactattgcctccatgtggtacatcattttaattggatatttaaataaaacaagtatatataggactactgtcatgttcaatactttaaaaagcctcatgaaatattctgaagaaatgctgtaacagttcctagaatcaaagtcacatactttctatagctggagaaggaagtttatgatgttcctatgtgagacacttgtagctgcaatccttaatgcaatttagaaataatgatactaataaattggaattgcttaactaaaatctgtaaaatccaaaaggcaacaaaaaaaaaaaaacaactgggccataaaaaccagaactttatgttaacataggagtgttcacaaacagtcagtatgcaaaggctactgcatttcaaattctaaatagctcatatgggttgtaattttaaccacaaattcccaccttcatcctggagagagagaggaaaaaaatgcttttttgaaagacacacatggagtataaatgacgtacgtagcaagagaccagggttggaagataccatgtgaggctcacagcactctaagtttagtgaatgcagacagaaccttaagcttttgagacagaaaaatgagggtaagaaattggaacacatccaaagggggccaaaaacaatcatgtgaattttagagaaaataaagtattttagtggcaatatttcaattcacttatatacaattcctagaaaaattcctcatcattttatataaaattcagttctattctgtgatctctctggctttggaagtataatacagagttttctctgtatataccctcaaaagtccaaattgtatatgaacagctatgtatttctcatcagaataggagacgaagaaataagaatgtgtgttatcaagatcaaagaaaagcaaatttcacagttccattaagcattaaggtgatgcaataatttagccaagctttttattctttttattttataaagaaagctgaggctgggcacagtggctcatgcctataatcccagcacgcaggaaggctgagggagggaggatcacctgagatcaggagttcaacaccaacctggccaacatggtgaaaccctgtctctactgaaaatacaaaaaccagctgggcatggtggcacctgcctgtaatcccagctacttgggaggctgaggcaggagaatcacttgaacctgggaggcagaggttggagtgagctgagatcatgccactgcactccagcctcggtgacagagcgagactccgtctcaaaaaaagaaagctgagctgttagcagatttgccattatctttcaatttgtagagaagtgtgagaactgctttaagaatttgtgatcagcagaaaatagaaattctatttaaacatgataaccatccttcacatcaatttccagatttgtactaatttgagagataactggttaacttgcatgtgaattaggaagtaaatcagattactttttttttcaactgctttatcatgacttaaagcgatgaggaatttgtaaaaaacaatgatttttccaaattgatcagttcatccctttgaattgttcttttcatctggataatttcttgatcacttataagcaacagacacatgatctgtctctcattctttttctcttacacatacacactgacatgtactcacaacatacacaaatgaacaccctccatcaggaaacaagctactctgatatttctaaattcactccacttgcaagaacaagtcacattgtcacgaatatcctaatgatttggttaagccattcctatggcctgtagctttaaggggtagactctttcattggcttccatggaaacaatacaaaaatgcggccctctccatgtaagcaaagacacaacagagagcaatctgtgcatttactgatgttgaatctaatttacgctgtggagtttgttatttaggagtgaaggaaggtggaaggactgaaatctgctggtgttcccgtaactgagtgcctacattttaaaggttttattctttttttctttttctttgtgttaaccactagacaccccctcacactgctagtgcatttaattatatgtctgcttaaaagttccagagactggccaggtgcagtggctaatgcctgtaatcccagaactttgtgaggccaaggcggacggatcacctgacgtcaggagttcaagaccagcctggccaatgtagtgaaactccatctctacaaaaatacaaaaattagccgggcataatggcgggtgcctgtaatcccagcactttgggaggctgaggtgggcggatcacctgaggttgggagttcaagaccagcctgaccaacatggtgaaaccccgtctctactagtaatactaaaattagccgggcatggtggcgcatgcctgtaatcccagctactcgggaagctgaggcatgagaatagattgaacccaagaggcggaggttgcggtgagctgagatcgcgccattgcactccagcctgggcaacaaaagcaaaactccgtctcaaaaaaaaaaaaaaattccagagactaaatcttgaaacaatacaaggacctgtggaaatctcccccacccggagcttgcttcaaggctgcagttgagcccaagatgatgagatgatgcaggcccatttaccagatgtggcaataactcaagccactcggacaagtcacacagatgtacactgcctcaccccctgcacggagggtactccacggcaaaacttccgcttcttaaacccttgcatttcgcttggaaacttgaagtggttccattaagacaagagcctggaccgttttctccacggctagctttggtttacagtacagtcactcttctaccatacccccaccttgctaactggtttggcaggcagcaaacggttgaacctgcatttgtaacatttccaacaatatttcaccattattttttaaatgttaaaaaattgatatacgtattttggggtacgtgtgatattttgatacttgaatacaatatgtaataattaaaagtaattaggatatccatcacctcaatcaccattaatttgaaagacccaggatacctggtgcatgcctgaggaatctagtgtcccatattagtagctgcagaatttttactggatgagttctgtgttgtaattctggttgtagttctagctgtctaattctgagcctggatcccaatccttctcactgattataggagctaatccccatccattaaatgaatgtcttttgttcttaaactaaaaacaaaagaaaacaagtccagaagtagtggagcggtagaaggacttaacatttaagtacttgagtctagactcagatctgggtttaaatcctgcccgtgcccttgctgatttgtacagtatgtatactaacacctctaagggcagggtctggcctttaggaagtgatcggtaagacatggaggttcttattaccgtttagacagtcaagcttgggaggagccttggtaattacatccaggttcataagatacaattacttggaacgggatgctttgtcttccccagacaattaagctaattcagtaaaaagtatgcagggcctcacaggtgagaaggggattgtgatgagccttggaaaccagaatcaacaagaagagttcaggggtgtgtgtgtgtgtgtgtgtgtgtgtgtgtgtgtaagacggagtctcgctttgtcacccaggctggaaaacaatgtgtgtgtgtgtgtgtgtgtgtgtgtgtgtgtgtgtgtaagacagagtctcgctctgtcacctctgcctcccagttcaagcgattcttctgcctcagcctcccgagcatctgggattacaggcgcccaccgccacggtcggctaatttttgtgttttcagtagagacggggtttcatcatgttggtcaggctggtctccaactcccgacctcaggtgatccacctgcctcggcctcccaaagtgttttaaaagctggcatgcaaaatcttatttccagagagtactgccaccaggatataatcctaatgactacttacctgtttcctgcttttcatatctttgttttcaatttcaggccatacctctttttagggtcttttctacccacccatgtctttgtttatagacacattacaaactattctccatggtgagcattcctctccaatggtatcttcaggaaactgcacttgttataagaatttaggccccagtgcttctctagtctctgactatattcagttgcctttgataaatctggttgaaagtgccctaggacctgagatgcatggctaatggtagctcctagttcagtggaacataaaaaactgactcttcaggctaacttcttaatattcatgtcctaaatgggcgctccggggtgactgatagatgctacccaagggcaattcacacatttggatcttgtttcaaaagtaatatctaggagtgatagagttagttaataaaatataggatacccagttaaatatgaattttagattaaaaaaaaccaaaaaattttgtaatataggcatgtcccatacaatatttggaaacttcatggcccaaaagtggagctgacagagctttgggttcagtctttccagagctttgtagtttgcccataatagtctacagaatttgcttgaccaggatttgcaggataattacccaaacagagcttccctacacagcagtctagcatctacaccaaagtaccagttgtgtgatatactgatataatgagaaatacactgtatatttcgtcttcatctgggtcctggacagaacttctaaaaccctcgtaacttcttaagtgataagagccatagaagtagtaataatatttggatatactcaaatatattcaaatatatatagaagttgtaatatttgttttttgtcctcagcttctgaaacagctcagaaacaatattggtgaaaggggcatcttttgttattcagaacaagcccctttcaactacacttgaacttatgttaatgaggtgacttttagaggatgggaggctggttgccaagggaaccttgtgattagggttggcattttgcgtcccaacaactcacctccaggagggtagagaggctaaaggttgagctaatcaccaatgtaatgaaatctgcataaaaaccctacccaaagaagttctgtctccacagggacagacgctcttgtgctctggacccttccagacctcaccctatgtatctcttgatctggctattcatttgtatcctttaaaaatatcctttgtaataaattggtaatgtcagagacgtttgaaccacagcgacttcatcttgaataggggatgggtaaaataaggctgagacctgctgggctgcattcctagtagattaggcattcttagtcacaggataaaaaagaaggttaccacaagatacaggtcacaaagaccctgctgatacaggatgtcataaagaagccagccaaaacccaccaaaaccaagatggctacaaaagtgacctctggtcatcctcacggctcattacatgctaattataacgcatcagcatgctaaaagacactcccaacagtgccatgacagtttgcaaatgccatggtcatgttgggaagtttgcttatatggtctaaaaaggggagggaccctcaattccaggaaatccctgcccctttcctggaaaactcatgaataattcaccccttatttagcatacaattaagaaataactacaggtatattcagtcaagcagcccacaccactgtgctctgcctatggagtagctattcttttattcctttactttcttagtaaacctgcttttactttatggacttgccccaaattctctcttgtgtaaggtccaagaaccctttcttggggtctggatcaagacccctatctggtaacagtaatagtcagtaaattgtttccttgggttgtacaagttatcctagcaaattactgaacccgaagagggggtcataggaacctatttgtatccaagttggacagaagttatgggtaacctgggaacccactacttgtgactggcatctgaggtgtggcagttttgtgggaccgaatccttaacttgtgggatgtggctacagttccaagtagatcgtgtcaattgaattgtgggacatctagttggtgtctacaggcaattggggaattgcttgttatgaaaaacacgtacacttgggtctcagaatgtcagaagtgttgtgaaggtaaaggaggttttgtttgtttgtttgttttcatttagtttgttaaatagatgcccccagagtcttcctagtgcttgtcctacaccaaccccacctcctgccattccccaaggaacccctgagtcttctcatagtttagtaactaaaagatgaatgcccagctaaatgaggggacttagtaacagctgtagccttaacaccagtgtccatcctgactcacggatgccaactcccaccaattatttcaagtatgagatgttttacctttcatcacgtactaatgagagtcagtgtagccacagaaaaaggcttaagaaagttaacatcctgattgtgacgctgcaagtcaggtttaaaactggaagcacggcagtgctggtccaatgtctcaggctgatcaatatattgcttagagtccaaagcccaccagaggaaaggggtttttgtgagctgctagtcattaacagcaggctatttttttcttctttttttactttttgatttctgtaagctattgggaaacaggtgctgtttggttacatgagttaagttctttagtggtgatttatgagatttgcacccatcacccaagcagtatacactgccccaatttgtagtcttttataggatacacatttgttctaaataagtagaatcctttcagatagaaaccttacctagaatatcaatatttaaacatataggagtcaaatcacactgtccaaagaggggagaagggcttgaggtgaggaaggaaacacagggcccaaactataaaaactgttgattcagaaaataatctaaaaaaactattttagttttataattctgattaatgaaaaactaagcaacatactaatatatactgtttaattacacagtatttatatatacaaatatatatatcacatgtatttatacatatattaaaattatacatatatacatatgcataatttatatatcatatatgtaatatataaatatataaagcccataaaaggctagttcaggaaatagacatttttcatctagtgataaatatcaaaaaacctaaaaatacttatagaaaagaatccacctcctagaattttatcataaggaaatagtcctaaataatggggggaaagggtataggaaaaattgtatttgtagtcacgctattttatttctaaatagtggtcctattccaaaactggaaacaacttcaatatccaataacagagaaataattaaataaattttggcatatcatttcatggaatattcatcacttaaaacacatctgtaacgagcttgcaacagcctggataagcagtttaagagtaattgtttgaaagagagaggaggagaccaggtgcggtggctcacgcctgtaatcccagcactttgagaggctgaggcaggcggatcatgaggccaggagatccagaccatcctggctaacacagtgaaaccccgtttctactgaaaatacaaaaaattagctgggcgtggtggcatgcgcctgtagtcccagctactcaggaggctgaggcaggagaatcgcttaaacccaggaggcggaggttgcagtgagccaagattatgccactgcgctccagcctgagcgacagagcaagactccatctcaaattaaaaaaaaaaaaaaaaagcaaaaacaagacgaggttataaaatctggcatgcttttatgtttaaaaaaaatctctcattgaaaaacaaaccatacttagtgaaaaaatacaaaaaaaaatttatcaaattgtacagtcgtctcagctgctaagattatgaggtttttttttcactgtaactatgtatttcaaattttctataaggattgtgtaggatttttataattgtaaaaaattaagtaatcatttaatttacagaggaaaaggaaaaccagaaatacacagtttagccaattttaaaaaacacataaacacagtattttttaaaaacacagaagaaaaagaaagtagcttttcaaaatctacttcagcacttttacactgtaggcctgctgtttgcggcaaatgcaacttaaagtaattgaccaacagatgtcactgttacacttcctactttaagcatctctaaagacgcacaactttatatatgggaacaaaaccaaaaactttactaattctcatgtcatctcctgcaggactgcagctttctcatctttcagcttcatttctaaacctccttttgtaatatctggaatgttgaatgctgttctaaaatgacatacagtgaccatggttttatggttatgaaaaatacagggttctcctgctctttgattgccacccatgtgaacatcacagacttaacccacactcgtcaaaaacatggttccaggtctgaaagtaatgagccggagaacacaaggttgtcaacaggcattaaagttaatggctaaaaaaagaaaaagtgctccttagatttgtggtgctcacctcatctgtgacaggaaactggatgggtaaagagggattgcagagaatcacaataatctggtcaatcctaccaggccatctaaatgtggaagtaggtgaaccccagcccagtgctttctaaggaggagtcaatacttctgtgtcaatgaaaacaagaatgaataagaaaggagaaggtagctggatgtggtggctcacgcctgtaatccagcactttgggaggctgaggcagggaacatttttgaggtcaagagttcgagaacagcctggccaacatggtgaaaccccatctctactaaaaatacaaaaattagctgggtgtggtagctcacgcctgtaagcccagcttctcaggaggctgaggtgggaggaccgcttgaacccgggaggcagaggttgcaatgagccaagatcgtgccactgcactccagcctgagcaacagagcaagactccatctcaaaaaaacagaacaacaacaacaacaaaaagaaaacagggaaggctatgtttttctgaactaaaagtagatccatcatttgatgcagcaatccaactactgggtatctacccagaggaaaagaagtcattatacgaaaaagatacttgcacatgcatgtttattagcacaatttgcaattgcaaaactatagaaccagcccaaatccccatcaatcacaatgagtggataaataaaatgtggtatatatttacatatatacatatacacatatatatacatatatacatatacatacacacacatatatacatataccatggaatactaagccatagaaaggaatgaaataacgccatttgcagcaaactgggtaaaatcggagactattattctaagtaaagtaactcaggaatggaaaaccaaacattctatgttctcactcataagtgggagctaagctatgaggacgcaaaggcatcagaatgatacaatggactttggggacttgagggaaagggttgggggaagcgaaggataaagactacacactgggtacagtgtacactgcttacatgatgggtgcaccaaaatctcagtaatccccactaaagaacttattcatgtaaccaaacaccacctgttcgccaaaaacctattgaaattaaaaaaatttaaaaaatttaaaaaaaactgcagaggttattaaaagtgaacaaaaactttaaaaaagagaagggaggtggttatgttttttaaatgcattatcctatattctgcagattttctgccaacctagtcacctgttatttgagcagctggagagaaaggttcatgaatatggaaggaaggcagggtattcggatttcacttgagaatccagagcatatcagttggctttacatatgttattgacaaatttttagtaaaaggatattaagaagtgactagcaaccagtgggtactcccacaatgagagatctaggctgcaaagctaatgaacagagcgctctgagaacactcaggttaaatgacaaacacagtcacttccagacaagttgctagttactttctagtgtacaaatttcagatcaccaagatgcatcttcattttctgcagcccactgattttttttaaacaatgatccatacattaaatgcagctttatatacacaatttacattaaatacatattaaatgagcctctgttgaccacaaagaaccacagcacaatcaccaagatttctacttacatggagatccaagtacaattcgctcctgtttgacttctccctttcctcatgaagcaaaaatggacaggctggtcccgctctgtagcccagaacccacgcgcctccatctctgttgggaaggtctttaggtgtctgctcattgaagccgtcccagggaaagccctcagaggagatacctaaacaaacacagagaaggccatcagtgacatggcagccaaataaataaataaataaagccatatttggggaactcctacatagacttctctatgctagctcttactttgctttctaagttatatttttaagagactgctttcctttaaaagtatttctcccgacaatttctagatcacaccaacaaaaatttacaacatacgccctcatcccccaagtctattggctgtactctatgccccatattcttgcttacaggttgcatgggtcattctatctcagcatgaaatcagaggagctaggggacagaagtcaggaggtctggcctgctggctttcctacagttcctaaacagcgtcatctgagccaagtcactaatgtgtgtgttctccagggcaggaactgtgccttgttcatcttcatttctgggaacagaatcattatgcatggtgcataccggacttggacagtttgttgaacgagtgagtagtgcatgagaaacccattttggattcgcttttgtcatctctagaatcaaaggtattagtctagcttattctaacctaaactataggcaagtttaggtttgccataggatgataatcattaactatgtgccagacactgtttttagttctgttcaatttttatgacaacatatagttaggtatcattagtgttctcattttaaatggggaaactgaagtacaaagaagttaagcaatttgctcaaaatcataaaatcagtaaatggttaagctaggacttgaacccaggcagttaaacaatagagggccgtgcttttaatgaccacactatggcctctgcctgacattctattcttaagatggcaatatgtgttctataacaaaaggattttacggtcaagtaagtgtgagaaaagctacatactgtatctcttaaagaatcatgattcatgttagcatattaaagaccttgggatgccctttagtacagaaaacctaattctatataatagggttttccaaacttatttgaccacagaatccatttaaagggacatctgctaaacatgtcgcaagccacttaatgttgtactggacacttctaatgtttcatacagcactcaagttcctagtcctcttttaattcctggtaagcaaccttggcaaaattttaagccactaggcagaagttaaaggtttaggctcagtgtattttgcaatagagatcactgttgaatatacgacagagtgtttattacacataatccctgtaagagtctatttggcagtcacccaaagccaaccaatggcttctaccatgctgaaacctgacttacacgaaactagagctgagagtaaaagtcagctcagaaaggaactgcgagatagcatgcttatattagagtagcattttagaaggaagaaaatttgaaaacagctaaggtttggctgttgtttgcctgtttggtttattagttttcaatcacacttcagaatgatgcaggtcacagtgtgtctatagttgccctctagcaggctgtccacaaaacacctttctgcaaccactgagaaaaatgagagtccagggcttccccagtctatgttccccctgcagacacagttgtctagaagagtatacccaggctcttccttcatctcggtcagatcccttagaacaaagtgcctttccactcaatccccttgctacccactgtctacagacagtcttctggcctttcatttagggtctcacatgctttagagtgacccacttctagtctcaagacataggaatgaactaatgcctaaaggaacctcagggagaaggcactctgcttagcacctttgctttatgctcatgttgactctgaggaagatagtactgcttatattttaacagatgaagaaattaaagctcagacctcctttgacttctatttatatggctcatcctcctcctggactatttctattcacctttggcataaattttttaaaatttacagtatactctcactgtactacctcatcttccaagatgttttggttactaatcacatccctcattttaaatccctccacctttcatttttcttttgaagtagctgctggctttgggtaaagtttgcacagaataataaaacaatataaaacataacatatataatatgtatcacaaaacacaatgtacaacacctgaggtaagacatttgtatcatcagaggcacattgtctggtgagtgtaagttcatcatttaggtacaagagagtgaaacattcccataacaacaaggatttggggtccttgaaacacacatgcatgcatatttatgcaaacacacatgcaaacccctcacacacctgcagtggctatccaatactgcattaatgaggtgaggtgtgcaatccaattcactctctacgcagagcaaaaacaatgtcaaggtgaaagttatcttctttctggaaatggttttagttttaaagagttaatttctgatacctaaggtttaaccagacaatatccctatgaaggaaacatgcaaggtaaaaccatgatgcataataattttggcaagaatcatttggacagaaaaggaccataagtaacataaaactgaaataagtaacataaaaccattattctcaaaagtctgacaaagtaggttaggacaaatgacaaagtcaacattctgacgaccacaatgtatttataaaataatttgggaatggagagttttagtaatacaaacaactttttttcagtcaaaaataaagcacgtctgtatttattaaaatgggtaatacccaagctagtctctccagctgaataaatttaataaaaagagaaaaaaatcatctgaaattagataaatatattctgtcaaaacagtcaactgtcatttaattttccgacacaaatagatttgggggtgttagatctttagagaatattttgtgaaaaactgaatcagtcttatcagtttaaacatgtctttccttttcatgtgcatactacaaacctgttttgtactcagtattagttattttgttcctcaaagacatttcaacagtttgatcgatcacacatacacacacaggttatctgtacagctgaccacggttaatacaacgtacagcacagtcacagtaaaggtagggtgacttaccttggaaccactttgaaagtctgtgcttttcaaagccattcacatgatgagctgcacttcctgatgctaacctacaacatcagactgaggttttgctgtcaattatcaaaacaacagaagcagacagaatgcaaaggtaataatatgccatttaaaacaggaggcagtgtccacagctcatctttccaaaatagaatcagtctgtctagcaggggtacattggattattgttcccactgtttcactccctccctgcaatatgatcacgcacccacggccttttctggtctatttcccctgccacgtgacttcctttggccatctgaatgtaaacaatgtgacagtgtgccaattaaggctgtaagacgcacggtgtgttttcatgccccgccctgtgcttctgccctcaccatgagacgaacatggtcctcgggagcttcgaatgagacgtggaacatctgtcccaggcacagtcctgcaagcctggagccaagctcagtcaaacccaggcccaatcgagtgaaccttagccaactcccaggccagtacgtaaaaacaatacatatttattataagccactgagatttgaggcctatttgttgaaatagttgcctcatacactatcatgtctgctcccactagaagcactgtaattattaaagacattaaaccttttcagctgagggcttaaacacaacagtgtttttgttttgtaacttgtactgaaaaaaattattcaatgcactgcaaggatctgaaaaatcaagtgaaaaactcatggcacacccatttactcattcataccaagattcatgcacaaactacattttattaaaaagttatttaccagatattgtctttaatcgtctaagaatatacatataaaaatataccaatttcctaaaggaagtctgtgaacatactatataaccagcagatctggacaaaagtccctaagggacaaaattacagtgccttttaagctgtttcctctaattctcccatcataccaagccctcacttgacagcaatgacgaagtggttatgcatccagaaagaggagagaaaaaacaaaaaccctaagcttaaaactctcctcagttttagctcctgtgttgtagtgcccaaggcactacataaaataaaccctaagaggtaaagttttctcagccgtgaatatcagaactgatatgtacaggtagacatatcttccattatgttattcaaacgtgtacttaccagcaagaaagacagcaatctagatgtacagctaatggaaagtgacactgctaagtgcttgtggagtggatgtgtggctgtgtgtgtaatcactcatgtctgtatctaagaagacagagctgtggcaaaagtatagtctcatggctggtatctgtcaattagagatcaatgctcactaatgcaactgcccccattttcattctcagcagtgttaaatgacacaatgtcaccaaaccacctaggtagatacaattctgagaaggtgtggtatctatccaccccagcctctaactcctcactgggaagtatgtggggagagaaatgatgaatgagcaaagatggacaggcggaaggtgtggccaggcagagaaaggctgatggcaaatcaaaaagtagcagagagtggggagcaagctctgtaagtctgaacattgatgaggaaagcatccatagccatcaggcaactgcaatgtagtttgcatttctaaaatcatgcttaaattcaaataaaataaaacaaatttacagttggaaagaatcttgtatatctccccacctacatgctcattttatagttgagagaaccaaaacccatgaagattgcagtatttccaacatgcccagctagcagcaaaggcagaactaaaatctaagttctttatgctatttagagaaagatattattgccagtctccagatgagaatattgagggctaagagagaagcagacgtgaacaagttaagagcgtgggtacagggctttaacatgtgggctaaattcctggctgtgacctttactaattatttgaccttggtgaagttaccaaaactccctgagtctttttccctcatcaataaaatgaagataataagaatatgtctgatattgaactaggctcacaattattttctttcagaagacttttcctgggctgggggatagatagatttgatgggagaagcaagtaatttcctgttttaagtaaagaactctatatacaatgagggcatatccaacatcacacagtcatgtgaaaggctatttttcttttgtcagagaagataaggagaataacaataaagcttataagaattcagttgcactgcagtgcagcagatcctaaatctgttcatgttccaaaaatagaattcacgtcatcaaatgcaacagctccaagtaagtggctgatcatctctggaaacaacagctcctcagggtcgttcatagataccctatgatactccttcccagaaagtcaaacataggagcctagagccatgaatggaactatttatagtcatgcctttaaatgaaatagcattttaaggaagtatataaatatctctttgattattttattaacctccttccacggttttctcctgtgaagaatactagttgagggatgtgtattactcagactaggaaacttatgtgtggccatagttacactggatattttaacacttgaaaaacaggggcacagatgatgctaacaatggatagagcacctaggtaagtcctgatgcagaaaagatcaaggaaagaacaaatttaggagattgtaggattcactgagacattaaaagcctccgtctactcccagataataaatgctcaaaacattagatgttagtacttcaaatacttaagtgatcaaaaaattttagtatgtttggttataaagaatatgaccgggtgcagtggcccacccctgtaattccagcactttgggaagctgaggtgggcagatcactagaggtcaggagtttgagaccagcctggccaacatggcaaaaccccatctctactgaaaatacaaaaagtaactgggtgtggtgggtggtgcctgtaatcccagctacttggaaggctgaggcacaagaattgcttgaacccgggaggcagaggttgcagtgagccgagattgtgccactgcactccagcctgggcaacagagtaagactgtctcaaaaaaaacaaaaagaaaaaagaaagaatatacttgcttgttaacaaaaaacatgtatatatatttttgagatggagtctcactgtgtcacccaggctggagtgcagtggtatgattacaactcactgtagccttggcctcctgtgctcagcaatcctcctgcctcggcctcccaagtagctgggacaacaggtgtgcaccaccacacaaggctagtttttaatttttttttgtagagatagactcttgctgtgttgcctcaagtgatcctaccaccttggcctctcaaagtgttgcgattacaggcataagtcattgtgcctggccccaaaaatattattgaagaataagaatgcaaaaaaaagtcatatggcattcattacaagtaaatttgaataacattttcccttttatgtcacattattccaattattatgaggatggttgcaccagtgggaaatccaactcttgaagacatatgatgtaattactggttgtcttaatagctaaggaagtaaagtagagaaaaaattacaaaatactaagccctggattatgaaatatataataaatgatttttttaaaaacttcctttccaaaaagaaatgatcctagcaaactcacaaaaaggaatatacgtaacaaggtaaataccaaaaaaaaaaaaagaaggcacatttactattaaatgtgattgagcatacacaatacaattaagagactgaaaatacaatatggctctgagtgtccttgcaacatagtgagaatgaaaggacattctttatttcattcctatcatcaaaaggaagaaacaagctgatccctgatggctgacagaagtttttgtgatataaaattctgagaaaaacagctgtataatcttagttcccacctttgccttagctccatcccaggtgtttggtctaacaattatctttacacaatattgttgccagcactagagccaataaggctggtctagtcgtctgtcaataacctttgcccttctaaccagaaaagtctggatattaccttgattgcccaatgatctggaattaaagtgatgaactcttcatcagagctgctaagaaatggcctctataacacatccagattcgtaaatcgccaccttttgcctgagtgtcttaggcaccagagttttcctatctcccttcctccaccagtcattagtactgagaaggagtcctgtactttactccagcaccggatttatcactttctctcccaacaaatctacttttttttttttcttagacagggtctcactatatcatctaggctggagtgctgtggtgcgatcctggatcactgcagccttgacctcccgggctcaggtgacaagtgatcttcccacctcagcctcccaagtagctgggaccacatgcaccaccatgcccagctatttatttttgtatctttggattttggttttaccattttgcccaggctagtatcgaacccctaggctaaagcaatccgccagccttggctttccaaagtgctgggattacaggcatgcaccaactcgcctcgctgccccatttttatttacacatacttcagactggttgataatgtcccataggtcactggggctctggtaatttttttcagtccagaaatcacctcagtagaaagcataggtagccgggcacagcggctcatgcctgtaatcccagcactttgggaggccgaggtgggtggatcacttaagctcacgagttcaagaccagccttggtgacatggcaaaaccccatctctactaaaaaaaatacaaaaatcagccaagcctggtggcctgcgcctgtggtgccagctacttgggaggctgaggtgggaggatcacttgttacttgagcctgggaggttgaggctgcagtgagccaagatcacaccactgcactacagcctggatgacagagtgagaccctgtcttaaaaaaaaaaaaaagagagagagagagagatgggctaaaaggagcagaaaaatacttaaagaagtattggcttcaattttccaaatttgaagaaaattattaacccacagatcacagtagctcaatgactccccagcaggataaatacaaagaaaactacaataaataaactggaaaatcagtgataaaaagacaattataaaagtggacaaggaaaaaatattatgtatagaaaactaaagaatcactagacttctcagaacatgcagcccaaaagacagtggaaagagaactttaaagtgtcgaaaccaccttagggaaaaatagtggggaggagggcagacagagagataaacagagaacttccataatgataaaagagtcacttcatcaaaaagacataacatgcctacattttcattatttgtacctcgcattaataacagaacttcaaaatacatgaagcaaaactatcagaactgaaataattacataaatagacacatatttggagatgtcaatattcctttcttagtaattacaacagcttgacagaaaatcagtacagatatagaaaaactaaacattacccatcaattttacctcacatttataacacactccattcacagtaactgtagaatatgtatttttgcaagtacatatggaatttatcaaaatagaccgcacactgggccacaaaacaagtctcaatgaatttaaaaggatcaaaatcatatgaaatatattcattggctacaatggaattaaattaggtactgataacagaaaattattcggaaaatcccaaaaacttggaaatgagaccatacacttcaaaataactcataggtcaaagaagaatcacaaaggaaattagaaaatatttggaacacagctaattcaataatcagagagaaactgatagccttacttcatgctgagtgactgtcctcccccaatagggctgatggcatttctcctccggactgggggagatgtcaggcataactgatgcatgattaactcatagcaaagtggattcagtgaccacatgcttcctgaatgctgaatgctgaggcctgagctcccacctccccctctctaggcttccagaacacttgtcttctctaaaactaggcacacactacaacattattctgagagaaacatgaccagctcaagagaaagaactgggagacaatgacacaggaggttcctcaatcaacagccaggcctgatcaccctacagtgatgttcaaatccagtattcttacacaggcactcagggctttcagttagctttttagtacccacacctcacgcaggtagacaaccaatgattatgagacagcggaggagaatttctaacataaagagcaggtaaaagagtaacaggaggatgaggttgtgtcactgcatacctgctgaatcaagattttggagatggctactttcttctaccaccacagctcttactacgtggcccttttccctgcctctagttcttgccaggttcctgtaatactctctcctccctttccccttcaggcctaaggttggtaagggctttctactgttgctagttcctcggaagctcacaagcccatgcttgttttctggggcccttcaatctccacacaatctcttcagttattttcattttaaactctcttgaatagcccaggcgtggtggctcatgcctgtaatcctaacactttgggaagctgaggctggtggactgcttgagcccaggagttcaagaccagcctgggcaacatggtgaaaccccatctacaaaactccatctacaaaaaaaagacccaatctacaaaaagttagccaggtggggtggcgcgcacctgtagtctcagctactctggaggctgaggtgggaggactgcttgagcctggaaggttgaggctgcagtgaggcaagatcgtgccattgcacttcaacctgggtggcagactgagaccctgtctcaaataagtcaatctatcaataaactctttcgagtgtactgtgtgtcaggactctgactgacacaataattggcatcaggaatcatgtttatttcctaccttctagcacttctgtatgtatcactaaggcatctagggtgattgctacatgatgctcaccatgctcaattagaataatagcagcaatgtgatgtgccagtataatcttttgagagctatcaagatcagcaaactcctttcagaatgtatcatgaaagagaataggaaaattgtcataaccctaaaagaagacagtgatggtacagtgccgttctttccaggatgaattgatatgaaaataaagcatttgtaaatcaataaatgcatattagatttaaggagctgtgttgatatatttggtagggataccatatctgaaacagcacctgcaattggcatccccatttatgtttccaataatccagtcattctctaaaagtcatctagttttctcactaaacaaaaaggaatttaagtgggaatatggtatgagttaccatttctgcatttttccaagctttgaggtagcataaatctctgcaatttctccagcacatgtctttctcccagaatacacagctgtgggactcaaaagaggaggtgagactggccctttttactattatacctaataaatcatttgcataacttttgcttcctgtcattgcaactttgggcttggtgggtttggaggtcttcgtgtccaaaagaggaatgcttccagtagggaacttagccatcattccactcaacaggaagctgagagtgcttcttggccattttagtttcttatacattagagacacatttatttagttttagtgcctaacgaaatgaatctttttggtagaatagaatattttgaactgagcctagagtcttaaactttcacagtaaaaaaaaaaaaaaaaaaaggtaggaaatataaaactgcacatttggaaaaataatatagtatatgaatgcctcaataaatgaatgtcctcatatcaatattaagataacacagggaagctattgtgaaacaaatacactcaaaggtttctggtaaaggagtaaattggtctacaactttgaaaagatatttggcaatatctgaaacgggggttgacacctatgcccgaaggccaaatacagcctactgcctgttttgtacatttttacatttttaaaggaggaaagggaggaggaggggaggggtcaagatggggagagggaaaaagaggaagagaagcagttgcagcaacagaggtcttacggcccacaaagtcaaaaatatttactatttggttttacagaagaagttttcaaacccctgttctaaaatattaaacatattcatatcctttaaccaataaaaatccacttgtgtgaatctatccttctgtgaatttaagtaaatggaagctaatcataaagaatcatcatcgttgttatttgagatctattacaaatatacaaggtatccaccaaaatataatctatgacagaaaaaagtgggaaacaaaacaccatcgattgtgatatagtcattactgtggaatattatataattatttaaaatcatgtttccaaagaatatgtaatacataagaaaatgttcacaatatgacatcaagtatgaaatacaattcttaccctgattttaaacacataaaagagatcaaaatgttagcaacaagtttcttctttatatttttctgtactttctaccgttttttcaatggactttctaaatttcatttagaaaatgaagcaactattaattttataatcagaaaacaataaaaataagtaaaaaggtagaaaatggatttgaacaagccttaaccaccaaaggatggtaagacactgaaaatcatctgtaaattgaagctgcatgtcgagccaaatctggcactgactatctgccaatgatgtattatttcaagatgtgcaagttgagtatactggaggaggttggcgatttggtaaattcagttaatggtattctaatttcaaactatacttacctacataatcctgtaatctaggggtgtctaatcttttggcttccctgggccacattggaagaaaaattgtctttagccacatgtaagatacactaacactaacaatagctgatgagcttaagaaaaaaaaaaatcacaaaaaatgttttaagcaaagtttatgaatttgtattgggtcacattcaaagctgccctgggataggagttggacaagcttgctgtaattcttcatggtaatccctgccccctaactcaaatcccagtctgaagcacaaaataaattctattttaaaccaaaaatacagctatttttacctgccattctttggcagcatgagatctaacaacaagagactttatgtcattgttttaaatcctatcccatcggtcctatgattatgacatttcccttctcatagaccttcaacaacttcttgttgcatacagaatagaacccaaattctttggttggatagggagaccatttatgcttggctttcacatattcttctgaatccccatctataaccccacataggtatcccggcttccagctgtactgggctgctttccattcctcataatacacttccttgtctattcactttatttggactgactgtataccagtatctgaaagacaagtgctacccatccttcagcaccctccttaaatttcaattcctctaccaagtttacttgtgtcttccaaactaagtttatctccccttttctattcttttgggtgtactctgtacatgtatgatactacagcatgtgacgctccgttatgtgctaatttattttatgtgtatctgctttaccataaagctgagtcttcagaggttttcccctatatcaggacctgtgtctttgtaagtattactgagcaagttccagaagcattcatactcaaattcaaagacataatttcccccttaattttcaatgaaagaaggagctattgttgaaatgagaagatgtgctagggagggatgtaaatagaggagtaaaacattggggagcagaaagataaaagttttctttcaaactccaaagctagactattctcataaaactaaatttaagtaaatggaagctagtgttccatcaggtagaaggtgaacccagtcttaagtcacccctaaatgaccagatttcttctctccatccttcctcattctttcttcttttcctctctccctccttctccctgtcttctctttcttcttgacaagcaaagattccaccataaatttaaatgatattgggtattatggagaccacaatggcaggaaaagcccatggagtttgcctcgtgggttatatatgactcatgagcaaacacaaaggaaatgatgtctttctgctttttaatcctttcataaacctcctaaagttgggagacagattatggaaacattgactgacattggttttatttcatttccacaagatgaaaatttataataaaactttctcatatgggtattcagtgtaaagaaatgtacttttagcaaattttcaaaccatggaactaattaggccttctctgatattcctgtttaaaatagatgtctccagtggttattttcatggcaatctgatttttcctccatagaatgtctttaatttattttttatttgtctttaggatgcaggaaaaggcttaatggggcagaaccttacttgccttctccagtaccaggcactccagcatctgacacagtgcctgtgtttagtagatatataataatatctgttgaatacaataattgttgaatatacattacatgaacagttttatgttcagaacatccaggtttttcaggtgataagatctactcttttttatcagtcctaatgaacacttactattgagcttagcatagactctgtagcagaacagttttggtttaaatctcagctccaacctcttactagccaagagaccttggcaatttgtttaacctctctatgtcccagtctcctctgtgaaagggggaaataatggttctcaccttctggagttactataaagattaaagagttaatattatacaatggactcagagcagtgcctggcacctatagtacataaacactggctgttagaattattactctctgctcagtgctgaattagaccctgtagagggcaaaaaggtagaatgagacagagctccatttctccaaaggattcactttcgagttccaatgaatggttcaacaaatgtgttctctaattttatccattgtgaaatatttgaaatgttgtttctcatcctcccttcaaactaaaatataccaaaggagaaaaacaaaaaccctaatccaccaaaatgagcttcattttgttatgtagaagagtatttaaggtgccagggtcttttcagaatgttttgttcagcaaagttatcatggtttctattctattacaccttgaatttatttggtcaagcttaaaattaacccaaatcatctttaatttaggaacctgtttttagcatcttatcactatctgaaaattgcccttttcttccccctgaggtaatttcaaatgttattttaccatgccttgggggcataatcctaccagaaaatacagctccaatttaaaatgcaagtcagaagaaaaatcaatttactaaaagaaaattaacttcatcggcaaaattttcaggaaggaactgatccttaaagttaacaaaatctgtactaagaataaaattgagttcatcatatatttgtcagctgaaaaaaacttttatcaatacagtcaagtgcatgataaacattccctaaaacgacttcaccaaatgataaaatagaaacttttgagactcacattggtaagaaatgataagatgcacaaatttgtcaataatggcttcaaaacaacaaagagcattagactgaactgtatggtgctgacaagtatttcaggagtcatgtttttactttgggcttaaattttacttataaatatgtaagtggactttcttgccaaattttcacgatttacaatttaaaatgagtcacaacagtgacttgttgctaaggaatagaagcaccaaataatttattttctttttatttgaaatgacaattatatgtattactgatagagatgcaggaagtttgaaagccacaaccaccctggtatgtggttggggaaaatgatacaacagaggactcactcagcacaactgaaacatgagatgaacctaagatagcgccagtcactgagaactcaatcagctaaaggaaatgaaaataaaattactagggaagctagtaatacgtatgtattcctgaagcaatgttttccacctaatgtaattctcaaatagttttgtgattttccatggagccaaggattgtgtgaattaactgaaaaagaaaaaagagtaaaggaaaaatgagataatttgatataaatttgtaaaggtattactttactaaagggatttgacactacttgctttgcagaaattaaaatatatcatttctatgttaaaaacaatgctaatttcagtcttaatatttgcaccatccaaagaaagagcaaaaagctgaatctaattggtggtgatttctgtgataagcaataagcaaaagatagaatgaccctctccctctccaagagctctgagaggtggtggagatgccctgggatgtggcactttgcaagctggggagctatctcactacatagtacatgctctggtctgacacaatctctctcactgtcttcaaagagggaatgagcaaccaaagggttaatattaaacatttttttcccctggctgtaatgattctaagacaggtgctctctgtgctctggatgtttcattactaaatggagctatgtccccactggtcagaactggggagcaggggtcatccctcagaattagaaacaaagactttccttgggccactttgagatcctcctgtcaagaaaaaaataaaacggacaataaaagggtaggggttgcaattaatagctagcataatttaccctattaaaaataggattgtaggggatttggtggggtatcagaggaatctagaggataatttagcagaagactcccataatattatctagatggactgtcaatggttcagacttctcagaaataaacggttgtcttcaccaaagaatccagaccagctgaaatgctgcctaaaggcaaggctgacttgaaatgggtaatgactggggaaaggtttacagactatatggctttgagatcaggcggaaaaatagggaatcttgactaaaactgtattttcttatgtactgtttggatatctaaagattaattacttcctgttttctctttcaataaatatctacttttccttttcttcacttttttttggtctcactactgggatatattatttacaataaaagtatccattgattcataaggttataaaatgttgtaataggacaagaaaaaaaaaacttctcagcaacgactcaaagaacagggtgcctatggcatcactccagatctcattactgtctgagcttgtactgtctcctattagtgagaaagggtttgcagttatgcctggtagagctgagtctgctgctctttgatgtgtagcatgaaggggtgaaagctggaaagtaccccttagaatggctgtccatcccatgattgttctgccttctctcggaactgctcccagtacataaggggaggctctgagcagccatgtctcaacctgatctggagtcgctggatctgaatcttataaatggcagaaaatatccaggaacttttgcttatgggattctcagtacttcctggttgccacctggcccaatattactattcaatttttccttgcttcttaacataccataatgttctgtaaataaattcctattttgattacagctaaccagaatccacacacacacacacacacacgcacgcacacacacacagacacaaaacgctaagcaacgagaatgccaaaatttcatttggcattgtctctgtggccttttttttaaagtcagctttcttcaatgtgtacatgattctacaaaagtgtataaacatcatttaaatctattagcttttagaggaattttgagtcattctgatatatccccaaattttcatcatctcatggaacttctcaggagcatccagcagggttgaatgcatactttttcttgaagttccttttcagaaaacactctttccatccaagttctcctgagttcactgttcactcttcagttgccttgctggctcctcatccttctaaatcagtgttctaaatctcagcaccattgaaattttgggccagataactgttttctgtgggaggatgacctttgcactgtacaataggatgttcagcagcatcccttgacctctactcactagttaatagtagcatcccctccccaatcccttggccaactaaaatctctgaaatcgcccctagttgagaagcactgctctaaatgtttcagcaccccaaagatatgtgcagaatcttctctgtcttcattcactccatctgtcatctcattcagtctcagttttaaatatcatctcagctctagtgacttccaaattaatgtatctggccataagctctcgccctatctcatacaggcacccaagtactctactcattgcttggctaatactcattccaaactctttattttccttctaactttgttcttcccccagtctttcccacctaattaaatagctctcagtttctaagattaaaacctgcttcatccttgagtcctctctttccctcacattctgcctaaattttataagcaagacctgtttgctctaccaccaaacagtatcccaaatctgatcacttcacacatcattaccacctcagtctacgccactacctctctcatctgggcaagtggaaaaaatctcccagctcttcttccttcttccactcgtgcctagacacaatactctccacaaagcatgccaacgatcttttaaaaatgtcacaccattcctcagatcaaaatcctccagtggcttcccatcatagttaaaataaaatgcaaatccctggccttaaagaacatcactggacttgatccccgcctatcactttctccccatctcctaacctctcccttacttcattccagccaccctcaccttcttgctgttttgtaatgacaccaacctcattcctgcctttggcatttacactggtgttttcttggctaagatgttccccaggctgttaaatggctgatttcttcacatcactcaagttcaagttcatgctcaaatatccttcgagcagaaaggctttcttgtcactgcctttttgccaacaagctctctagtattttacccatcgtacttatcattacctgaaactaaataatgaatgagtctcaaaatcaactctagcaatgcaagatatcagatctggttttcttctgtatataggtggtactatgatgatccctctttgaagacatttaaataaaatgtaaatgctagtatattttttatttttcatgctggccccttatttattacagttaactctggaagccacagaggtgtgtttgcagatcttctatcatgaaaataacaaaggtttcagtttggatgccgtgttattgggagtgagggactagaattcaacactggcaagaattctgtgccaggttcagctccagtaagaaagagtctcgtgatttctctgggagagcaatgccttccctggcacaggatggatggtggtggggtgtgtgtgtgtcatgtttttaccatcctttgactaagccctctctgttttcttgcctactcattttttggcagttcttactggcatcttcattggcttaactagaaaaaagaaaagatatgaaactcaatcagacaactaaacactgctttggtaaaagttttgatggagggggaaaaacataaagctaaaggacatgctgcaacaatcagtgggtgtgaatcttctatctacatgtctcttactcccatgagtagggaaaggagataatggcacataagaagagaaaatacattcaaaatagtattattttactctccttgccctccaagaaaaaacagcttaagttattagattgcaaggtagataacataattctctaactctgctattaaacaacaagaggcctggagaaactgaacttaaagagaaaaaaagaagaaagttaaaggattttttaaaaggctactatataatgaaaactacccaatcattcaaattcctctccccactcttaagaaaggtcaactgatagcccttggctcctgatgtgtaactatatcctattcctcttttgatgttctcaccaagagggatttaattgccttttccttgattcattagatggtcacttcaaagagaccttcaagaggcaacatttgcccaaacaactcccctgtcttagtaaatccagataaaacccaaaaagcaattcatcctaaatttcacacattgttgtctttggcctctgtcagtgacctcagcctacaatattgattaccactctgcctcccaatatgaatccttcagacaatcaatcagttaccaggacagagaaggagttatccagtctaatactaaaaatgtccccatgcctacaattaacccaagaataaactaaacaacctagcaaacttgtcataactttaccatttataacctatttcttctcccaaaagcaaggaaggcataaaacatacttggtctagagtgtgctagactctattcaagacaaagatggatacttggtttagtaacaaactaaaatattttattaaattaacgaatgtctttgttctaaaatgcaagtaaggtttttgaggttcctgtacaaaaacaacatagaaatccactatagtttccttacttttgtcaaaacattaatagataaatggccaaagggaaaataaaaataaacaaccaatgagtatggggaaattttaaacaccattagtaatagctaaaagaattgcaagccaaatgaaatgcgagcactattcacaatagcaaagacagggaatcaacctaatgtcaatcgatgacagattggataaagaaaatgtggtatatataacaccatggaatactacacagccataaaaaagaatgaaatcatgtcttttgtgggaacatggatggagctggaggctactatccttagcaaactaaggcaggaacagaaaatcaaatactgcgtgttctcacttataagcaagagctacatggtaagaacttatgaacacaaagaaggaaacaaatactggggcatacttaatgggggagcatgagaggagggagagaaacagaaacaatattcgatactgggcctaatacctgggtgatgaaataatatgtacaacaaccccccatgacacgtttacctatgtaacaaatctttacatgtatccccaaatctaaaatgaaagttaaaaaaaaaaaatgcaagctcaaagaacatttcactgtaaatcaggaagtctaaaaccttaaaaacctaaaaaagtaagacagtgcccatggatgtttaagttagcaccagcacttcacctagcaactggacacagcaagttcccattaaatatttattgaatacataaatgggtaagtgcacgaatactcttcaggcaaaaagtatattgaataaaatttggagaaacaatttggtaataaatattaaaataactgataattgtcatacttttgacaatataacgcttctcctaggaatctaccataaacaaattctctaaaatgcaaacattctatgcaaaaatacctgtcagattattaggacactaaaaaaccataagcaagtaaagtgtccagaattaggtaaataatacatagatggtctattctctttgcagaattgttcacaataactgaaacaatatttatgaaaagttaaaaaacacaggaaatgcttataacatgtggaaccaaaaggttatgtatcaagttcaggaaattttttaaagtacagtaaaaagactggaaataaatgtaaattttagcagtaatttttctatgggtggtgataatggaaggtttttttcgtatccttatgaatcttctatatttttctataatggccatataatagttttgtaacaaaaaggtaaaattctgtattaaccaaggagagcattttttgagaatagctattctgtcatgcatctcaaataatatcagtaaaacacgtccccccgcccctcacattgacgcttctttttctttttaatatttgattatattcagattaaatttatataaacacagatcattaaagcattttgatgactaacagtcttttatttaaaaatgcaatattaaatcccaattaaaactattttgctattcctttagccattttctctgttattaaaacaaaaataagaacaacttgtcagtatttttagtccattaaaattttcccacattaaaacaatttttaatgtcttggcatgcagtatatttttactaaccttaaagaagttctaaaaacaactcctttacatttttcaagatgcctttgtacagcaattatgataattattccgagtaaatgagttaacacatgtgaaaaagtgctatggaattataaactgccattcaaatgttagttttacatttttatggtatgctattcctgaccttacattcatttctcatggcatatttccatttccctcacaatctatgagatgattcatttgtgtgttttccatggtgctttgcacatgccctctataaatcacactgatttttaaaatgtacattgtaaaatgctttcaaccctacacaagttaatttaaaaaataaaaaaacttaaaggatcctttgaaatgcaaatcgaaacctcagtaggataccacttcactgggatggctataattaaaaaggcagataacaacaagtgttcatgaggctgtgaagaagttgggactctcacaagattgctggtgggagcctaaaatggtacagcagctccagaaaacagtcttggcatttcctcaaaaggttaaatcaagaattagaatacaactcagcaatttcactcctagaaataaatccaagaaatataaaagcacatgtccacacaaaaacttgtacacaaatgttcgtagcattacgcataatagccaaaaggtggaaataactcaaatgtttgtctacttatgaatggataaacaaaatgtgctatatccatatgaaggagtatcttttgcctataaaaaaatctcaaaaacatgctaagtagatgtggccagtcacaaagaccacaatattgcatgataccacttacatgaaatttccagaacaggcaaatctacggaggcagaaagaagctcagtgataacttgggctggacggggttgtgggaaaatggtgagtgacttctgatggtatgggggttttgggggaggtgatgaaaatgttataaagttgattttgatgatggttgtacaactgaatatattagaaaccactgaattgtacattttaaatgagtgaattatatggcatgtgtattatatcttaataaagctgtttttaaaaagactcaagttaccattttatatgaattggttgtatcacattttactgtaattttttggaaagaactgtagtgttaacaaagtttttgtatctttttacaatttcatgtctatgaaaacaaaaagctatataaataaagattttaaccacagcatttttattggtttcaacttggaaacaatttaaatgtctaataatggatttagtaccatagtcatctacatgataaaatgttaccccttaaaattataaaggtataattaaagagatggtatataaacattagaagtttgaaataatgttaggtggcagtgcataaaacaaaatatttttatataattttgtttccatgacctttgttatttaaaaacacctatctctatgaagagttgaggtggttggattatagaagattttgttgttctgtactagttttcttacataattcttttaattaagaaaagaggaactgttattgctccattaaacaagtactaagcacaactatgcaatgaaattaaaaggttccctagagatgccgaacctaagagcattcggtacctgcagcaaagaatttcaggcactagtgcttagtttaacccctatcataaaaacactccaaagatattagaggcaagaaggtggttacaaaaattccagctcatcaactgactggcctatattctacttgtacatctggtgtattttttcaccactacttgttgagtacgtgataacagtcacggctgcccaatcaacagaattttaggatattttccctgttctgctagagatcacatgggaaatgtgggttgctaggaagtggtgtgggtaaatggcaagaaatgaagggcatttgcagcagagttatccaaatgtcaaggcctacacagctactgggtttatatcgtcagaaaggttaagcctccaggttacagctgccctaggcagtcctggtgtactgggacaaaggggaaggcagggaaagtctaagagaaccttcgctgttaggtgctttgacaacagtgtcttctctattttcttcacaatgcctcagtgtggcggaacaaaagaacaaaatacttatatctaaagtacaaccaaagtgtttaacacccccaaggcatatctacctctcaatatgctgtttcaaatatctgcatttattggtgtaatttggatgctttgtggccaaagcttgacctgtgtactgtgtgatcatttgttagggggttgctcactttctgacatattcttacctaaaggtcagtgggctccttgacatgaattcaaacaacttcagtgaagtaattaaacaggatgagtgttgccatgtatttgtaacgtaggtccactacaaaatttgaattatctattgttttaaactatataagcttatttttttcaattaatagttcagtgatttcattccagcctttctttctttacaaaatttttgttgttgtcttatactgtttatgtaacatagatgtgaacatagggtacgatatagacaattatgcagcctcttttttccaacaacagtttgctcctccatgaagtacgaccctgctcccccatctttagtcaatacctgcgctcctacagaaaacacaaaaatcatccagtgtcagtatacggaggcaccttcctctacagcccacctcataccccaatttaaatagtaccaccacccaccttctgttacttctcccccttctagacaggggccccacgttgaacactgtgcattggattcctggtgctccacctcagagccagcttccatggccacgtcagttctttcatctgtgactccttccagacggtcttacagctgaggcccctgaggtaccagcacacttcaaaacagagccttctttaacaatgaaaccctgactggaaactgcttctactgttcctttaattagccttaacgatgttttcacccacaagtgtgggaaaccagatccttagccacctacctgctccttagctcaggaattgctctaggctcagttatctaaggtccaagtcaagcctcctccccttggcagttctccaagatcttgtaagctggtttcctacccaacaccttctcttggagcagctctgttcagaattgtcagcccggtttccctctgagcctgttctgccgtcaaggtcctataggacactactgctagtgcctgccctttatatctcaatgtgctgcaagattggacaggaggcaccacatggcctcctaggccaggcctatgggttattatttctacaagtccttgcttgtccaaggacgaggaatgaagcagctcaggactctaaagtatagcatcctaaaagcctaacttctggacagtgacataagaagaaataattggcctctggctgcctgaacatttagacctaaacataaatatatgcagaaatgataaaaatatgaatattttgcaaagaatctgcataagtgttgaacatggaatgtgtggccagtggattccggaagcctgtctgtcacatctgttccgtttcagaaacaagtcattgtcgatccaatcatttgaatcatccagtcgcttgtttgtgtacccaagaacaccacgcaaacgcgagtctctcctcgtctcatgacaaaagcacttaggatttccttcccctgccacatgaccaacaatgcaccttcttttggagagagcctgtgggtaaatagtcacaactgctgtaatgtctcctaaactataaactccatatttctcatcacctgacaggtagcatgacccaaatgccccaaaacaactacagaactatcattaaaggaatagaaataatcctactttagctgataaaatttaagatctttgacttctggaaattaacttttttcccctcccttattttgcctatccatgtttgaaaagatgcaagcatctctacgttactgtccagccagctaactgaaaagtttaggggtctggtggctgggcaggcctcagaagataaactgacctgcactgatccttcattcaatatatgatccatgtattgattttatagagtcctcaagacttcatctatcaatcagtcaaaatgctgattaagcacccactatgccaggcacggaatcatatgatacaaagataactaagacaaggcccttgccttcaaggagtccagtctcccatggggaaaatgaagaactaaataaattcttagaatttaagtgttaaaaggagagtacttaagaaataaagagcagagttgcctaaggctgtcctataaggagggtgggaggctaggagtcacaatgggacacttctcatgggaaataatacttgaaggatgaataaaatctaacgagtcaaatcagaagaaacatgtacacataaaagaatgtatgtgtaagaagatggcatattttcaacggactggtatgtgggttgcttatgaaagaggtaggcaaggctcaggttgaggtccttgtgtacagccttgctaaggaaactggatttcatccttaagccccccccccccacacacacacgcacacacacaaacttgctgtcttgccagcctccctcacatacaccctcccccacctctcctatcttttacattcaaataattcttccacaaccacaatacactgagcacctgaaatccagctgtgcacagcacctgcatcaggtaattgtctggaaattcttgcctgtttcctctaaacctgttcttcctcacccttcctgcctctcatatccctaaacctatgctccgctcccatgttgctatttctggccagactttcagttaccacttagaagttccctttccaccttatggcttgactcttaactctttgtggtcatgagattttattaaccttagcagcttccaatgagaggaattctccaccacctttactccaaccagcaaatccatttgcatcattattcatttcaactagattctctcacacacctgcttgcaataatagtaagtttctcaggtagctttgggctgggctgaattaaagaattttcttagggtgaatggggactgtaatcactcaccttaaaggtatatccagaaagactatagagatccaactataaaaagacattcctgagttttagctatgtccctggcatttggatagtactatggttttccttagccttattagtagttacttaaatccccatttatacagaaaaaagatgtaaacgtagactaactttttcactgggattgacctagtctaggaagcataatgttctactttcctttatacctgtttataaaactcttttaaagtatccttggttcacattaatctgtgcttcatccaaggacaagctttggaaaatcacagcagccaagttgcaacaaatccgaggcagccaactgttcaaaccgtgttcaaataaggcaaacgcccagctgtagccaatccagctgtttctatgcctcatttccgttttctgtctataaatgttatccgaccatgcggcagccctgaagtcattctaagcctattcttgttctgggggctgattcaagaatcgttctttgctcaattaaattctgttaaatttagtttgtcgaaagttttttttttaattttttaacacctcccaggcttaaattatttctgctcattatttggcactccattccagcctcttccagcaaaactgcctgtgataaagcagttgtagagaggaaattcatattgaagcccaaacatgattataagatgcgaaaacaaataatactagatatggcttttttttccctcatgagaaatagtcgacaaagtataggccttgaattcaggaaggttactatccatctgactttgggcaggtccttcatagagaaaatggaaataacagagatctttcgaaagtttgttgaggattaaagaaaacgaagtacttgaaacacgttttacagcactcaataaatgcttattattactattgtttccaccaatacaacactaccactattcctatcattaccacaaccaattaagtgtggcactgacccaaatttcagaggagctatggacgatcctgcagagactgagaaatatcctatttgaaataaagttagcctcagatccaggtaaatcacttacatagtgagagcttaagaacaatggaggatctagtttggagaaattactcccctctaacaactctcacggagtccccaacccctactccaaaagagagagagagaaaacaaatccagggtgccactgctggaagttatacgccctcagattctggcaataacaacgaaagtatttgtaatgtcctgccataaagaagacaatgcagaaattccacatctccttaagagtaatctaaaatcttgaaagcatcgaaaccatagctgcattttgattactggcattctgagaaatacacaggggctgagagattgacaaggtagcattcatttctcggcgttttcttatttaactggcatatgctcttgaacatctttttccccacacaagtaatttaaccttaatatgcttttggaaaatctgaactacggattaagctgaatgtttgctccttgcacctcaataaacttacggagtccacttcagggatcaaaatttatagatacgtggaatgagatatttaacaaatgttttgcagtgattccaataaataaacattaatttctgaactgtgcttcacccacatttactagagattaactattatctagcaaacaacatttgtactctcttgatgagacagaaggaacacaaagattaatattgcctcaaaggaagaaccactagagcaaacaatggttatgaagcatactcaggaccatgtagcaaattagtgtttgaactaagaataaagttcagattgacctcgcattcaaatgcctgttcttcatctagtttaggttatgggtgatggagtggcagtacggaagagaaataatactgtttttcgtgttcctagaaagaaaattgttgttaatttgcaaagacttttgcatcaaaataatgatatagtgtgttgtgaatttgcaaaaattttctaaaactgcttctgactttccacaagaagaaatcacatgaattctgagaaaatgtaaatacatgtgcatgtatctctatggaatgccaatacaccacaaaatgtagtttgcaaacctaaacttatataattcactgcctaacatcctccatgggaaactagctttttctgttttagttgctagttccaaccaagcaattatatcgtaagagattttctcatttgttatattaataactttccttatagtttaacatccagtccatttggtacccttggaacagttgatgattgtccaaacacaaaaattctcaggggcatactaagaagtccatctaaatgattagaacaaaccagaaaaatggagatcatggcttcaaataagcaccagcaaacagagaaataggaaagtaaaaaatgtcaatttctcccttaatgctgaaattaattacctttacataatttatttttcctaggtaatttttctaatttcagtataaacttgttgataagaatcaagtgaaacttgtttgacaggaatgagggacagttcctgtaggaaacaagaaatcagaaaatctcttcctctcacatcctaataatgctcatattaaatattaaatacaaaaagcatgatttaaacaatttccatatgaaatattagatacaaatattttcacctattttggttaaataatctagattaagtatttcttgatattgatacagcattttattacatcaacctatctttaaagaatggtataaaatctttaaatttcaaacaatttctagtcacattcatactccaaagtctttatgaagaaaataatgtctataaaaaaagattggccgtaaaccttcctttacaaaaaaaaaaaaaattagacacataaattcttagttttgttcaacataattgaatgaaaatgctaatattcagatggtataatttaaaaaattggagatcagcacccctgcaggtatcaactggaggacatctgaatcaacttatgcgacaaaacaatgacttttcagctagaattcttcatagttcagcccataaaaactagaaagctaaaaacactaagtagagagaaacttctattctgatgatctagttagattcatctctatgttcaatgaacacccttctctctccacctgcaacccagagaacaggcttctgttttcaagcttaccttcctctggggttaccgacctcctgtgccggcacttccaaatcctgggaactgaaatggactgtccatatcttgggctacagtggtagcaggcacccatggtgccaaagggtggggagcctgtggtaaacatgatagattctcaggacagcctgggaggaaggagaatgtgggggatgtgcctcccctgctccatcgcaagagcaactgctacagtgccacccaggaggagactctgccaagcattaatgagtccaccgtccgtacgctcagtgggccagacaggtttcgccactttatagccctattaatgataaaactttctgtaaaaaaccagcactattcttgaagagcttgcttttattttctttctctttcaagggatagaagtgatcactctgttttacaaaagatgttttcagttaaacacaaaacttccaaaaattttttcatttttttgaatcatctctcaaaactaagctctcatattctaaaaactgtttgtactatattcgtctttaaaatgtgttaggaatttcattttcagattttgaaagccagtcttcttctttgctctcataaaatgacctccccatcactaggtttagccttgcatgtaaactatgaaaaatcactgtataattatcttaatgagactttgtgtttatattgtgtcttctatctaaagagctcaaagcgttttgcaaacatgatcttattaagcgtcacaacacctcattcaggaatgcgatggtaaggattattattatcaattttaacaggtggggaaactaagagattagcaattaaatgactcaatttgaggttacaatgttagttaaaggcacagtttgattcaggactctgacatctatttccaaggacatacccaagtgaccaatggagagcagcatagtgaaatgaaaattgtttttcacttctcagaaataatctgttcttttgctctacggctttgaagaacattaaacataaggcaattacaaaataatttgtttacaaaacttggcacaccctgctaaagatagcagatgtgctaactccagtcactttattctccttgctgaccctttccaagggccatcatcatcttccaggtcaatggattaggttaccagttgtgcccatagtgtttacagagtggttagctactgcacttttcctacacaccggcagggaagacatgttcaaagttagccatctagtgcatgtttattggtggacattccagcaacaaggaattgtataatccaaaaaatgagaaaacctcatgtcgccaaccccagagattactatttttttatgtggggatatacgaacacacacgtagtgataccaagatactgttcggcagcttttgttgtcttttcgtgttctggtattcctggatcattggtgtgtcagttcatatatatctacatcattcttttaagtgactacatacccattttacagacatatatataagatatggaaaaatttattctacctattacccttttactgcacatttggtttttttaatcctatgaacattcttgcatgtttatgtatttttaaaagtatttcttttgaatctactttccatttttttacaagctctccaggactctttcttctgaaaatatacctgttgcactatacactgaactacttatagtacagtaagcccatcatcttggatgcaaagtaaattcacctcttttcctcccattgcttcttgatagaggttttagtcttaattataggatagtactctgccttcattcatataacccaaaaatgtaaactggagaaccttccacatgggacagatgaaaggttggctagatgatgttgtaacaagagtatacaataccccatctatgatttacagtctactttctccaaggacttagatcaacaacaacaaaaaattaaactcttgccttttatcaatagagcagtgggtcctgtgtcttgaaacaaaaagtattctgcaaataaaacttcatcatatgcctgattctgagtttcaataccacaatgaccaattactttgtacctctgctccctcagaccacatggcggattcagggtcacattcaatgccagtgtcaatattgtttacaatgttctggactgtctataaattgagagcacaaagggagaaactcattccctcatttccagtattacatgtagttctatatgatacaaaggtagaaatcatttgtctattacaccatttcccagtaaagtacatagttgacaagttggttttgttttgtttgttttgttttttagatagtcttgctctgtcgccagggtagagtgcagtggcgcaatcttggctcactgcaacctccacctcccgggttcaactgattctcgtgcctcagcctcctgagtagctgggattacaggtgtcagccaccatgcccagcttctttttgtatgtttagtagagacaagatttcaccatgttggccaggatggtctcaatctcctgacccctcaagtgatccgcctgcctcagcctcccaaagtgctaggattataggcgtgagccaccacacccggccaaatttttgtttttctgtttgtttgaattttaggaatttgaaaacaaaaagaaagcagtagacttagagccacaataagaaaaatctagaacttaattaggtctctctcattgtgttaccaattaattcatttattcatttaccaaaagtgtactgcaagcaaacaatatgaagaggacacgatctctactttcaaggagcacaatacagtcaggccaatagacaaagaacagacaaataaagaatactactctggaagtgcaggaaagggcctgggaacttttacagttaactacacagtgaaacaaattatcccttgtccacggaattaagtgcaatgttcttaggtgaaacctaaaagattgaaaactctgacctatagtcaccaaaaaaagtgaataagctaagtcttatttattcttgtcatattccaattttgtgtttctactccgtaaaacgttgttgtgttccgcaaattcaagtaaccatgtaattgtgctttaaaagaagaaaattttttaacccaggcatgtattaaacaattttctcccaaaaagtacatgcctggtgggaaagtaaggtaggtcagagtaggttttataaaattagtattggctttagacagtacacattggctcatccttttactgctcagcccacagtacatttcatgtataccttctagatgtcccaagtatttaaaatgcaacaggataaacaaccaggccaatattctgacatcaccttctaaacagtaccactagctaatgcagcagtaataaaatctaatggccactagtgacaggtacaatgtgagagagaaaacttggagtttgtgtcaaatctaggaacactaaattggcacatgctggcctatcctactccaggtttgctccttcaaaaagctaatgatgtgtgtcaacaaagattgaccacggcaacagattgctgccattattctgttacataatctgaaagaagagggaactggaatatttcttatatataggaatagaaagagattgacatagtataggctatccaatcttgataaagcaaaccaacatctatgcagcatgtactatgtgccaggcagtgagctaaatgctttatatatacatggcctaacaatatcctgctaggtaattaatgtcacaaataaaaagacaggccgagagaggttaagtaatctgaccatgttcacacaactaaataggtttacagcatctccacatccttataactaaagcccaaattgtagaatcatctagaatgcctttctttcaacgtcatatcgtcaagccttgtggatctatttgcgcaatgttttcacatccatccacttatttccaggcccaattcaagtccccatcaactggggatcaccaactggccttcctttttctaacttatttctgtccactctgctgcttaatctttccaaatcaaaactggggtcatgtcactcctttgctcaaaggccttccatagcttttcaccatctactgaattaggtaaatactcctgaatctggcattcaaagcctactgcactatatagtatacagacttggttcaaacaatgtttgttgaatgaatacatggcactaagctaagactcactatctgtggcaatagttccccaaagtagtatcatagcatattaagtaataaatatgtcctcaaaagataaatacaaggcctagaatctatttcaccctaaaaccaagaatattgaggaaaaattaagtctaacatatggtatgggggtacaggttatatagtgagggttgttgatcaaacagctagctattttatagaatgcatgttttaacacagattaagttttccaagacatgaacgtcccttccatgaattcctcactccaacatcagcacattgcttcctccatttggccttttggctccactacgtaaagtttcttagttagaacttcttgtattacaagtggcagaaatccaactaaactggcttaggcagaatagaatttgttcatataaccaaaaagtccaggattacaggcatggagctcaaatgatataaggaatctctctacatctctcgattctgttctcccctcatggtatcaaagataatcattacaacttcacaattagattcttccagctcagtaaccatagctactaagacagtgtcccaactattccagcaaaggactggggaactactctctagagtataacttagaaaatgtgcccgtccataaacagatcacagtgaccaggtgacgtgaattatcattcagtcctgggttgaggatcatctctagatccaatagatcagcttcatcctaaccatgcagagtgcaaagggtgagacgtggcttttcaaaagaaaagtgaggtgatgttaaagacaaaaaggaaacagatgttatgtggaggaaaaaaacacattgacattcactgtagaaaagttctgagacataaaagtgagaagggggtctggtcagcgtcttgctgtgctgttatagcctctccgggctacttctgatcaatgagtaggaccctctgtacatttcaccccccttgccattttgtgcctttatcagtaaagcttcccatggccctgccattcagcagaggcggcagctgcatgaccttcttaaattactgcttgggactgagcattgggattgctttaaagctctcccaaagtgatcctaatgtgtagccagggttgagtcatcggagtaggaaagcccttggtcttcaccatcagcatatacaaatattgcattaatcttctagaatgtatttggtatctaataatctgtgttcttttcaataaaaatatctgagattattcctttcattttcagaaactgatccacaaagtctggaaggagagggaggaaatctcacaaatcagacactaaatagcactcctttgtgctccttaattttggattttgttttcttttttgcatgggatcaattcaatactagatgaaaaaaatgcttttcatttttctgcatttttttttttaatttggaacgggaaacaaatcatagagccttgtttggcacaagggcaaatgttaaagatactatgtgccactcccctccactgaggttttgatttctttgaaatcagaggcaattcaaatgaagttatattcctggaatgtataaaatcccttctcgcatccatgtctactctatcatggaatgcttaaacaatttaaagcgactgagtttttccaccagcccctctctgtgaaataacataatgccttagaacattacatctagggaggccaaatgatgcggtagaatgcagagtttgaatccctgatccatcacttactgtgaatcacttactcagcttaagaaggtcacctaatttttgtcttccataaaatggaggaaataacctctctcaaagactcttgtaaagtttagagataatacatagaaagcttctgatgcatagtaagccgtcaagaaatgttagcaatcatcatttaggaaaatagtttccttttaaaattcagtcttgaaggttagttctagttgaagaaaggtagactcttcctagatgtaccagtgcactaagacaatatgtgtagaagattatttaaaggaaatatctaatggggttatacaaattagttatgtctggtcttcaaatgaacccttctcaaatttggatatctaaattacagcttaaaaaaattcagaataggtggggcatggtgtctcacacctgtaatcccagcacttcggaaggccaaggcgggcagatcacttgaggtcaggaattcaagactagcctggtcaacatggtgaaacctcgtctctactaaaatacaaaaattagtcaggtgtctcaaaaaaaaaaaaaaattaagaatgaagtctgttaaatggccaactttgtatggtgaaattttggtaaaaactcccactgttttagtgactgagcccttcctattttcatgtagttcatcaagaatgtgcttcatcagtaatactaaatctctaaatgtttaacttctcaagcatgactgattggctatagcctattgaaaagtgccaaatttctttctaaaaaccatctctaacaattcacggttgaaggcttttttgtgcagtaagtcactaagttaggaaagtggcttctaaatctacacatgagataacagtaataccaaactcacagtgcagttgtgaaaaacagataaggtggatgaaagggctttgcaggtgataaagcactgtgtaaatgttacgcttttgcagctgtggctgccacagctgctgactaaatgagtttatccccggtcatgaggagcatacatcctcattagagacatggtgtgttattaagcaccacctaaagacagagagttttcctagacttcagagaaggaagatgggtggaaagatcaaggaaacaccactgtgaggcaggtacggcaccaggccctcatggatgggcaacagtctaatagagaggaggcagaaggtcactgtgggcaggcagtccagcagagcagcacgcagtgtgcaccaaaaggagcctggaggcccagagcttctggagggtgagaggagaaggtgggtgcagagggcagagtggatcccataacgtccaaaattttttcaagacagaccaactctacatctactcctcttattcgctgagtacctccaaaactcactgaaaaactccatagatttagctgaagttcttagcacttctgcccattcttcaatagaccagaaagaagaaaggaagcagcaggaaatgggcggaagtgttaagttgcaaatcctggcagcatgcccagaatgggaccaactcagcagacaggaagcgaaggcaataaaagagcaatctacgctacaggcaggctggagcagaaactcgggaaaggagggaagacagattactggaacagccagtttgcagggccatgaaacccgaactcttttcgatccgccttcctggcgagtcttctggctctgaaactttgggaaggaaaactgatacccataaataactgtggctgtataactgcaaagtgggataaacgtttcatcttgattaaacgtaaggtgactcctgacaaagaactgtggttggctgactctgtggagaggcttgcaagatgctgtcatgactacatgtgggagtttgagaaaactgcaagatgcatgttgcaaaaagacatattaagctttctgctgttttccaggcactgtatcaggagctggttgggggagtgatgaacgagatagcatcctgttaacaagcagtagcagacttcccatgttacattctctcaaacagagaggaggtcaggccagatctgtttctcctcaaaaatataatctcaagaaaaatcaactggtcggatcatcactacctaaccacagatctccctccttattcttcacaacaagaatccgtcaaataagtaacgtcatggttaatgctcctccacattcaacctggaccctaaatccctctaaataacttgactctgttcatacacagaccacccactttaccagtctcaaaggatggaccagaacaactatttccttgagttaatgagtgaacctacatctaactgtaaataaaacactaaaaataggtaactattacttactaaatgaaacccaagtgtaactttccattaaactcaacctgaataaagtttttaaacagtgaaccttttaaaacagaaaccagtctgtaagcatcctaaagctagtcaaccaagacagaagttaaaacacaagtattttccaatcaaactcagcaccattccaactgaagcttccacttggggctgtgaaaccctctttggacgtaagctatgctgaacctgtggtttcaggcaggttatattgtaatgataggggaaaccaatgccacatccacttgcagtgtctgtagagaactacatcttgccacacatccaagatctcattcctcagtctccctgaaaaattctgttggtaagagagaagtgagacagtgctgtttccgaggaatcttatgcctctctttattctacaacaaatggagacagatggaaatagaagaagaggcagcaacaggacaggagaaaggaaagaaaggggaaaggaaggtaacagaagggcaacgggggaaggggaaaatagacaaatcatagcagaatgcccagacacgacacaggtcaggtgacagaaaggacaaaaaagatgggagaagaaaaccaagaatgaggccagaagaagggagaggagacaccatggtgatgggagcagtagagagtgtaacagaagtaggatggagaaataaagcaagcaaacaaattgctcccgggaaaaaaagcaaaaagcagacttacgagcaaccaaagaccataatttccaacaccctcagagagcaataattagaagcgcaacagttgggaatttgaacatggctgctgactaggcccgaccatcaacggggtctgattccgggcctgatccttgacgatctcaaggattcaccagcctctctccgaactccaactgcccgccatttgttcatcaacaaaatcattctttctacctcctaaaagaatttttattcctatgacattgcaaggtccatttataaaaagcctcatgcaagttctcagagtcattacactgagaatgaaacagcgtgatatgttaagtaaacacataccgagtccggagtttcttgcttccgatgcgttcgtggtctaacttcacaaacatacccgcggacctttgcggcaagtgttacagctcttaaagacggtgcgtccggatgctccggtgagtttgtagtctcactgacttcacgaataaacccgcggaccctcacggtaagtgtgacagctcttaaaggtgatgtggtgaattttaaagcccttaaaagtggtatggacccaaacggtgagcagcagcaagatttactgtcacgagcaaaataacaaagcctccgcaatgcggaagacaaccggagcagactgcagaggcctgcgtgcgtggccagcttttattcccttatttggccccacccatgccctgcttattggtccattttacagagtgctgattggtccattttacagagtgctgattggtccattttacagagtgctgattggtccatttttacagaatgctgattggtgcatttacaatcctctagctagacacagagcactgattggtgcatttacaatcctctagctaggcagaaaagttctccaagtccccacaaaacccagaagcccagctggcttcacctctcaatattttaaagctcaatgtaactcggagaaaacagcaattaagtaataccacaatgcagttagctaccagaatttggggacaggaattgaaaccactcagtgaaatctagaaatttcagattataaatatgtgctttaaatataaataatatagtatgccatacttcttttccaaatgaggtaaatcactaaacttaactgagctgaaataaatctgaggctggtgtagcaatgtgtataaataaccgtggtaagattaccaaaacactgttgaaatctgggtatctttgagagctttctcagtacctgcacatgggtaagttgaaatacttctatttctaacatacctttcaactgacaggttaaactggtatatgctgatgcccacttcctggcatgcatgccatcccagacacctccataagcatgaccttatgagtctcacaaccatccactgtcgtgggtgtcaccccaatcctacagatgaggagactgaatctgagggtggctcaggtcacacagctgatcactggcagagccaagatatggacccagggctttactccaagtctgagacattttgtaagataaccagactgcctccatggctcacacctctgaccagaaaagagttgactagcaatttttttttttttttttttttttgagacagagtctcgttctgtcgcccaggctggagtgcagtggcacaatctcggctcactgcaacctccacctcccaggttcaagccattcccctacctcagcctcccaagtagctgggactacaggcacacgccaacatgcccagccaattttttttgtactttagtagagacggggtttcaccatgttggccaggatggtctcatccatcgtgatccacctgccttggtgatccacctcgtgatccacctgacctcgtgatccacctgccttggccttccaaagtactgggattataggcatgagccacagcacccagcctattttttcattcttgatccaagttcctgcaaattcagaaaaccttcctcttatgccagttaagattgccctgctagcattttctttctattttcattatttattataactatttatgtcattgaggagaaattcgttgtgttcagaagactgtacagaactcaaaatattgccctacatgtatatacataaatatacacacttcaaaactaaatatatagacaatttttcaaatgcttaaggttaagaatcagttttatgaaacaatgtagaaatatcaacagagattgagacaagttgtgggctgcactgtagtttattatagcaaagatcagcaacctaagaatgagataaggaggtttaaaaaattaaggtgatttcatccactggagtatgtgcaaacattaaaattaattttaagcaattttgatgacaagaaaatgctgtgatataaggcaattttgttaataggtatatgcattttcaaaagcccaaatcattaagtgataatttcagagttttagggtttggagcagtttttatgtattagttttaaaaataatttgagtctccagtatgtatgtaataccacactgaatattattagagtctgtattcgtttcagagtcaaaacacttacatttgcttgtctattaagatgttttgatttaattttatttattttatttttgggctgttataatttttaaaacttgtactgagaaaaactagatgggagatttggttctatttcttactagctgtgtttctttagccaaggttacttcaattctaggcttcagtttctacatctgtagagcaaacaatacttgtgatggttgtcatagagttggtaggagaatcagatagaataatgtctatgaaagagcactgtaaactgtaaaaagctgtattaggccgggtgcggtggctcatgcctgtaatcccagcactttggggggccgaggcaggtggatcacctgaggtcaggaatttgagaccagcctggccaaatacaaaaaattacaaaaaatacaaatacaaaaaattagctaggtgtggtggtggacacctgtaatcccagctactcgggaggctgaggcggaagaatcacttgaacccaggaggcagaggctgcagtgagctgagatcgctccactgcactccagcctgggtgacagagtgagactccatctcaaaaaaaaaaaaaaaaaaaaagctgtattaaaatcaggatgtgcagatgtgcatggttattatttttattgacttttatggctctctttctgaacaagtaaatgtcagctgaagatggaaacaagtgttgaaaacgatctctaatcataactagtcattgatatactttctcactgtgtgtcagtgtggcccagaccactgcatattcttcatgatctctcacaaactgtgaacgtaataatatgcaacaccaagtgcttgctgcaggaaatatccttcaaaaatacaactaccccactgtgagtttcatgcagagagataatatcactgtaggccacctcctcaaagcaaccagcccgagcagccatgaggataggccatcaggaaactgatggggaggggaggtctgagccctggaaaagtgcagtacaaaggtgtagtcaacacttactaggtaagtggcctctgagggcaatgcagcctcaagtgagtgaaacatctctaccatgctattaaatgctgtttaagtagatgtgataaaagcattttaagatccccaaagaaagatactagtctgaatagcacggatcattatttttccacacctgctttgaccctctctacaagaaggagagaacaagaacaagataaaggcagtcaagtcccaggaagtgccccgaaatgacctttgccttcctttccacctggggcaatcattcagaccagttaggcaaaggatctaaaataacatcttccacagctggcttggaagaaagtcaagaattttcttttccctcctttctttattcccattactcactctctaagtcctcagcttgtctccccttccccctcttccttctttcctggctgtaatatgcttgtctcaattctaataataccaaatataagcagctgaatattttcaataaatcagcacttctccaaaactactcaacagcttcagcttctctataaccacacttctcattcccgctctcttgtactactgtagtctatcactttcaagatgaaagaatcagctagtctttctcagaactcagcacgtaggcttcaggcataaagaagctgcctgtgtgcaactggctcctgtaaggaatactatatttctttccaatgtagcccacatcatgtcatttggaaaaggagcctcagaccagagctgatttagagctctgtaagtcacagaaaagtgccaggtcgtttgcagtattaatattatatgcatgtattatacccaggatactcaccacacctaagagcggagggaagaattgcaacaggaacatccaaacctgcagctttccagcctattattcttcttggtgagacataaacctaaaagaacttcgggggccttggtgatttgtttcctaggaacacctttaatttccttttgtaatttcagacagcacagccacttgaactcttccatcactgtctctagctcctcccatgcacatgcctgcctggacctgtacctctttgaccacatcttcaagatgtctccacaataatccaacctggagaagtccagaggggttgttagtctgtgagcacacacccccctctactggacaaaacatgaagaaacatacatgcctgggaaaggaccacagaattctggaacagaaaggaatgcctaattaactgccctcgctttgtaaaacccaggcctacagaagtgccccaagtcacagacttataacagggatagggggccaagcactgcatctctttgcctcccacatcaggcaccatcactacatagaactgtgtgtccctcaacagttaactcacaaggaagaggggattatgcaactgagttcatggggatctttaggttatgagttagaaccctcccaaggcacagccatcaacaaagaaggagagtgtgtggttgaaagaacagtgcgctgggagtcagggacttggtctctagtcccagttccagcacctacagcctctgcgactctgagcaagacacagtccctgagcttctcagagatcagtcttctggtctctaaggaacctctcacaatatgaacacagatctatggttctctgtaaatggctgggccaaagagtacgaacagggccatagaaactgtagaagaaagagcattaactggagtgctagagacctgtttcctaattctggctctggtgcccattagctacttgacctaaggaaagtcactctctggaactctggcttagaaatagagatgaggctagatgaccttctcaaccccacagtttctgtaattgtggctaatgataactgtaagtatgaatgctttcttcaaaggatcctaaagccacaggggcatgttgatacatctttgggacaatggaaggaacattaacgtttctacccgttttataataaatgtaactaagggcaaatatatcaaactatttgctcagagttcagaaaagcacaattaggtgtgccgacttccaacctgtgctatagatgaaacattagtccaggatactaagatcaaaccacaaagcttttataagccatgccagccatctataaaatgataagtagacctaataaattacaaaattagataattaattctacatctcattttattttttatttatttattttgaggaaaggtctcactctcccaggctggagtgcagtggcacagtcatcgctcactgcagccttgaactccctcaggtgatctcccacctcagtctcccaagtagctgggactacaggcacacaacacatgcccagctaattttttgtattttctgtagagatagggttttgccatgctggtcgggctggtctcaaactcctgggctcaagtgatcttcctgtctcggcctcttaaagagctgggattacaagtgtgagccactacacccagccaatttacaattttaagtgggattatagaaaataacataacaattaaataaagagacaaaactgtggcaaggatgccactggatggcccagggatgtctcaggaggcagttgtgggggaggatgctgaggtaacagttccacctcacctcaccccaaattacccagtgaacaaccatctaaataaaaagtgtgtgtttggcatgtaaatgcagtttcaaaacaagttctctagctgcctcatcacctcaccttgcacctggctgctgcactatgggagttctagatccgctagacattaggggaaacagtagtcgattggggtagcctcacaaccaacgtttgggctgtgggccacaaagtcaagtggagagcaccgaaaggagaagaaagaaaagaactatgatcctacaagttgcttaagctctctgacattcagctatctcactttttctgaaaaatttaaaaatggaaggccaggtgcggtggctcacgcctataatcccagcactttgggaggccaaggtgggcagattacctgaggtcagatgttcaagaccagcctggcgaacatggcaaaaccccatctctactaaaagtacaaaatttagccaggcgtggtggcttatgcctgtaatcccagctactcaagaggctgaagcaggagaatcgcttgaacctggaaggtggaggttgcagtgagccaagatcgtgccactgcactccagcctgggtgacagagtgagactccgtctcaaaaataaataaataagtaggaaaacattttgagttacaatgtttcacagctaaaataaaggtagcctatacatgggaaatattttgctttttgagtttctcccttcatattatcttccaaagccccgctttttttggtctcccaaggaatgttttttaagtgtcaaaattcacacaaaatgtttgacttgcactttagatgttaaatatacaactatttgaggatcttgcgctagaaggttctctacataaattattttttcaaaaggccagtgtaaccttttgagagtctttatcatctcaccctttttctgaagtcctgttttgtaaaaatgtgcccttagaaataaagagaatattgattttgcaatgttggtacaaactggacaacagcaggaagatctcaaaataagataagccactgcacagcacagcacagaataacccagttagggaggagaatgtctgctctgtcagtctgtcttccctggcactgcttctcgctggcatcaagtaggaaagatccctttcagcttgacacaagtatgcactgtccttctgaaatatgagaaaagcagttccctcaggaacaaggaggcctcgtgccagaggttagtgaagctggagaaaccgagagcttggctggcaaggactgtgtaagatgggactctctctgttggaatgctagtggaatcagttaggttacttccccaaggttatgcaatgttcttaaaatatactacttaacactggatagaattcttatcgtgcattgcgtaccaatactaactgttctattctatgaaccaaaaaaaccatggaatgtcttttcccatcacccacatgccctgctgtacatagagtatacaattggctgattatgttttggtcttcacccttctagaatgagtgtgagctccatgaggacaggaattagctttgcttttttctgttttgcctactgctctgtctactatacttagaacaatgatgaatatatgatagggattcaataaatatttgttgaataaaaaatgttttgaatgcttttgtagatataaatataaataatcagaatgatggagctgtgttcactacttaagttcagagcagatggcttcatggccactgaaattatccccatgacatcacaatgtggtacaaagggaggacacaggatttaacatcaatgttgtccctctgctgtttacttagcaaggtaccctctctgagtcttagctccatcctcactcaaagagagatgtcattatctgcttcagggacaggactgttaaaaattgcacaaaagtatatgtcttggagaggtttaaatttcatgggagaatatgaaaaacacacatttttatgcatatatacagtctacccacgtagacaagaaagacgtataaccataaacacagagacagacgtgtttgggaagagcttcaaataggactatggaatagttcttaaactcccacttcctaattttataacagatttcagggtgaaaatgtctaagcaagtggttttttttgatgaaccatgttttagttatttcctcctaaaaacagaagcaaggatcgtggtaatggctctacagggtttggctctgaaatgtgtcatcagtcaagataaatttgtgctggtcaatataaccctaaaaacaatgttttctctttaatttctatcacctgttttaaaggtatttttatctgctatattgaatgcaagtcccttaaatgatttctggaatgaggtagaacataaccaaataaataattttttaaagtagacagaaacatgccaggcatggtggctcacgcctgtaatcccagcactttgggaggccaacgcaggcagatcacctgagatcaggagttcgaaaccagcctggccaacatggtgaaaccctgtctctactaaaaatacaaaagttagccaggcgtggtggcgggagcctgtagtcccagctacctgggaggctgaagcagaagaatcgcttgaacccgggaggcagaggttgcagtgagccaaaatcacaacactgcactccagcctgggcgacagagcaagaccccgtctcaaaaaaaaaaaaaaaaaaaaaaaaaaagacagaaaaacataccctccccaaacagggatttttaagagaatctgataacaatgtatgtaaaagttctgggtaagcaatgaagtgtgtacccacagatgtcactgaaattggtggttcttattcacagctggctttcagcccatgccacccttgcctttccccattccctgttgccatgggaccttcactgttgcctgcactcagtagcaaagcacctcttctacatttgcctcttctacttaagaggccagggtaggagttttagaagcattccagagttccctctgcctaccttgaatgagaagggtagctatatatatttctaagaggaaaaaggaaatctgtatgattccaaactaatcccaaagagtaagacatgactgatcagtagagccccagattaatgagctcagaggataatgtttaatgatatcaccaaagaagtgtccacatttcttcccaggagaggattctgatttttattcagattccatacaagaaattacttttcctaccaccaccggacaatgtatttcctttcaacatactatgtaaaatgcttgcacatttctttacactggggtatggcttctctacatgattacagacatcagagctaagaggggagcatcaggtactgcggtttcttaaagaacccaccaccatacagcttgcccaacaaattgcccttctgctgtgttccaggttttcaactcatcccctgttacaaggcacagtcatgaagagatgagggactgcagctgcagtcggccagacctggtgtgactctgggttctgcctcttattagctgggtgacatgggccacgtacttcacttctctgactttccattgcttcctctgtaagatggagataataataactattgtgtagattatggtttggcttcaatacaatatttgtcaactgtccaagtcagtatctggtacacaagaataaaggactgctgttgctgttactgctatttgttaaccagtatccataagcacaactgcctgctatgacacaggacaacgaaagtgatgaaggcacatgagcagataaaataaacattggaaaaggcctccaggaaatgctctgtcagcaggaacactatcattgactgcctgtacttgagggaatcagatttctatcgagtaacctaaagatgagtaggtgaaatgtatcaccgactcttggctcctgggctctgcagctgttgctccttatcctcactagcttcattcagtttcatttttcttcccttttgctaatgcaatgtggcctatgcaggtgtccctatattcccatcatctcctcctctgacatctctccccaaggacagtctggcacgtccctcaacgttcccagcgagatactgccaccttcctcttgtctaacctctcaatgtgggcatacagaggcttgaattatcctagcaaactttgtattttcatgggttactagataacctgactcctcctggaagtgaggatactattgctgtcttcattaaaccaggtacacagctttgaaacaaagctctgattattctaaaacacagggttcttctaagtatgagagctatgatttagggctccaatctggctcagatatcggttcacatcatcatgctatgtccctcccagcatgaagagatggtggccatagtagtgggagaggaaaacaaagggttcagggcagaggctaggagcagcatccttccaaagtctgctctggcccttcactatctctgacctaacctcaaaatctccttgtatttcaagaccctggagaagttcttcatgaagtaatgatgagtaggttcgtctaatctcttctggtgaatggaggactaggagaggatgagaggcacactggccataccaagcccacaattttccagtctggggatattactaatgatattttaataattatgtaagattatgacacgtaacagactatcataacttaattaatgaaaaagtagacgtttaatgtattttcgagaacttcacctcttaatccatattgactatgagtctaataattacattgcactgaaatggagttgtgtatccccttgaattcaggtgctaatgaaaatctattataaagtttatgaagccaccaggcaattgcttattgaggaagtttcaagggttccaaaataaatacctaaatagctgttgttggccgggcacggtggcgcacgcctgtaatctcagcactttgggaggccgaggcgggcggatcacaaggtcaggagatccagactatccaggctaacacagtgaaaccccgtctctactaaaaatacaaaaaattagccggtgtagacacacctataatcccaactactcaggaggctgaggcaggagaatcacttgaatccgggaggtggaggttgcagtgagctgagatcacgccactgcactccagccagggcgacagagcgagacttctgtctctaaataaataaacaaataaatacctaagtagctgttgttattgaaactcaatgtcactaaagatccaaataagcttcgtgttccctttaaattggtagtaggaacagaatgtggaagaaaggagagcatcaaaattcaagtcagaagatccggcatattccaccaatagacagttacagtacttcagatggaacctcattttaatcatctataacatgaagacacagagccaagggatccttttcatctttactatttaattatcattttaagaggcgacaaataccaactaaatcatatactcctatgtggagtgtgtagaactgccactgacttttttaaaaaagatatgaaaaatttcaaatgtctttagggtgtatgtttccaaaaatttaaatttcctgagggagagatattttattttttaaaatatattaacatattttctctctctaggcaaagtatatttatttcacttttttaggattaaaaataaatcctgatgatgccactaagcagcaatatccctgaaagaaaagcaattaacaacaaagacaaataaaatttattttgtccctatgcaactttccacctatggttaaacacacacacacacacacacacacacacacacacacacacacagcttatccgtttatcccctttaattaaattgagagcgggaaacacattcaaccatatgctgcactgcaggtgatgaacaattaagaactcttcaaaaataaagttacccttgaactaattttagtggtacatcaaaaaagaaaacaaagcaaccattacagagcatctgaagttcagatcctgttttgaaggggtctgctctaatggaagagccactggggcaaggaacgacagattcccccatccgatgttgattcacgactcaggtatcagacactacgatcaaggccacgtgcacacagagaaacatatgattcctgccacccaggagctggtgatctagtgtcagactcacatgtaaacaaataattacaacaatgtaaagtgctttaagatggaagaagcacaaagcaatatctggaatataaaaaacgaaatgcttaactctaaccagagaagttggagagctttatggaaaaaatgacatgtgtgctaggtcttgacagatgagaagtttatcgtggaaacagcatgtgcaaaggcacagaagtaaaggaaggaagcaaaaggaaggggaagaaaagaaaggtagaatataaatttgaaaaaatattttccaatctaatatgtataaactaggatcttattttaattgtcatattcctaattacttgtgaggctaagtatattcttatatactgaattcatcattcaaactttcttataagtgaattgactatctcctttgctcatttttttcctcctgggtagtttgcctttcttttattaattgatatgatttctttacaaatgttggatgctaattatcagtcataatagctacaaatatctcctcccagcttttcttcttactttgttaaatgatatcatctgtcatagtcaaatgcttttcctttaattttaattttatattatttaaatatagacaaattcaccagtaatcttcattatgttttgtgcctttaagaaaccctttcctaatccttccatattttcttctaaaagctgttaagttttccttttcacatttcagttcaaaatccacctgaaatagatttttgtgcatggcataaggtacatccaactgttttttttccccatagggataactaattgtcctagcatcattcatcaaataatttatcctctcccattacaaataatgggagctgttatgggtaacataacgtcacccatcacgggtaggatcccctggaaaatagaccctgaaaagagattccatgcagaaggtttagtggagagtgctctttggagcaatacctatgggaaagtgagggaagcaggattggagaagatgcaattttgacagaggcctcaggtgataatgtagggagcatggagactgggatggcccttcagaactgccctacaaaaggcaatggtgctgagcttccgtactctcacacacagataagtcattggtcaggcctgcgcttgagaagaaggtgtaatcttgggagtacctccccccttgcagctgagtacctccccaggaactgccctctgcaaatgacacttcagatggaacctcaaaatggcagaggtagctcccatttggagagggcagttcctggggaggcactcagctgtaagcctttggctggcaatgctcccagcagcggagagaacagggtgttagtcttgcaagggggatctgggtggcgcacacagcatacactataccaacttgctcatgtatcactttgacattgtgatacatgggctacgctgtttagtataactcttttccccatgaaataattttcagatatgtttccattctggtcaccaacacgtaatctaatctgtcaataatgcccttcaaatatgtacctataactataccaacaactccagattcatcagactctataaagtacagaagcacattttctcccttgatatgaatatctatttctaatgtagcctgactttttgttctcaacagctatacattacccaactggctcaaaatcaatatgctgtcagctaaaacagaaactgaggtccctgatgtcctttacctgtaagtggatagtttaatctcaatgcaggatttttccattatcctcttgagtttaatcttgttccatttaacttaggaaaatttaacaagctgtgattctgtcacctaacacctctcgctgtttcaatttttctctaaatttgatacaggatgccaaaaagcttttaaaaagaaaatcccatgagggcagagagcagcgatgaggcttgtggcatgccaatgataccctgacttctacttccactctcagaaacccatcccataacccatctgtaaagatcttgctctgctaggtaatattaatagcaggaattttttcagcatattaatataatgacttacagtgagttttgtacatagcttttggaaaccaatcacatgacctcaacttacatttgcattatacacaagttttctagcaacagtgcttacacagaagggaaacttccatggtgggcattaggcacccagctggtgagccttgcagaactccctgaatcacagcctacaagagttacaggtccctgcctggccttctagttcaccaatgtgttgggctataaaatgtaccttggttcagacgtgctgtcctttgatcatggataatgcaacatggttaatctgtgaccagtgaagtacatgaaacattaaaccgcctctggtttctgtttcaagtttgatcacttgactgcccctcagtaactggattttacaatgaagttaaatctcatttaaaaatgtaaagctgtctgttctggtaaagccaatcatatgttgtaaagttattccatttaaaagatcagtttctttgttccccaaaggtttgactttgagtacccaagttccatttaattctactcacatctctgagtacatttagattcccaaacccatgcagagatgaatagtttcaaggttagttaaaaataaaaaaagcattttctagcaaaatagggtaacagcatctaacattgataataatcacatgatatgacatgaaaccagtttcattgtttaacataggaaaaatgtgaaaaatgtgtccctgttaccagttttcagactaagttatctcatcattaatccatccatttattcattcattcaatagaacacttactgagtatatgtcattggtcagtttcagtaactgacccaggtatacaatgatgaatgtgataccattgctatctttgaggagagatttttttaaaaaccaaaaataaagagacatctgtttccattttgaagtgttctatcactagcagaaacaggttccaaatgaagatgggacaccaagaacaaagcaaggcaaacccattttactctgctgggtggcatgtcagctgcaggaattcccaatcatcctgtctgattactcctaaggacaatttgtcgcttgcagccactgccttatcactgtaagttggaaggttgtttttaattaaagtcaacaatcataattttcttaaaagaatcagtacctattaatttactgtttatgaaactgcaaagcatgcatccaaagtaaaagataaggtcctacattcaaaagcttgataagagctaaagattaagttctttatcacagaagaatcgctgagttaatattataaaaatacagatgagaggcagataatatgtcttgaggtccaaaacctatcgccttgatagaaatatgatatggaaatcagtagggacaaaattactattagatgcagaaattgagaacactttgaagagagaaaatgtgacttcacgtgattcagaaatgattgggaggaagaaaggggacctttgtttttcttttcttttgctctttcatcctttaagatttcacactgaaatgacattagtagtcagacataccattccaattcctttctgacttgatttaatttagaaaattttaaaaccctgatttaattcaaaggctaccgagtgagccagtttgaagctagacactgtggggagtacctcagaggtatcctatacgatctctgccctcaagtttttttattaatgcaaattaggtagaaatccaatattaggccgggcatggtggctcactcctgtaatcccagcactttgggaggccgaggtgggcggatcatgaggtcaggagatcaagaccatcctggctaacacggtgaaacccccatctccagtaaaaatacaaaaaattagccgggcgtggtggcaggtgcctgtagtcccaggctactcgggaggctgaggcaggagaatggcatgaacccgggaggcggaacttgcagtgagccgagattgcgccactgcactccagcctgggcgacagagctagactccgtctgaaaaaaaaaaaaaaaaaaagagaaatccaatattaacctacacaaaacaataaaatatcgataaagatgctatataagtaagtgccttaaaaaacaagcagcaaatgtagcagctttaatcaagaacaaatcagcaaatccacatcgaataaacaactcattgtgagctattctttgtagcatcatttcatcattggaaaataccaaaaggagtgggattttaaaatcctttctgcccctatgaaccagcaatgatgtgtaattataataaagctaattttaaaaagtgctttatgaactattttcattgatattatttcatttgattctcaaaaaaccgctatgaaatttgacataattccttccagcaactgcaatcaggggagtaataacaagctaaaaaatcggtatttcactgactctaccgattttggtgcttccctctcccccacaccaatttcccctgaatcattctagaaatcatgtgtgctcgtggatgtaatccttcctcctcatcactgctttcatctcttgcttcggctgcacaaggtgcctcttgatgcttccaaaatgggcaccagggctgctgtagtcaaaggtgccagatgtgttgcccaaggcacaactgcctacctctcccgcttctccttgggataagacaaaatctcattcattctaccatcaataaaaccacactggataaaatctagttcattatgccctttcacaccgtgcttccatagcacctccaatagggacactgcttccccaagtctgtacatcctgttatgcagaatttgctttcaatgtcctaaagaaattttagtaacattactctttaaattttcacactgctttttttatggcagtcctctctccctatctccaggcatgaatccatggggctggcgcaacagaaaatctggagaacatacgtcatgctattttcagtgttgtccctccccgtggtagccgctaccctcggatgtggctcaaattcttgctttccttaagatgagctttgtcctgtgatgatcatcccagccctcaagcagaagactctggacgggcatgactgtcaaattatccagacatgcccagacaagtctgaatcctagggagaacatagctgaggcccaagctgcacaccttatttactctccacaattcctctgggctcacctggaaaccaacagctttactcagtcacaggagcacttctgagttctccctctaaacacaaaactgaaactaaagacttgaacgttttagaaaaaatacgtgaaatctgaatgaactgatttgtgactttattgtgaataaaaccgtattaccatgaattttttttttttttttgaaatggagtctctctttgtcacccaggctggagttcagtggtgcaatctcggctcactgtaacatacttctcccgggatcaagagattctcgggcttcagcctcccgagtaactgggactataccatgaattactaatacaaaaatctgaatctcagcgtttgaagtcctcactcacttgcttagcgtgaaacccagtcctcaagagaggaagtccctacctctcttgaacagctcttcaatactgcaaaactgttgggcttctgatgataaagttctttcatttctttttgccaaagctccttcttcctcaagtgtaggggccctcccaggaggatgaggaaatgtttgtccaagacattctggcccagaagtgttctctcttggtacttttccttcagtagtttgttgttcctccctattatccaacatcgttccaggacccctcaaatccgtctgtatcccatacatctctgaattccaattctgacctgatttcaagttctttcctataaggctctgagccttgtttcaatgtactggaacaatccatgactgtgaaaaaaaaattcctagaaccttctatgagagggaagaaactccagaacatgccatgataggaggctgagctgccggggcacacagaggaactccaaggggatggtatgacctaatatcacagcccaggggccacaaagatacattagatatggtctgattccaatttcaaaattatctaacagaagtcactatccctgtaagtgatcagaaagcaaatacagtgagatcggcaccacagtcatttatctgctcacagctatcaagaggaagggggtggggccgcagtggtatctgctgttttcaaaaagtgctttctcaggattccctaagaaataaaacaaaacaggccgtggctcacccctgtaatcccagaactttggaaggtcgaggcgggcagatcacgaggtcaggagttcaagacgagcctggccaacgtggtgaaatcccatccctactaaaaatacaaaaactagccagatgcacacctgtaatcccagctagctgggaggctgaggaaggagaattccttgaacctgggaggcggaggttgcagtgagccaagatcacgccactgtactctagcctgggaaacaagagcgagactccgtctcaaaaaaaaaaaaaaaaagaaataaaacaaaacatacgctttcaatattcagtactctgctttatcagtttgatataatacttgtaatccaattacaacccgaaaaggttgtctttttctcatgtcccaaccaataatgacatgaggcagagtgttgagttaacaaatatatccaatgaattattctctaaaatttaatatctatttattttaaaaatagttttctcttttacatttatcagtggctgttacttttaatcatggtgttattctgctatttctacacatctttggaattatttcggaaggctgtgcatatagccaaaggccacagactgccacccttgctttatatcttgtactctgaatccaaaaatagagacaagtgaaaagcaatccagtggaaggtgttatcctcaaagcataattcaatcttaatctggggaaaaatgcacaggcatagagctggcttgagattttaaaacatcagattctggccatggtcctggcctttaaatcacattcccctttaaaaagcaaaacaaatgagaaaaatactcatttattttatacagaaactgaccttaaaatacaaattgttcattagtagaacatttatttcgtatttcacatgccaatgagctattcttatttgagatcattggaaaaggcactctttaaaattctctttatgctttacacaaaaagcaagcaggcacaatgggatctcaaacactgttaaattttaagagctttgtgtgttgttttttgaaaaaaaaaatattgtttctgaatccatggactaaaaatcatattaccaggacttctaattcactttctctttgtatgaacttttaacaataaaaagatggtcaacctaatcaaatttagaggagaaaggtcacatgagaaagaaataaaacactgtaataatcatttaagtattaagattaccactgttctataacaaaacatatacccatataccacataaacacacattcttctttcccctgttgctcatttaaaattccatcccatctttcacatccattcactaataaatcggagggaaaaaactgtagccactacttccacttccttatcacctaccttcagcctcttataatctactcatagacgtcattctaccgaagtaactccctcaaagagggttagaagcaacagtattttcctgttctttatggcataattcatccccctcatccagactcccattggctcctccagatccactccccatttttctcaacctgctcttggccctggaaggctgaccccgtagaccacagcccctggcttggctcctttacactctgctttctggttggttcagttagaggaggtttacaggaagtggtccagaggagggtgaggccaggatatttatccccacagcttcctctccgctgggtgtctctaccagaaaccactgttcctgacagagggtcccctccattaatctcccctgtctgggctccagtgaccacgcacgccttcccttgcgccttcagccttgcaggtatctgtttcctctcaggactgtgagtaatccaggggcctctctgaattgctttcttccgttggtttctggattatgctctatcctcatcctatccctacctcctggactagtgctttttgagcatggcttttacaggtctctaacaacctacatttccccttgtaacaatgatatattctcaatgctaaaattcttgcctcaaaggacatggggaaaacatagaaaagtgtactttagctataattgtactccccacccccgaccccacacacaagcactctaggtggtgaatttgtttttttcttaaaaaataaaagtagttaaatcactcttgaagaatcataaaagtaacatattcactacaaccagagaaacaatataaaaatatgtaaagagaaataaaattaatgcctttctccaatttttccgcatctttctctttcacttcattccccacctccactgccttgaccctcaataaggaatgttaacagcctggccagtgttcttccacactcatctccatgatattcgaacctgtaccaaacatatatatttatatattgggaggggtgatagttgttttacaaaacctgagagcattttatgtattattttataactcaaatagatacaaatctagatcagtactctgaacagcctcataatattacagagcataaatgcacaatcatttatttaaccatttctctaatgatgaacattcaaattttttctagctattttttgccactacagacaatgctgcaataaacatccttatgcctaatttcttattggtacatatatttatgtaagctaaattcctaaaagtgggattgccaggtcatagttacacagagttttaattgggatcctattactttctcaaaagtgcatagcaacatactttatgtcaacttaattcctgtatttgttttatatgggtagaatatggctgatgcaatttttgagtcctattttccctccattaattttagataattttctttgtactacatactttctgtagtaaccttaaatggctgcatatgtctattaatgtcgtgacgcttctttacaattttattggaattgcatcaaaccttaatattaatatgggaagagtttatatttacttcccataatgtatatccacagagacaatcaaagctttgacagtagtattaggggtttacacatgtaaataaaatttatttcatgtatgcctcttaactcttaataagttgacattaattacatattttcatgggcacaagaattgatcaagagattctcagttctcaatatcaggaagaactatgcctggagcatatgcttccatcaccacatcagtgacttcagtcaaaggaaaacaaccacaggattactcaagagcatactaaagattgggcatttcccaagtatggtgagccaagctccctgtgattcttctggcactaaaagggtttactttgaatcaaaggtaaatgaaagcaagcaaaacagaaaggaatcctagcaccaagctccaaggacactgctttgcaggctagcacaactagagttcctcaaggtttgggggaagaccatactccacaaaggcttgggaacattccacatcagtctccacccgccaaataaaatactataaaaccaatctccaggttggtggtgggaggaggcaggagaagaaaaacctgactaccagttcttgttagtatattctctattttatcaccactatgtggtgataatggagattcccatgcatcatccttgaaatgagaagttaagaaattacaaacccaacagaaggtgcatcgctggcctctgtgacatccttatgctacatcctgcatgaatggtaatgtcagctttaactgcttagtcttgtaacaaggataagcgggtttcactggttcctgggaattactacttgcctctaacattgaagagtcttccaactggaaacagatctgattacttttgccagacttaatctctttcttaagcagttaatgagagctttcaataatcttaatgacatcacttcaataaaaatacctagatgttatttccacaggaaataaatgtccacagaccataaacttaatctggttaatagctaacctgggagaaaggtgggagttgggttcagataaagggacactgtagtgtgatggtaaatgaattattcacccctctttctggactgctggcaactctctgagccctcttctgggtttaggtgggaagagaaatgaagtgaaagacaaaggtagctggaagcaggaaacttctccctgtatgggcttcccagctgcagggagtcactgaagggttcagaatataaagaggactcacagcgacaggaaagggaaaatcaagagagaaaagggaactagacagaggatacaaatcaaaggtactatctggggaactccctccctcatgcctttcaaagtagggccaataggaggtaatggctggaggccctataggaagtctccacagtagagaagttacccatatcaaaaaaagctcttacccacttctactctccttcccttttccagcttcttcttttataaggttagaagcacaggagatgcttacagttcttatgactggttcctgaaagtgctgctgaagatcccaatggaaggctgaggccaaagtaaagggaatgttgagtgattgcacggagaggccaaaggaacatgtgatcatccattcaccttgtcactcagtgggctcacggtcagtctccaacagaaactgaatgtgctctgtgtgcctgccttgatccagatacactggagcttttatgatatttttcaaatagaaaaagggcaaaataataagataatcctacattgaggaaaaagaggatttactaaagagcaatgtatttaatgcacagtttctgcagtttttggagttaaggcagctaagatattctacactcttgcctccagaaatctctctcttaataatctcagagagtttccttgtcaagtgtttctaagtcctcagcatccgacaggagaaagaattttcatcactagggttctgcaatacatgatataaaatctacgattctgtgactttcctggtgaagcatattggttatgaaagtagaaaatcttatcaaaacaagatttattgcaaaaaacaagatgaaaagcatttaccacatttttaaagctctaccccctggatcaatgatctagagagatttataaaatttcacaagttcaaaatgaccaaaaagctttgaagctcctcttccctagatagatattttttatctcaaaaattgcacttgatgtttgctctaacctgtaagagactgtctatcatattaggagctattccctagaaaaagcattgcccacatgctgttagaggagctctgaaaaagaacacataacctgcacaatggcatataaaaccctgagattctggccacaacagcctagaaaatgtaatgaataccagagcagtgcttcttttacacagtcttttttggtcctattgaatccacaaaattattttcatgtaacattttaaatcacattaagtatgtaagtcaaatgagctctttagcaccttttacataagaaatgatgctataccagtaacagtaacaacccataagtaaaagatacctacggaataaagtcaatttgtgcttatttgggaaatttaaaaactgtaaaaaaagaaaactttgaaccaagtttcttcaaattagactgaattccttcctgttctgttaaaacacaaaagtttttgtcataaaataatagcacttatcgagatgattactaaaaacaaacaaacaaaaacctctaactacagacataagtgaagacacagcgtacttttgcacttctgcttagagaatccctagaatgactccagcagcatgaatggcagaatttaggtcaagaggccaattacccagtgttaccatcaaaggcagggacaagttaccacttctctctgcctgttcctgttttcctttgagagtcactgttacgcaaccacagaagtaactttagaggatgccaaaaaaaaaaaaaaagaaagaaataaaagacattcacaaagtcctggaagcaactatacctctgaaccactaggtcaaaaccatcctaatcatctccacaccccgctgttccactccccgttttcttgctacaaagtgaagtaataggcctaggaattttggtccattgttaatcagtcagtttctaagtagcacaggcagactgatagttccccaatcagccaagaatagattcaaagcatcttaaacagagactaacctggaggtgactggtgctggggctcagctgtggtcttccctggccccaagctcttttccaaagtttccccaggcaccaaccgaggttggcctgctctgaggaaggccgggctggctcctttggtctccgtgacctttgcagaggatggtggctccaaggtgtcagcagagacgcacccagagaagacacggctctttctacaaggagagtcattaagagcagcttccctctcaccaggcaatgcagggagccggaggatcctgtgatgctgctgagggctggggagccttggagacagaggcgagggaacaggtgacgtctgtttgtgtgtgctggactgcgaggctgaattattaaacaccttgccaagagctgccggtgctggtggggatggcttcttcttatcacctctgggttgtgaggagtcaggacctactttgtggggcagatccagaaacaaggacttgtggccaccaaggggcaacccggctctcctcttgtttctcgtttctgggcgagtgtgagggacactcgtgtggacagggaagcccagtcttttcccctcaggggcttcatctaacttctcactctctatcaccttcagggggaccttgttcacggccccctcggcactggccgacacactagaaatggaggctgtttccccggctggcgactgcgatgacctatccccttgccgctccttgccctgccgcctggagccatgagccccagcctcagctcccgggagggtgagcaagtcggctttgggtacaaactcagcgtgggctgctgggcgaatggcaatcgtctccttacccttagaatgcgttttaactactctttgtacctgggaggacaggtcctgaactttggccaccactttggagacaggtttctgcttgcaagtccgcttagccggcttctccatctcatccttttctgcctctggatgcttctcagggtcctggtgactttcagacaaacctgtttgctgatgctccagcccgctcggcggcctccgaatgccatcccctcctgcctctgtggagctgcagtcagggggcagcacttctcttccaagcccagtgtccttgaaagccgtctcaaagctcccaaagccaaggtctgtgtctggcgtcttgggaatatctggggggcagctctctctcctctgcagggagcaggcaagtgccccattcgggagcagatttcctttctcctctagtacccaaaggttaggccttgttctagaaagaggaagggagtggctggaacagatcttgtccttgcccatcagaggagctgattctcggcctccacgcccttttcttttggtcctcttctgtggaagggccccaaagctctctctccttccactagacctccgaggctttttgttcccgtgggtgctcctcttattgagagggcccacggggagctctccctgccagtcaccagcactctggaaacagtcatcctcgggggccaggctcacggacagctcttgcagcttcccctcctggttccccatcgtgatccccaggatgtggtctgagctcaggagattggttagcagtctctccctctctgttgtgagtttgtacagctcagttagaatgtctttcgtgggagtctgcttgaaaaatatgtcgcctggatgttcgtccggctcctggctgaggctgatgatgtctgactcctccctgacttggtagcagttatgaaaacctttattggatctgtctagagttacagtgcccttgtatgaaaatcctctgacttccccctttggaagacagaagctgatgtagcagagttccgtaatgggcttatgcaattggagggtacaatgagtgccttccattatgcctacctaattattcatgccttggagatgccggtttgtggtcaggcttcccaggctccagtggtgaggcatgtgatggtggctatgcagagaaagcagctgacagtcatctccagcaatgagactgcctgttagaggaacaggggaagaaagcagcttgtctaacagagtgcataaatcacacaccaacataaaatcaaagcataaccatgacttatccttcctctgtggctgacctcaacaactcaaggaatcagacaacagccagatttcaatctcttcctcactcccaccctactcctgatcagtagaacttttgtataactgagagatgggaaagtcctctcatttcacccccaggacaaaagttccctttccctacatggggactcactgtgcagcctggatcaggtctctcaacttctctagaccttggtttatgttcttctgtaaaatagagctatcataactcccagaagtccttatctagggggctttgagatccttagaaaacacagccattttcataactcatatttggaatattactttgcaaaggtagatcgatcaagcctttttaccctctaaaaaccaccttcaagatctgagctcaaattatcgattcaacttaaaacacaatgtgaggaaagatcttaggccccaaatttggtgtcaacagtaaaaatttcaatgtaaaagtttaaaatttaaataactcaagtcttaatcaagttttgctgttttcttttttatttattttttgttgttgtattgccttcttttttccttcctgttgtctattcgaagccaaatggaatgacagaggaacagcaaaaaatctataaggaacggctggccctgtacagatttttcaatgatgtcaccacagaaacggctgaaatgtcacataattagtgaaggtggctgcttccttgtgtgatatgagggacctcagaaatgtctctgtggctaccatccccacacacaaactctatatttctagtttcttaagctattgcccagtcttcaagccttccttgcttaaaacaagcaccgcccacaccctgggaatgataacacaataactattcattagcccttgatatctttagtgaattattttcctcaggttttttctaactgcttctaaatagcaaaaaagctacataaaagtatattttgagtgaaggaagagagaaaggaggaagagtctggtaaaagtaactccttgaggaagagagtgataaaatgacagttatgaaaattgcagatatctggtcaaaccagaatgccaggagaccaggagaggccttgcctctttcacaattgtatatggggctgttctcactcaagtagttttttttttttttttttttttttttagatgggttcttgctctgtcgcttaggctggagtacagtggtgcaaacatggctcactgccgtctcaacatcctaggctcaagtgatcctcctgcctcagcctcccgaataggtgggactacaggcacgtgccaccaccacccagctagtttttttgtattttttttttttgtagaaacagccttttgccatgtttcccagggtggtctggaaatcttggactcaagcgatcctcccacttcagcttctcagagtgctgggattataggtgtgagccactgctcccggccgtatttttaaaacttttctaaaatgcttattgctagcattttctaaagatgcacatgtgtagggatacttaataattattggtaaaaactcgctgcatgtgtccaagaactcacttaggaggtagtctcttattgtgtaatttataataatcagtaataaaagcaattgcaaagctgtcaatatccgctgagcactaagcattaggagttcaattaatgaattctcagacaaactgaagggaagcagcagatgagctatgctgagttttggaaaaatagaatgctctcctctctcttcaagcatcattttcctctagctgttctcatctcctcaattcccatggattaggagtagtgtgtgatgttgggggaggagtgttaaaaattttcagaattggctgggtatggtggctcacgcctgtaatcccagcactttgggaggccgaggtgggcagatcaccaggtcaggagatcgacaccagcctggccaacatggtaaaccccgtctctactaaaaatacaaaaattagctgtgtgtggtggtgcatgcctataatcctagctactcaggaggccgaggcacgagaatcccttgaacccaggaggccaaggttgcagtgagctgacatcgcgccactgcactccagcctggtgacagagtgagactccatctcaaaaaaaaaaaaaaaaaattcagaatctgttcaaagtcacagtttatgctgtaatttcaaataggaatatgactgcgtattctattccctaagagagggaatttgtatatactgagcacatatacacttatattttcattttgttatctcatggaatcagtacatctccattttacagatgaggaaactgaaattcagagataaaggaatttgtctaagggaatatggctcagaatatgcaagtttcaaacccagatctctctcactacattgcttcataggtcatgttgctcttcacctactgccttctactaacaaactggttttccatctaatttgaatagaggagttttttttgttgttttctgttttttgtttttttgttaacttggtgttacataatttcttaacaatgtctcacatcttgctattttaacgctcacggaggccaggcgcagcagctcacccctgtaatcccagcacgttgggaggccaaggcgggaggttgcttgagctcaggaatttgagaccagtctggggaacatagtgaaagcttgtttccacaaaaaaagagaaaattagctgggaatgtggtgcaagcctgtactcccagctgctagtgaggctgaggcaaggggattgcctgggaggttgaagctgcagtggactgagattgcgccactgcaccactgtactccagcctaagtgacagagcaagaccctgtctttcaaaaaaaaaaaaaaaaagaaaaagaaagaaacaaaaaccacactcattggagagcttcaacatgtctgatcaggtaaagtgctgctccctaaggtcatcccttaaacaataaaatctagaaaaagggcaccaggagttcactacagctggtataggcagtaaaaactcaatgaagattctaatttagaaataaaagaagagaaggactgacataaaggctatatcctttatgagaattacagacatgtagtgcctgtttacaggattaagtacttttttcccctggtctttataagtcttggttatgtaaatggagaaaatgtcatggttagaactctatatgttagtcacagttgggaaactcaagtcaaggtttagaaaattataacattggattttatagcaataaagccacaatgcaaggcataaagctactattataaaaaaaaagaaaaaaaaaaagaactttacactattgcctcatccacccagaaacttccatacagaatgctcttaccacacttgtggtgcacatgtccggaaccaaagaggagcagaacagaggaagaaaaaagaaatgggagtttgtctcatgatcttgggactacagttcctttgttctgggccctgggaagcagtatgttgtaagaaactttgtactgaactagactaaggagtttcactatcccaggatccataggagccaatgaagaatcctaagctacttacttatacttgttataaaaagattacttcagaagtaaagtagagagtagacaagtagggggtaagactagtggtataaatcacttagaaaggtctttcagtattccagaaagaagcgatagccaaaaccaaagcagtagcaatgtgatggagaagagatggtcaattttaaaagatagatttcaggccaggcatggtgcctcatgactataatcccagcactttgggagcctgaggtgggtggatcacttgagttcaagaccagcctgaccaacatggtaaaaccccatctctactaaaaatacagaaaaaattagacaggcatggtggcacatgcccgtaatcccagttatttgggtggctaaggcataagaattgcttcaacccaggagatctaggctgcagtgagccgagattgtgccactgcactccagcgtgggtgaaagagtgagactctgtctctaaataaataagtaaaaattaaataaaaagatagaattgaaagggtctggtggttaattggatatgcgtgacaggaaagaatttggtttcatgatttcagatgtaggtgactgggtagattgtggtgccattcacaaagataaatgcacgaagaggaataggcttcaggggaagaagatgaattcagttgtggaaatattgaatttgatgtatcggggaataatcaaacaaatatgtccacaacactgctagatgcaaagggatagagaatgagatttaggctaaagttaacacatttagaaggaatcatacagtatataaggtgtttcaattccatgtaagataaagtaagtgcactctatcctagctctcccactgaatgtaacagaaaaaaaacaccaatataaaatgcatggagcagctatttgaacactctaaaagtaaatggtaacaagcaggttgatgaggaagaccaggctttgaagtatcaaccaactgtaaagcagctaactttctcaactttgtccttcagtagcccctaagcctggactcaaatgtgcctgaaacatggcagtgaatatcagcacaaacagaggaagatataggaggagtcctgtaattcagaatcaagaatagaaagaagttttcttgttggcacctaaaactctgagggaggagaacatttctctatgattagaggaactgtagtcccaagatgtatgggggaaaaccctatttctttttctctcactctgttctgcctctcgttgatttcgggtgtgggcagagttgcaggaagtttgcagccaaagagttggagggttagtagtcctagatttctagttagaggactgaaatcagagcctcagagagcccagaagtatgggaaagattatggagaaggatcttagaaagtgacccataaagttgttcatggatacctgaattaaccccagcctgtggattgtggatctgaacttaaacaccatacgaagggctttgaaaaaaaatgaagagataagacaacttcccagggcctaggctggccactgggtggcacatacatgggatggaacactgcaaaagctttgaaaatggaactgacatgaaaaccacaacccacaggaggctcattggaactggaggactgagccaaaccaggttgactagctggttgtttcaacaaaaaaggatcttccctgagcaaatgaacttcaacctcaaccctctagagtgttccatgtcagaagaaggctttagaccagggcaaactcttctctgtgacaacccattagaaagtcagaatgcagtatggaatcatcacacatatttttcatccaagaaaccagaggaaaaagagcagtaagtcctaagagaaaaaaagcaaaaggacaggaaatcactgtgcattggggttaaatacactggcattgcaattccatgctgagttcacaggactatttcaaacagcattgcctcattctacttggactcaaatgcagcggctctgcagaggcacacactaaattatacatcttaatttggcctgtgaagtgacctgctctggttatgttcaaggtaaaagcactttgcttcccagggagtcttcgtgtcttctatttcctctgacaggctccaggctggcattctgtctatgacaacattgcagcagtgatttctcccttgattctttttccaataaacaagtagattacctcactctaccccaaatggaaatatctgttctgcctcatcctaatgagaaatgattgccttttagtagatgctatctattgttcatagcatatttcaccaatgctaaaaataagattcaagaattagttgtcgtcattctgtctgctgacggcagacatcctaattgattttggccttaaaaggccaatgcaaagctttctttgcctagtcattggcacagtctttccctgtgactccatctgagcccaacacggctaagacagattacctgtattccatttctaaactggaaaatttttattagttcagtcaaattcacactctacctttcacaccctcctaagaccaagagactgacttttatgaactcaatcaacaagtttccttgccctgtggcttctactagatttagccattgggaaacagtaacagattggagggcagatggaagagggctcgggacctttatcccctgactccctatctcctgggctatagtttggtagtaggcgtgccctctaatgaagaccacgctcctctggggtagttctcctccagctgcagctgctttctctgagtaccattactgccccctccccttgctcatttagtcctagatggctttgaattctgcctctcctgtgtgattttggacaagttattgcctgcctttctcctttccatccaccctgggatggagtgcagctttttcaaagagtagattaaaaaaacaaaggaaggctgggcgcagtggctcacgcctgtaatcccagcactttgggaggctgaggcgggcggatcacaaggtcaggagatcgagaccaccctggccaacacggtgaaaccccgtctccactaaaaatacaaaatattagccaggtgtggtggcgagcacctgtagtcccagctactcaggaggctgaggcaggagaatggcgtgaacccgggaggtggagcttgcaatgagacgagatcgtgccactgcactccagcctgggtgacagagcaagactccgtctcaaaaaacaaaaaagaaaaaaaaaaaaaggaagttctgcaataggttaatggctcttcttctttccatggagtttttcttctctttgctttcctttttgtttttcttctttctgagatagggtctcgctctgtcacccacgctgcagtgcagtggcgtgatctcagctcactgcaacctccagcttctgggcccaggcaattctcctacctcagctcctccaagtagctgggaaaacaggtacatgccatcatgcccagataatttttgtatattttgtagagacagggttttgccatgttgtgcagcctggtctcaaactcccgagctcaagtgatctgcccaccttagcctcccaaagtgctgggattacaggggtgagccactgaggggtttttctttaaacaacctccacactgtaggagtaagaacgtaggaataataacaaaattactacaatacacagcagaaagagacctataaggtatcaaagaacaaatcagaggagttaaaaaaaaaaaggagagtcaacatcatgtttgtagaatcagaataacacttcaggcagaagaaagcattttaaaatagcccctcattaaaatatgggccttggacaggtagagattaagaaaatgaacttccaagaggaagaaacgtaatacaggactgagaaaacaaggattttaatcaggttggtaggatattaacgctatcttcatagacaaatgactcatgaagccatggatgatttttgaccagggaagcagtatgttcagcactactcttaaagattaagtcaaaagtaatgtcagaacagattggagtagaaagagaacagacagggagtcaagaatgaggagctggggacaacatcaaattctgcaaagaggtcaagaaagaaacaaattaaagtgttacaggccgggcgtggtggctcacgcctgtaatcccagcactttgggaggccaaggcaggcagatcacctgaggtcaggagattgagaccagcctggtcaacatagtgaaaccccatccctactaaaaatacaaaaactagcttggtgtggctaattagctggcacctgtagtaccagctacctaggaaactaaggtgggagaatcgcttgaacccgggaggtggaggttgcagtgagccgagatcacgccactgtactccactccagcctgggtgacagagtgagacactgcttcaaaaaaaagatatgttacagacagttttaggtagcaactttagtagagtgagagaacaccaaactaattatattacaaagagtaagtgagaatgctagtggttaagacaagaaaaatatgagtaataacctgtaccggtatttgctattttggtttcttgtcttgtcttttctttttttttttttgagactgagtttcgctctcgttgcccaggctggagcgcaatggcacaatctcggctcaccgcaacctctgccttctggattcaagcgattctcctgcctcagcctcccgagtagctgggattacaggcacgcaccaccatgcccggctaattttgtatttttagtagagagggggtttctccatgttggtcaggctagtcttgaactcctgacctcaggtgatctgctcatctcggcctcccaaagtgctgggattacaggcgtgagctaccatgcctggctgttttgttttgttttgttttgttttgttttgttttgtttttgagacggagtttcactcttgttgccgaggctggagtacagtggtgagatcttggctcactgcaacctccacctcctgggttcaagtgattctcctgcctcagcctcccaagtagctgggattacaggcagccgccatcatgctcaacaaatttttgtatttttggtagagatggggtttcctcatgttgtccaggctggtctcgaactcctgacctcaggtgatcctcccacctcagcctcccaaattgctgggattacaggcgtaagccactgcgcctggcctgtttttgttttttttgagacatggaaaacagaagtatgttttcagtttgaaaagaaggaagtagcaaggaaggagatattgatgatacagtgaaaaatggtatgaaacatgggaaaaaaggcaccagaggaagaagacatgggctcaaggacacatggggaggaatcagccttgacaagaaggaggatggtttcctactcaaagactaaggaaaaaagattattatgagatagcactgaaattgagagagtttacttattttctcaatgatttttgttttcttcaaaaagtctgtaaatttatgattttctttgcattctaacaatgtcacaagaaggaaagcactaaactagagtttcggaggcaaaattctttcctgtgaaactatgatttgactgtgagaccaccagcataagctatgtcttattttaacatatgggcaaatctctacaaaaatgtagaggacaaatttcagccaatataactattttagaggacgagtttctggccaaagtcacagctggttattaaagggaaaaaaagggctcctttttgtgtacgttttttcattgctgttcattttttgacctacaaaccaacccacacagatacccagatatgttaacaaggtgtgcgcattgaagattctctcaaagacgtcgaggaattctttctttgcctctcccttaccttttcaaagcttaattacataaagaaaaatgagtattagctttccacatgatttccatgaaaattagatattgagatcctcaacacatcactggttttacatcactatctggctaacatcatcatctacaggagatgtatgagtatgcttaggaaataagccctttccccctgatttaatttttaatttttatgggtacatagtaggtatatatacttatggggtacatgaaatattctgatacaggcatatagtgcataataatcacatcagggtaaatggggtatccatcacctcaaacatttatcatttctttgcattacaaacattccagctatactgttttagttatttttaaatgtacaacaaattattgttgactgtaatcaccctgttgtacaatcaaatactagttcttatgaattctatctaactatgtttttgtacccaccgcctgatttaaaaaaagaatctgtagataggagattcctactcgttgaacatttaaggctttaccaacaatggtgacagcacagcatctcgctaaaggtgggcttagtacattttactttgtagttagtaagacaaagagagcttccttttcaaatatcgggagtatcttttttagatatgtgaacacattctgtggagtttgcttttatgagaactttatatcaggaacaatggttgcatatgttacatcaaatttgcattttctgattaaggaagctgctcttgaacaatggctttccaattagagagcacaaggggtttaagtaggtttttctttcttttttttgagacggagtctcgctctgtcacccaggctggagtgcagtggcgcgatctcggctcactgcaagctccgcctcccgggttcacgccattctcttgcctcagcctcccgagtagctgggaatacaggcgcccgccaccacgcccggctaatttttttgtatttttagtagagacggggtttcactgtgttagccaggatggtctcaatcttcttacctgatgatccgcctgcctcggcctcccaaagtgctgggattacaggtgtgagccaccgcacctggccggtttttctttttaacaggcaactgcaaagagacgattgtaaccccattttatagaggattgaggatgcaggcagggtgctttgatggtactctcatttttaaaggtctgccacacagtacagctctcaaggaggaaggtggggaccatgggggctctccaagacaaagctgatctgccatctctcccacttccctgatagccacatctgttgacagaaaacctattttttggttgttgttgttaaaatgtctgttcatttataaacctagtaacatggaaggaaaacctattttaattatctcacattatgtgtgtttcgattttataaaatactggaaatctttttataaatcacagtaatatgacatctgtttaaaacgtccacaaaagaagttctttggtttgaacttccatttgagccaaaccaccatcatgtgaggcagacatagcagatgcggttattgtcactgtatacccaaggaggctaaaggagacaagaaatttcaaagcgacttgcccctggtcaaacaactagtgagcaatggaactggactcaaatccaggtttctggactctccgtatgctgctgtttccactaccctagtaccactggcactcactttttctttttctttttttttttttaaagaaagaccaatgaaacaaagtgccatttttaaaaagcccaaaatttaaaaatgtattgcgggataggattttaaaaatgtattgctggataggacttaaaatacaatatagtactatatgcagtgaagcaagtggactcaaagccactactttgtaaagatttctcatttaaatataattttattaaatcttgaagtagataccttctaagaaaaaattcatatcccatcaaatactcagaatcctacaagagatcatataggcaacagtttcacaggtgtgtttgcttcctttttgctttgttgctgttgttcagggagagatactggtattagagttttacaaactcttctgtttaccatgaggatcaaggaaggccctcttcatcttaatccagcgttatttcacgaaatccatcctaagagttagttattttgaaatgcacttcgtaaaataccagtgaccatatatatagactgcttaaacagaaagatctacccagggtagaaagggctgtgtaacccagcaagggaagcactgggccatgagttggaggcatgtatcccaatccaacaagggcaactggactcaccactgctgtatgccaagctcatgtgtttcttagtagactaatcaaggggcaggaagatagcaatttgtggacaagcagtaaaaatctagtaaaaattaaatatttaggtgaggtaatgaaatgagtagattcatacttggttaagaaggagaaagaaagaggagaggagagagatgacattagccaatgatatggtttggctgtgtccccacccaaatctcaccttgaattgtaataatccccacgtgtcatgggcaggccaggtggggataactgaatcatggtggcggttttcccaatactgttctcatggtaatgagtaagtctcatgagatctgatggttttataaatggaagttcccctgtacaaggtctgttgcctgctaccatgtaagatgtgcctttacttctcctttgccttcaccatgattgtgaagcctccccagccgtgtggaactgtgagtccattaaacttttttcccttataaattacccagcctggggtatgtatttattagcagtatgacaacagactaatacagccaacatttcatgaggtcttaaccagtgctaggcctttggctaaatgtacaccatgcctcattcatttacagttgacctttgaccaaagcaggggttggggtgctgactccctgcctgcacagtcaaaaatgtatgtataacttttggttccccaaaagctttactgttaatagcctactgttgaccataagtcttactgataacataaacagttgattaacacatatttgtatgttatatgtattagatgctgtattcttctaataaagtaagctagagaaaagaagatgtcattaagaaaatcacaaggaagggaaaacatatttattctttattaagtggaagtggataatcctaaaggtctttatccttattgtcttcacattcagtaggctgaggaggagaaggaagaggaggggtcttgctgtctcagggacgacagaggcagaagaagtgaaggagaagggagggaggagagacaggcacacttggtataacttttattgaaaaaaattcacgtaaaaatggatccactaagatcaaacccgtgttattcatgggccaactgtaattctcatagtcctatgagtgggtactaataattcttccattttacccatgagaaatcatgtaagcttagggaggttaagtaacttgtccgaagtcacagagttattcagtcacagaattggaacttgaatccaggactattttaaaagtctctctgagtaaaagtgacaaaatactgcatttcttaaaacttcagggagaaataatgaatctgttatgggaggccatcagggggcctctaatataaggattattttgcttctcttcagaaaaatatggttaacagattgtgtttattaagcaattaacactatgatctatgtgccccttgatcagaatataaattaatccatctagaagcaaggacaaaaaacacataatgtttgcaaaattcctgttaggaattcctctttgtcctgaaagtatgttagtgctcatggtttaaggtttctgtcagagcctagagaagaacttgtcccacaataccccagagagagtgacaaaggttaaaactggacatcaccattaagtttgcctcaagtcaagtaaaagaattgtgactgaatttcagtttctgccacaggggatatactaaaaagggtcaaagtgtcaaagtttgacgtggtcctctttgtgattaggaggttggctgtggctgtggacagttggtatctgctcaagcatttaaaccaaccccaactttggcacaaggctgcaggttctaaaggtaatatctaaaccagatctaactagccgctattccttgatattggaatttaaaataattaaagtctcagtcacaagtgctaagacgagatcctctaggtcacagcagccacagtctgacccaaagggcttagcataaaaagtggtgccgccttgggatgaacaatacacagcttcctcttaataaactgagctgctctgggaactccccatttgattgccactcacaatttcgatactttatacaaaaatctcatatccacaattcctgcagttggagatgtcacgatagttctttcacaccatttacatacaagtttagaagcatttccagatgattccacaaattcattctcaacagtctgttaattgagctcaatagaaaggcaaaaacataaaaaggacattacttattagaatgactggcttgaaaagaataaaggggaatataaatatacatttatgaaactaataaaaaagccaaagctttgttgccctagataacttgctatagcggcctcacgctgcttctagaaatctactatgctcctaggattcaaaacacatcctcaaaacacataaataaaaatcctttgaaaacataaaacagtttaataaaaacaatttctgaatttgacattgctaaaacttcaaatttgattgaaggaataaatatacgcaataaaaaaattcaaacggaattttgagacaaatggctactgttgagattcctaatgggaagaagggtaagtttcttcctcttccaaaaataccagggaatttctgggaattaaagaactctgaacacagttctaacatcaggaagattttacattgtttacggcaaatttcaaagacactttgaaataaaagcaaatatataataagtatagcaaataggtctgtaatgagaaggcgctgggcccggagatccagctttttataaaaagccttttttttttcttttccttttttttttttttttttttggtaatagccttttccaaaaagttgcagtcagcataaattgcaaaataaatctgtgaaccagatgaggccactattgagcatattatttattcttttgtcatcagattaagtaatattttctaaagtagatacatacttgcataacaaatcacttttccagttggatgattctgcagagattaagaggtcaggattaccaagaatatccttctcaaaaagcccaataccatcagaagaaagacgcatttagctgcatttatttaagccaaataaatttatatcaagtctttcttctaaaaaccatgttttgtggaccaatagaactgaatggagaacccagaaataaattcatatatttacaatcaactgatttttgacaagggcaccaagaacatacatcagggaaaggacacccccttcaatatacagtgctgggaaaactggacatccatctgtagaagaaataaactagacttgctatatctcttgacataaacaaaaaatcaactcaagatggattaaagaattaaacgtaagacatgaaactagtagtggaaaacataagggaaacacttcagaactatggactaggcaaagattttatggctaagacctcaaaagcacaggcaacaaaaccaaaaatagacaaatgggactatgttaaactaggaagcttctgcacagcaaagcagagtgaagacacagcctgttgaatgggagaaatatttgtaaacttttcatctgacaagaaacaaacatacagaatatacagggaactcaaacaactcaacaataaaaaaaaaaaaaacccgttgaaaaatgggcaaaggacaagaatatttctcaaaagacatacaaacgcccaacaggtatatgaaaaaatgtttgatgtcactaatcagggaaatgcaaatcaaaaccacaatgagatatcattttaactcagttataatggctaatagcagacaaaaaaataacagatgctactgagaatgcagagaaaagggaactcatacactgttggtggaaatgcaaattagtatagtcattatggatgaagatatctcaaaaaaagaaactaccatatgatctagcaattccaatcccactactaggtatttatccaaaggaaaggaaaccaatataaagaaaatcagtataaaaaagggatacctgcaccctcatgtttactgcatagcaaaagatatggaatcaacctgtgtgtataaacggatgagtggataaagaaaatgtggtatatacacaatgaaatactatctggccataaaaataatgaaatcatgtcatttgcaacaacatggatagaactggaggtcattaaataagccaggcacagaaagacaagtatcgcatgttttcagtcatatgtgggagctaaaaaattgatatcatgtaagtagagagcagaattatagtttccagagactgagaaggggatgtggagagaggggaatgaaaaggggtaggttaatgggtacaaacatacaaatagaagaaacaagttctgatgggcgacagtagagtaactatagttaacagcaacatattgtatattccaaatagctagaagagaagatctgaaatgttcccagcatgtagaaatggtaattgctcaaggagacagctgtcataaatatcctgacttaatcattacacattctatgtatgtaacaaaatgtcaccatgtatcctataaataagtacaaatattatatgtcgattaaaaaaacttgttttggaacattaaatgtttcaggaaatgccaacatttataatataagtaacttcagggcatggaaatttaattccagcaatggttcttggaatttaattattaatggaggaaaaatgaactatgggtttttttttaaatcttaatgttgggaggtaggatacaacatttccctatttcttttcttcagtcttaatttccttcccagacccaaaatctcattactgcagctacagttagttcttgctcaatctaagatgtttcaaagaaaatatgtaaaatgctattcacaaatgcaattagaaatgtgatcacttatacaactgtgtgtacatatcactaaacgccattataatgtacagccatgaatagtatttcaaacacaatgattcgaattaaagaaatgtgtttttggccgggcgcggtggctcacgcctgtaatcccagcactttgggaggccaaggcgggtggatcacgaggtcaggagattgagatcatcctggctgacacggtgaaaccccgtctctactaaaaatacaaaaattagccgggcgtggtggcgggcgcctgtggtcccagctactccggaggctgaggcaggacaatggcgtgaacctggaaggcggagcttgcagtgagccgagatcgcgccactgcactccagactgggtggcagagcgagactccgtctcaaaaaaaaaaaaagaaaagaaagaaatgtgttttctatttaagacacttatggattttatggtattaatgaaaatttgatgtaattactaaagtactaagaggtggaatgggtggacttttgtttcaatgatcaacccacatactaaatggaggttccatgataaagttaagcagagaccattggtatactcagttatctggaggaggaatagcaagacgaaaaaaggtaccacacatgcggtgagagtgttatgtggctcttcatgagtgatgggtacagccatctgcacagggaggagcaacttaatcaccaagggatgggacagaaaggggaagaagtgtaggatactgacactggttatgtggtttgacacagagttggaaattctttatttttcagctcctttaaccccggcaatgtaacttctgcctcataaggttgttaccttcactttatggatcataaatggattcacaagaggttcacgagaaggaagtggcagagttgggcttcaacacaaggtcaatgtagtcccaaagtcaatagtcctctaagtatagcacactgagtagagattaaagactgtcaatattctagcttatcagaaagtgtttttaaaaatagaaaaaaagaaaagagaaagcacaggatttcagtaatgttgcagaaaatatgaaggataatgaatcaaagaatgtgactttaggaagaagagaatagggaagggagtgagagggaggcaactgttagaaagcatgcagtaagcacaagattgatcttgccagaggttttctaatacaagggcaataccatataacccacagaacaatgacggagcagctgaagaacctcataataaagttgttgtatatcatggtgacccctgtgcctgaccccaatctgagatatccagtctacttctttgtgaaactgatgaataaggaatcctttataggtttattacacaactagataggcagggagacagttttgagattggaagtacaaggaggaggacataattggttacaagaacctggggaaagagggaaagttgtcagtaaggtggatgaggtgagagagaaagataaagacaatgaagaaaaacagtatctggctcagacagaagaaagaaggtagaagtttctttttcttagtgtttgtaaaaaactttatgagaccacgaaaccaagcagtgctgcttcagggcccaggtgagaaagcatgcttggtgttagagaagggaccattctcccccatgccccatctacttcattccctaagaactcaaaatggtcattggaaaagtctgctgtaaccagcatagcaccattttaatgcagggcaccagaggccagaacaagatgctgtgaggaggaggatagaggaaaatatgattggtccaattggtgagcacaaatgaaacttcaggaaataggccgggcacggtggctcacgcctgtaatcccagcacattgggaggccaaggcgggcggatcacctgaggtcaggagttccagatcagcctggacaacatggtgaaaccctgtctctactaaaaatacaaaaattagccaggcgtggtggcaggtgcctgttatcccaactacttgggaggctgaggcaggagaatcgcttgaacccaggaggtggaggttgcagtgagccgaaattgcgccactgcactccagcctgggcagcaagcctctgtctcaaataaaaaattaaaaaagaaagaaagaaagaaagaaacttcaggaaataaccgaaggagcttttaagaggtcaattaaatcctatgtaaacaggaaagaactaaggttcaatataatatgtattattattattaatgtggcctcactggaacctataaacaacaatttctgggttattaagcttatagaggatgaagaaggagtaagtgacacagaaaaggatataaaaaagaagaagctcaatgaaaaatatcattttcttttcccaaagaaaagaaaagaaaagcaaaaacatccaaatgaaatgggtttctttggaaggtttgctatcattgaacattttcaagtgcatgttgatgactaattgacagaaattctaaggaaattctgtttccacagacctgtaagtccttcttaatacctccccctctcagattccaatccattactagatccgattgattttacttctgtgtgaaagagcatatgcttggatgagttggccttcagaaccgcttccattctgagccagtattttgtgtacattatgttatacaatcttcttgaaaaggcaaagaatgtttgctctcttaagctgtattccataatactccaaatcataaatttttcgtttcaaatacaaagtagaccccaatcatcaacatttttttgattcagttaattagacaattccttagcacacataatttgatccactgatacttaagggatcaatcaagtgtttctagccccaatactagccattatattcttgagagcataggatcatattcagcatatatgatgtagttttccatgttgccagctcccatactgtgaatattaccaacgacaagatccctgtgtaacccatatttagacttatagaatagcgggacaatcagaaatctttccgcatttcacactttagtgtttccaacaagccaagtgcaattcttcaattacatcaggatttctttttcaaatctgggtgccaacccacagggctagatagggaatttgttacactgagaacttttagaaagaatttttcttatcacatctgctttaaatagtaaaactagtttcctttcagaggaggaaacgatttttttttttttagacagggtctcacccaggctggaaggtggagtgcagtggcatgattatggctcactgcagccttgacatccgaggctcaagcaatcctcccacctcaggctcccaagtagctgggactacaggggcataccacaatgctcagctgatttgttttttgtttggttggttggttgtttttgtttgtttgtttttgttcttgttttttacagccagggttttgccatgttgcccaggctggggtcaaattcctaggctcaagtgacccgcctgccttggcctcccaaagtgctaggattacaggcgtaagccaccatgcccaacctgaaggaattattctttaagagctaggatttcaattatggagacttcctaggttatttcaagggaaagaattgacattctggaagaaaacctcctcactcttctaagttttaccatctattttcttctttcactacctctattttgaaagaaattcaagaaggtagggagcccctatttctctatatctcttcccatttcctttgcttttaaataaagaaatgaatcttcaaaaactaagcttagaacactttacacagtgtgggctatatattttctggcctgacaactgctaggtatggcctcagtgaagtcaaaatttagtgcccattaaagcagagaaaactgaaaaacagcactcttcccatcccacacacacacttagaagaacttttcacatggatgccaaaatcatccaagaaattctcacccatatattgttcccttcaaataaagggttctgccccagtcaaatattttttattattgtcaaagttgaactgaggctacaatgcctcaaaattccataatgcctcatactttcttaaggaacctcacatacataattttatttaaataagcaatttatccgaatattgtagcaagatcaatatgtaaagacgtgagacatgtgaattttgctgaagaaagtttgagagaaatagtcggttagagggccccaaagcaaatggtacattttccttttaaaaatcattcctgaggccccctaggtgcagtgtctcatgcctataatcccagcactttgggaggccgaggagggtggatcaagaggtcaggagttcaagaccagcctggccaacatggtgaaaccctgtctcttctaaaaatacaaaagttagctgggcatagtagcacatgcctgtaattccagcactttgggaggccaaggcaggcagatcacaaggtcaggagttcgagaccagcctggccaagatagtaaaaccctgtctctactaaaaatgcaaaaattagccaggcttgttggcaggcacctatagtcccagctacttgggaggctgagacaggagaattgcttgaacccgggaggcaaaggttgcagtgagacaagatcacgccactgcactccagcctgggcgacagagtgagaccctgtctccaaaaaaaaaaaaaaaaaaaaaaatcattcctggagttcccactacttgtcagacattttcctccacactatttcacatggataatttgtctttaagcacctctaaccagcctctttatatttcctttcttctcacttgtaatactttctctttcctgtccctataaaaattcactcaattcactctaaaaatatgactagatataaatcatttcattcttgactatatatgttagccttcacaggaagattatcattttcagggtcaccctgtcggtggagaatgataggttgtgaagtcaattaaaggaatccagcttcacttaaatagaagtattaatatggtcaggggtcttcgcagatggcaaagtcctaatgcttctacctgcagctaagacactgcttaagaacatcaagagtgtttctatgctttggttctcaagcaaaagatgaaggaacagtctatgcctttaaataattaagataattactgctgcttagtgatcactcaccacgtactggccactcttccaagggctttacctgttttaacacattgatttttacagaaaagcctgtgaagtaggtactattattatctccatttacaaggaagaagctgaggcacaggagggtaacttgtccagggtcacacagctagtaagctgctgagctgcaatttgaacccaggtgctttgacccagagccctggctcttgaaattccttacaggactgattggggacaataggtcttattcagaaaacaggcctactcatttactaattcctcttctttaggtcatagaatatggagcactcacaccatgtacaactggtctaagactgatcagtcttcacctgagatggtttctaccagggcagggcaaactaagaaaaaagcagtgtcagaaggcttggactcaagtccagctttgccaattactaacagtactcttgtgcaagtcacttaacctcattgcacctcagtgtcctcatctgtaaaaaggccttttgttctccctacttacagtgcaattccatagtcccccctgcaaagaaatgaaacccactcaccaaattacttttctaggtagacagtaaattcagcgcacaaataggatcagaacccagatttccagagccaaaagagataccacaagacagtaaggggtgaaaacaggcaaaggaaatggtgtaagaaatttagatatgagaaggctgggtgcagtggttcatgcctgtaatcccagcactctgggaggctgaagcgcatggatcacatgaggtcaggagttcgagaccagccagaccaacatggtgaaaccctgtctctattaaaaatacaaaaaaaattagccaggcatggtggtgcatgcctgtaatcccagctacttgggaggctgaggcaggagaattgcttgaacccaggaggcagaggttacagtgagccgagattttgccattggactccagcgtgggcaacgagagcgaaactctgtctcaaaaaagaaaagaaatgtaaatatgaggcgggtacgggcaggaagaagccaatccttcatcaggaatatgaaaactagaaaaaaagcaaatgaagtgtcaaaaataagtaacagcactgaatgtaaaaaaatttaaatgaatgaaaaatgaatgaactaatcaatgcatgttatttccacttctattctagaagaacattcactgttagcttaaatgagacccaggacacagtcaccgcttcactccagcacttccaaggtttttctttctgctttgatccaaacgctatttgcacttaacatgtaccatctgaggaggtgcctttaatcactccctcctggcctgtgtataaaggcaaaaattttcaacttgagactgtcttgggcttttatctgccagtctcaatggtttatgatgtctccatatcctgctctcggtctcaagtctgtttagctacctctgttagattgttttgtccaatcctaaccatgcccatgaacttacacttttggtttccttgaggcctattcctcatagtcttgaaggcaagggtttccctccctccttaacccctagcacagctttaggactatactgcctcggttaaaatcccagctcttccacttagcacattacatagttaagtaatctttgtgagccttaatttctaatccctaaagttagtcaatacctgatagatacactggcattcagaatacagtgactggtacatagtaagtactatataagtaattgctactattatgtgcttcagatcctcattattcaagaatagaatcccaatacaccctgccttctattggcaatgaaccttttgcaatgtattgttcctatttgattaaagcctctctaaagggaagactgtcattgtcaccatctttgtattcccttcagtacataaaacatgacacatattcagtaaatagtggattaaaatgtaattatctaaagatacaaatccaacctgcgtctctgcctgaaaatccaagcatattattatttgtagccagcaataatgattaatgacagcttgatctttactttccaataaacacaacaattaaagtagacaataaaatcataattaggaacaaaattggctttccaccattagaacatatatcaaggagagaaaaatatgaaaagtataaaaattcaataggagaataacagaataaattgataccaaactttccattaaaaatcaaatttaaatggcagtaggaaatgtgaaaagtaaagaaaaaattttttaatgctctcagagactaaacaagggaaaaaaatggatctatgaaatgttgatccatccctgatagaaaaatgaaaggtatgatttcaggattctaacataaactgaaaaaaatatatttttgctcttccttttgcctgaactgccccagaatctttatgactcaatctgggggtacctttagatatctgctcaaatgatgcctcattagaaaggcttccttggtcacccaatttaaaatagtgcctacggccaccgtcactgttgagtccctttccctgaggcatctgtctccatggaacttgtcatctgccacattatatttctattggttacattctgtctcccctacaactatagaatgtaactgtcatgaaaagagttttgttcactgccatgtcctatgtttcagagattaactagaaaatcatgggtgatcaataaaaatctgtccattgagtgaatcacttattaatacaaatattaacaaatatatatggaaagtgtttaaaatagtgcctggcacataatgggcccagttagctatttttaataggaatagaaatagtagcattccttccttgcttctttttgattgattggtaagaaaagtcttctgccttgagtgactagaaaaaagtaggaagccttagataagtaaggagctgggaggcagctttgaaatcaggagcgtaaatacttactttatttaggggacaactggaatttactaatctgctctgtagtacagcatgggcaaagagcagctttagtggaattaacataacaatgtgggaggaaaaacaaggcaggaatcagaaccctgtgggtgaaaacattgcacaggagcccagggccagagcacagcgtgtcagtgaacagaagctgctgccatgatttagtccaccttcttacctagatcagccttcgcttgggcagggtccagatgcggagatgtgaaaaacgtgatgccaccaggcctgtgtaaaaaaaaaaaaaaaaatcaaggctcacctgaagtaatttgcacattaggtgtgtatgtgttactgtgtttcttatatatattaggtggctaatttgaaggggctttcagaaattggggatcacaatgctgaccctttaaggtcttctggagtaagtctagggaacagacgatcctgcctcttccgtgagataaccctaatctcccacctaaactactgcctagcatagggtaaccaaccatgctgggttgcttatgattgaagagtttccaggattcagacatttcagtgctgaaaccagcaaagttgcaggcaagccagtaccagttggccatcctgtatccttgtaagcctgcgtatgctcatctacttagtgttcacactgcaatgagaacaatcatttaaaacaaatctggccacatcgtgcctcagctagtcacacacagccagatcccttcagaggctctcctgctgccttttttttttttttttttttttaagacagagtctcactctggttgcccagactgaagtgcagtggtatgatcacggctcactgcaacctccccctccagggtttcagccattcatcggcctcagcctcctgagtagctgggattacaggccaagtgctaccacgctcagctaattttggtacttttagtaaagagggggcttcaccatgttgtccaggcttgtcttgaactcctgacctcaagtgatccatcacccttggcctcccaaagtgctgggattacaggcatgagccaccatgcccggcctctcctgctcttaaggcagattttagcccttatcatggcctgaaaggctccgtgtggtcaggcccctgttgatttttccagcttaatttttgcatcacatcacagccagtttccttttgggggctcacatgaggccactcccttctgctataagggttccttgcatgatgttcctcctgcatggaatatgatacccatctctctttcacatagttttacttctaaaaatttttcagatcattttactcctaaactgttttcatatagtagctccataactgtcactttttctgagatgtctctcctgcctcttccgagcagacaaatcctcttccatgccctttgggagctgcagccactgctgttggcgcccaccatatactcttgacatgacctccacacacaaaagctgctcgctgcaaacacctgtgactttctgcccgatggctttcttactgcacgtggaagcaccttccccagcacacaggatggtatcagatgagattagagcaacaggtaggagtcagatcagggaggctttcggggctgtgatatagagtccaaattttattctaagttcaatggaaagttattggagagttttgcattgcggagagacaagatctgattatattcttttcttttcttttttctttcttttttttttttttttttgagatggagtttccctctcgttgctcaggctggagtgcaatggcgtgatctcagctcactgcaacctctgcctctcaggttaaagcgattctccttcctcagcctcctgagtagctgggattacagatgcctgccaccatgcctggctaattttttgtatttttagtagagacagggtttcaccatgttagccaggctgctctcgaactcctgacctcaggtgatctacctgcctcggcctcccaaagtgctgggattacaggcataagccaccatacccggcccgtgattatattcttaaaaggtcactcagactgctctatggaaaatagattgtgaaagggtacatctggaagcagagagaagccagtcgggaggttagtgtagtaggcaagattatttttctagctggaatcattggaagtacaactgaaagcataataaaaagtggctttttgtaacagcagcaggagccttcaagtctagggtcagctaagaaagcaacttacctgagaggtcctctgaagtctggctcattcaagtgggttcttagaaatgggtgaaaatcttactcttctcatgcataaagcagggataatgaaaaaaatgtttgagaaacactgttctagaatctcaggcaggctgtaggctcatttttagggccatccattgctcttaagctggcctggaatggcccctggcctccttgactaatcgccctcaacctgccctatcacctcacatttcttcagctctgtacagacactgactaattcacctactcagtgggaagatggtccagtcagataaaatggtctattttcaagtcagcctctctaaacacagatactcctgtttggacaccctcgaagtatacaagtgaaggaaggaagtgttaggagttacatagggtgatgcagataccatgcatctcagcgggatctctccttccaggtttcatgcttctctttctgcccaggcgccatctacctctcactggatgaattcctatgtgttcaacagagcccaaccacaaatgtcacccaccctggaaatccaggaggaaaaaaatttattcctttttttgagcatctaaagcactctgtaaaaatagcattaacagctactattacttgagcacttgtggcagggattatgataaacattttgcctgaattatttcatttaatttccccattgttaaccactttttacagacaggaaactggggcttagagcagcgaaggggcttgctcagtgtcagaaaactaataaatgatagaatgaagattcaataccaagcagcctcttcccctctagaccttaaatacactgtcctatgacttacaccactgtgttataatcagcagctcacgtgcctctttcctctattacttccaccataaatgaccaaggcctgctgtcatgaaaagagaatgacttacaatcaaaccctgttgtataactttaggatattacttactgagactcagcttcctcatttataaaatggagaaaacaaatgcctacctaataggttgttgtcaagataaaattagatagaacttttaatgcacttaccacagtaagtggcacataaatgctcattcaattaaacaagtattatttgagggcctgtggaatgccagtccttacgatggacactgaggatagagaaataccaaaatgtctctcatggagctaacacatgagaaatttaatatatgttgattgctcttacttcttgaggacagagactgtgtgttactcaacatcgaatttctatagtttaatcatgcctagcaccgagtagacactcaataacatttcagtgaattagtaataatgggttacataatttcatacacccaaagtagtggggattatgaatgactgtttcaaattggtgggttgacatttatcaaacagtaggaagaattgaaagcaaagtacaaaaatagcatacccagaggttgtatgcactaaattcatttaagcatagagttactactaaataactttcaaaatattctcaggacaaaatggaatgttataacctgaataatatagaaataataacacatctaatactcaggaggtggggagaaagggtggggaggatgtttcaaaagtgttactctttcaagaaagaaagtcaactgatactgtctaaagaagacactaatttataaaaacagcaatataatcacaatgactttaacttcatgatttttttttggccagagaaacttttaaaaaatatatgtatctcaaggatatatcttgaaataaggtaaacttattggtttcaccattcttttagtttcaattcagtttctttttattgcttgaaattcaagaaaaactaatgtattgttttcgttataaacagcatctctattcatttttataaaagcatttctacctaaacatccatgcaggtagattcatagagagacagacagacagctgtctgaaatgatattacctaaggttaacaattggaatgatagtatttgagatttttaaaatttatctttgtaacgtaatgccttatatgaattcttgaaaccaacatacatcattttttaaaaaagtatttcctactctttctaaagaaaaaatatggcaagatatagttaattcttcctggtaggaatatagatcattgttattttcttcttttccacatttcaaaaatgattttaaaaaatttatatcagactgtacatccataagtaaatttcttcccttttaatttagatcttttttttttcttttttttttttccctgagacagaatcgcactccttcttcacccaggctgaaatgcagtggcacagtctcagctcactgcaacctccgcctcccgggttcaagcaattcttgtgcctcagcctctcaagcagctgggattacaggcgggcgccaccacactcagctaattttcatatttttagtagagatgggtttacgccatgttggccaggctggtctcaaactcctgacctcaagtgatctgcccacctcggcctcccaaaatgctgggattacaggtaagaaccaccgcgcccagctataatttagacctttttttacttatgttgcaaatcgtatccttaaaattacttgagaatccagtttacaaagcggaaaagactgtattcttttgaatgctctttataaatgtaatccacttaagtaaatgaagagctgatgaatatgctacgttatatgtgtgcttatattgttaaaggtttttacatgaagagagattatgaaaagcttcacgataccagactatgtctaatggggtcattaagttcaggattttcaaactaagtggatttccttgtccttcttgtttaaagcatgattattgaaggttagcatctgcttgctgtggtaagtgacaaactagagtaatccagttctcaaccccaagttaagaataataatttaaaatacacaacagttgcatagtcgtaatgttttggaggttgtcaataaaatacctgagccacctgtttaggtgccatggcaatatcttttttcatttatttgggaaaagtttgggagaaaagttggtagtcctattggttccttaaaataattcaaggaatctattgtttcctgtagaaattcagtattctctgggttttgtattattatattaatattatagaaggtgttttctatttgagtaaaacactgcctgtgaaaattttaattaccgttaattccaatttagagaatagaaagtaaatttttgtttcctttactttttagagaagtcttatttcaatgaaaatttgtagtaatttttttttaataaagtaagaattttttttttttttttttttttacacagagtttcactcttgttgcccaggctggagtgcagtggcatgatcttggctcactgcaacctctgccttccaggttcaagcgattctcctgcctcagcctcccagttagctgggattacaggcacgtgccaccacacccagctaattttgtatttttagtagagacagggtttcaccatgttggccaggctggtctcgaactcctgacctcaggtgatcctctcacctcggcctcccaaagagctgggattataggcatgagcccctgtgcctagtcaggaagaagttttttataaattatattcatgaaatgctttcatgcctattgaattctataaaaatgcaggttggaatttctagtctacaagttaataatagtcatagggaaaatgatggaatcttagatttaaagaaaacttagacattattcatctcatcccacctccttcccaaggctgggccctctccttcaatgcaacctttgtgaatggttctccagtctcaccttgagctcttctattgcaaagagttctgtgccccaaaaggaagcctcatggccttccagacagctctaaatgtaaaaaaaaaaaaaaacctctccttttctaagtcaaaatctatttccattcatttattttcattggtgcttttttctcacttccagagctgcagtgagtatatccaactcctttcctgcccaatggccctttaaacacctgaccaccaatcatgtttcctgagacactttctcatgctgagtaaaccatcccaggcccttcagcaagccctcaaatagaaaagtgtttagcctcgaaaatcctacatatttctgactgttctctagtttatcagtgaccctgctacaaaacagtgctgacagttttaaatgttcctcaaaaaaaaaaataaataaaagtgaaagttttgccaggatcacaaatacagttcttgcaactgtcactttaaattattagaaaaacacatcttaaatagccagattctatcttactatctcttcacctatcttaagtttcagtttcctcttcatcatgtttttctttctttgcaaatttgaagaccattcttaagtttctcttggttgcgagcaaatgaaactgattttggctaccttaagcaaaaagagaagcatattgaatctcatgaaattcatgggcagtttcataaaatcagagaaagagtagaaaggccaagagttggaagaagagaaagcagaggcttccagtggcctcctgcatcaggctcacaggtatctccctggagcacttctcttactgcgacttaactccagtgactcttagtcaatgcagtccttcaacccaaaactccagttttgggaagacattccatctggcccaccttggatcagatttccagatccctggtttaactagtcctgcccaggaacagagtcatgtctacagggaccccacacctatatattggggtcattcccagagaaaagaaagtagatatgaacaaggcagacatccccaattgctgtacttctaaaaaaagtaatattcagaaacattgatattaatctatgtttacttttatttctccttgtattttcccctttgcttaacccccactaaggcaggtattagaattggaattcattgcatcaggagaggtatgtggtaaggagaaaaagataaatagcctgtgattattcctagattgtgtttctcaaaattctaaactcttagaacacagggaatttcttgaagcatgtaaaaaggagtgagatttatcaacacaaagagtcctgaagaaccctgaaaaaagaattatctccccagggctgttgggaaaggaaggcaagaggcttgtggatgctggaggaaggacacccaggccctacttcctggcagtgtccccagagaggtcacaagaccctagagccctgcgtgctatatctaggtaagtaggaaccataggaaatgtcaacaaaagaattctgtgggtcaagctccaatgggacacagccacagatgactacaactgagagagctgggagagcagaattactgggtgctacagagtaacccatgcattctgatgcctcaatgaccagaaggtccctcttcccatgccgtggcactgtcagtcccctggagccttgacacaactctggggggtggtataatactgagaaggactgaggttaagttttccacttttccagaaagaaaaggcttgaaatagaaatgaacatggtttctaaaaaataaagagataattttcatatacctgtctttgtagatggagactcttatctgcaaggcttgaatgaaaatgacaggagtaaaatgaaaattgagtagttctgcttccttgctctctgtgaatttggcccatctttttcaagcagctggatttgtacatcatgcactgattgaaatgctaaaagccctctttttaaaaagtcaactttggccgggcacggtggctcatgcctgtaatcccagcactttgggaggccgaggcgggcagatcacaaggtcaggagttcgagaccagcctggccaagatggtgaaaccctgtctctactaaaaatgcaaaaaaaaaaaatcagccaggtgtggtggcgcacgcctgtgatcccagctactcaggaagctgaggcaggagaattgcttgaacccaggaggcagaggttgcgttgagccaagatcatgctgctgcactccagcctgggcgacagagggagactttgtctcaaaaaaaaagtcgagttagcatttttttcaaatcctcttgttattcatgaccttagtgttcctgaagctgttgccctgggtccatgtcatacctttctatacatagtcttagactatatctccctttcctctcttctgtgtgtttcttccttcttagatgtggttcaggcagaaggtccctgcacaactactttggagtcttcagctgtgtctcccttttgctttatcatttgccaagtttgtgactatgatatcagaattttgtttttcttaataaattctgttaagttcctgaatttagctaatggtgctgcaatgtggcagctattgatacattttaacaaaagatgaagaaaaaaaaaaagtcaagacctagaaactgagtctgagagttgactgccttcattttcgtaggctgcagggctgttacttcctaaagagaagttgagtgatgtaatgaacaaagcccagggagtcaggtgacctggatctattcttggctgtgccactgaccgtgtgtgaccttgggcaagtcacttttaatctcccatctcagttttctccactgtataactagaaaaatatcttgtcacttaacaagagaaaatttgggcataagagttactgttgcttgctgcttgaaaaaactttaaggtttttttgtttcaacctaccacagtcttccttaagatggtgtggtatcatggagtttcagttcttcaaatatcgtgaaaattagaattaaattgttttcggaggttaaaattaggaccagttgaaaataaatcagagggtgatcttaacacaaggccagtacctccattatgtgtgatatgttttattcatatttacttggggttggatgggtaggaaagagggaaagcccggctagtctcctgtaagtagaaggtagaggatgctacaatagaaatagaaataaagagagatggggacattggcaaacaaggacaggactgatgccaattctgtagatgaaatccattttctgcagaactgtgggcttttaaaaaattatttgcaaagctctccaaatatgagctaggcttagaaaattttctgaagtggctgccttcatctaaaaagagaaaggagaataattctaatgcctaaaaaagcaactcttgcttttcactatattcatacccagcatactgaactttatttatggtttatcctgctttgtaagtttaaaacatgataaagccaggaacgttctctgtggcttaggcttactagagcacagatagaaaatagaatgcaagcctagcaggtacatactatccagattccattgagagccggccccgtaagcaaacacattaatctctatgatccttgatttcctcatctgtaggagaggtacagcatcatttacctacttcacagaggaaccagcagattacataaccaaagaaaggaatttaagtcttctgtattaagccaaggatggacacagagaaaacatacaactcatgctcacttgagtcttgcccttggaatagactttgaggacatttttctcagaatagagcatcaacaaactacatggactccctggtgtaacggtgagaaatcagctttattaggacgcacagggctgagaccatagggatgtgctttcggtcagtgaagagatcaaagcagcaatgcacactttgaaaatggtaacaaagattttactcactgcctcttggggactgaacacatttaaacataacaatgtttgctcagttgtaattctcacagaggaggaagaccattaaacactgtggcagcaattcttcccaaatactttctccattctggctcagcaatccttacaatagcaaagagcaaaaaacctgctctttaatacttagaagtattatcttctctactgagaagagactgaaaagagttcttgaaactctaaagaagagattttagagaacatgagacagtgctacagtcacctgtgtgctgctcaaaagatggcattcattcaatttcatttgaatttcatttgtgcaaatattaaggttttggaaaccatgaggtttcccaaaattactatggtgagtgaatcaccagggagggcttctcctaataagtagacagttctctttctctttgagaggtccatatttttccttatgtttcacggaggacatcattggagaaagcacctaggcctagatgaatgtggatagatactcacgtgggggaaaaatggaaaaacagggcaactatggctaaaggagtgtttaacaacaagcactgctgtctgacgcatttctagactactagtcttcagatcgtatcatgttctctgagcttctttaacaaaaacatgaactagagcactcatactggaaggcctgtggcaggggtgtgagtactagtatcctggcagcagcatcataaaggtgtctcctgccccacttttacagccttgtctatcctcccagtcagcattctggcggtccctgctacttctccattaatgcccagatcctgatgacaaacatgaacgttaaaaagtcctggctggccggacgtggtaactcacgcctgtaatcccagcactttggaaggccgaggcaggcagatcacaaggtcaggagatcaagaccatcctggctaacacggtgaaaccccatctctactaaaaatacaaaaaattagccaggcgtggtggtgggcacctgtagacccagctattcaggaggctgaagcaggagaatggcgtgaacccgggaggcggagcttgcagtgtgttgagaccgtgccactgcactccagcctgggcaacagagcgagactccatctcaaaaaaaaaaaaaaagtcctggctacctccaaaatattttgcccaatagcctgtcacgtggaagaccacagtaaaaaagcgtttcatttgaaaggtgttcatcattagcagtgacctatgacactttagaaggaagagataggcatagttcgaataagatggaacataaaacaagtcagtatcaagttaaggaaataggaggtgtgttggttaaagaaaaaaaaacttaactagtagtctgcttcctagagagatgcattacagagatcatggtcatttcaggccagtggggaggtaaggatgtccacaaggaggaccaactctcttctctctccctcatcctcaaacatgcactaaggcagtatttgctgaaagcgtagataagcacagaaatccaggttactctgggagattgtttacttttagccagggaacttgagaaacataagtgagagggaatgctccatttctcagacccttgcttttatgcgctgacaaggtaaagaggtttgtttccttctttacatctccccgctttagtaattactattttgcagagcatggggttgatgctttgtcagcacttcagcacagacactaaatacagagatgcttcagttccttcacagtgccagcctgttggtgcaagcttatatttgctgcaggagaatacaattcccatggtttagcgtctctgcaagatcaggcaaatcagattaacagctgtaattctgtcaacacaggctgggacctgttgagaattaagctgatatttaagacagagactatgtacatctaaaaataatagctactcttaaaaccaggtcccaaaaagagattatgaatagcccctaaacgtggtcatactaccaaccagtagcatcactgcaagatatgaaatatccattatgaacttttacactgatacgaataaagttttaataagaaaaccattaaaggcaagatcatctaaagcacaccacagcttgggatggtgtgcatgaatccaaaactttaacgtaaaactagactttgaggcatggtatatgagataggagagaagcatttctcaattttctatcaaggatatttaccatcatcacatcaagttccagtctgtccccattcctcttcctctgggaacagctccaccaattttatgtctggaaagggaggatgaccaggatatgagacctacccttagacaatcataggtcctatgggaccccattcccttggccaaagcatttggtctaggcagggttaagcctgtgacaaaggcttcatcaatcacagtcaatgcattgaacactcagtgagaaagaagcagtctagaatagggccagaggcctggaaatcttctctaaagctgcatctttaacgtatctcaactaagaatcggctaagtacttgtgaaggctggtgagagaaatgcctgtccaaacacaggtggcttcaatagtggcacccctctaagatgtagtgctataaggaacctgaagactaccataccccatttgcatcagctctgacacctaaaaaggataaagacaatggaaaaaaatgcataatttttaggaacgagactggcctttattatccttcttgactagtattattaatagcagttactataaattccccacttatgtgccagaaactactgagtattttacctatattatctcgtttaatcctcacaccttctcctaagagacaggtagtattatccctattttacagacgagaaattaaaattaaagaggcaagcaacttgcaaaaatcactgagctagtcagtggctggtccaggatttgaacctatgtctgacaggtttatgagtttagccattacaatatactgtctcactactcttctccattgtttccctccattgaggccattgcttctttgttcctgcaatatgtctaactattcattggtcctgctcctggactgtaacacagttgagagaaaggagactagtgtttagatatctgatcaagaagacccgagacctcattgattcattgtggaagcaacatcttccacaacgacagttaatctggtatgcaattctcagctatactgttttccctcccaaaaaagggttaataagtctgtgatccaagagatttgcagtaagccctagaaacagctaagcaacggctgttgaatcccattggtgtgcctataagatgctacctggtgtagagaacagaatataattctctctcctaggaatttagatgcgcccctccgcccccctgccaatacacacgcaagggggcatagcagatgatggcacatgtcccatatgcaaacatgaatagtaaacatgctttagtacagctggagctactgtagcagaaagtcaggttgtctgctactccacctggtcttcttaaaggattgggtctggacattcacctctcagtgactgccactccccatatatatcacaggttcaggctctgcattcagcccattcggagtgtgtgagtgctaacatggaactctccaggagacagcaagcagaaatgtggatgattaaaataaagggttttctttggcaatctcaattgcaaatgaggataaggaaaatcctcccagctcacactctgctcccagctacttgttcttgagttaaatgagggcttggctctggcctcagggggcaagagcactgttcgttatttggtggtgggggagggggttgggggatccgtcagcacttacatgcctttagagaatctgcctttacagaacttgaagagctctgatggaggaacagagatgctgtggtggtagtggccttggaggtggtggtagtggcaatggtgatgatgatgatgatgaaagaagaagaaaacggtgatggtaaatgtcatctataaacacaagcaaaaagcagcaacagatacctttctagtcattgccaaccatagtcatgaagctgcttctgttcccaatgcaatcccattgtggtgctccccctctgcgctaaacacatccagcttcaaaaaaaaaaaaaaaaaaaaaaaaaagctctgcatctctccgtcccccgccctcccgccctcccgccctccacctttcctgtgccaagctgggaatgagactgcactggcgggtcaagggggctgggacctgagagtcaacgacaggagttctgtagtgaggagcgttgggatgacccggagggcccaccaacgtacttgggagcagcttggtgggggagctggaggaaccgacacagaaggggaggaagataagctggcggggtaaatagacttgatgcctcattccaagaaccctgaaagccacgggggaaggcggagcaggcagcctttggtcgggaagaagagacgggcagatggccagcagaacagacaagactctctttacctgaccaatactcgggaggctggtcccgagtcccagctactcgggaggctgaggcaggaggattgcttacggcaacagccgtggcggctgcagcctcgaaggatgctgcgctccagtccagagccaaagcccaaaggggcagctgcgccgacctcc

SEQ ID NO: 618 - DNA, 44950 bp, Homo sapiens
cttctttacaattttattggaattgcatcaaaccttaatattaatatgggaagagtttatatttacttcccataatgtatatccacagagacaatcaaagctttgacagtagtattaggggtttacacatgtaaataaaatttatttcatgtatgcctcttaactcttaataagttgacattaattacatattttcatgggcacaagaattgatcaagagattctcagttctcaatatcaggaagaactatgcctggagcatatgcttccatcaccacatcagtgacttcagtcaaaggaaaacaaccacaggattactcaagagcatactaaagattgggcatttcccaagtatggtgagccaagctccctgtgattcttctggcactaaaagggtttactttgaatcaaaggtaaatgaaagcaagcaaaacagaaaggaatcctagcaccaagctccaaggacactgctttgcaggctagcacaactagagttcctcaaggtttgggggaagaccatactccacaaaggcttgggaacattccacatcagtctccacccgccaaataaaatactataaaaccaatctccaggttggtggtgggaggaggcaggagaagaaaaacctgactaccagttcttgttagtatattctctattttatcaccactatgtggtgataatggagattcccatgcatcatccttgaaatgagaagttaagaaattacaaacccaacagaaggtgcatcgctggcctctgtgacatccttatgctacatcctgcatgaatggtaatgtcagctttaactgcttagtcttgtaacaaggataagcgggtttcactggttcctgggaattactacttgcctctaacattgaagagtcttccaactggaaacagatctgattacttttgccagacttaatctctttcttaagcagttaatgagagctttcaataatcttaatgacatcacttcaataaaaatacctagatgttatttccacaggaaataaatgtccacagaccataaacttaatctggttaatagctaacctgggagaaaggtgggagttgggttcagataaagggacactgtagtgtgatggtaaatgaattattcacccctctttctggactgctggcaactctctgagccctcttctgggtttaggtgggaagagaaatgaagtgaaagacaaaggtagctggaagcaggaaacttctccctgtatgggcttcccagctgcagggagtcactgaagggttcagaatataaagaggactcacagcgacaggaaagggaaaatcaagagagaaaagggaactagacagaggatacaaatcaaaggtactatctggggaactccctccctcatgcctttcaaagtagggccaataggaggtaatggctggaggccctataggaagtctccacagtagagaagttacccatatcaaaaaaagctcttacccacttctactctccttcccttttccagcttcttcttttataaggttagaagcacaggagatgcttacagttcttatgactggttcctgaaagtgctgctgaagatcccaatggaaggctgaggccaaagtaaagggaatgttgagtgattgcacggagaggccaaaggaacatgtgatcatccattcaccttgtcactcagtgggctcacggtcagtctccaacagaaactgaatgtgctctgtgtgcctgccttgatccagatacactggagcttttatgatatttttcaaatagaaaaagggcaaaataataagataatcctacattgaggaaaaagaggatttactaaagagcaatgtatttaatgcacagtttctgcagtttttggagttaaggcagctaagatattctacactcttgcctccagaaatctctctcttaataatctcagagagtttccttgtcaagtgtttctaagtcctcagcatccgacaggagaaagaattttcatcactagggttctgcaatacatgatataaaatctacgattctgtgactttcctggtgaagcatattggttatgaaagtagaaaatcttatcaaaacaagatttattgcaaaaaacaagatgaaaagcatttaccacatttttaaagctctaccccctggatcaatgatctagagagatttataaaatttcacaagttcaaaatgaccaaaaagctttgaagctcctcttccctagatagatattttttatctcaaaaattgcacttgatgtttgctctaacctgtaagagactgtctatcatattaggagctattccctagaaaaagcattgcccacatgctgttagaggagctctgaaaaagaacacataacctgcacaatggcatataaaaccctgagattctggccacaacagcctagaaaatgtaatgaataccagagcagtgcttcttttacacagtcttttttggtcctattgaatccacaaaattattttcatgtaacattttaaatcacattaagtatgtaagtcaaatgagctctttagcaccttttacataagaaatgatgctataccagtaacagtaacaacccataagtaaaagatacctacggaataaagtcaatttgtgcttatttgggaaatttaaaaactgtaaaaaaagaaaactttgaaccaagtttcttcaaattagactgaattccttcctgttctgttaaaacacaaaagtttttgtcataaaataatagcacttatcgagatgattactaaaaacaaacaaacaaaaacctctaactacagacataagtgaagacacagcgtacttttgcacttctgcttagagaatccctagaatgactccagcagcatgaatggcagaatttaggtcaagaggccaattacccagtgttaccatcaaaggcagggacaagttaccacttctctctgcctgttcctgttttcctttgagagtcactgttacgcaaccacagaagtaactttagaggatgccaaaaaaaaaaaaaaagaaagaaataaaagacattcacaaagtcctggaagcaactatacctctgaaccactaggtcaaaaccatcctaatcatctccacaccccgctgttccactccccgttttcttgctacaaagtgaagtaataggcctaggaattttggtccattgttaatcagtcagtttctaagtagcacaggcagactgatagttccccaatcagccaagaatagattcaaagcatcttaaacagagactaacctggaggtgactggtgctggggctcagctgtggtcttccctggccccaagctcttttccaaagtttccccaggcaccaaccgaggttggcctgctctgaggaaggccgggctggctcctttggtctccgtgacctttgcagaggatggtggctccaaggtgtcagcagagacgcacccagagaagacacggctctttctacaaggagagtcattaagagcagcttccctctcaccaggcaatgcagggagccggaggatcctgtgatgctgctgagggctggggagccttggagacagaggcgagggaacaggtgacgtctgtttgtgtgtgctggactgcgaggctgaattattaaacaccttgccaagagctgccggtgctggtggggatggcttcttcttatcacctctgggttgtgaggagtcaggacctactttgtggggcagatccagaaacaaggacttgtggccaccaaggggcaacccggctctcctcttgtttctcgtttctgggcgagtgtgagggacactcgtgtggacagggaagcccagtcttttcccctcaggggcttcatctaacttctcactctctatcaccttcagggggaccttgttcacggccccctcggcactggccgacacactagaaatggaggctgtttccccggctggcgactgcgatgacctatccccttgccgctccttgccctgccgcctggagccatgagccccagcctcagctcccgggagggtgagcaagtcggctttgggtacaaactcagcgtgggctgctgggcgaatggcaatcgtctccttacccttagaatgcgttttaactactctttgtacctgggaggacaggtcctgaactttggccaccactttggagacaggtttctgcttgcaagtccgcttagccggcttctccatctcatccttttctgcctctggatgcttctcagggtcctggtgactttcagacaaacctgtttgctgatgctccagcccgctcggcggcctccgaatgccatcccctcctgcctctgtggagctgcagtcagggggcagcacttctcttccaagcccagtgtccttgaaagccgtctcaaagctcccaaagccaaggtctgtgtctggcgtcttgggaatatctggggggcagctctctctcctctgcagggagcaggcaagtgccccattcgggagcagatttcctttctcctctagtacccaaaggttaggccttgttctagaaagaggaagggagtggctggaacagatcttgtccttgcccatcagaggagctgattctcggcctccacgcccttttcttttggtcctcttctgtggaagggccccaaagctctctctccttccactagacctccgaggctttttgttcccgtgggtgctcctcttattgagagggcccacggggagctctccctgccagtcaccagcactctggaaacagtcatcctcgggggccaggctcacggacagctcttgcagcttcccctcctggttccccatcgtgatccccaggatgtggtctgagctcaggagattggttagcagtctctccctctctgttgtgagtttgtacagctcagttagaatgtctttcgtgggagtctgcttgaaaaatatgtcgcctggatgttcgtccggctcctggctgaggctgatgatgtctgactcctccctgacttggtagcagttatgaaaacctttattggatctgtctagagttacagtgcccttgtatgaaaatcctctgacttccccctttggaagacagaagctgatgtagcagagttccgtaatgggcttatgcaattggagggtacaatgagtgccttccattatgcctacctaattattcatgccttggagatgccggtttgtggtcaggcttcccaggctccagtggtgaggcatgtgatggtggctatgcagagaaagcagctgacagtcatctccagcaatgagactgcctgttagaggaacaggggaagaaagcagcttgtctaacagagtgcataaatcacacaccaacataaaatcaaagcataaccatgacttatccttcctctgtggctgacctcaacaactcaaggaatcagacaacagccagatttcaatctcttcctcactcccaccctactcctgatcagtagaacttttgtataactgagagatgggaaagtcctctcatttcacccccaggacaaaagttccctttccctacatggggactcactgtgcagcctggatcaggtctctcaacttctctagaccttggtttatgttcttctgtaaaatagagctatcataactcccagaagtccttatctagggggctttgagatccttagaaaacacagccattttcataactcatatttggaatattactttgcaaaggtagatcgatcaagcctttttaccctctaaaaaccaccttcaagatctgagctcaaattatcgattcaacttaaaacacaatgtgaggaaagatcttaggccccaaatttggtgtcaacagtaaaaatttcaatgtaaaagtttaaaatttaaataactcaagtcttaatcaagttttgctgttttcttttttatttattttttgttgttgtattgccttcttttttccttcctgttgtctattcgaagccaaatggaatgacagaggaacagcaaaaaatctataaggaacggctggccctgtacagatttttcaatgatgtcaccacagaaacggctgaaatgtcacataattagtgaaggtggctgcttccttgtgtgatatgagggacctcagaaatgtctctgtggctaccatccccacacacaaactctatatttctagtttcttaagctattgcccagtcttcaagccttccttgcttaaaacaagcaccgcccacaccctgggaatgataacacaataactattcattagcccttgatatctttagtgaattattttcctcaggttttttctaactgcttctaaatagcaaaaaagctacataaaagtatattttgagtgaaggaagagagaaaggaggaagagtctggtaaaagtaactccttgaggaagagagtgataaaatgacagttatgaaaattgcagatatctggtcaaaccagaatgccaggagaccaggagaggccttgcctctttcacaattgtatatggggctgttctcactcaagtagttttttttttttttttttttttttttagatgggttcttgctctgtcgcttaggctggagtacagtggtgcaaacatggctcactgccgtctcaacatcctaggctcaagtgatcctcctgcctcagcctcccgaataggtgggactacaggcacgtgccaccaccacccagctagtttttttgtattttttttttttgtagaaacagccttttgccatgtttcccagggtggtctggaaatcttggactcaagcgatcctcccacttcagcttctcagagtgctgggattataggtgtgagccactgctcccggccgtatttttaaaacttttctaaaatgcttattgctagcattttctaaagatgcacatgtgtagggatacttaataattattggtaaaaactcgctgcatgtgtccaagaactcacttaggaggtagtctcttattgtgtaatttataataatcagtaataaaagcaattgcaaagctgtcaatatccgctgagcactaagcattaggagttcaattaatgaattctcagacaaactgaagggaagcagcagatgagctatgctgagttttggaaaaatagaatgctctcctctctcttcaagcatcattttcctctagctgttctcatctcctcaattcccatggattaggagtagtgtgtgatgttgggggaggagtgttaaaaattttcagaattggctgggtatggtggctcacgcctgtaatcccagcactttgggaggccgaggtgggcagatcaccaggtcaggagatcgacaccagcctggccaacatggtaaaccccgtctctactaaaaatacaaaaattagctgtgtgtggtggtgcatgcctataatcctagctactcaggaggccgaggcacgagaatcccttgaacccaggaggccaaggttgcagtgagctgacatcgcgccactgcactccagcctggtgacagagtgagactccatctcaaaaaaaaaaaaaaaaaattcagaatctgttcaaagtcacagtttatgctgtaatttcaaataggaatatgactgcgtattctattccctaagagagggaatttgtatatactgagcacatatacacttatattttcattttgttatctcatggaatcagtacatctccattttacagatgaggaaactgaaattcagagataaaggaatttgtctaagggaatatggctcagaatatgcaagtttcaaacccagatctctctcactacattgcttcataggtcatgttgctcttcacctactgccttctactaacaaactggttttccatctaatttgaatagaggagttttttttgttgttttctgttttttgtttttttgttaacttggtgttacataatttcttaacaatgtctcacatcttgctattttaacgctcacggaggccaggcgcagcagctcacccctgtaatcccagcacgttgggaggccaaggcgggaggttgcttgagctcaggaatttgagaccagtctggggaacatagtgaaagcttgtttccacaaaaaaagagaaaattagctgggaatgtggtgcaagcctgtactcccagctgctagtgaggctgaggcaaggggattgcctgggaggttgaagctgcagtggactgagattgcgccactgcaccactgtactccagcctaagtgacagagcaagaccctgtctttcaaaaaaaaaaaaaaaaagaaaaagaaagaaacaaaaaccacactcattggagagcttcaacatgtctgatcaggtaaagtgctgctccctaaggtcatcccttaaacaataaaatctagaaaaagggcaccaggagttcactacagctggtataggcagtaaaaactcaatgaagattctaatttagaaataaaagaagagaaggactgacataaaggctatatcctttatgagaattacagacatgtagtgcctgtttacaggattaagtacttttttcccctggtctttataagtcttggttatgtaaatggagaaaatgtcatggttagaactctatatgttagtcacagttgggaaactcaagtcaaggtttagaaaattataacattggattttatagcaataaagccacaatgcaaggcataaagctactattataaaaaaaaagaaaaaaaaaaagaactttacactattgcctcatccacccagaaacttccatacagaatgctcttaccacacttgtggtgcacatgtccggaaccaaagaggagcagaacagaggaagaaaaaagaaatgggagtttgtctcatgatcttgggactacagttcctttgttctgggccctgggaagcagtatgttgtaagaaactttgtactgaactagactaaggagtttcactatcccaggatccataggagccaatgaagaatcctaagctacttacttatacttgttataaaaagattacttcagaagtaaagtagagagtagacaagtagggggtaagactagtggtataaatcacttagaaaggtctttcagtattccagaaagaagcgatagccaaaaccaaagcagtagcaatgtgatggagaagagatggtcaattttaaaagatagatttcaggccaggcatggtgcctcatgactataatcccagcactttgggagcctgaggtgggtggatcacttgagttcaagaccagcctgaccaacatggtaaaaccccatctctactaaaaatacagaaaaaattagacaggcatggtggcacatgcccgtaatcccagttatttgggtggctaaggcataagaattgcttcaacccaggagatctaggctgcagtgagccgagattgtgccactgcactccagcgtgggtgaaagagtgagactctgtctctaaataaataagtaaaaattaaataaaaagatagaattgaaagggtctggtggttaattggatatgcgtgacaggaaagaatttggtttcatgatttcagatgtaggtgactgggtagattgtggtgccattcacaaagataaatgcacgaagaggaataggcttcaggggaagaagatgaattcagttgtggaaatattgaatttgatgtatcggggaataatcaaacaaatatgtccacaacactgctagatgcaaagggatagagaatgagatttaggctaaagttaacacatttagaaggaatcatacagtatataaggtgtttcaattccatgtaagataaagtaagtgcactctatcctagctctcccactgaatgtaacagaaaaaaaacaccaatataaaatgcatggagcagctatttgaacactctaaaagtaaatggtaacaagcaggttgatgaggaagaccaggctttgaagtatcaaccaactgtaaagcagctaactttctcaactttgtccttcagtagcccctaagcctggactcaaatgtgcctgaaacatggcagtgaatatcagcacaaacagaggaagatataggaggagtcctgtaattcagaatcaagaatagaaagaagttttcttgttggcacctaaaactctgagggaggagaacatttctctatgattagaggaactgtagtcccaagatgtatgggggaaaaccctatttctttttctctcactctgttctgcctctcgttgatttcgggtgtgggcagagttgcaggaagtttgcagccaaagagttggagggttagtagtcctagatttctagttagaggactgaaatcagagcctcagagagcccagaagtatgggaaagattatggagaaggatcttagaaagtgacccataaagttgttcatggatacctgaattaaccccagcctgtggattgtggatctgaacttaaacaccatacgaagggctttgaaaaaaaatgaagagataagacaacttcccagggcctaggctggccactgggtggcacatacatgggatggaacactgcaaaagctttgaaaatggaactgacatgaaaaccacaacccacaggaggctcattggaactggaggactgagccaaaccaggttgactagctggttgtttcaacaaaaaaggatcttccctgagcaaatgaacttcaacctcaaccctctagagtgttccatgtcagaagaaggctttagaccagggcaaactcttctctgtgacaacccattagaaagtcagaatgcagtatggaatcatcacacatatttttcatccaagaaaccagaggaaaaagagcagtaagtcctaagagaaaaaaagcaaaaggacaggaaatcactgtgcattggggttaaatacactggcattgcaattccatgctgagttcacaggactatttcaaacagcattgcctcattctacttggactcaaatgcagcggctctgcagaggcacacactaaattatacatcttaatttggcctgtgaagtgacctgctctggttatgttcaaggtaaaagcactttgcttcccagggagtcttcgtgtcttctatttcctctgacaggctccaggctggcattctgtctatgacaacattgcagcagtgatttctcccttgattctttttccaataaacaagtagattacctcactctaccccaaatggaaatatctgttctgcctcatcctaatgagaaatgattgccttttagtagatgctatctattgttcatagcatatttcaccaatgctaaaaataagattcaagaattagttgtcgtcattctgtctgctgacggcagacatcctaattgattttggccttaaaaggccaatgcaaagctttctttgcctagtcattggcacagtctttccctgtgactccatctgagcccaacacggctaagacagattacctgtattccatttctaaactggaaaatttttattagttcagtcaaattcacactctacctttcacaccctcctaagaccaagagactgacttttatgaactcaatcaacaagtttccttgccctgtggcttctactagatttagccattgggaaacagtaacagattggagggcagatggaagagggctcgggacctttatcccctgactccctatctcctgggctatagtttggtagtaggcgtgccctctaatgaagaccacgctcctctggggtagttctcctccagctgcagctgctttctctgagtaccattactgccccctccccttgctcatttagtcctagatggctttgaattctgcctctcctgtgtgattttggacaagttattgcctgcctttctcctttccatccaccctgggatggagtgcagctttttcaaagagtagattaaaaaaacaaaggaaggctgggcgcagtggctcacgcctgtaatcccagcactttgggaggctgaggcgggcggatcacaaggtcaggagatcgagaccaccctggccaacacggtgaaaccccgtctccactaaaaatacaaaatattagccaggtgtggtggcgagcacctgtagtcccagctactcaggaggctgaggcaggagaatggcgtgaacccgggaggtggagcttgcaatgagacgagatcgtgccactgcactccagcctgggtgacagagcaagactccgtctcaaaaaacaaaaaagaaaaaaaaaaaaaggaagttctgcaataggttaatggctcttcttctttccatggagtttttcttctctttgctttcctttttgtttttcttctttctgagatagggtctcgctctgtcacccacgctgcagtgcagtggcgtgatctcagctcactgcaacctccagcttctgggcccaggcaattctcctacctcagctcctccaagtagctgggaaaacaggtacatgccatcatgcccagataatttttgtatattttgtagagacagggttttgccatgttgtgcagcctggtctcaaactcccgagctcaagtgatctgcccaccttagcctcccaaagtgctgggattacaggggtgagccactgaggggtttttctttaaacaacctccacactgtaggagtaagaacgtaggaataataacaaaattactacaatacacagcagaaagagacctataaggtatcaaagaacaaatcagaggagttaaaaaaaaaaaggagagtcaacatcatgtttgtagaatcagaataacacttcaggcagaagaaagcattttaaaatagcccctcattaaaatatgggccttggacaggtagagattaagaaaatgaacttccaagaggaagaaacgtaatacaggactgagaaaacaaggattttaatcaggttggtaggatattaacgctatcttcatagacaaatgactcatgaagccatggatgatttttgaccagggaagcagtatgttcagcactactcttaaagattaagtcaaaagtaatgtcagaacagattggagtagaaagagaacagacagggagtcaagaatgaggagctggggacaacatcaaattctgcaaagaggtcaagaaagaaacaaattaaagtgttacaggccgggcgtggtggctcacgcctgtaatcccagcactttgggaggccaaggcaggcagatcacctgaggtcaggagattgagaccagcctggtcaacatagtgaaaccccatccctactaaaaatacaaaaactagcttggtgtggctaattagctggcacctgtagtaccagctacctaggaaactaaggtgggagaatcgcttgaacccgggaggtggaggttgcagtgagccgagatcacgccactgtactccactccagcctgggtgacagagtgagacactgcttcaaaaaaaagatatgttacagacagttttaggtagcaactttagtagagtgagagaacaccaaactaattatattacaaagagtaagtgagaatgctagtggttaagacaagaaaaatatgagtaataacctgtaccggtatttgctattttggtttcttgtcttgtcttttctttttttttttttgagactgagtttcgctctcgttgcccaggctggagcgcaatggcacaatctcggctcaccgcaacctctgccttctggattcaagcgattctcctgcctcagcctcccgagtagctgggattacaggcacgcaccaccatgcccggctaattttgtatttttagtagagagggggtttctccatgttggtcaggctagtcttgaactcctgacctcaggtgatctgctcatctcggcctcccaaagtgctgggattacaggcgtgagctaccatgcctggctgttttgttttgttttgttttgttttgttttgttttgtttttgagacggagtttcactcttgttgccgaggctggagtacagtggtgagatcttggctcactgcaacctccacctcctgggttcaagtgattctcctgcctcagcctcccaagtagctgggattacaggcagccgccatcatgctcaacaaatttttgtatttttggtagagatggggtttcctcatgttgtccaggctggtctcgaactcctgacctcaggtgatcctcccacctcagcctcccaaattgctgggattacaggcgtaagccactgcgcctggcctgtttttgttttttttgagacatggaaaacagaagtatgttttcagtttgaaaagaaggaagtagcaaggaaggagatattgatgatacagtgaaaaatggtatgaaacatgggaaaaaaggcaccagaggaagaagacatgggctcaaggacacatggggaggaatcagccttgacaagaaggaggatggtttcctactcaaagactaaggaaaaaagattattatgagatagcactgaaattgagagagtttacttattttctcaatgatttttgttttcttcaaaaagtctgtaaatttatgattttctttgcattctaacaatgtcacaagaaggaaagcactaaactagagtttcggaggcaaaattctttcctgtgaaactatgatttgactgtgagaccaccagcataagctatgtcttattttaacatatgggcaaatctctacaaaaatgtagaggacaaatttcagccaatataactattttagaggacgagtttctggccaaagtcacagctggttattaaagggaaaaaaagggctcctttttgtgtacgttttttcattgctgttcattttttgacctacaaaccaacccacacagatacccagatatgttaacaaggtgtgcgcattgaagattctctcaaagacgtcgaggaattctttctttgcctctcccttaccttttcaaagcttaattacataaagaaaaatgagtattagctttccacatgatttccatgaaaattagatattgagatcctcaacacatcactggttttacatcactatctggctaacatcatcatctacaggagatgtatgagtatgcttaggaaataagccctttccccctgatttaatttttaatttttatgggtacatagtaggtatatatacttatggggtacatgaaatattctgatacaggcatatagtgcataataatcacatcagggtaaatggggtatccatcacctcaaacatttatcatttctttgcattacaaacattccagctatactgttttagttatttttaaatgtacaacaaattattgttgactgtaatcaccctgttgtacaatcaaatactagttcttatgaattctatctaactatgtttttgtacccaccgcctgatttaaaaaaagaatctgtagataggagattcctactcgttgaacatttaaggctttaccaacaatggtgacagcacagcatctcgctaaaggtgggcttagtacattttactttgtagttagtaagacaaagagagcttccttttcaaatatcgggagtatcttttttagatatgtgaacacattctgtggagtttgcttttatgagaactttatatcaggaacaatggttgcatatgttacatcaaatttgcattttctgattaaggaagctgctcttgaacaatggctttccaattagagagcacaaggggtttaagtaggtttttctttcttttttttgagacggagtctcgctctgtcacccaggctggagtgcagtggcgcgatctcggctcactgcaagctccgcctcccgggttcacgccattctcttgcctcagcctcccgagtagctgggaatacaggcgcccgccaccacgcccggctaatttttttgtatttttagtagagacggggtttcactgtgttagccaggatggtctcaatcttcttacctgatgatccgcctgcctcggcctcccaaagtgctgggattacaggtgtgagccaccgcacctggccggtttttctttttaacaggcaactgcaaagagacgattgtaaccccattttatagaggattgaggatgcaggcagggtgctttgatggtactctcatttttaaaggtctgccacacagtacagctctcaaggaggaaggtggggaccatgggggctctccaagacaaagctgatctgccatctctcccacttccctgatagccacatctgttgacagaaaacctattttttggttgttgttgttaaaatgtctgttcatttataaacctagtaacatggaaggaaaacctattttaattatctcacattatgtgtgtttcgattttataaaatactggaaatctttttataaatcacagtaatatgacatctgtttaaaacgtccacaaaagaagttctttggtttgaacttccatttgagccaaaccaccatcatgtgaggcagacatagcagatgcggttattgtcactgtatacccaaggaggctaaaggagacaagaaatttcaaagcgacttgcccctggtcaaacaactagtgagcaatggaactggactcaaatccaggtttctggactctccgtatgctgctgtttccactaccctagtaccactggcactcactttttctttttctttttttttttttaaagaaagaccaatgaaacaaagtgccatttttaaaaagcccaaaatttaaaaatgtattgcgggataggattttaaaaatgtattgctggataggacttaaaatacaatatagtactatatgcagtgaagcaagtggactcaaagccactactttgtaaagatttctcatttaaatataattttattaaatcttgaagtagataccttctaagaaaaaattcatatcccatcaaatactcagaatcctacaagagatcatataggcaacagtttcacaggtgtgtttgcttcctttttgctttgttgctgttgttcagggagagatactggtattagagttttacaaactcttctgtttaccatgaggatcaaggaaggccctcttcatcttaatccagcgttatttcacgaaatccatcctaagagttagttattttgaaatgcacttcgtaaaataccagtgaccatatatatagactgcttaaacagaaagatctacccagggtagaaagggctgtgtaacccagcaagggaagcactgggccatgagttggaggcatgtatcccaatccaacaagggcaactggactcaccactgctgtatgccaagctcatgtgtttcttagtagactaatcaaggggcaggaagatagcaatttgtggacaagcagtaaaaatctagtaaaaattaaatatttaggtgaggtaatgaaatgagtagattcatacttggttaagaaggagaaagaaagaggagaggagagagatgacattagccaatgatatggtttggctgtgtccccacccaaatctcaccttgaattgtaataatccccacgtgtcatgggcaggccaggtggggataactgaatcatggtggcggttttcccaatactgttctcatggtaatgagtaagtctcatgagatctgatggttttataaatggaagttcccctgtacaaggtctgttgcctgctaccatgtaagatgtgcctttacttctcctttgccttcaccatgattgtgaagcctccccagccgtgtggaactgtgagtccattaaacttttttcccttataaattacccagcctggggtatgtatttattagcagtatgacaacagactaatacagccaacatttcatgaggtcttaaccagtgctaggcctttggctaaatgtacaccatgcctcattcatttacagttgacctttgaccaaagcaggggttggggtgctgactccctgcctgcacagtcaaaaatgtatgtataacttttggttccccaaaagctttactgttaatagcctactgttgaccataagtcttactgataacataaacagttgattaacacatatttgtatgttatatgtattagatgctgtattcttctaataaagtaagctagagaaaagaagatgtcattaagaaaatcacaaggaagggaaaacatatttattctttattaagtggaagtggataatcctaaaggtctttatccttattgtcttcacattcagtaggctgaggaggagaaggaagaggaggggtcttgctgtctcagggacgacagaggcagaagaagtgaaggagaagggagggaggagagacaggcacacttggtataacttttattgaaaaaaattcacgtaaaaatggatccactaagatcaaacccgtgttattcatgggccaactgtaattctcatagtcctatgagtgggtactaataattcttccattttacccatgagaaatcatgtaagcttagggaggttaagtaacttgtccgaagtcacagagttattcagtcacagaattggaacttgaatccaggactattttaaaagtctctctgagtaaaagtgacaaaatactgcatttcttaaaacttcagggagaaataatgaatctgttatgggaggccatcagggggcctctaatataaggattattttgcttctcttcagaaaaatatggttaacagattgtgtttattaagcaattaacactatgatctatgtgccccttgatcagaatataaattaatccatctagaagcaaggacaaaaaacacataatgtttgcaaaattcctgttaggaattcctctttgtcctgaaagtatgttagtgctcatggtttaaggtttctgtcagagcctagagaagaacttgtcccacaataccccagagagagtgacaaaggttaaaactggacatcaccattaagtttgcctcaagtcaagtaaaagaattgtgactgaatttcagtttctgccacaggggatatactaaaaagggtcaaagtgtcaaagtttgacgtggtcctctttgtgattaggaggttggctgtggctgtggacagttggtatctgctcaagcatttaaaccaaccccaactttggcacaaggctgcaggttctaaaggtaatatctaaaccagatctaactagccgctattccttgatattggaatttaaaataattaaagtctcagtcacaagtgctaagacgagatcctctaggtcacagcagccacagtctgacccaaagggcttagcataaaaagtggtgccgccttgggatgaacaatacacagcttcctcttaataaactgagctgctctgggaactccccatttgattgccactcacaatttcgatactttatacaaaaatctcatatccacaattcctgcagttggagatgtcacgatagttctttcacaccatttacatacaagtttagaagcatttccagatgattccacaaattcattctcaacagtctgttaattgagctcaatagaaaggcaaaaacataaaaaggacattacttattagaatgactggcttgaaaagaataaaggggaatataaatatacatttatgaaactaataaaaaagccaaagctttgttgccctagataacttgctatagcggcctcacgctgcttctagaaatctactatgctcctaggattcaaaacacatcctcaaaacacataaataaaaatcctttgaaaacataaaacagtttaataaaaacaatttctgaatttgacattgctaaaacttcaaatttgattgaaggaataaatatacgcaataaaaaaattcaaacggaattttgagacaaatggctactgttgagattcctaatgggaagaagggtaagtttcttcctcttccaaaaataccagggaatttctgggaattaaagaactctgaacacagttctaacatcaggaagattttacattgtttacggcaaatttcaaagacactttgaaataaaagcaaatatataataagtatagcaaataggtctgtaatgagaaggcgctgggcccggagatccagctttttataaaaagccttttttttttcttttccttttttttttttttttttttggtaatagccttttccaaaaagttgcagtcagcataaattgcaaaataaatctgtgaaccagatgaggccactattgagcatattatttattcttttgtcatcagattaagtaatattttctaaagtagatacatacttgcataacaaatcacttttccagttggatgattctgcagagattaagaggtcaggattaccaagaatatccttctcaaaaagcccaataccatcagaagaaagacgcatttagctgcatttatttaagccaaataaatttatatcaagtctttcttctaaaaaccatgttttgtggaccaatagaactgaatggagaacccagaaataaattcatatatttacaatcaactgatttttgacaagggcaccaagaacatacatcagggaaaggacacccccttcaatatacagtgctgggaaaactggacatccatctgtagaagaaataaactagacttgctatatctcttgacataaacaaaaaatcaactcaagatggattaaagaattaaacgtaagacatgaaactagtagtggaaaacataagggaaacacttcagaactatggactaggcaaagattttatggctaagacctcaaaagcacaggcaacaaaaccaaaaatagacaaatgggactatgttaaactaggaagcttctgcacagcaaagcagagtgaagacacagcctgttgaatgggagaaatatttgtaaacttttcatctgacaagaaacaaacatacagaatatacagggaactcaaacaactcaacaataaaaaaaaaaaaaacccgttgaaaaatgggcaaaggacaagaatatttctcaaaagacatacaaacgcccaacaggtatatgaaaaaatgtttgatgtcactaatcagggaaatgcaaatcaaaaccacaatgagatatcattttaactcagttataatggctaatagcagacaaaaaaataacagatgctactgagaatgcagagaaaagggaactcatacactgttggtggaaatgcaaattagtatagtcattatggatgaagatatctcaaaaaaagaaactaccatatgatctagcaattccaatcccactactaggtatttatccaaaggaaaggaaaccaatataaagaaaatcagtataaaaaagggatacctgcaccctcatgtttactgcatagcaaaagatatggaatcaacctgtgtgtataaacggatgagtggataaagaaaatgtggtatatacacaatgaaatactatctggccataaaaataatgaaatcatgtcatttgcaacaacatggatagaactggaggtcattaaataagccaggcacagaaagacaagtatcgcatgttttcagtcatatgtgggagctaaaaaattgatatcatgtaagtagagagcagaattatagtttccagagactgagaaggggatgtggagagaggggaatgaaaaggggtaggttaatgggtacaaacatacaaatagaagaaacaagttctgatgggcgacagtagagtaactatagttaacagcaacatattgtatattccaaatagctagaagagaagatctgaaatgttcccagcatgtagaaatggtaattgctcaaggagacagctgtcataaatatcctgacttaatcattacacattctatgtatgtaacaaaatgtcaccatgtatcctataaataagtacaaatattatatgtcgattaaaaaaacttgttttggaacattaaatgtttcaggaaatgccaacatttataatataagtaacttcagggcatggaaatttaattccagcaatggttcttggaatttaattattaatggaggaaaaatgaactatgggtttttttttaaatcttaatgttgggaggtaggatacaacatttccctatttcttttcttcagtcttaatttccttcccagacccaaaatctcattactgcagctacagttagttcttgctcaatctaagatgtttcaaagaaaatatgtaaaatgctattcacaaatgcaattagaaatgtgatcacttatacaactgtgtgtacatatcactaaacgccattataatgtacagccatgaatagtatttcaaacacaatgattcgaattaaagaaatgtgtttttggccgggcgcggtggctcacgcctgtaatcccagcactttgggaggccaaggcgggtggatcacgaggtcaggagattgagatcatcctggctgacacggtgaaaccccgtctctactaaaaatacaaaaattagccgggcgtggtggcgggcgcctgtggtcccagctactccggaggctgaggcaggacaatggcgtgaacctggaaggcggagcttgcagtgagccgagatcgcgccactgcactccagactgggtggcagagcgagactccgtctcaaaaaaaaaaaaagaaaagaaagaaatgtgttttctatttaagacacttatggattttatggtattaatgaaaatttgatgtaattactaaagtactaagaggtggaatgggtggacttttgtttcaatgatcaacccacatactaaatggaggttccatgataaagttaagcagagaccattggtatactcagttatctggaggaggaatagcaagacgaaaaaaggtaccacacatgcggtgagagtgttatgtggctcttcatgagtgatgggtacagccatctgcacagggaggagcaacttaatcaccaagggatgggacagaaaggggaagaagtgtaggatactgacactggttatgtggtttgacacagagttggaaattctttatttttcagctcctttaaccccggcaatgtaacttctgcctcataaggttgttaccttcactttatggatcataaatggattcacaagaggttcacgagaaggaagtggcagagttgggcttcaacacaaggtcaatgtagtcccaaagtcaatagtcctctaagtatagcacactgagtagagattaaagactgtcaatattctagcttatcagaaagtgtttttaaaaatagaaaaaaagaaaagagaaagcacaggatttcagtaatgttgcagaaaatatgaaggataatgaatcaaagaatgtgactttaggaagaagagaatagggaagggagtgagagggaggcaactgttagaaagcatgcagtaagcacaagattgatcttgccagaggttttctaatacaagggcaataccatataacccacagaacaatgacggagcagctgaagaacctcataataaagttgttgtatatcatggtgacccctgtgcctgaccccaatctgagatatccagtctacttctttgtgaaactgatgaataaggaatcctttataggtttattacacaactagataggcagggagacagttttgagattggaagtacaaggaggaggacataattggttacaagaacctggggaaagagggaaagttgtcagtaaggtggatgaggtgagagagaaagataaagacaatgaagaaaaacagtatctggctcagacagaagaaagaaggtagaagtttctttttcttagtgtttgtaaaaaactttatgagaccacgaaaccaagcagtgctgcttcagggcccaggtgagaaagcatgcttggtgttagagaagggaccattctcccccatgccccatctacttcattccctaagaactcaaaatggtcattggaaaagtctgctgtaaccagcatagcaccattttaatgcagggcaccagaggccagaacaagatgctgtgaggaggaggatagaggaaaatatgattggtccaattggtgagcacaaatgaaacttcaggaaataggccgggcacggtggctcacgcctgtaatcccagcacattgggaggccaaggcgggcggatcacctgaggtcaggagttccagatcagcctggacaacatggtgaaaccctgtctctactaaaaatacaaaaattagccaggcgtggtggcaggtgcctgttatcccaactacttgggaggctgaggcaggagaatcgcttgaacccaggaggtggaggttgcagtgagccgaaattgcgccactgcactccagcctgggcagcaagcctctgtctcaaataaaaaattaaaaaagaaagaaagaaagaaagaaacttcaggaaataaccgaaggagcttttaagaggtcaattaaatcctatgtaaacaggaaagaactaaggttcaatataatatgtattattattattaatgtggcctcactggaacctataaacaacaatttctgggttattaagcttatagaggatgaagaaggagtaagtgacacagaaaaggatataaaaaagaagaagctcaatgaaaaatatcattttcttttcccaaagaaaagaaaagaaaagcaaaaacatccaaatgaaatgggtttctttggaaggtttgctatcattgaacattttcaagtgcatgttgatgactaattgacagaaattctaaggaaattctgtttccacagacctgtaagtccttcttaatacctccccctctcagattccaatccattactagatccgattgattttacttctgtgtgaaagagcatatgcttggatgagttggccttcagaaccgcttccattctgagccagtattttgtgtacattatgttatacaatcttcttgaaaaggcaaagaatgtttgctctcttaagctgtattccataatactccaaatcataaatttttcgtttcaaatacaaagtagaccccaatcatcaacatttttttgattcagttaattagacaattccttagcacacataatttgatccactgatacttaagggatcaatcaagtgtttctagccccaatactagccattatattcttgagagcataggatcatattcagcatatatgatgtagttttccatgttgccagctcccatactgtgaatattaccaacgacaagatccctgtgtaacccatatttagacttatagaatagcgggacaatcagaaatctttccgcatttcacactttagtgtttccaacaagccaagtgcaattcttcaattacatcaggatttctttttcaaatctgggtgccaacccacagggctagatagggaatttgttacactgagaacttttagaaagaatttttcttatcacatctgctttaaatagtaaaactagtttcctttcagaggaggaaacgatttttttttttttagacagggtctcacccaggctggaaggtggagtgcagtggcatgattatggctcactgcagccttgacatccgaggctcaagcaatcctcccacctcaggctcccaagtagctgggactacaggggcataccacaatgctcagctgatttgttttttgtttggttggttggttgtttttgtttgtttgtttttgttcttgttttttacagccagggttttgccatgttgcccaggctggggtcaaattcctaggctcaagtgacccgcctgccttggcctcccaaagtgctaggattacaggcgtaagccaccatgcccaacctgaaggaattattctttaagagctaggatttcaattatggagacttcctaggttatttcaagggaaagaattgacattctggaagaaaacctcctcactcttctaagttttaccatctattttcttctttcactacctctattttgaaagaaattcaagaaggtagggagcccctatttctctatatctcttcccatttcctttgcttttaaataaagaaatgaatcttcaaaaactaagcttagaacactttacacagtgtgggctatatattttctggcctgacaactgctaggtatggcctcagtgaagtcaaaatttagtgcccattaaagcagagaaaactgaaaaacagcactcttcccatcccacacacacacttagaagaacttttcacatggatgccaaaatcatccaagaaattctcacccatatattgttcccttcaaataaagggttctgccccagtcaaatattttttattattgtcaaagttgaactgaggctacaatgcctcaaaattccataatgcctcatactttcttaaggaacctcacatacataattttatttaaataagcaatttatccgaatattgtagcaagatcaatatgtaaagacgtgagacatgtgaattttgctgaagaaagtttgagagaaatagtcggttagagggccccaaagcaaatggtacattttccttttaaaaatcattcctgaggccccctaggtgcagtgtctcatgcctataatcccagcactttgggaggccgaggagggtggatcaagaggtcaggagttcaagaccagcctggccaacatggtgaaaccctgtctcttctaaaaatacaaaagttagctgggcatagtagcacatgcctgtaattccagcactttgggaggccaaggcaggcagatcacaaggtcaggagttcgagaccagcctggccaagatagtaaaaccctgtctctactaaaaatgcaaaaattagccaggcttgttggcaggcacctatagtcccagctacttgggaggctgagacaggagaattgcttgaacccgggaggcaaaggttgcagtgagacaagatcacgccactgcactccagcctgggcgacagagtgagaccctgtctccaaaaaaaaaaaaaaaaaaaaaaatcattcctggagttcccactacttgtcagacattttcctccacactatttcacatggataatttgtctttaagcacctctaaccagcctctttatatttcctttcttctcacttgtaatactttctctttcctgtccctataaaaattcactcaattcactctaaaaatatgactagatataaatcatttcattcttgactatatatgttagccttcacaggaagattatcattttcagggtcaccctgtcggtggagaatgataggttgtgaagtcaattaaaggaatccagcttcacttaaatagaagtattaatatggtcaggggtcttcgcagatggcaaagtcctaatgcttctacctgcagctaagacactgcttaagaacatcaagagtgtttctatgctttggttctcaagcaaaagatgaaggaacagtctatgcctttaaataattaagataattactgctgcttagtgatcactcaccacgtactggccactcttccaagggctttacctgttttaacacattgatttttacagaaaagcctgtgaagtaggtactattattatctccatttacaaggaagaagctgaggcacaggagggtaacttgtccagggtcacacagctagtaagctgctgagctgcaatttgaacccaggtgctttgacccagagccctggctcttgaaattccttacaggactgattggggacaataggtcttattcagaaaacaggcctactcatttactaattcctcttctttaggtcatagaatatggagcactcacaccatgtacaactggtctaagactgatcagtcttcacctgagatggtttctaccagggcagggcaaactaagaaaaaagcagtgtcagaaggcttggactcaagtccagctttgccaattactaacagtactcttgtgcaagtcacttaacctcattgcacctcagtgtcctcatctgtaaaaaggccttttgttctccctacttacagtgcaattccatagtcccccctgcaaagaaatgaaacccactcaccaaattacttttctaggtagacagtaaattcagcgcacaaataggatcagaacccagatttccagagccaaaagagataccacaagacagtaaggggtgaaaacaggcaaaggaaatggtgtaagaaatttagatatgagaaggctgggtgcagtggttcatgcctgtaatcccagcactctgggaggctgaagcgcatggatcacatgaggtcaggagttcgagaccagccagaccaacatggtgaaaccctgtctctattaaaaatacaaaaaaaattagccaggcatggtggtgcatgcctgtaatcccagctacttgggaggctgaggcaggagaattgcttgaacccaggaggcagaggttacagtgagccgagattttgccattggactccagcgtgggcaacgagagcgaaactctgtctcaaaaaagaaaagaaatgtaaatatgaggcgggtacgggcaggaagaagccaatccttcatcaggaatatgaaaactagaaaaaaagcaaatgaagtgtcaaaaataagtaacagcactgaatgtaaaaaaatttaaatgaatgaaaaatgaatgaactaatcaatgcatgttatttccacttctattctagaagaacattcactgttagcttaaatgagacccaggacacagtcaccgcttcactccagcacttccaaggtttttctttctgctttgatccaaacgctatttgcacttaacatgtaccatctgaggaggtgcctttaatcactccctcctggcctgtgtataaaggcaaaaattttcaacttgagactgtcttgggcttttatctgccagtctcaatggtttatgatgtctccatatcctgctctcggtctcaagtctgtttagctacctctgttagattgttttgtccaatcctaaccatgcccatgaacttacacttttggtttccttgaggcctattcctcatagtcttgaaggcaagggtttccctccctccttaacccctagcacagctttaggactatactgcctcggttaaaatcccagctcttccacttagcacattacatagttaagtaatctttgtgagccttaatttctaatccctaaagttagtcaatacctgatagatacactggcattcagaatacagtgactggtacatagtaagtactatataagtaattgctactattatgtgcttcagatcctcattattcaagaatagaatcccaatacaccctgccttctattggcaatgaaccttttgcaatgtattgttcctatttgattaaagcctctctaaagggaagactgtcattgtcaccatctttgtattcccttcagtacataaaacatgacacatattcagtaaatagtggattaaaatgtaattatctaaagatacaaatccaacctgcgtctctgcctgaaaatccaagcatattattatttgtagccagcaataatgattaatgacagcttgatctttactttccaataaacacaacaattaaagtagacaataaaatcataattaggaacaaaattggctttccaccattagaacatatatcaaggagagaaaaatatgaaaagtataaaaattcaataggagaataacagaataaattgataccaaactttccattaaaaatcaaatttaaatggcagtaggaaatgtgaaaagtaaagaaaaaattttttaatgctctcagagactaaacaagggaaaaaaatggatctatgaaatgttgatccatccctgatagaaaaatgaaaggtatgatttcaggattctaacataaactgaaaaaaatatatttttgctcttccttttgcctgaactgccccagaatctttatgactcaatctgggggtacctttagatatctgctcaaatgatgcctcattagaaaggcttccttggtcacccaatttaaaatagtgcctacggccaccgtcactgttgagtccctttccctgaggcatctgtctccatggaacttgtcatctgccacattatatttctattggttacattctgtctcccctacaactatagaatgtaactgtcatgaaaagagttttgttcactgccatgtcctatgtttcagagattaactagaaaatcatgggtgatcaataaaaatctgtccattgagtgaatcacttattaatacaaatattaacaaatatatatggaaagtgtttaaaatagtgcctggcacataatgggcccagttagctatttttaataggaatagaaatagtagcattccttccttgcttctttttgattgattggtaagaaaagtcttctgccttgagtgactagaaaaaagtaggaagccttagataagtaaggagctgggaggcagctttgaaatcaggagcgtaaatacttactttatttaggggacaactggaatttactaatctgctctgtagtacagcatgggcaaagagcagctttagtggaattaacataacaatgtgggaggaaaaacaaggcaggaatcagaaccctgtgggtgaaaacattgcacaggagcccagggccagagcacagcgtgtcagtgaacagaagctgctgccatgatttagtccaccttcttacctagatcagccttcgcttgggcagggtccagatgcggagatgtgaaaaacgtgatgccaccaggcctgtgtaaaaaaaaaaaaaaaaatcaaggctcacctgaagtaatttgcacattaggtgtgtatgtgttactgtgtttcttatatatattaggtggctaatttgaaggggctttcagaaattggggatcacaatgctgaccctttaaggtcttctggagtaagtctagggaacagacgatcctgcctcttccgtgagataaccctaatctcccacctaaactactgcctagcatagggtaaccaaccatgctgggttgcttatgattgaagagtttccaggattcagacatttcagtgctgaaaccagcaaagttgcaggcaagccagtaccagttggccatcctgtatccttgtaagcctgcgtatgctcatctacttagtgttcacactgcaatgagaacaatcatttaaaacaaatctggccacatcgtgcctcagctagtcacacacagccagatcccttcagaggctctcctgctgccttttttttttttttttttttttaagacagagtctcactctggttgcccagactgaagtgcagtggtatgatcacggctcactgcaacctccccctccagggtttcagccattcatcggcctcagcctcctgagtagctgggattacaggccaagtgctaccacgctcagctaattttggtacttttagtaaagagggggcttcaccatgttgtccaggcttgtcttgaactcctgacctcaagtgatccatcacccttggcctcccaaagtgctgggattacaggcatgagccaccatgcccggcctctcctgctcttaaggcagattttagcccttatcatggcctgaaaggctccgtgtggtcaggcccctgttgatttttccagcttaatttttgcatcacatcacagccagtttccttttgggggctcacatgaggccactcccttctgctataagggttccttgcatgatgttcctcctgcatggaatatgatacccatctctctttcacatagttttacttctaaaaatttttcagatcattttactcctaaactgttttcatatagtagctccataactgtcactttttctgagatgtctctcctgcctcttccgagcagacaaatcctcttccatgccctttgggagctgcagccactgctgttggcgcccaccatatactcttgacatgacctccacacacaaaagctgctcgctgcaaacacctgtgactttctgcccgatggctttcttactgcacgtggaagcaccttccccagcacacaggatggtatcagatgagattagagcaacaggtaggagtcagatcagggaggctttcggggctgtgatatagagtccaaattttattctaagttcaatggaaagttattggagagttttgcattgcggagagacaagatctgattatattcttttcttttcttttttctttcttttttttttttttttttgagatggagtttccctctcgttgctcaggctggagtgcaatggcgtgatctcagctcactgcaacctctgcctctcaggttaaagcgattctccttcctcagcctcctgagtagctgggattacagatgcctgccaccatgcctggctaattttttgtatttttagtagagacagggtttcaccatgttagccaggctgctctcgaactcctgacctcaggtgatctacctgcctcggcctcccaaagtgctgggattacaggcataagccaccatacccggcccgtgattatattcttaaaaggtcactcagactgctctatggaaaatagattgtgaaagggtacatctggaagcagagagaagccagtcgggaggttagtgtagtaggcaagattatttttctagctggaatcattggaagtacaactgaaagcataataaaaagtggctttttgtaacagcagcaggagccttcaagtctagggtcagctaagaaagcaacttacctgagaggtcctctgaagtctggctcattcaagtgggttcttagaaatgggtgaaaatcttactcttctcatgcataaagcagggataatgaaaaaaatgtttgagaaacactgttctagaatctcaggcaggctgtaggctcatttttagggccatccattgctcttaagctggcctggaatggcccctggcctccttgactaatcgccctcaacctgccctatcacctcacatttcttcagctctgtacagacactgactaattcacctactcagtgggaagatggtccagtcagataaaatggtctattttcaagtcagcctctctaaacacagatactcctgtttggacaccctcgaagtatacaagtgaaggaaggaagtgttaggagttacatagggtgatgcagataccatgcatctcagcgggatctctccttccaggtttcatgcttctctttctgcccaggcgccatctacctctcactggatgaattcctatgtgttcaacagagcccaaccacaaatgtcacccaccctggaaatccaggaggaaaaaaatttattcctttttttgagcatctaaagcactctgtaaaaatagcattaacagctactattacttgagcacttgtggcagggattatgataaacattttgcctgaattatttcatttaatttccccattgttaaccactttttacagacaggaaactggggcttagagcagcgaaggggcttgctcagtgtcagaaaactaataaatgatagaatgaagattcaataccaagcagcctcttcccctctagaccttaaatacactgtcctatgacttacaccactgtgttataatcagcagctcacgtgcctctttcctctattacttccaccataaatgaccaaggcctgctgtcatgaaaagagaatgacttacaatcaaaccctgttgtataactttaggatattacttactgagactcagcttcctcatttataaaatggagaaaacaaatgcctacctaataggttgttgtcaagataaaattagatagaacttttaatgcacttaccacagtaagtggcacataaatgctcattcaattaaacaagtattatttgagggcctgtggaatgccagtccttacgatggacactgaggatagagaaataccaaaatgtctctcatggagctaacacatgagaaatttaatatatgttgattgctcttacttcttgaggacagagactgtgtgttactcaacatcgaatttctatagtttaatcatgcctagcaccgagtagacactcaataacatttcagtgaattagtaataatgggttacataatttcatacacccaaagtagtggggattatgaatgactgtttcaaattggtgggttgacatttatcaaacagtaggaagaattgaaagcaaagtacaaaaatagcatacccagaggttgtatgcactaaattcatttaagcatagagttactactaaataactttcaaaatattctcaggacaaaatggaatgttataacctgaataatatagaaataataacacatctaatactcaggaggtggggagaaagggtggggaggatgtttcaaaagtgttactctttcaagaaagaaagtcaactgatactgtctaaagaagacactaatttataaaaacagcaatataatcacaatgactttaacttcatgatttttttttggccagagaaacttttaaaaaatatatgtatctcaaggatatatcttgaaataaggtaaacttattggtttcaccattcttttagtttcaattcagtttctttttattgcttgaaattcaagaaaaactaatgtattgttttcgttataaacagcatctctattcatttttataaaagcatttctacctaaacatccatgcaggtagattcatagagagacagacagacagctgtctgaaatgatattacctaaggttaacaattggaatgatagtatttgagatttttaaaatttatctttgtaacgtaatgccttatatgaattcttgaaaccaacatacatcattttttaaaaaagtatttcctactctttctaaagaaaaaatatggcaagatatagttaattcttcctggtaggaatatagatcattgttattttcttcttttccacatttcaaaaatgattttaaaaaatttatatcagactgtacatccataagtaaatttcttcccttttaatttagatcttttttttttcttttttttttttccctgagacagaatcgcactccttcttcacccaggctgaaatgcagtggcacagtctcagctcactgcaacctccgcctcccgggttcaagcaattcttgtgcctcagcctctcaagcagctgggattacaggcgggcgccaccacactcagctaattttcatatttttagtagagatgggtttacgccatgttggccaggctggtctcaaactcctgacctcaagtgatctgcccacctcggcctcccaaaatgctgggattacaggtaagaaccaccgcgcccagctataatttagacctttttttacttatgttgcaaatcgtatccttaaaattacttgagaatccagtttacaaagcggaaaagactgtattcttttgaatgctctttataaatgtaatccacttaagtaaatgaagagctgatgaatatgctacgttatatgtgtgcttatattgttaaaggtttttacatgaagagagattatgaaaagcttcacgataccagactatgtctaatggggtcattaagttcaggattttcaaactaagtggatttccttgtccttcttgtttaaagcatgattattgaaggttagcatctgcttgctgtggtaagtgacaaactagagtaatccagttctcaaccccaagttaagaataataatttaaaatacacaacagttgcatagtcgtaatgttttggaggttgtcaataaaatacctgagccacctgtttaggtgccatggcaatatcttttttcatttatttgggaaaagtttgggagaaaagttggtagtcctattggttccttaaaataattcaaggaatctattgtttcctgtagaaattcagtattctctgggttttgtattattatattaatattatagaaggtgttttctatttgagtaaaacactgcctgtgaaaattttaattaccgttaattccaatttagagaatagaaagtaaatttttgtttcctttactttttagagaagtcttatttcaatgaaaatttgtagtaatttttttttaataaagtaagaattttttttttttttttttttttacacagagtttcactcttgttgcccaggctggagtgcagtggcatgatcttggctcactgcaacctctgccttccaggttcaagcgattctcctgcctcagcctcccagttagctgggattacaggcacgtgccaccacacccagctaattttgtatttttagtagagacagggtttcaccatgttggccaggctggtctcgaactcctgacctcaggtgatcctctcacctcggcctcccaaagagctgggattataggcatgagcccctgtgcctagtcaggaagaagttttttataaattatattcatgaaatgctttcatgcctattgaattctataaaaatgcaggttggaatttctagtctacaagttaataatagtcatagggaaaatgatggaatcttagatttaaagaaaacttagacattattcatctcatcccacctccttcccaaggctgggccctctccttcaatgcaacctttgtgaatggttctccagtctcaccttgagctcttctattgcaaagagttctgtgccccaaaaggaagcctcatggccttccagacagctctaaatgtaaaaaaaaaaaaaaacctctccttttctaagtcaaaatctatttccattcatttattttcattggtgcttttttctcacttccagagctgcagtgagtatatccaactcctttcctgcccaatggccctttaaacacctgaccaccaatcatgtttcctgagacactttctcatgctgagtaaaccatcccaggcccttcagcaagccctcaaatagaaaagtgtttagcctcgaaaatcctacatatttctgactgttctctagtttatcagtgaccctgctacaaaacagtgctgacagttttaaatgttcctcaaaaaaaaaaataaataaaagtgaaagttttgccaggatcacaaatacagttcttgcaactgtcactttaaattattagaaaaacacatcttaaatagccagattctatcttactatctcttcacctatcttaagtttcagtttcctcttcatcatgtttttctttctttgcaaatttgaagaccattcttaagtttctcttggttgcgagcaaatgaaactgattttggctaccttaagcaaaaagagaagcatattgaatctcatgaaattcatgggcagtttcataaaatcagagaaagagtagaaaggccaagagttggaagaagagaaagcagaggcttccagtggcctcctgcatcaggctcacaggtatctccctggagcacttctcttactgcgacttaactccagtgactcttagtcaatgcagtccttcaacccaaaactccagttttgggaagacattccatctggcccaccttggatcagatttccagatccctggtttaactagtcctgcccaggaacagagtcatgtctacagggaccccacacctatatattggggtcattcccagagaaaagaaagtagatatgaacaaggcagacatccccaattgctgtacttctaaaaaaagtaatattcagaaacattgatattaatctatgtttacttttatttctccttgtattttcccctttgcttaacccccactaaggcaggtattagaattggaattcattgcatcaggagaggtatgtggtaaggagaaaaagataaatagcctgtgattattcctagattgtgtttctcaaaattctaaactcttagaacacagggaatttcttgaagcatgtaaaaaggagtgagatttatcaacacaaagagtcctgaagaaccctgaaaaaagaattatctccccagggctgttgggaaaggaaggcaagaggcttgtggatgctggaggaaggacacccaggccctacttcctggcagtgtccccagagaggtcacaagaccctagagccctgcgtgctatatctaggtaagtaggaaccataggaaatgtcaacaaaagaattctgtgggtcaagctccaatgggacacagccacagatgactacaactgagagagctgggagagcagaattactgggtgctacagagtaacccatgcattctgatgcctcaatgaccagaaggtccctcttcccatgccgtggcactgtcagtcccctggagccttgacacaactctggggggtggtataatactgagaaggactgaggttaagttttccacttttccagaaagaaaaggcttgaaatagaaatgaacatggtttctaaaaaataaagagataattttcatatacctgtctttgtagatggagactcttatctgcaaggcttgaatgaaaatgacaggagtaaaatgaaaattgagtagttctgcttccttgctctctgtgaatttggcccatctttttcaagcagctggatttgtacatcatgcactgattgaaatgctaaaagccctctttttaaaaagtcaactttggccgggcacggtggctcatgcctgtaatcccagcactttgggaggccgaggcgggcagatcacaaggtcaggagttcgagaccagcctggccaagatggtgaaaccctgtctctactaaaaatgcaaaaaaaaaaaatcagccaggtgtggtggcgcacgcctgtgatcccagctactcaggaagctgaggcaggagaattgcttgaacccaggaggcagaggttgcgttgagccaagatcatgctgctgcactccagcctgggcgacagagggagactttgtctcaaaaaaaaagtcgagttagcatttttttcaaatcctcttgttattcatgaccttagtgttcctgaagctgttgccctgggtccatgtcatacctttctatacatagtcttagactatatctccctttcctctcttctgtgtgtttcttccttcttagatgtggttcaggcagaaggtccctgcacaactactttggagtcttcagctgtgtctcccttttgctttatcatttgccaagtttgtgactatgatatcagaattttgtttttcttaataaattctgttaagttcctgaatttagctaatggtgctgcaatgtggcagctattgatacattttaacaaaagatgaagaaaaaaaaaaagtcaagacctagaaactgagtctgagagttgactgccttcattttcgtaggctgcagggctgttacttcctaaagagaagttgagtgatgtaatgaacaaagcccagggagtcaggtgacctggatctattcttggctgtgccactgaccgtgtgtgaccttgggcaagtcacttttaatctcccatctcagttttctccactgtataactagaaaaatatcttgtcacttaacaagagaaaatttgggcataagagttactgttgcttgctgcttgaaaaaactttaaggtttttttgtttcaacctaccacagtcttccttaagatggtgtggtatcatggagtttcagttcttcaaatatcgtgaaaattagaattaaattgttttcggaggttaaaattaggaccagttgaaaataaatcagagggtgatcttaacacaaggccagtacctccattatgtgtgatatgttttattcatatttacttggggttggatgggtaggaaagagggaaagcccggctagtctcctgtaagtagaaggtagaggatgctacaatagaaatagaaataaagagagatggggacattggcaaacaaggacaggactgatgccaattctgtagatgaaatccattttctgcagaactgtgggcttttaaaaaattatttgcaaagctctccaaatatgagctaggcttagaaaattttctgaagtggctgccttcatctaaaaagagaaaggagaataattctaatgcctaaaaaagcaactcttgcttttcactatattcatacccagcatactgaactttatttatggtttatcctgctttgtaagtttaaaacatgataaagccaggaacgttctctgtggcttaggcttactagagcacagatagaaaatagaatgcaagcctagcaggtacatactatccagattccattgagagccggccccgtaagcaaacacattaatctctatgatccttgatttcctcatctgtaggagaggtacagcatcatttacctacttcacagaggaaccagcagattacataaccaaagaaaggaatttaagtcttctgtattaagccaaggatggacacagagaaaacatacaactcatgctcacttgagtcttgcccttggaatagactttgaggacatttttctcagaatagagcatcaacaaactacatggactccctggtgtaacggtgagaaatcagctttattaggacgcacagggctgagaccatagggatgtgctttcggtcagtgaagagatcaaagcagcaatgcacactttgaaaatggtaacaaagattttactcactgcctcttggggactgaacacatttaaacataacaatgtttgctcagttgtaattctcacagaggaggaagaccattaaacactgtggcagcaattcttcccaaatactttctccattctggctcagcaatccttacaatagcaaagagcaaaaaacctgctctttaatacttagaagtattatcttctctactgagaagagactgaaaagagttcttgaaactctaaagaagagattttagagaacatgagacagtgctacagtcacctgtgtgctgctcaaaagatggcattcattcaatttcatttgaatttcatttgtgcaaatattaaggttttggaaaccatgaggtttcccaaaattactatggtgagtgaatcaccagggagggcttctcctaataagtagacagttctctttctctttgagaggtccatatttttccttatgtttcacggaggacatcattggagaaagcacctaggcctagatgaatgtggatagatactcacgtgggggaaaaatggaaaaacagggcaactatggctaaaggagtgtttaacaacaagcactgctgtctgacgcatttctagactactagtcttcagatcgtatcatgttctctgagcttctttaacaaaaacatgaactagagcactcatactggaaggcctgtggcaggggtgtgagtactagtatcctggcagcagcatcataaaggtgtctcctgccccacttttacagccttgtctatcctcccagtcagcattctggcggtccctgctacttctccattaatgcccagatcctgatgacaaacatgaacgttaaaaagtcctggctggccggacgtggtaactcacgcctgtaatcccagcactttggaaggccgaggcaggcagatcacaaggtcaggagatcaagaccatcctggctaacacggtgaaaccccatctctactaaaaatacaaaaaattagccaggcgtggtggtgggcacctgtagacccagctattcaggaggctgaagcaggagaatggcgtgaacccgggaggcggagcttgcagtgtgttgagaccgtgccactgcactccagcctgggcaacagagcgagactccatctcaaaaaaaaaaaaaaagtcctggctacctccaaaatattttgcccaatagcctgtcacgtggaagaccacagtaaaaaagcgtttcatttgaaaggtgttcatcattagcagtgacctatgacactttagaaggaagagataggcatagttcgaataagatggaacataaaacaagtcagtatcaagttaaggaaataggaggtgtgttggttaaagaaaaaaaaacttaactagtagtctgcttcctagagagatgcattacagagatcatggtcatttcaggccagtggggaggtaaggatgtccacaaggaggaccaactctcttctctctccctcatcctcaaacatgcactaaggcagtatttgctgaaagcgtagataagcacagaaatccaggttactctgggagattgtttacttttagccagggaacttgagaaacataagtgagagggaatgctccatttctcagacccttgcttttatgcgctgacaaggtaaagaggtttgtttccttctttacatctccccgctttagtaattactattttgcagagcatggggttgatgctttgtcagcacttcagcacagacactaaatacagagatgcttcagttccttcacagtgccagcctgttggtgcaagcttatatttgctgcaggagaatacaattcccatggtttagcgtctctgcaagatcaggcaaatcagattaacagctgtaattctgtcaacacaggctgggacctgttgagaattaagctgatatttaagacagagactatgtacatctaaaaataatagctactcttaaaaccaggtcccaaaaagagattatgaatagcccctaaacgtggtcatactaccaaccagtagcatcactgcaagatatgaaatatccattatgaacttttacactgatacgaataaagttttaataagaaaaccattaaaggcaagatcatctaaagcacaccacagcttgggatggtgtgcatgaatccaaaactttaacgtaaaactagactttgaggcatggtatatgagataggagagaagcatttctcaattttctatcaaggatatttaccatcatcacatcaagttccagtctgtccccattcctcttcctctgggaacagctccaccaattttatgtctggaaagggaggatgaccaggatatgagacctacccttagacaatcataggtcctatgggaccccattcccttggccaaagcatttggtctaggcagggttaagcctgtgacaaaggcttcatcaatcacagtcaatgcattgaacactcagtgagaaagaagcagtctagaatagggccagaggcctggaaatcttctctaaagctgcatctttaacgtatctcaactaagaatcggctaagtacttgtgaaggctggtgagagaaatgcctgtccaaacacaggtggcttcaatagtggcacccctctaagatgtagtgctataaggaacctgaagactaccataccccatttgcatcagctctgacacctaaaaaggataaagacaatggaaaaaaatgcataatttttaggaacgagactggcctttattatccttcttgactagtattattaatagcagttactataaattccccacttatgtgccagaaactactgagtattttacctatattatctcgtttaatcctcacaccttctcctaagagacaggtagtattatccctattttacagacgagaaattaaaattaaagaggcaagcaacttgcaaaaatcactgagctagtcagtggctggtccaggatttgaacctatgtctgacaggtttatgagtttagccattacaatatactgtctcactactcttctccattgtttccctccattgaggccattgcttctttgttcctgcaatatgtctaactattcattggtcctgctcctggactgtaacacagttgagagaaaggagactagtgtttagatatctgatcaagaagacccgagacctcattgattcattgtggaagcaacatcttccacaacgacagttaatctggtatgcaattctcagctatactgttttccctcccaaaaaagggttaataagtctgtgatccaagagatttgcagtaagccctagaaacagctaagcaacggctgttgaatcccattggtgtgcctataagatgctacctggtgtagagaacagaatataattctctctcctaggaatttagatgcgcccctccgcccccctgccaatacacacgcaagggggcatagcagatgatggcacatgtcccatatgcaaacatgaatagtaaacatgctttagtacagctggagctactgtagcagaaagtcaggttgtctgctactccacctggtcttcttaaaggattgggtctggacattcacctctcagtgactgccactccccatatatatcacaggttcaggctctgcattcagcccattcggagtgtgtgagtgctaacatggaactctccaggagacagcaagcagaaatgtggatgattaaaataaagggttttctttggcaatctcaattgcaaatgaggataaggaaaatcctcccagctcacactctgctcccagctacttgttcttgagttaaatgagggcttggctctggcctcagggggcaagagcactgttcgttatttggtggtgggggagggggttgggggatccgtcagcacttacatgcctttagagaatctgcctttacagaacttgaagagctctgatggaggaacagagatgctgtggtggtagtggccttggaggtggtggtagtggcaatggtgatgatgatgatgatgaaagaagaagaaaacggtgatggtaaatgtcatctataaacacaagcaaaaagcagcaacagatacctttctagtcattgccaaccatagtcatgaagctgcttctgttcccaatgcaatcccattgtggtgctccccctctgcgctaaacacatccagcttcaaaaaaaaaaaaaaaaaaaaaaaaaagctctgcatctctccgtcccccgccctcccgccctcccgccctccacctttcctgtgccaagctgggaatgagactgcactggcgggtcaagggggctgggacctgagagtcaacgacaggagttctgtagtgaggagcgttgggatgacccggagggcccaccaacgtacttgggagcagcttggtgggggagctggaggaaccgacacagaaggggaggaagataagctggcggggtaaatagacttgatgcctcattccaagaaccctgaaagccacgggggaaggcggagcaggcagcctttggtcgggaagaagagacgggcagatggccagcagaacagacaagactctctttacctgaccaatactcgggaggctggtcccgagtcccagctactcgggaggctgaggcaggaggattgcttacggcaacagccgtggcggctgcagcctcgaaggatgctgcgctccagtccagagccaaagcccaaaggggcagctgcgccgacctcc

SEQ ID NO: 619 - DNA, 16666 bp, Homo sapiens
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcccctcctcgaccgactccgaatctcggctcttatagacagaaatacagcctcagcgttaggggttaaaatccccctcttaaacggtccgagggcagagaggtgaccaccgataggtaattggatctcctgctggaaagagcaaatctgagcggtgtgcgcgtctgtttatgttccccttcgagatggtgccaggacacgaactgattaaaacaatctattgtgttaagtgggtcactagggttttaagctgtcccagggaccccagagtagtggcttccttctggctgtacacacaagttaaataaatagcgtagaagaggttaagataaccccattctagggtgaggagtcctctttcatccctagggcttccccctccccttttctctttttttggaaggagggggagcatgagagtcttgagggggggatgtacttttcaaagcaaggagggaaagatcttaagaaaactatatattctcactgccccccaagccaagtctataacagtaggtgatttgattactatctctggataaatggcactgtcaaattgttaatattaactatttcagggatttttagcagggtagtggcagtatgtgtgcgtgtgtgtgtgtgtgtctgtgtgtgtgtgtttaacctccaggtcattgtaggaattagagtcttttgtaaactttgtaatttcacaggtttcctattttcttaaaagttcatttttagtgaaatgttttggtaacccacgctctgtaggaaatccaggttggctaatgcggtctttatgtgagtagttacacagggaaggataaaaaccttttatgtcctacatctctgaatgagggctgcctaccctgtctttgaaactaagccgaagatgccttcagtctgaatggtcaagtattaaaagtgataaaatgcaaagaaatttcatgccgcagacacctcccccaagaactgcttgttgacagcaaagctgtggaacatgttccacaacagagagtaaaggacagccaggaaatataaaccttttatgtaaaggaaaggcaggtgggggacagtggttaggggaggtgactgcagcctctaaccaaaaggcaaccatcaggcaagtgctaccagcccgtgtcttcgatctgcaaggaattttctttagttttaacatatgctcttagaaattcaaagtacaacaggaattcctgggacaagagaaatctttttattcacatgtgaacatgaagatacaaaatagataattattttatttatagcactcttcaaattgtattgcattagaaaacatatccattgacccactgttaaggacagcactgggtgtcaataggacagtggttaaggacctgtgtttggggctagatagaattgggtttaaactgctggctgggctaggcacagtggctcacaccggtaatcccagcactttgggaggccaaggaggacggatcacctgaggtcgggagttcgacaccagcctgaccaacatggaaaaatcccgtctctactaaaaacacaaaattagccaggcatggtggtgcatgcctgcaatcccagctacttgggaggctgaggcaggagaattgcttgaaaccgggaggcggaggttgtggtgagcccagatagcgccattgcattccagcctgggcaacacgagtgaaaactccgtcaaaaaaacaaaacaaaacaaacaaacaaaaaaatgctggctttcccacttatgagctgtgtgaccttggacaaatttccaacttttctgagtgtagattccctgattggtaaaaggaagatgatattatctacctcatattttgttatgaaaaataaatgataaaattgggtcagaaatcagcataatgcctggcacagtaagggcttcaaaataaaaggtagctcttattattagtaatggtgttaggaaaagtagcaatgttatacagaaccaggatatatcacagggcagttctgaaattaaatcctgaatcctggccgggtgaggtggctcacgcttgtaatcctaagcactttcggagactgaggcaggcggatcacgaggtcaggagtttgagaccagcctggccaagacactgaaatcccgtctctactaaaaatacaaaaattagctgggtgtggtggcaggcgcctataatctcagctacttgggaggctgaggcaggagaatcacttgagcccaggaggcggaggttgcagtgagctgatatcgtgccagtgcactccagcctgggtgacatctcttaaaaaaaaaaatcctgaataccacactacgcagtgactaacacatctttcactacagaacagaacctgtaacttggccgtctctcagcagtgctgctcagtgaacatttaataatttattactttctaactcgtttcttgttgacctcaagaattgtacatagtcattaactttcctaagaaaatctttgacaaacatagagctcctgagatatttcacaaccaggtggtctcctccctgtcctatgcaatgttgggccccagcctgatttagccgacctggtcttcagacttgagaggctgtttagggttcttacaacacaaaggggatgagactttatcctctacctgtctgccaacaagggattcttcttatctccttggtgcaacttgtctgaaaaagaaagtcaacacaattatcttcttaaaagttaaagatcaaattaaaaataagctatagttttcccaaagatttagacctgagaaaaaggaatagatctttctaaaacctggcctgcacttagagcatttgtagtcacttccactatttcttatgctgagagaataatttgatgtcatgcctattgaatgtctttctaaagcttgattcatcaggaggaactgaccagaagtccatgcacagacatttggctttcactgtaattcctactcaaaactccctttcactgattatgagcaggttgcttagctaaaatgagaaatacagcaagaagagggatggaaagagctggcttaaactttcccaaagacatcatgaacactgggaacaggtcatacatataccatttttatttctcagtcctcagtattagaatattgtgttcctagaggctttgtgaaaattggaatacattgccatgacctgcacaggatagaggtggttaatatggcttaccttgcttgtagatgtttactcttgatccctaagggaaactggaaggaaagcatgctgtagagaggacctgctttgagagtatgtgtcctctgggacaagtggaatgaaagagaggatagaggcaaagagaaaaaaaggtggagatggggtgagacttgctggtggacagttgcaaagaaaactcatgatgagaataacatcacatttcttgaagaagctgaactgcattgatgggaagttgaggcagagtttgaaaagaagatatactgtctgcaaaaaagaatcaacggagatgtcaggtatcttgatgcaccctgagtctatgagatgcagcttaatttaatttagtgatatgagtaggccatttcataagtggtggaaattaccataaagtgtttgcagctaatgacggcgcatgaatgatgtcataggaacctaagtctggatgagctatggattgaatttttactatgggacacccttctacatgttgctgtggaaaagaattgtcctcaagaaatgtacatcttctgcatttcctctacatctctgatatttacaaagtgcacattatttggtgatactacaactgggatttcaagtgcacatcactactatttccttcactgaagaatcaagagcagtctgggggtggggagagcttgagtgattgacaaggatgtggcagagccctggttccactatgaattatagttcttaccctgcttactgtcactcatgtagagcagctagtgtgcctcagagcactgctgttctctgagaagctgaggtctcgattgacattcttgaagttggtgtttacttctctctgaataaacaaaggttggcaactcagacatcttacaataagtactaaagatttttgaagaataggtttttaaaaaatgaaaaaacatttcactttccatagctaataaatcttattttgaggaaaatgtacttttctttaaaaaaaaaaaaaaagcctgtctgtcactctagaccctttggcttagaaggtaggcacactcacatagaaacagaaagtctgtccaaattaaaactgaaaaccacagttgactaattttgaatttatagctctgctgttggcttctgcgatagtattaatttcaatggcttcaattagaaaatgaaacccatagcattccatatgagaacaggtaaaaagtcagggacatttggagttttccaagaaaaagaaagacaagtcttaggaagctctctaggatggaaggaatttgccacactgagagttagacatccaaaggatagcaattggctcttctgctcatgggcactggtgaaggcattttaaaatgcgaagaatggtacctctgtaaatcaatgaggttcataataatcatgcatttaccaaatttttataagcacctgccttgtgccaggcactgagggtaaggtgatgaataagccctcatcaactgtcagactagatatttactcaataacagatgtgaaaatgccaagaaggaaaagttgagtataaagaaagccttaagttggttcagagaaataaaattgcatttttcggatagatgtttatggaatcggccttatgaggtaaacttgtcctatgcagtgaacatacattcccagttagtctcagattggcctctgtgatgacaaactcagagggtcctggtctaggaggggtgaatttgtctggaggccattttcaggaggtatggaggaagactggggcataggcctggggccatcccatgtactcctcctctgaaatggggagcaactgaattgtgttttattttagatcttcgtccaacttgaataccagaaattcgtgaaaccttctcaaattcacactatattttgagaccaggagaaggctccttgagaaattgccacactgtcttatcctagtctctggaaaaattcagtcctgtattataactgggcgtttctcataagtgctttttttttttctttttctttttataatactttaagttctgggatacatgtgcagaatgtgcaggtttgttacataggtatacacgtgccatggtggtttgctgcacccatcaacccatcatctacattaggtatttctcctaatgctaccccttccctagccccccacccctcgacaggccccagtgtttgatgttcccctccctgtgtccatgtgttctcattgttcaactcccacttatgagtgagagcatgcggtgtttggttttctgttcctgtgttagtttgctgagaatgatggtttttggcttcatccacgtccctgcaaaggacatgaactcatcctttttatggctgcatagtattccatggtgtatatgtgccacatttgctttatccagtctatcattgatgagcacttgggttggctccaagtctttgctattatgactagtactgcgataaacatgtgtatatgtgtctttatattagaatgatttataatcctttaggtctatacccagtaataggattcctgggtcaaatggtatttctggttctagatccttgaggaattgccacactgtcttccacaacggttgaactaatttacactcccaccaacagtgtaaaagcattcctatttctccacatcctctccaacatctgttgtttcctgactctttaatgacggccattctaactggcgtgaaatggtatctcattgtggttttgatttgcatttctctaatgaccaccgatgatgagctttttctcatatgtttgctggccccataaatgtcttcttttgagaaatgtctgttcatatcctttgcccactttttgatggggttgtttgcttttttcttgtaaatttgtttgagttcctggtagattctggatattagccctttgtcagatggatagactgcaaaaattttctcccattctgtaggttgcctgttcactctgatggtagtttcttttgccatgcagaagctgtttagtttaattagatccaatttgtcagttttggcttttgttgccattgcttttggtgttttagtcatgaagtctttgcccatgcctatgtcctgaattgtattgccctggttttcttctaggatttttatggttttaggtcttacatttaagtctttaatccatcttgaattaatttttgtataaggtgtagggaaagggtccagtttcagttttctgcgtatggctagccggttttcccaacgttatttattaaatagggaatcctttccccattgcttgtttttgtcaggtttgtcaaagatcagacggttgtagatgtgtggtgttatttctgaggcctctgttctgttccattggtctgtatatctgctttgataccagtaccgtgctgttttggttactgtagccttgtagtacagtttgaagtcaggtagcgtgatgctttgttctttttgcttaggattgtcttggctatatgggctcttttttggttctatatgaaatttaaagtagttttttcatagacatctatagaactctccaccccaaatcaacagaatatacattcttctcagtatcgcatcgcacttattctaaaatgaccacataattagaagtaaaacactcctcagcaaatgcaaaaaacagaaatcctaacagtctgtcagaccccagtgcaatcaaattagaactcaggattaagaaacttactgaaaaccacacaactgcatggaaactgaacaacctgctcctgaatgactactgggtaaataacaaaattaaggcagaaataaataggttctttgaaagaaatgagaacaaagacacaatataccagaatctctgggacacagctaaagcagtgtttagagggaaattgatagcactaaatgcccacaggagaaagcgggacagatctaaaatcgacaccctaatatcacaattaaaagaactagagaaacaagagcaaacaaattcaaaagctagcagaagacaagaaataactaagatcagagcagaactgaaggagatagagacacaaaaaacccttcaaaaaatcaatgaacccaggagctgttttttttttttttttgaaaagattaatgaaatagactgctagccaaactaataaaggagaaaagagagaagaatcaaatagacaatagacacaataaaaagtgataaaggggatatcaccactgatcccacagaaatacaaactaccatcagagaatactataaacacctctacgcaaataaactagaaaattgggaagaaatggatacattcctgaacgcatacaccctcccaagactaaaccaggaagaagttgaatccctgaatagaccaatagcaagttctgaaattgaggcagtaattagtagcctaccaaccaaaaaaagcccaggaccagacagattcacagccgaagtctaccagaggtacaaagaggagctagtaccattccttctgaaactattccaaacaatagaaaaagaaggactcctccctaactcattttatgaggccagcatcatcctgataccaaaacctggcagagacacaacataaaaaaggaaattcaggccaatatccctgatgaacattgatgtgaaaatcctcaataaaatactggcagcacatcaaaaagcttacctgccatgatcaagttggcttcatccctgggatgcaaggctggttcaacatacgcaaatcaataaacgtaatcaatcacatacacagaaccaatgacaaaaaccacatgattatctcaatagatgcagaaaaggccttcgataaaattcaacaccccttcaatgctaagaactctcaataaactaggtattgatgaaacatatctcaaaataataagagttatttatgacaaacccacagccagtatcatactgaatgggcaaaagctggaagcattccctttgaaaaccgccacaaggatgacttctctcaccactcctattcaacatactattggaagttctggccagggcaagcaggcaagacaaataaataaagggtattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataatagacaaacagccaaatcatgagtgaactcccattcacaagtgctacaaagaataaaatacctaggaatccaacttacaagggatgtgaaggacctcttcaaggagaactacagaccactgctcaaggtaataagagaggacacaaacaaatggaaaaacattccatgctcatggataggaagaatcaatattatgaaaatggccatactgcccaaaacaatttatagattcaatgccatccccatcaagctaccactgacttccttcacagaattagaaaaaaactactttaaatttcatatggaactgaaaaaagagccggtatagccaagacgatcctaagcaaaaagaaaaaagctggaagcatcatgctacctgacttcaaactatactacaaggctacagtaacaaaaacagcatggtatagtataagtgcttttttttaaaagacaaagtaaagtaatttttttgttgttggggtaaaacaaaagctctgcataaagagcagggatgttgtaacatacactgaccaaaggtgggaaacctacagttggagcagaagctgaatgtcacattatcagctccgaacttataatggtctaaaagtactaggttaatgttggaaagatggtgccatttaaagatatcttaaattcaatatttaattattttaatttgacattatcctagagttgaatggtgtttacttaccatgtgctgttcattagaaaatctagatcctacactgcctttgcgcaaggtagttgctctaataataccaacctgtccagttttggtgggagaaataatgttactgttaagttgcacttagtggttattatgtgtaatactggtattccaaagagagaaggaaaatgtttgctacacagctgtgttcttaggttcagaaaaccacaggagtgggacaggagaaccttcaggattcaggtccgattgttgtgatggccgcaggagggagactgtgaatttgaaactgcatccattgaaaagaaaatccctccacactttaataattctctccgtgccccatggcagcaagtgcttataggccttgctactcaaagcttaataaaaaggcagacctgctgaatcataatctgcatcttaacaatatccccagatattgtctgcactttctttttttttttctttctttctttcttcttttttttgagacagagtctcgctcagtcacccaggctggagtgcagtggcgcgatctcggctcactgcaagctctgactcccgggttcacgccattctcctgccttagactcccgagtagctggcactacaggcgcccgccactacgcccggctaatttttttgtatttttagtagagatggggtttcaccgtgttagccaggatggtctcgatctcctgacctcgtgatccgccgcccatctgggcctcccaaagtgctgggattacaggcgtgagccactgcgcccggccaattgtctgcactttcaagtctaagaagcactgtcccaggaggaaaatctttttagtctgtctgaggcttctctcttgcactctcctttttaaaaatatgctgctccttctccacctttccctcttcttccgccttttctgtctgcctttactacctcccctgaacattcaacttgtagaagagttcccctttctctgaattgcattcttcacttcattcattcttttctctctctgtctatggtttcctattttttgtcggttttccctcacctcacctccttgttattttttgccattgttcacatatcactgccctttcagacccatatctagcttctgacccatccactaatccattgccactaatttattcagcatgcccatgccatttattaatgtaaatatttgcacatacttgttctatcatgcccatttttctaccttttaaattgtatatacacagacacatgtgaatgacatatttcactatttaaaaggtagaaaaatgtatatcgtggtacaaagtgatacattgagtatctgtgcccagtttcaagatgagaataagtgagaggtgaagcctcatgagtcacgtcacctacacgctactgtctttcattccatctgcagtactgccacacatttggttagttctccaattgctgtcacattgacatcgagttggatctgaacagcgtacctggggagacgaagtattggtatctttgcttaaatggagtgatttactgagagacaaagtgacatctttaagatcagatagcaagttactgcaccaggagcgcgacctttcctgttttgttgttttccctctgtcaaatgccttctggtctccatgaatctctccttccacatatgataaaaatgcaaagtctcataagcattcacagctcaggaagcctcaggctagttggggagaaaagactgggaggtttccggaggaatgaagtcctctgagcagagaggttaattcatcttgctgtaaaacaaaatagaaaataagttcccctcaataagtgaacgtaatacaaagacaaatgtggttggtgccagaggccaggaagaagttcttgtgagaataggtgcagagaagagctaggccctggctgagtttaaaccttgacttagtcactgtgggactctgggtgagttactccatggattgatggctgggtcatggagataatagtacctaattcatacaggtactgtgagaagtaaatggaatatttcacgttaagtgtttaacggtgcgtttaaatgctaggtgctattattattaatttttaaattaactttgccatgttttgtgtcttcccctctctgtgcttcctttctttagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 620 - DNA, 16666 bp, Homo sapiens; identical to SEQ ID NO: 619

SEQ ID NO: 621 - DNA, 16666 bp, Homo sapiens; identical to SEQ ID NO: 619

SEQ ID NO: 622 - DNA, 22692 bp, Homo sapiens
ggacacactaaggaaactgcatttccagagagagacacaccacgtaggactgaaaatggttactctaaggggattcgtgacaggtaagcatgggggagcggggagggtagccagaatgtggggctttaagtgctcaaagaggatttgaaaaatcaaaggagcaatattaaaggatgcaaaccactcagcccattcacattagagggacatgatatagatggttggggacagaaggaaggtcagaaagactgactgttcacctcatgaaaatcagggagtgaatgtgagactccttacttactgagtgtggttgtcagttctgcagggctcccaaactttctccatctgtgttagccaggcctttggaaatccttaattagaatgtaaactccatcatagcaactatttttgtgtacttcgttcattgcagaatccacagacctatgtaagtgcccatttgtaggaagaaggcaataaaaaattgctgagtaaatgtggttctgctagtggcaattctgccttatgctcttgatagcctcgatcagggaaagcactgtagaccagttgaatcgtttgcttctttgtttctttaatatgctagtttaagctacagactctcaatgcccatcccaggaaagtgggccagggtttagactgtgtgtacaagagtcagtaagacctgattcattcccagctatgcttcttctctacctggccaaacttttagatctcatgtctcttcatctttaagaggttgataataattgtccattaccccatgtgtttgtcgaggatcacatgaatcatgtatatgaagcacttggatgtctgacggtatcctaatgttgctactgaatgttactgcatcatttatttactcttaggattgtactgaagaacagatgcttagtgaagtttaatttcttttcaattaaatgctaagccttaggccatctgttgttattgctgttccaattttttggtctcagaacctctttatattcttaaaaattgttaaggactccaaagaacttttgtttctataggatatacctagatatttaccatattcaaagtgaaaactgagattaaaatatatttattcattcctttcaaaataaaatgataaatgcgtgacgtgttaactatattttccacacacaaaaaaaaattgtgagaccaatggcattgttttacattttagtactttagggcttaatggaagatggcagaattctctcctgcttttgcagtcaccttttctgatgcattactctattgaagtgtaagaagaaaatctgacctcatacagatatgatgctagaaaaaggagtattcttgtagcctttgaaataattgtggatattctttgaaattacaacacaaactcaacaagtagcagtttcttaaagatgagttgcaatgtgaaaactttttttttttttttttttttgagacggagtcttgctctgtcgcccaggctggagtgcagtgacatgatctcagctcactgcaacctctgcctcctgggttcaagcgattcttctgcctcagcctccctagtagctgggactacaggtgcgtgccaccacgcccagctaattttcgtattcttagtagagatggggctttaccatgttggtcaggctggtctcaaactcctgacctcaagtaattcaccctcctcggcctttcaaagtgctgagattacaggcgtgagccaccatgcccgtcctgcaatgtgaaatttgaaatcatatgaatgaactttccaaattctgtgacattaaaatccattggtctacattgaactttgagtggatcttttacccatgcaggattttgtaacattacatactggtcatttgcaaaatattggtttatgaattaagaagctcttctaaatttattcccctgtacatttgttatagaataagagtgaaaaagtaaaataacatgcaagatgtcaccattgagggaggctagctgaagtgtgtgcagcaccttaaccatatatattattttgcaatttcttgtgaatctgaaattagttcaaaattaaaagtaaacaaaacaaaaccagtaaacaacatggtaatttttgctttcaatcttcatatatattccaaatagcttttaaacatttaagacctattatatgtaagcagatatttaccatatgtgtggcttttcctttattcttgaagttccaattttccctcttaggaagaattttctttaatactccacagaacaggactactggccacagattctcatagttcagagaatgtcttcatttcaccttctttcctgaaagatattttccctggatacggaatctgagttgattgggagtgatggcaagtggtgtaaaaaacaatctaagttgacagtggtacaaaatctttgaagtgctaaaagaactgtctttgtttctgatgagaaatctgtggtcatttgatctctatcttttcgtgtatagattgcactttaacaatctcatcaaagaaatatccctctactttgagtcacaaagatattgacacaggatttcttttgttatttctaaagtttcatttttgacaagtacagctagagtatttctctatggtataaaatatgaatcattttccagctgaggtagaggaattgggggttaacctcacttgccagaggtcatacatcaagcccaggctccttgaaaacattgctatccagcgaatgaattcctcatcagcattccctatctcataggccttccatctcagatttcagaaaccatgaggaacagaatggccccagagaatccccagccagaccctttcatcaataggaattattccaacatgaaggtgataccaccacaggatccagctagtcccagtgagtatcatccttctttgtcctctttccttttctactgccccattctcatgcagccctacaattgcattttgcatttgttttaaggcagctattgattgttttaaaaaatctattcaaaaagtcttcccatcataaaaggagaaatacatttcaaatcaaatgggcctttggcccatggttgattcaaattatgagagataagctaagaatataatatatagagcaagtgagcatgtttttctaggagaaaagatctgaaacatagacagatagaaactgagaaatctccttttccaaggcaggtatattgtggcccaatatggaaggaaaatgaaaacaaacaaacaaacaaaagctcattattcagagtagtattgtatacatgtataagaagattcatttatataaggtggatcttagtgaattgttctgaaatatatatttgttatttgatattttatcctggagatttcccaaacattgtttgtatacaatgtttacctttaaaaatatgtaaaactgtataaaaatctggtttttctatacactaataagcaatcagaaaagaaaattataaaaataactccatttacaatagcatcaaaaataattaggtactaagaaataaacttaactaaggatgtgaaagacttgtccattgaaaactataaaatgttgctgaaataaagacacaaatggaaaaacactccatgtgcataaatgggaaggcttaatattattattattattattattattttttgagacagtcttgctctgtcacccaggctggcagtgcagtgtcacaatcttggctcattgcaaactccacctcccgggttcaagtgattcttctgcctcagcctcccaggtagctgggactacaggcatgcaccaccatgcccggcaaatttttttttttttttttttttttttgtatttttagtagagatggggtttcaccatattggccaggctggtctcaaactcctgacctttagggttttgtttgtttgtttgtttttgagatggagtttccgctcttgttgcccaggctggagtgcaatggtgcgatctcagctcactgcaacctccgtctcccaggttcaagcaattctcctgcctcagcctcccgagtagctgggattacaggcatgtggcaccatgcctggctaatttttttgtatttttagtagagaaggggtttcaccgtgttagccaggatggtctaggatctcctgacctctggtgatccacctgccttggcctctcaaagtactgggattataggcgtgagccaccacacccggctgactcctgaccttgtgatccgcctgcctctgcttcccaaagtcctgggattacaggcatgagccacctcgcctggccagctttaatatttttattattattgttgtttttttttttttttttttttaaagacggagtttcgctcttgttgcccaggctggagtgcaatggagcgatctcggatcactgcaacctacgcctcccaggatcaagcgattctcctgcctcagcctcccaaatagctgggattacaggcaggcgctaccacacccggctaatttttgtatttttagtagagacagggtttcaccatgttgatcaggctagatgggctcgaactcctgaccttgggtgatccacgcgcctcggccttccaaagtgctgggattacaggcatgagccaccactgcccggccaggcttaatattattaatgtgtcaatactacctaagcaatttaaagatttaatgcaatccctataaaaatcccaatggtgctttttgcagaaactaaaaaaagtctatccaaaaatttatataaagtctcaaggaatcccaaatagccaaaataatgttgaaaaagatgaacagatgaacaaagctggaggcctcatattacacaatctcaacatttattacaaattacagtaatcaaagagtgtggtgctggcataaagacagatatatagaccaatagaagagagcaaagtccagaaatacgtccttgcacatatagtcaacaagggtgctaaggccattcaattgggagaggacagtctctgaaacaaatggtgttgggaaaactgaatatccacatgtgaaagaatgatgctggatccttaccttaccacatgcaaaaattaaaatggatcaagtcctaaacacaaaagctaaaactgcaaagctcatagaaaaaacatagaggaaaagctttatgacatttgatttagcaatggtttcttggatatgacaccaaaagcacaggcaacaaaataaaaatagataaattagactacattaaaaataaaaacttgtatgatcaaaggacacaatcaaaagagtgaaatggggccgggcatggtggctcatgcctgtaatcccagcactttgcaaggccgagatgcgtggatcacctgaggtcaggagttctagagcagcctggccaacatggtgaaaccctgtctctactaaaaatacaaaaattagccaggcgtggtggcaggcgcctgtaatctcagctacttgggaggctgcggtgggagaatcgcttgaacttgggagacagagactgcagcagagatcacgccactgcactccagcttggatgacagagagagagagactctgtctcaaaaaagaaaaaaaaaagtaaaatggcaaactatgtagtgggagaaaatatttgcaaagcatttatctaataaggggttaatagctataatatatacaaaactagaactcaacaacaataaaaaaaatccaattaaaaatgggcaaaaacctgaggtcaggagttcaagatcagcctgaccaacatggagaaaccctgtctctactaaaaatacaaaattagctgggtgtggtggtgcatgcctgtaatcccagctactcgggaggctgaggcaggagaatcacttgaacccaggaggcagaggttgcagtgagccgagatcacgccattgcactccagcctgggcaacaagagcaaaactccatctcaaaaaaaaaaaaaaaaaaaaaaaaggcaaaaaacttgaatagatctttctccaaagaagatatacaaatggacaaatccatgaaagatgctcagcaacattaattattaggggaaagaaaatcaaaaccatacccgttaggatgacaactatcaaagaaacagaaaagaacaagtgtcggtgaggatggggagaaatcagaatgtttgcaggaatgtaaaatggcactgccgctgtgaaaaacagtatgatggtacctcaaaaattaaaaatagacttaccagttcaagaccagcctaggcaatatagtgagaccccatcttataaaataaatatatttactgaaaggtatgaaaagctctttccagaagcattcagggcagcagtctccaacctttttggcaccagggactggtttgtggaagacagtttttccacggactggttggggggctgattttgggatgatccaaggacattacatttattgcacattttatttctattattattacattgtaatatataatgaaataattatgcaactcaccataatgtagaatcagtaggagacctgagcttgttttcctgtaacaagatgctcccatctgtggctgatgggagacagtgacagatcaccaggcattagattctcataatgagcatgcaacttagatccctcacctgtgcagtgcacaataggattcatgctcctatgagaatctaatgctaccagctgatctgacaggaggcggagctctggcaataatgtgagctatggggagcgactgtaaatacagataaagcttcgctgactcattcgctgctcacctcctgctgtgcggaccagttcctaacaggccatggacccataccagtttgtgacccaggggattagggaccccggatttaggagatgtggaagaatatgttacacaccaaatagaattgttatttcttacatctcacacagtacatggctaagaattttgcagaaaatccccagcagaatggtaatgtggaaatagaggctgcaggaacatggtgagaactgagagaacagaagaaagttcagaaaattgatatgtttgaagaccaaatgtatgtacaaattagtcattgctgtttcacacaatttcagtggttttaaaaaaataagtatttgttgttgtttatcaatctacaagccaggccaggtgcagtagctcacgcctgtaatctcggcactttgggaggccgaggcaggcggatcacagggtcaagagatcgagatcatcctggccaacatggtgagaccccccatctctactaaaaatacaaaaattagctgagcgtggtggcgtgtgcctgtagtcccagctactcaggaggctgtggcaggagaatctcttaaacctgggagacagagattgcagtgagccaagatcgtgccactgcactccagcctggcgacagagcgagactccatttcaaaaaaaaaaaaaagaaaaagaaaaaaatctacaagccagctggccatttctgatcttggctggcatctcttgcatgcttgagggttgactagctgtaaactcatttaaagtagcctatgttgcagaatatgagctcttttcgctatagtctctcatcctctagaaggctagtccaggcttggagggagagagtgggtgagacagagagagggcaggcatgagagcgagcacagaagcatgcacggcctcttgagtggggggcatcatcacttcagagtgtcactctctggctcaattaagaaggtgtggctaggttgggcacagtgcctcatgcctgtaatcccagcactttgggagaccgaggtgggtggatcatttgagggcaggagtttgagaccagtgtggctgatatggtgaaaccccatctctaataaaagtaaaaaaattagccagcatggtggtgagcgcctgtagtctcagctacttgggaggctgaggcaggagaatcgcttgaacctgtggagtggaggttgcagtgagctgagattgagccattgcactctagcctgggtgttccggtgagactctgtctcaaacattaaaaaaaaagtgtggttgaaaataaatgaaataaatgtaggacaaagagaaaaggaagaggaaaataaggtctcattgtacataatctgtgaagtgactcaataaaataaagctattcttttttattttataaatgtgaaaactgagaccctccacgtaaacagacatttatgttttgccaaattttctccttttttttttcctttttgtggagaatgggggtctcactatgttgtccaggctggtcttgactcccaaggtcaagcagaatgctttgcctccctaaatgctgaaattactgatgtcatcaacagtgcccaaaccaaattttctaataataatggacatatgtgttccctgagattatggtggtttggatggtccagtggctaaagtgtgtctatttccaaactcaatttatttatttatttatttctgagatggagccttgctctttcacccaggctggagtgcagtagtgtgatctcgactcaccgcaacctctgcctcctgagttcaagtgattcccctgcctcagcctaccgagtagctgggattacaggtgtgcgccaccatgcccagctaatttttgtatttttagtagagacaggatttcaccatgttggtcaggctggtctgaaatgcctgaccttgtgatctagccgcctcagcctcccaaagtgctgggattacaggcatgagccaccacgcctgaccttccaaactcaaatttatattctcattgttctttctttctctttctttttctttctttctctttctttctttttctttctttctttctttctttctttctttctttctttttctctttctttctttccttttctttttttgagacaggtttcactctgttatccaagctggagtgcagtggcacggtctcggcttactgcagcctcaacctcccaggttcaactgatcctcccacctcagcctcccgagtagctgcgactacaggtgcgtgccactacaccctcttttgtagagacgagatttcaccatgtggtccagactgttctcaaactcctaagacagagcaagaccttgtctctaaaaataataataaaataaattaagataatggagataaaacaaaagtacttgatgaccatttctatcagttccattctatctcctctctgaggttgtcattacaataggtttctcataatttttgtagtctactctctatatattcataaattataattttgagttataaagaaaagtgtgttgtgtatatatgtatgtgtgtatgtatatatatatatatctacatgtacatatatatatatatatatatatatatatatatatttttttttttttaaatggagtctcactttttctcccaggctggagtgcagtggcgtggtcttggctcactgcaacctccacctcctgggttcaagcgattctcctgcctcagcctcctgagtagctgggattacaggtgtgtgccaccacaccagctaattttttgtatttttagtagagacagggtttcaccatgttgaccaggctggtcttgaactcgtgacctcaagtgatccgcccgcctgccttggcctcccaaagtgctgggattacaagcatgagccaccacacctggccagaaaagtatattttacatgtcacattaccctgctgaaaagacttcattttcagtgacatactctaaactaaaataaaattaatttacaaaagagaggtatgttgtgcatacaatgtgccacacattattgtagtgtattaatgcctttacattaataaatcaatataattagtgccttacattaatacattcatgtaataaatttacaaaccctattataaagtaggtattcatttttgtgtgtgtggcaaggtctcattctgttgcccaggctggagtgcactggcataatctcagctcactgcaacttctgcctcctggggttcaagcgattctcctacctcagccttttgagtagctgggattacaggtgcttgccaccatatctggctaatttttgtatttttggtagagacagggtttcaccatgttggccaggctggtctcaaacttctgacttcaagcgatccgctcgccttggcctcccaaagtgctgggaatacaggcgtgagccaccacacctggccaaaagtacgtactcttaacattccccctaccccactttttttttttttttttttttttgagacagagtttcactcttgttgcccaggctggagtgcaatggcgcaatcttggctcactgcaacctcctgcctcccaggttcaagtgattctcctgcctcagcctccagagtagctgggattacaggcatgcgccaccatacctggctaattttgtatttttagtagagatggggtttctccatgttcgtcaggctgatctcgaactcctgacctcaggtgatccacccacctcagcctcccgaagtgctgggattacaggtgtgagccaccacatctggccacattccccttttatgcttgatgaaactgaggtgggctgggtgtggtggcttccacctataattctagcactttgggaggctgaggtgcggaggatcacttgagccaaggagtttgagattagccttagcaacatagcaagaccccatctgtatttaaaaaattaaaaaattttaaaaaagaaattgaggtgaagagtttgggtaataggttcataatcacattcctagaaaagtatagttttatctttttttttttttttttaaacagagtctcgctctgttgcccaggctggagggcaggggcgcgatctcggctcactgcaagttctgcctcccaggttcatgccattctcctgcctcagcctcctgagtagctgggactgcaggcacccgccaccacacccagctattttttttttttttgtatttttagtagatatggggtttcaccatgttagacaggatggtcttgttctcctgacctcgtgatccacctgccttggcctcccaaagtgctggaattaaaggcgtgagccaccgtgcccggcctgaaaagtactgttttaaaagcaaaatttctactgttgaacatatatcaagattactgcttaaaacttttccacagtgcaacttgcatattatggactccttgagctaattgaataagaaatagatcaaagttttcagaagacagcatgtatacatttaaatttctggaagaaatgcgccccacatggatgtgagttttcctgggatattattggtagttgtccatatatgatgtttccttgacttaatcttccttatcacattgccctaaaaaataacttaggtctgcatttataattattgaagtatttgtaacacaaagtatatcctggttccaggctttttatttttccttatctgataccaaactgatctatagtttctttaattttcattttagccaaggctgactgaaaatactttcaagtatataatgtttatttccacagtactctgatgaatagggtatcctttgtgactcctcagccacatattttaatcagcatcagtgattccagcgtgtccttgataccacaggaccaagccagttccagcaagctctgttcccctgtgccctctctgtagtctgtatctcttctcagggagcccacttgtccttccctaagagggtagttaccaggtgtgaatataacagacctaaatctaggactaaatatcttgtatgttggtcatatttgattgagatgggttttcctggaatagaatcaggaggctgatgagctgggtatggtggtgcacatttagtcccagctactgtgaaggctgaggcaggaggatcccttgagcccaggtgttagacaccagcctgggcaacatagcgagacctcgtgatctgcccgccttggcatcccaaagtgctgggattacaggcatgagccaccgcacctggccttccaaaatcaaatttatattttctttctttctttctttttcttttcttttcttttcttttttttttttttttttttttttttgagacaggtttcactctgttatccaagctggagtgcagtggcgcggtctcagcttactgcagcctcaacctcccaggttcaactgattctcccacctcagcctcccgagtagctgggaatacaggtgcgtgccactacacccttttttgtagagacgggatttcaccatgtttttgtagagacgggatttcaccatgtggtccagactggtctcgaactcctaagacagagcaagaccttatcttactgcaacctccgcctcccgtgttcaagtgattcccctgcctcagcctaccgagtagctgggattacaggcatgcaccaccatgcccagctaatttttgtatttttagtagagatggagtttcaccatgttggtcaggctggtctcgaacacctgacctcatctctaaaaataataataaaataaataaacaaaataaattaagataatggaggtaaaacaaaagtactcaaccatttctatcagttccattctactgcctctctgaggttgtcattgcaataggttctcataatttttgtagtctactctctatatattcataaatcataattttgagttataaagaaaagtgtgtgtgtgtgtgtgtgtgtgtgtgtatatatatatattttttttttttttttgagatgaagtctcactttttcgcccaggttggagtgcagtggtgcggacttgactcaccgcaacctccgcctcctgggttcaagtgattctcctgcatcagcctcctgagtagctgggattacaggtgtgtgccaccacacctggctaattttttgtatttttagtagagacagtcctatttcaagggacattttgaataaatacagaagcaagctaatgattcaaaagtatgtaaaaagctaaaaacacacacaaaaacccactgcttcctttactgtatcatctatatgttttttatttaatttacttttattatatgttgtgtttagatacacacaaatagatagcaagtttattattattatttcttttttgaggccgagtctcgctctgttgcccaggagtgcaatggcatgatctcagctcactgcaacctctgcctcccgggttcaagcgactctcgtgcctcaagtagctgggcttacaggcacacatcaccactccaggctaatttttgtatttttagtaaagatggggtttcgccatgttggctaggctggtctcaaactcctgacctcaagtggtctgcccaaagtgctgggattacaggtgtgagccaccatgcctggccaaaatagtaagtttaaagcttctaactttacttttaataggtaattaaacaatgtatatatgacattgaatgcaacacattaataaaatgtaacaattttgttaagcagacaaaatataatccaatgagatggtttacattctttgttcatagcaagactttaaaatccagtgaatactttacactttgcatatctcagtctagatgctaaatatttcatgagaaatacttgatctgcatttagatttcataaaatcacagttgaaaaaaggttgacgaacccaagttgttccaagcatactagtttcccaataattgcactatcagtttttaattttaaattaacatttaataaaattaaaaattacaggcacagtggctcatacctgtaattctagcactttgggaggtggaggtgggaggatgacttgagcccaggggtttgagaccagcctggacaacgtagcaaaacctcatctctacacacacacacacaaaaattagccaggcatggtgtgtgcacctctagtcccagctactcgggaggctgaggtgggagaatcacttgagccagggagatggcagttgcagtgagctataatcaagcaactgcactgcaatccagcctgggctggtgagggagactctgtaaaaaaaaaaaatcagctcctcagtggaactagccacatttcccatgattaatagtcatttgaagcagtggctactgtattgaacagaacagctctagagagtaattgggtggttggggaacagggatggtttcaattttgtactatttgtacatattgcttttccaaataaatgaataaatcaagttcttatttttaaacaatttacagtttgtaaattgttatttttaaacaatttacagtaagtagttaggttatggaagtcacaaatgcacccctatgggatgagtgtggggggaaagtggttatcttaatattatataaataagtttcctgtggcttagaacaaaattcccagtaacagtattccacagacacattccagaaatattgtatcacaaactacttatttgaaagtaaagaattagtgcctggtaaaacgatgttatttaattaaaagaacaggctcagaatatttaagatatggctatctaaggtaaatacagtttgagtagaataattttattaaatgtgagcagaaaaaaatcaatatttctaagtatattggatttcacatatatatatgaactgaaaaaataagatattataagtttagaaatatgtacatttaaagtgggattaaatatgttttatataggttattttcatctacgttcgtaagtggcattgcctatagttttatctatagtgtttatttttgcctgattttagtattggtattatggacttttaagtacaagaagggaggtccaagtgaggacctttcctccttttacttttattttatttatttttctagagccagggtctctctctgttgcccatgctggagtgcagtgacatgatagtagctcacaatagccttgatctcctgggttaaagtgatcctcccacctcagcctcccatagctgggaccacaggcatgtgctaccatgcccacctaatttttaaacattttctgtagagacagggtctcattatatttctcaggctggtcttaaattcctggcctcaagcaattttcctgccttggcctcccaaagtgctgggattataggtgtgagccactgtgcatggccaaattttgataattgcgggattttttttttttttttttttttgagacagaatcttgctctgtcacccaggctagagtgcaatgcaatgatctcggttcactgcaacctccacctccagggttcaagcaattctcgtgcctcagcctccctagtagctgggattacaggcatgcaccactatgcctggctaatttttgtagttttagtggagacagggttttgccgtgttggccaggctggtctcaaactcctgacttcaagtgattcacctgcctcagcctcccaaagtgctgggattacaggtgtgagtcaccacacctggctgataattgcatttttaaagaaaaaacccttttcctttccattgccattaaaaaactatactttttcaatcttctatacatatttatttttattttgttttattttattttattttattttattttgagacagggtctcactctgtcacccaggctgacacatgattgtgcagtgacacaattatggttcactgcagcctcaacctcccaggctcaggcaattctcccacctcagcctcaagaatagttattatgcggtgacaatcatggttcactacagcctcaacctcctggctcaagcaatcctcccacctcagcctcaagaatagttgggaccacaggtacatgcaaccatgcccagctaattttttaatttttcatagagacagggtctccctacactccccaggctggtctccaactcctccagtcatgtgatgctcttaccttggcctcccataagtgctgggattacaggtgtgagcacattgtgctgaccacgtttgatttcttttccccaaagtagtgaatagagcctcagaaatcccataaaagaaaaagctctaccaggcacggtggttcacatctgtaatcccaacactttgggaggccaaggcaggaggatcacttgagcccaggagttcaacatcagcctgagcaatgtaaggaaaccccatctctgtgaaagaaaaagttttttaattagccaggaggggtgatagtgcctgtagtcctagctactcaggaggatgaagccagaggattgcaggagcacaagagttcaaggttacaatgaactatgatcgtgccacagcattcagcctgggcaatagagcaagaccccgtctctaaaaaaagagagagagacagagagagaggaaggaaggaaggaaggaaggaaggaaggaaggaaggaaggaaggaaggaaggaaggaaggaaagaaaagaagagcaaagcaaagcaaagcaaagaaaagagcctatttgccagatgagatggactggattcctgaacaaataaatgaagagaggaaacccatttagaagagtgggttatattcagttgcaaagacatggggtttattcctagttttttctatttcataattaaaaaaatttttggctagctcttgcacagaatattcctagtttctagaataacaaaagtgtgaaaaagatgagaagacagaagctactatccactgtcctgaggttaggtagggtagaaagactgagtaccagagaataaaagtaaaacagaaaacttttcagtgcagtcagggcagactgaaactcaagggagccagtttccagagtgaacagactgagtacacagaaaattgaagaggtaactcatgtcctatcagagacaaaatctcagaaagcggaggacagagcattgttacacagggctcagccattcagactcaagacctgggatctgcattttctggatcctaagcctggttggaggaaaggcatgagagattcaccatggtgatttgttttttggtttttgtttttttggttggggggagagattggtaatgtaaatgtaaccaccccttctttatctctgccctgaagcaatacggagaaggcataaagaacgtacttctttcacccaccaacagtatgaggagctagaagctctgtttagccagaccatgttcccagatagaaatcttcaggagaaactagctttgagactcgacctaccggagtcaacagtaaaggtctgatcccctgtggtgtgcttggtacccccatccaagccacattcacctatccagcctggaaattccccaccctctacccctgccccacaataatatttcattaattgagtacctactgaaacggtatcaaactggggacatcgcaaatactggcctcactctcatgcagtttgaaaaatgagaaaaaatgaggttcagaggcaaagtgactgggccacagagataagaaatagtgttgctagaactaaaaccccagaaatcttatttttaatacttgtactatagagttcaaatagcggaaaggtgctcatccagacagactcctcgcttagagtctttttaagcaaagccctgcaatctgtttattcataatgctaccaacagacaaataatactccctctaacctctgagtctgctaaagcccatgacgtttttcttttttctctttttttcagagatggggtctcactatgttgcccaggctggtctcaaactcctgagctcaagtgatcctctcacctcagactctcaaagtgctgggattacaggtgtgagccaccgtgactggccatacatttttactggagtattccttataggagaggcctcctaaaataatccttaaaaatccttcagttcaaattcttcacctctccctagatcctagatccctaaactagcctctcttctctagagttcaggaccctatctctgaacacccagcacaaaccctgaaacacacccgcttccttcctttctggggtcccagacctgatcttcatcatccctcctactgactccagtcatgcccatctctgcttttgcagagcccagtgtcatggtgaattagagaggacatgaagattataacctggctgttttcactcaggagaatcctccaatgcctcctccaataacagaccacaatctccccctcttcccctactcccaggtttggttcaggaaccggcgattcaaattgaagaagcagcagcagcagcaatcagcaaagcaacgaaaccagatccttccatccaagaagaatgtgcccacctcccccagaacatcccccagtccttatgctttttctcctgtgatttcagatttctacagctcccttccatctcagcccttagacccttccaattgggcatggaactctaccttcactgagagttctaccagtgacttccaaatgcaagatactcagtgggagaggctggtggcctcggttcctgctttgtactctgatgcctatgacatattccaaatcatagaactgtacaatcttcctgatgagaatgagatatccagctcttctttccactgtctgtatcagtatctctcacccacaaagtaccaggtaggaggacagggttcctctctcagcatctttgctggtccagctgtaggcctatctcctgcacaaacctggcccaatatgacaagccaagcctttgaagcctacagtctaacagatagcctggaattccagaaaacctccaatatggtagacttgggatttctctgaccagagtactaataaatatagatcatttagaaaagtggtcttcttgcctcttgtacatgactgtttttttcctttgtctcattttaacccaacatctgggtctgtgtctctgatttccatgtaaatgttgcaaaaagagttttccaagtagagctgggcactacgtaatcagccccacaagtctccctgagaagcctgcctagtccctttcatggccaatgagactccaaaattcccttcccaaaactatcttggattttctaaaagtaggacagtggttttgggggttatccacttttatttttttgaaactagctctcattctgtcacccaggctggaatacagtggtacagtcacggctcacaaaagccttgacctcctgggctcaggtgatcctcccacctcagcctcctgagtagctaggactacagatgctcgccaccacacctggctaattttttttttttgagactgagtctcgcactgtcacccagggtggagtgcagtggcgggatctcagctcagtgcaacctccacctcctggggttcaagtgattctcctgtgtcagcctcctgagtagctgggattacaggcgtgtgccaccatgcctggctaacttttgtatttttagtagagacggggtttcaccacgttgcccaggctggtcttgaactcctgacctccagtgatccgcctgccttgacctcccaaagtgctgggattacagacatgagccaccgagcctggccaatttttgtgttttttgtagagacgaggttttgccatgttgcccaggctggtctccaactcctggacttaacgccatccacctgccacagcctcccaaagtgctaggaatacaggagtgcaccatcgcacccggctgggttatctagtttaaaaacactttttttcaaggaaaccgaagaaaccatcatccacttttctctctgtatcattctgattttagtatatgtgttgtggaagtgagtacactatcatccacttttaatgacagaaagttataaacttacattttgtttccaatttttcattttttgtttgttatttgttttttgtagacagcactctgtcacccaggctggagtgcagtggcaccatcttggctcactgcagcctctgcctcctgggctcaaacagtcctcccacctcagccttctgagtagctgagactacagacatgcgccaccatgtctggctaatttttgtatttttagtggagatggggtttcgccttgttgcccaggctgaatttgggtttttttaaaatgagactttcagtcctaatttgaggggaaattactgtcaccactagttttaatatagtacaatgaaaaaataatatatatatatatagtacaatggtccagacataataagaggtgtaaaaactatcacaggaagaaataaaaacagatttttgaaggtgagatgataaacttgcaaaactcacaaaataaagagtcaaacttttagaatgacaagttagcatattttccagccacatgatcaacctacaaaattaataccatttctgaacaccagtaataaagaaacataagggctgggggtggtggctcatgcctgtaatcccagcactttgggaggccgaggcgggcggatcacgaggtcaggagattgagaccagcctgactaacatggtgaaatcccgtctctactaaaaatacaaaaaaaaaaaaaaaaaaaagccaggcatggtggcacacacctgtaatcccagctactcgggaggctgaggaaggagaattgcttgaacctgggaggtggaggttgcagtgagctgaggtcgcaccactgcactccagcctggacaacagagcaagactctgtctcaaaaaaaaaataaaaaataaaaaataaaaaataaaagaaacataagataagtacctctcaatgaaaaatgtaaaagtacctagaaattcacaaaaaaattaatacctctgtggagaaaacttcaaaacttaaaaaaggacatagaaaatgttttgaataggccaggcgcagtggctcacacctgtaatcccagcacgttgggaggccaaggcgggcagatcacgaggtcaagagatcaagaccatcctggccaacatggtgaaatcctgcctctactaaaaatacaaaaaaaaaaaaaaattagctgggcatggtggcacacacctgtagtcccagctacttgggaggctgaggcaggagaatcacaaggattgaaactatgcagtgtgttctccaaacatgatggaacgaaattagaaatcaataaaatttgggaaattcacaaatatgtggatattaaacaacacattcctaaataaccagtggttaaagaggtaatcacagtctgagcaacatggcaaaaccctgtgtctacaaaaaataaaaaattagctgggcatgacggccagagcccatggtcccagctactcgagaggctgaggtaagagcatcccttgagccacagaggtcgaggctgcagtgagctgtgactgtgccactgcactccagcttgagcaacacagtgatactgtctcaataaataaataaatagaagaaatcatgagtaaaattggaaaacacttttaactgaaaaaaacaaaagcacaacaaaccaaaacatgggatgaagctaaatcaatgcttagaaggaaatttatagcttcaaatacttatatacatattttttaaaagtagctttacataggaaggaagtggcatagttttatcaatatctgtcaaattaaacttcaaggcaaaacttttttattgagatggagtcttgctctgtcacccaggccgtgcaatctcggctcactgcaacctccgcctcctgggtcaaatgattctcctgctttagcctcccaagtagctgggactacaggtgtacgccaccacacccagctaatttttgtatttttagtagggacaggttttgccatgttgcccaggctggcctcaaactcctgagctcaagtgatcctcccgtctcagcctcccaaagggctgagattacaggtgtgagctacctcacctggccaaaacagtttttttagaaatgaagtatattagacaacaacaaaaggaacaactaacctgaaatatataataactttgaacttaaatatacttaacaacatataccaaaaatatatgaggcaaattttagcaaaaattaaaattcttaagaaaacttcactaatatatagtcataatgtggtatattcatagaacattctcaataattgataataacagtccaaagaaagcagaaagaaggaaagcctagaacagaaataaatgaaatagagaatagaaaagcaatacagaaaaaaaattatgaaatcaaaagctggttctttgaaaagatctacaaaatggcaaacatttagctagattgaccaccccctcaaaagactcaaattactagaatcagaaacaaaagtcaagattttattaccaaacttatagaaataaaaattattagaaagaaatactatgaacaattgaatgccaacaaattagataaatgaaatggacaaattcctaggaagacacagaataccaaatctgactccacaagaaatagatgttgtgaatagagcttgctatggtatgaatgtgtcccccacagctcatgcgttggaaacttaatccccaaagcaacagctttgagaggtgagacctttaagggttactaggcagagcccccatgaatggattaatgccattattgtgggagtgggttagttatctcagaagtgggttcctgataaaaggatgagttcggccttcttcttccccaaaatctttatccccacccccacctctatctttctctctctctcttacctcctcctctcccttccttctgccatgggaggatgaaacatgaaggccctggccaggtgtggcccctccatcttccgtctgagactggaagacttcccagccttcagaactgtaagaaataaatctctcttcata

SEQ ID NO: 623 - DNA, 36970 bp, Homo sapiens
atttttaacttcgcaacacttggactatttctgttgaagttttctctcctttccctgccttcccaacagaacgctgtcctctactgcagctgatgcaacccagccacctcccggcaatccgcttacttgcaatcaagggttcaggtgcaagcagatgctgactcagcctgttccattaaggtaagtattcaaacaggagcaggtgcaccatgacgaggacattcagtggtgaatatgcagatgaagctgagccgcatatcacttttgtgtcctgtggaagaggattgttaagcaaattagttatgtaaagatgtgggggaaaggctggcactgagaatgagatccagccgtgtgtaaatttctgtttccatttcaagagcaggtagagtacttgctttctgacagcttaggttctttcttctataatcaacaagagtagttatgatatctgtaaagttacaacatggtgatgggtggggggatctggggaagtggaggaggtggtgaggaaacaagtggaaggcctagaatccaggatttctattcccttttctttcttttttgagacagtcttgctctgtcacccaggctggagtgcagtggcaccatcttggctcactgcagcccctacctcccaggttctagtgattctcctgcctcagccttccgagtagctgagactacaggcacatgccaccacatccggccaatttttgtatttttttagtagagacagagtttcaccttgatggctaggctggtcttgaactcctggcctcaaatgatccgcccacctcagcctccaaaagcgctgggattacaggtctgagccactgtgcctggcccagaatttctattatttatttatttatttaattcattgttattatttttttgagacagagtctcactctgttgcccaggctggagtgcagtggtgcagtctcagctcactgcaacctccaccttctaggttcaagagagcctcctgcttcagcctcctgagtagctgggactacaggcctgtgccaccacgcctggctaatttttgtatttttagtagagatggggtttcaccatgttggccaggctggtcttgaactcctggcctcaagtgatccacccgcttcggcctcccaaagtgctgagaatacaagcatgagccgctgtgcctgatcagaatttctgttttctaaagtctaaatgctgtgatcttttctccagtcaacatttgctatgtttgcttgcaagtcattctcatgtagcttaaaatttcgtctgctgtgtcatactactggttaataagcacaactgtattttctgtatatactattcaaactccgcagagtttaacacctttttttcgccaacaatattctctaagtgtggccctcttctccccagctctcttgagtccaaaatgcatccatgaaatataagtgaaatatttctcaagttgaaaaacttatataggcttatgcaccaaaaccaaagattgttacaagcttgaacaattttgcatattcagagggataaaagtaaaatgactaatgatacttgaggtatcaaaagttataactttagacagatagtttctcgcttctggaataactgtatagtgttgcatgcactaaaaattggcaaggtaagggagcagtgtttattttcttgtttttcactggttcaaagttcagctaaggacatcctgggaagtggcctatgcagcaaaagggattctgtacactctgacctttgatgtgtacaggctaaagccaccgatgccaagtaaaaggagacctaaactaactattcagataccttaactcctggttccttcctgcctgtctctgtaacctccatatgtaccccaagactctgctataggtgtctgggttatcattatgcctgtttcctgggcacaagcaaattcactgtgtataatcacctaacttcatttaatttttccagggcctccacagcaccaaggtctccaaggtgtatgctgggatgctgtcctggtgaaactagggtgtgttggcttacaagtaaccaagcagacagattgagtcccagctacccctagataatccagttactttagcactatcttggccaatgcaactgtaatttaatagaatagtactgatacaaaagcaccagatataagaattaactagctaattcaataactaataagtataaagttagagagatttctagtataggtggaaaacttcagattgtgaagtggaatggatctgggagagggtggttctgttttaggatacagtgaaggtactggaatcgcagcgtcgaagccaaggattatggaacccaatgtgggaattagcctcagcaaagtgattgtgttaaaatctcaagaaggcaaagagattactttaataattatctttatacattttctttccctacaattaaatatttccatagcagggaaacaggtcaacaatgcataattaaagtaactaattaattggctggttaacaggttaagagttaaaaaatctttgacctttaacttttaaccttgtcactttcactgaagttaaagctcagaaataaatcattattgccagcgccagccacatgaggaggcagaatagtttagttactgacatcatgtgaggggtgctgagagggccccttgcctaaaaatatctccctgacatcaaccctgtttgcctactaactttaaaattatagaaaagaatgttaaaactattgtttgttaatcccattctcttttgcttgagtcagtgatttaaatacacctgctatacgtgttagcatgactttgttgaccagcaacacttggtcaccacctcctcctccttcttccacgctttgtcctactctgcccttggtaccatctaagctgccaacatgccttggctgtcaccactcaggtagctttgtgtggtgctgtgatttctacagactctttcaataaaacatcaaagcacaatagaaaaaaagcacgtgactagagccagagactctgggagcataggcaagacatttcacttctcagagcctcagtttctcctctaggaaacaaggaggttaaaacagaccctttcctttcaaaatgaggtccttagaccatcagcttcatctggattttgttacaaggaaagagtctcaggcctcaccctggtcccactggatcagaatctgcattttaaaaagtttgcccgggtgattcctttgcatgttgaagtttgagaagctatggaatatggatttcttaatatctgcctgatccagatttcggattctgtgcctgtcaagtgtttaaaagaacaagtactttaatcccctgcaaacaatctggcagtgctcagattatctattataaatccagcccactgaggtcttttcttcaatgaggcctacattaacctaagttgaaatgatttccttttcaccttaaaaaaaaaagcagccccaattagcatacatctgacaccactctactttcttcctaaatttgtttcaaattactctcgcagcttttaaaatgctgcctttttaagggttcagtttaattcagttcaatcctattcaatgttctcgttgactgagtgctgggggcagtgtttgctctactcactctcagtccctagaagcccatttggtgggtccttaagaagtattatcaccctctgttgatattccggtcagacctccttccactgcctgcacacacctcgctggcgacaacacttgtgcccatcattggaacctctctcaccattctcaccatcacagcaactttgccaggttctgccaactgccacagccaatcacaagagagaaggcaagtctcaaggaccacactttccttttttcttgatgagcagaataatgcagatgagcaaaaaaatttacaaattttggcctaggaaacaaagatgccttcaagttgtctttatggcatctacaaagtttcagtcctaaagcagtactatttgaattcctaagtgcttaaggaatggctcgtggtgattaaagggggccgaaagtggggggaagtgtggaggcttacattcttaaaagagtgaggaaataatttttaaaaaatagaatttgaatatcatcaaactgacagtggaatataagatacattggagtgagggggactgaaaatggaaagaccagacatggctacaggagggcagtgggaacacatgaaggcctggaggagggaggtgaccatgagaatgaccttcctcatagagtgactcatctattacacactccctatttcatctcattggatccttgtgcaaccctattggttattataggcccccttttttttttttttttttttgagacagaatttcactctgttgcccaggctggagtgcagtggcatgatcttggctcaccacaacctctgcctcccaggttcaagtggttcttgagcctcagtctcccgagcgtctgggattacaggtgcctgacaccacacccggctacttttttgtatttttagtagagacagggtttctccatgttggccaggctggtgtcaaactcctgacctcaagtgatccacctgccttggcctcccaaagtgctgggattacaggtgtcagccaccgtgccctgcttataagtcctacttttgaattaataaattagctttaggtagattaacttgtcaaaaatcactcagcttattcatgggagtgctcattgatttactttatattgggggtgtcaggtaaggactctctgtggaggtaacatgtaagcagaaaactaagtggcaagaaggagtccacagagcaaatacagaacaagaggagaattctcgtagaaagagcaggtacacaggccctgtgctggaataagtgacaagaccagagcaaagtgcataagggtgggaggtcaggcaaaagagcaagcaagggagagctcatgcatggcctcatgggccaagagaaggacttcagagtttatttccttgtgaagggaatccactggaagttttaagttggggagtaataacctagttttgtaaattgtgaaaaattacgccttctgctggtaaatattgccaatccattctccccaaaataggagctttaaaattcccctgtcttagcagtcaacataatatgatttagatttaaatactacaaagattcatacagagctagatttttctagatgtgctagatgtagtttaaatggaatatgagttggtggaaggacctggtgtgtgaactgagacatggtgcaaaatagaaggagtgagactgattataaacccattgcactacaccgggtgagcaaggatgatgcctggcattgggcagtggtggagatggaaagaagtgggcagaatttgcccactccttttccagatcttttgtcaaggccttcccacctaattggcaatcctcccaccttggtctcccacagtgctgggattacaggcatgagccactgaactgggcccaatttacacctttctgcgtggtccacacagcaccacaatctgcatcaaatcaagttgctgcccccttgccaggtgctaaatgcttccctatttctttgaaaaacaagctatgcctcaggctcacacacctggtccttccaccagcctatgtttcatttaaactacgtccagcacattccgtgtagatcttgggactatttaaatctaaactatattagtttgactgctaactcctctagacaggggaactttaaaactcatattttggagaaaatgtgttgaccatatatttaactgtagttcatttttaagaggatagaacatactgctttttcagacaagaagcaagaatttaaatgtgaacacaggggccaggggtggtggctcacacctgtaatcctagcacgttgggaggccgaggtgggcggatcacctgaggcccggagtttgagaccagcctggccaacatggcaaaaccccgtctctactaaaaatgcaaaaattagttgagtgtgatggtgcatgcctgtaatcccagctactcaggaggctgaggaaggagagtcacttgaaccagggaggtggaggttgcagtaagccaagatcgtgccactgcactccagcctgggcaacaggagcgagactctgactcaaaaaaaaaaaaaaaaaaagtgaatacaaggcatagtaattaaaagggaaatggcacctggatagccatactctgtctcaggcatagatttttgtcaaccttttcacagtgaagaatttctataatctgagtgctttgatctagtaggtatttcattttaaatatcagaatccatattgtagtgcatacacacacacacacacatgcacacacacacacacacacacacacacacacatatatatatatatatatatttttttttttttttggagacggagtctcactctggtgcccaggctggagtgcagtggcacaatctccactcactgcaaactctgcctcccgggttcaagagattctcatgcctcagcctcccaagtagctgggattacaagtgtgcactatcatgcctggataatttttgtatttttagtagagatgaggtttttccatgctgaccaaactggtctcaaactcctgacctcaggtgatctgcctgcctcagcctcccaaagtggtgggattacaggcataagccaccatgccctgtctaaacacacatatatatatacacacacacacaggatcttgctgtgttgcccaggctggagtgcagtggcatgatcacggctcactgtagcttcaatctcccaggctcaagcaatcctcctgtgccagccctccaagcagctaagactacaggcatgtgtcacacttggctgatttttttttttttttttttttttttagtagagacgaggtcttgctgtgttgcccaggctgatctcaatctcctgagctcaagcaatctcccaccttggcctcccaatgtgctgagattacagacatttgcctcagcacctgacttatgtagtgcatagtttttaaccctacaaccttccctttcacagttatatcctctgaaatgcaaagccattgggcctggatgttccttttgttttctgtactcagagagggcacagtatgggatatgatccaaagaagtatcaaaataatcgccataaggaaggaggggcttcttaaggaagggcatctggctcctttacaacctgaaaagattaataatacatgtggacactattctgtgccccaactctagcgatgggcttgcatttttcccacaccatgtggatcaaacacctgtgtctccatgggcctttgagggccaagtgtgatgtagcaaagagtatagagtttgaagacagacaggcctaggcctctttgtgcctcagaatccttattcataaattggaaatggtagtacccacctcacatggttgttgtgagaattaaatgaggtgttatgtaaaagcataggaaaggcactaaaatttcatttctctgcctccgtgacacccaaaatgcagagaaatctctcaatctaggaaagtcacacaaaccccatgggggataaggatcctgttactgggcacaggaacagagaagattgggagaacaggtcatcttctatcacaaggcaaccaatgatatatctaatttgatcattttggggcaacaccagttggttcctacttaaggtgatcaatcaactgtccagatttgcccggaactcaggcattttctgggatatgggactttcagtgctaaaccaggagagtcctaggcaaaccaggacaaattggtcatcacacttacccagccatgattagactatcgagagttccagattgacccttatatcagtgagaacaatttcccccccatacacaacaaaggctcagatgtgatttgtttatagatgtgaggctatttcatcttcccccttcctttcattgtcaaacttctctggagtggtctccactcaccgtgcctttctgctctgtacatgtcctctctcaaagtcactcatcgggtgtagctccaaagcctggtaggagagctttaaatagcaacatgaaaaaaaaaaagcgtctttgttatctcttaaagggacattttcaagtaacttcaaggagctggagaacaataaggctgcacaacaaatgtttccagcttcaataatactgttcccaagaaccatactccatagtgctgaagggtaagaaatgatagagcttaagagttagtcaccagtgtccctccagccagacacagccctgctgctggggcagagttctcactgcacgcatagaagcacactgaactagccagcccttcttttcctttccaggaactgagctcaacttaatgacagaacaggctggcatatatgaagttagactttcctggagctggtagcttttttcacagagcattattccatttgtgattttccccttctttcccacctaaaaagcagcaggggactctgaattatccagactttgtcatcattggtgaatttctcttctgaataaaaatagatggccacattctctcagccaggacaggccctgacaacaatggagtgtatgcttaatagcttttccttcctctacaagcaaacaacacattttcaatggccaagggtcccactgcgcagctaaaatgccacacttgctctggcaagagctctttggggacctgccataagcagtgacattgtcatcattgttcttaactttgcagtatcatttgaggccgtagctcactttttcctttgcatctgtgacaacatagtcctgactcttttagctctctgatctctccgtctctggttctacttcttcctaatttcccccaaagccatcatacttggctatgtacttcatggctccaatttctattctgtttttactttcccacatatggcttcccctctcacttgtaagtggatacttcacaaatctgcatctccacattccagtccctcatcttcccatccatgagatctatcatcctctcaagcaacttgtattaaactttcaggacccatctctcctccccaaattgttccctctttagatctctatttttctcaaaaattatagccaacattctttcttcctggttcgaaatcttggcatcaactttgtttccttttttaccatcccagccagaaataaaaatgtgattctccctttgtaatgtcttctatgtgtctcatcttgactatttttactgtcattggtctcacccatccaagcttccatcgcattctctacacagcagtttctaactctaggtcttcctactccatttattcctccagtactcttacttaacaccccaattacagtgttaaatggctccctattgtgtatcaaataattccagatgctttagcctaatatttaaacatttccacattaagtccataatggactctttttttttttccaaaagtgacctggaatatggcaggaatctacctctacattacactgcatgttaagagatcagtagctgggctcttggacccaaagatgtgtttcctgctggatcctattctgctccatcacagtccatttttgtccattcaggcttctataacaaaagattctagactgggcagcttacagacaacagaaactatttggagactggaaaagccaagatcaagatgccagcagattctgtgtctcgtaagggccttcttgggtcacagactgccatcttttactcctgtcctcatgtggtggaagggacaaaggatctctcttgggcttcttttataagggcactaattctattcatgagggttttaccctgatgtcttaattgttgccagaaaagagtgtcctgatccagaccccaagagcagattctcagattcccacaggcaagaattcgaggcaagtcacagagcacagtgaaatggcaagtttattggaaactactctgttacagtctagggcatcctcagcaagaggaggagcactccatcttttgttagtgtctgtacttataagaaactataaagaggtaaattaaacttggaatgtgcagacatgctctgatgtgctcactaaaggtagtggctgtcagtgttatcgatgaccatcaatcctttaacctcagcttgctctttaacattatctttaagcaaagagggctgcactgtcaggacatctggacattctgcaggcttggtgagagatgttttgtctggccataaatattctgtaattataagtggtggtcagcttgggatgtggctattttcagaccataagtattaaccttataggtgctttgtgggtgcctcactattcactgaaaggtgacatcactctggtcatagttcttttttattttattttatttttatttttattttttttgagatggagtctcactctgtcgcccaggctggagtgcagtggcacgatctcagctcactgcaacctctgtctccccagctcaagcgattctcctgcctcagcctcccaaggagctgggactaaaggcatgtgccaccacacccagctaattttttgtattgttagtagagacggggtttcaccatgttagccaggacggtctcgatctcttgacctggtgatctgcctgtctcagcctcccaaagtactgggattacaggcgtgggccaccacgcccagctctggtcatgttttatcaagccagaggcctggtaaataggggttcctctaacatatttcccccttctgtcatgagtggacccttaatcctaagggacactgaagggcagaggtcagtcttctgcaacctcttcctgctgagaaacgtcattgatgttaactctgcctagctttaagggacctgtcatgttgggaggggtcttaaccagaggtagcttgaagctgttgcagttaactggaggagcaataggtctgtaggtttgtaggtcactcataagttgatatcctaaacatagaaacttataagaattatagctataattataaaacatgatatatgagtaccatacattgtgaattaaggattaataataagaatagggcccagtaaaccctacattccatgcaaaacatgcagcaacaataaaatccacaacataaagctatgcctattccaatttttatagctggggtgacaaaaggaactttttccaccatgatggccctgacccaaaccacaatgttagccattatctaaagaaagtgtgggattagagatggctttaatttgttgatgcatatctggagggccaaagaaatattgtctgagttatttgggatatatatacaatatttgattctgataatagcacaggttcctccctgtgccgcagtcagagtatctaatgacattctgttttgcatgatagccttatgcatataatacatttcagcatttataaaagatatatctcacaggctgttacttacagcccatggggtatcattggcaatgacctcaacatgccagatagcatcttataatctaacagatggtaggaagagtgaggccaagtggttatacccatgaaaaatggatctggcccacatactggttatgtggagaaggttggctggctttatttatttatttatttatttatttatttatttatttattatttatttatttatttgacacagtctccctctgttgccgaggctggagtgtggtggcatgatctcggctcactgcaacctctacttcctggattcaagcaattttcctgcctcagcctgccaagtagctgtgattactggtgtgcaccaccacacctggataattggccaggctggtctcaaattcctgacctcaagtgattcatccacctcggcctcccaaagtgctgggattacaggcatgagccaccatgccagcctggctggcttttttaaatagtctttgtccagtgacctggggtcaagataagcttcatgtacaatgtcctagccacccagaaggcaatcatggccaaagattggtgccacatatccaatgagttcctaagggatgcatatcagttgggttttggtcgttgcgaccaatcggtagcagataagtccatttgttgcaggactatggtatgttggcattgtcttgcaggaatccatcccatgacacaagtagcatttgtcaaggcatcaagggagtgattccattgttcctaacacagtgggactacctgacttaggtgtcctgcagaggtggttagtcatagaaaaccatctcaaatctgaagaaatcattcttcaaaactggagtttttgagctttttagtttggatgtttatctttgggtctagaaaggaggtgcccagtgcaagaaacttttctgtggtctcatttactgagaatggcttcctatgcccagaattgctaaaattgttattaattggccattgggttacattgttccaagtcaggccagacatctgtgcttttgtccattgtttaagtccctctaagtatgtctgtaagttatctaagcatgtccctgtgtgggggatatccaccagggcaagcctgagatgctagagaagggcaatagctcacaaatccagcaagaggacatcggcatagtcctgtgcccattgtaagaaaagatttgaacctccagcaatagtgaaaggaaggatagaagccccaaaatagacacaaataaaagagaagctacattctatagttatatcctgtaaggacatagatattgcttacccagagctgggacagactcataccagtaaaagtaaaagacgaccaggaggaggatcaggaagactaaccttgcccccaagcttatccagagcatcactttgtagtaagaagcttccaaggatttctcctgaagaggaagtatagaccttctactggctcacaagagtaaactagattagcagactgggtgtcagaagtgtagaccttctactggctcacaacggtagactagattagcagactgggcgtcggtagcttgtggggctccataagaaacaggtttaattcaagacaaatgtacctaactgtgaatcccttgcagtttaactgctattggagtgctcagagcacttgatatggacctttccacattggggaaagctggtcactagagacccttccattcaagtctttagtaaggttaaataccctagttgaactgaaacagaattttcctctcatgtggggagggaaagccttttatatccatattcacacaatgcattttgcacttgtcctagattgataacatatttttgtaattaatgaatcatttcatctattaggagatttgcagttaggaaaggccttccatatgttaatgcaaaaggacttaattataagtttccctttggagcagctcaaacctgcagtaaagctacaggcaatagagatagccaggtctctgatgtttcctggcaaatttagccggagtcctctttagcctatgattaaccctttccacctttccagaggattggggtctccatgcagaatgaagatgatattggattcccaatgccaaggataggtattgggttatgcctgccgtgaaagaggggccatagctactttgcaatctttcaggtaatccaaactgaggaattatttcttttaataaacttttagataggcttggtgtggtggctcatgcctgtattcccagcactttgaaaggcctaggcaggtggatcacccgaggtcaagagtttgagactagcctggccaatatggtgaaaccttgtctctactaaaaatacaaaaattagctgggcatagtggtgcatgcctgtagtcccagctacttggaaggctgaggcaggagaatcgcttgaactcaggaggctgaggttgcagtgagccgagattatgccattgcactccagcttgggcgacaagagtgaaactccatctcaaaaaaaaaaaaaaattgagagacctctaaagctctttttttttttttttttttttttttgtgagatggagtctcactctgttgtccagactggagtgcagtggcacgatctcggctcactgcaagctccgcctcctgggttcatgccattctcctgcctcagcctcccaagtagctgagactacaggcgcccaccaccacgcccggctaattttttgtatttttagtagagacagggtttcactgtgttagccaggatggtctcgatctcctgacctcgtgatccgcccacctcggcctcccaaagtgctgggattacaggcgtgagccaccgcacctggccgagacctctaaagctcttttggatcaagtgggggaaagccttaacctaaccagtgaaggtaacaataaacaccagtaaatatttgaatcccctacatagaggcatttaaataaagtctagttgccagacttcacccagataggctcctttatgttggacaggtttaactagaggtgggggcaatggctggctgcttgggttattttgggcatagagctttcaggctgaagtcatctgttttagtgtcttgaaaaattttcccataaataaataagatatcaactgaaataaagaatcccttcccaaatgagtggaattatgaaaatgcttaactattttacactgattggcacttggcattagtaatttgttatcattaaccagccagaggggtcctgggccaaatcgtgatccctggcccattttcgttcttccttggagtacactggctcggctatgtctggggctgtgggcactaggatgcccataagcgttaactggctcttttagtgcagtggccttggcccccacatctgcaagggcatttcatttaataatatcatcaaaatgtgctctgcaatgaattacagccatttcttttggcagtaaaacagcatctaacaagctcaaaatatccgagtgatgttttctgggggagtccttagcagtgagaagtccccactctttccaaatgtcggcatgaccatgaagcattaaaaaggcatgcttggaatcatcagaaatgttaatttttacatccttttccaattgcagggccctagtaagagcaattagctcagcttccatctgtaaaccattctgtctcaggattgttaagaggctcatctcttaagtttggcctgctagaataaatttgctccataacctgtatgcaggaatggtttagagcgtctgtggactctggcagacaagcagctgggtttacttggagaacttcaagaattatgtctggtgtgtctaacagtaaggcctgatgctttaataaacatcctcccatcatccactggtgccctttagcttctaggaccccctggacttggtgtgtggtcaaaacctccaggtgctgtcctaatgttagcgtattagcttcatctaccagaagagcagtagctgcaacagcccaaaggcatccaggccatgcagaagccacatggtcgagttgcttagaaaaataggctactggctgtggaatattccccaatttttggacaagaacatccaagaccataccttgctttttggccacataaaggaaaaatggcttatccaagttggggattcctaaggctggagcagagcccaatttcgctttgacagtattgaagttttgtctgctattctcattccaatcaaagcgttttaaatctgtcctttatagaacctcacatacagacttgaaatgtttgcccaaatccaggcacccataaatggcagaacccagccatccctaaaaaggcccacataggtttcttggtatggggctcttgaatgagcttccttccattctgaggctattgcttgggtaccagaggttaagatgcaacccaaattgattctggaggagtgttataaataataaagagagaaacaaatagtaaataataaaaaaatttataaaaaagatatattcaaaatatttgactttctgagtagaaatctgagccttgtgtggtgacaccctatatccagtagttcctaggaaatttagcaatttaacggtagtattatctgagttctctttagttgggctagcaatgagcaaatcatctacatactagataattgtgcccttttgcagttgtagattcttcaagtccttagctagagcatttccagacaagtgtgggttatcccgcaacccttgagggagaactgtccaggttagttgtgaggttgaatgagtatcaggatcattcctttcaaagtcaaacagaggtgtggatctggatgcactgggtgcagaaaaatgcatccttatcttccttttttctctcctcaggggagaggaacaaaagtaacactcgtttgttttatgctctctgaaggtaaccatgccttgcagccgaatcaataaattcctccccagtaaggggtagggcatgcaggtagtactaaaaagccatgcaagaaaaccagagtccctgaaggacagcttaaaggataaggaaagtggcatttctgggcttgcccatcaatgcctgtacagctatagaagacagggctccattatgctgggccagaacaaagtaaaatgctcccatattgaataagaaattaataatcttatctgccacttcaagagtcacctgagtctcctccagagcaatggctaattgtccaacaggaaataaggtgtgaagtcttgggctggtgtcactcttaggtctgctgggccattatgggttcaggagccgattcttgggaacacagggcattccctcttccagtgaccaaccttcttacagaaaacacattggtttacacccaggacacagtggcccagggcacagtggctcggaggcccagaatggggctttctgcctgctagcttcctctggcagggcttgggggataaggggctggctctgaaggggtggagagctcaaggctgcagctaaaagctgggcctttgggaggtttgctttactttctctgcctcctctgccctatcttggccattgaaaattgcaaaagtcatgtctaaaagctgatttatggaagtccaggggcctaagtttgcttttgtagcttcctgcagatatcaggagcagactggattatgaaatgaactcctggcaatgcctgtccctccttggagtcagggtcagtgttagtatatttcctcaaggcctcaattaactgcccttggaacaaggttgggttttcatcctttccatgagtaatttccctgactttatcataattaacaggctttatcacaaatcttctcattgcttcaaggaggcaaataatcatatggtttctcctctctaggttcttacttcctttttttgttgtttttttcctcaagacggagtcttactctgttgcccaggctggggtgcagtggcaagatcttggctcactgcaacctccgcctcccagattcaggtgagttctcctggctcagcttcccaagcagttgggaccacaagcacatgccaccacatacggctaatttttgtgtttttagtagagacagggtttcaccacattgtccaggctggtctcaaactcctgacctcaagtgatctgccaaccttggctgcccaaacttacttcctcttaataactccaatttaggtcccagtcaggaactgctgtacctcctactggatagatgtcatgcccctggttgcaggctgccactccatctgcatatgctttaacagctcccataatatgctgcttttcttcttctgtgaagcaggtagacagatgtatatgcaaatcttgccaggttaaatcatatgttgaaggggtggcctgcccctccacacctgtgggtatttctagtcgggtgggacgagagactgagaaaagaaataagacacagagacaaagtatagagaaacaacagtgggcccaggggaccagcgcttagcataccaaggacctgcaccggcaccggtctctgagttccctcagttttttctgattattatcttcattatttcagcaaaaaggaatgtagtaggagggcaaggtgataataaggagaaggtcagcaacaaacatgtgagcaatagaatctatgtcataatgaagttcaagggatggtactatacctggatgtgcacgtaggccagatttatgtttctctccacccaaacatctcagcggagtaaagaataacaaggcagcattgctgtaaacatgtcttgactcccaccatagggtggtttttctctgatctcagaattgaacaaatatacaatcaggttttataccgagacattcagttcccaggggcaggcaggagacagtggccttcctctatctcaactgcaaggggctttcctcttttactaatccacctcagcacagaccctttacgggtgtcaggctttctcatcccacgaggccatatttcagactatcacatggggagaaaccttggacaataccccgctttcaagggcagaggtccctgcggctttccgcagtgcatcgtgcctctggtttattgagactagagaatggcgatgacctttaccaagtatactgcttgtaaacattttgttaacaaggcacgtcctgcacagccctagatcccttaaaccttgattttatacaacacatgtttttgtgagctccaggttggggcaaagtggctggggcaaagctacaaattaacaacatctcagcaaagcaattgtttaaagtacaggtctttttcaaaatggagtatcttatgtcttccctttctacatagacacagtaacagtctgatctctctttcttttccctacaatatgtcaatgttagtctctcaaattcatctatgaattttcctagaccctctaaaaaccagctgaattttttctggcataaggctgtcaggcacagaaaagggtacatgtacccatagagtgcccctgtcaccatctgccagctcctgaagacagcaaagagtcaacttcgacggctggtaagaggccccactaagagtggtgctggtgaagctaggctctttggggaacgaatgtaagacagggcttgaagggtaaggaggaggtgatggcaggacatcggacaaccccaaataactaggaggggttaataatactttggacacttctggggaactaggagtctgactttgttcctccggagcacttgaacttacagtggggagtctggaaccagctgggggaagcctgggattaggaggcacttgcataagtggtcatgaattatgtctagtccttcatttttctctccttctatcaaacatatacaagcgtattttaaatccttatcctgactaaccattaggaaggcctgcacatagagtatttctccacacttagtttcccttctacaaaacaaatcaagccgaagtatagtgttaggggccgctgtaacacctgaggtccacctttctggtcctctcaaaggatattggggccagtgttatattaaaaaaaaatttctcagccgggcgcggtggctcacacctgtaatcccagcactttgggaggccgaggctggcagatcacgaggtcagtgaatcgaggccatcctggctaacacagtgaaaccccgtctctactaaaaatacaaaaaaattagccaggcatggtggcgggtgcctgcagtcccagctactcgggaggctgaggcgggagaatggcgagaacccgggaggcggagctttcagtgagccgagatccagccactgcactccagcctgggcgacagagcaagactccgtctcagaaaaaaaaaaaaaaaaaattctcttaagcccatccagtttaaaccttcccttccctaataggttaaaatgcaccctaacagtgagctcttcaggataggtactgcgttctccaccaggactgaaggtgctgaataccactccttgtccgcaagattgtactgcctccagccgagctccactgaaagggacaagataattcttagtgccaatttggccaagggaggaactactggagccagtagggtccccttgttcatatcagataataagaacaagtaagcagacccatggtcgcctgaggcaatgccacaaggaacccagcgaagaaaagatgatgaaccaaacaagggaagtgggcaagctgtaacttgggatcccctgacaaaactatttcagggcaaaaatgacattctgggtctagaaagcggggcccggctgtccgtgaccagccaataaaagatgatcttctgattaatagacaagagaaaactgttaagaaaaagtctcctgtcctccattctggggctaattttttgcaaggaaagtcataaaagaggcttttttcttaaagggcgtttctaatcttgtcacatatggctgttaaataccacactttaacttgtaactgcagtaatggagaagttattgcccatctcttccaataattaaggtacaaaaagactagatcctgagtgacttcttgtttccagtgtccctcagacaagtggcgaattaagtcagaggagaggcaaggaaagtaaaagctaaactgtttggtggccgggcattgtggctcacgcctgtaatcccaacactttgggaggccgaggtgggcagataacttgagatcaggagttcgagaccagcctggccaacatggtgaaacactgtctttactaaaaatacaaaaattagactgggcgcagtggctcatgtctgtaatcccagcactttgggaggccgaggtgggcagatcacaaggtcaagagatcgagaccattctggccaacatggtgaaaccctctatctattaaaaacacaaaaattagctggctgtggtggcgcttgcctgtagtcccaactacttggaaggctgaggcaggagaatcgcttgaatccggaaggcggaggttgcagtgagccaagattgtgccactacattccttctagcctggtgacagagcgagactctagctcaaaaaaaaaaaaaaaaaaaaaaattagctgggcgtggtggtgtgcacctgtaatcctagctactcaggaggctgaggcaggagaattgcttgaacacaggaggcagaggttgcagtgagccgaaatcgcaccactgcaccccagcctgggcaacagagtgagactctgtctcaaaaaaaaaaagaaaaagaaaatgctaaactgtttgggccatccttcccgtggcagcctcaggggttctgtgaaacaaaggcagcaagccgacaggagacaagaagcaggacgctcaggccagcaacagaaagcacaaggtggattactcccaaggagttagtggcaaacatctcatagggccaaatccgttttccaaataaaccctggggcttctaactccttgggccctgggcctcaaactcaagtagcagtggacaagcatccttgtcccctggaatagcttaatgactctaaaatgagccccacttacccaaagtcagccaactgatgctgcgcagactgttttccttccgagtgggagtctcttcttattgtccatccatacaaggacaccagaaggatgttgcaggaaaagagggtcacgacccagacaccaagagtgggttcttggattctcacaggaaaggatttgaggcaagtgaaagaagcacatttgccaggtgcggaggctttcacctgtaatcccagcacttcgggaggccgaggctggtggatcacgaggtcaggagatcgagactatcctggctaacatgatgaaacccccacaaaaagtttgctgggtgtggtggcatgtgcctgtagtcccagctactcgggaggctgagacaggagaatcgcttgaatctgggagacggaggttgcagtaagccaagatcgtgccactgcactccagcctgggcaacagagagagcatctcaaaaaaaaaaaaaaaaaaaaagtagcacatttgttggaaactactctgttacagactagggcgtccgcagcagaaggaggaacgctccctcttttgttagtgtctctacttataagaaacccgaggcaggcagattccttgaggtcaggagtttggaacaagcctggacaacatggcaaaaccccgtctcttctaaaaacattaaattagccaggcatggtggtgcgcgcctttaatcccagctactgggaggttgaggtgggagaatcatttgaacccgggaggtggaggttgcagtgagccaagatagtgccactgcaatccagcctgggcaacagagcaacagagtgagactgtgtcttaaaaaaaaaaaaaaaagaagaagaagaaagaaagaaactataaggaaactataaggagctaaattaaacttgaaatgggcagatgtgctcactaaaggtagcagctgtcagtgttattgaacaccatcaatcttttaacctcagcttgctcattaacattatctttaagtaaaaagggctgcactctcaggacatctgggcactctgcaggcttggtgggagaagttttgtctggccataaatattctgtaattataagtggtggtcagcttgggatgtggctatcttcagaccataagtattaaccttacaggtgtcttgtgagtgcctcgctattcactttaagatggagtcactctggtcatgtcttattaaatcagaggcctggtaagcagagcttcctttaacataatcacttctctaaggccccacagccagacaccctcacactgggaattagacttccacatatgaatttgggggtcgatacaaacattcagatcatagcacagtccaaccctctcagccaccctgctctgttcctctccttctctggctttaacacctttgtttatcttctgctgggccctgaccctgtttgatgcttctgcttgcgatttctcacctgccccctgactagggctattaggagtatagagcactctgccgtgattcctctttcacactcagtagccccagtggggtccagaacaagggttctcatttattaatgtgcataagaatcagatggggagtgtgttaagcatgtaaattccaggagtccatcattccctcaggtccaggggtacagccagcatctgtagcagtggaactttttgtgaagatgggaatgttctattctgtgttgtcctaaagaggagctactagccacaaatggcgattgagcacttgaaatgtggctaacgtgactgagaaactgaattattcattttattgcattttgattaaatttaaatagccacatgtggcttgtgactttcatattgaccagtgcagatctataggtttagcaagcatcacagctgactctaatgaacaatagtgtttaagactctaacaagccgtccaggtgatccttatgctcacttactggcaagtagtagtaggtaatcaacaaatgtttgttgagtgggtgaatgagtggaggaactaataaatgaatgaaccagactataatttccttgtggtttaaggctgtctctcctgaaaaagaaaatgtgggggactgttccagattaaagaggctaaaaagacttggcaatcgaatggaacaaattgacattaaaaggatccttgttcaaaaatgagaggtcttaaagccagacatagaaagacacgtattgcatgttctcactcatatgtgagaactaaaaaagttgatcacatggaggtagagagtgaatgatagttaccagaggctgggaagggtgtaggggatagtaggagagggaagaagagaggttggtgaatggatatgaacagacagagaaaacaagttttagtgtttgatagcagagtagggtgactatagctagcaacaatgtattgtgtatttcaaaacagctaaaagagaggccttgaaacgttcccaacacacagaaatgataaatacttgagatgatgacctaaatatcctgacttgatgattacagattctgtatgcatataagaaaatatcacatgcacaccataaatatgcacaaatactatgtatcaattaaaaaattttgggccgggcacagtggctcacacctgtaatcccagcactttgggaggctgaggcgggcggatcacgaggttaagagatcgagaccatcctggacaacgtggtgaaaccccgtctctactaaaaatacaaaaaattagctgggcatggtggtgggcacctgtaatcctagctactcgggaggctgaggcaggagaatcgcttgaacctaggaggcggaggttgcagtgagccaagattgcgccattgcactccagcctgggcaacagtgtgagactctgtcacaaaaaacaacaacaaaattttttaaaaaataaagttagaagaaataagttctagtatttgataatacagtagaaaaattataatgaacaataatttattgtatatctcaaaataactaaaagaggccaggcatagtggctcacacctgtaatctcagcacttttggaggccgaggcaggcggatcacttgaggtcaggagttcaagactagcctggccaacatggtgaaaccctgtctctgctaaaaacacaaaaattagccaggtgtggtagcgcctgattgtaatcccagctacttgggaagctgaggcagaagaatcgcttgaacccaggaggtggaggtttcagtgagctgtgatgtgccactgcactccaggctgggcaacagagcaaggctctgtcaaaaaaaagctaaaagagaagaattataatgttcccaacataaagaaaagtgtttgaggtgatggatatcccaattaccctaattcgatcattccatattgtatacaggcatcaaaatattgcatatacccccaaaatatgtacaactattatatatcaataaaaatgtttaataaataaaaatattaaaaatttaaaaataactatactagacattttggagacaactggagaaatgtgactataggcattttacatgatattagaaaagtatttttagttttcttaggtgagacaatattattataagtctttattcttaggaagtacaagctgaagtacttagggataaagcgtcttatatcagcagcttattttctttccttcttgttttttttttttttttttgagatggagtttcactctgtcacccaggctggagcgcagtggcgtgatctcgattcactgcaacctctgcttcctgggttaaaacaattctcctgcctcagcctcccgagtagctgagattacaggcatatgccacagtgcccggttaattttttttttttttttaattttagtagagatggggtttcaccatgttgactaggctggccttgaactcctgatgtcaggtgatccacccgcttgggcctcccaaagtgttggggttataggcttgagccaccgcgcctggctggcaacttattttcaagtggctcagccaaaactgtgtgtgtgtgtgtatgtgtgtgtgtgcgtgtgtggttggagggcagggagagattgagagagagacagagaggagagaaagaaaggacacaaaaatggtaaaatgttagcaattgttgaatctagataaagtatattttggtgttcattgtatgtattccttcaccttttctgtatatttgaaatgtcttttttttttttttaagttgggggaaattttacccacaatgaattggcaaattctaaagtaaagtaaaatggttttttgtttgtttgtttgtttttgagacagggtcttactctctcacccaggctggagtgcagtggtgtcattacagctcactgcagccttgacctctcaggctcaagcgatcctcccacgtcagtgtcactctcaagtagctgggaccataggcgtgcaccaccatgccccgctaattttttaactgtttttttttttagtagatacagggtatcgctatgtttctcagactggtcttgaactcctgggctcaagcaatcaacctacctcagcctcacaaagtgctgagattacaggtgtgagccattgcgcctggccaaattttaaacttatggatcttctgacatttggatgctaacctccccactccatcacagactaacactgtgctgaaattatgttacaaattctgtagaccagatattgcaaactggcaacctacagatcctatctggccagcattcacatttttccttggctcaaatagtgttgttttaaattaagttagttgttaacatttaaaattcagagtatttttatttcgatatattatgtagtaaaatattttgcattgtgatgaaatataaaatactactttataatagcaaacatgtatagatcactgcctgtgaaacaagcactgttctaagagtttcatgtatatttaggtcatttactccttacagcagcattatgggataggtactattattatcctctctctactgatggggaaactgatgagcgaagaagtgaagtaaatttcccaaagtctcacagccactgacttgtagctccagggtggaaacctgtgcagtctgccttctaaccactaaaccatatcacagctcacaaaagtccgcatccccactgtctctggaaaaaccaggtctggcaacacattcccacatggcatcaattaaccagggctgagaaatttcatttccctgaagacagggcattttctctttcacttgccagagtctccattcagtcaacttctgggacctttggggttttgacccctgctctagcacagctgaatataccaggggaaatggcatgttacagatatttcacagacacctatacactgccccagacaaagttagatctcagactaacctctaagtggacaggaagccccagtggaagagaagattagaaggtaacctaggccagattgtgggtagcagagtgtttaggatgccaggataattgtcagcagacaatggagaaagttataggaagcagaagttaacatcccatgattggtaatatgccctatcagagggcagcgggggtcagtgaaaataacatgggccagcatggcctggattacaaagctgattccatcacttagcagctgtgtgaccttggacaagttacttaccttcaagcttctgtttccttgactcaaacatggagataaagacacctccaggatggtggaaggaattaaatgagatagtgtgtgaagtctctttagcctctattaatataggtaacctaactgtttttcttactaattatttatattcatattttcccgtagagctaagaagcaagaagaaattggggcgccatggtaagcaccaggagcttattgaagcttcaccattgagaggtccaggtcttccttcatttatcctgtagcccaagcagctagcagacttgctcttatggtttgatgatatttatcaacttttttccaaactagagatgctgaacagaacttggaagaaattgacacagagtaaggggaaaacagttgagaaggatttttgagcaaagagtttaagtgaaaatttaaataaaatagtcaaaaagccagcaataatctaaatggctagcaattccttcattcagcaagcattgaatacccacaaaggtccaggtcccatgctagatgctagggacataaatgcgagcaaaaccagacatggctgctgtcctcccagcccgcactctggtggtagttgattaaatgatagcacacccatattccggaatgttacactgccattatgaagaaagtttgtaaagaataactaataaaacaatctagtttcatgttctaatagcaagataaaaagcaggatgaaaagttgtattcatagtattatccgtatgatataaataacctgtaatccacaactcaaaaataacaattgtcaacagtgtagtccattatattcaattctttttttcctattctaaacacatctactacatatatataataaactattggaaaattctaaaaagtacttatagttgttatttctggattgtgggattgtgatattccatatatttcaaggtttctacaaaaagcaggtataaacaggaaatatgtcaattaaaacacagtcatagacatgcatagagcttctcctcagtattcatttgttttcttccccctgtccttggtgtgtccaggggaaagcccgcagatccccgccagggcaccacaggcattgtgagggatgcttcaaccgccactgccacattcctgtggaacccaacacctcctgcctggtaataagctgccacctgctctgtggtgccaccttccacatgtgcaaagaggcagagcaccagctcctctgccctttagagcaggttccgtgcctcaactccgaatatggctgccctctgtccatgtcccgccacaaactggccaagcacctgcaggtgtgccccgccagcgtggtctgctgctccatggagtggaaccgctggccaaatgtggactctgaaaccacccttcatgaaaacatcatgaaagagacccccagtgaggagtgtttggacacagccctggccctgcaggatcagaaggtcctcttcagatccttgaaaatggtggaacttttcccagaaactagagaggctactgaggaggaaccaactatgaatggtgaaaccagtgtggaggaaatgggaggagcagtgggtggagtggatatcggtttggtaccacatggtctgtcagcaactaatggggagatggcagagctaagtcaagaagaacgggaggtgctagccaaaaccaaagaagggatggacctggtcaagtttggccagtgggaaaatattttcagcaaagagcacgcagcctctgctttaacaaattcatcagcgagctgtgagagcaagaacaagaatgactccgagaaagaacagatttccagtggccataacatggtagaaggagagggcgctcccaaaaagaaagaaccacaggaaaatcagaagcagcaggacgttcgtacagccatggaaaccacagggcttgccccttggcaggatggtgttctggaaagactgaaaacagctgtggatgcaaaggactataacatgtatctagtgcacaatgggcggatgctgatacactttggtcagatgcctgcttgtacacccaaggagagagactttgtttatggcaagctggaggctcaggaagttaagactgtttacaccttcaaagttcctgtgagctactgtggaaagcgagctcgacttggagatgccatgttgagttgtaagccaagtgaacacaaggcagtggatacttcagatttggggatcactgtggaggacctgcccaaatcagatctcatcaagaccaccctccagtgtgctttggaaagagaactcaaaggccacgtcatctctgaatccagaagcattgatggactgttcatggattttgccacacaaacatacaactttgagccagaacagttttcctctgggacagtgctggctgacctaaccgctgccaccccagggggactccacgtggagctccacagcgagtgtgtgaccaggagacacaacaaaagcagctctgccttcactttcacttgcaacaaattcttcaggagggatgagttccccctgcacttcaagaatgtccacacagacattcagtcatgtctcaatggctggttccagcatcgatgccccctcgcctacttgggatgtacatttgttcaaaaccatttccgtcccccagggcaaaaggcaaaagtaatctatagccaggagctcaagacctttgccattaagccggaggttgctccagagctgagcgagggaaggaagaacaaccatcttttgggtcatggaggaaaaagccagaattctttaaccagcctgcccctggagattttgaagtacattgctgggttcttggacagcgtcagcctggcccagctctcccaggtgtctgtgctgatgaggaatatctgtgccactttgttacaagagagaggaatggtccttttgcaatggaagaaaaagaggtattcccatggaggcacctcctggagagtccacagagaggtaagtaaacactcatttattgattgactcattcagcaattttttgtttcattttttatagacaggttctctctctgttgcccaggcaaaagtgcagtggtgcaatcacagccttgaacttctgggctcaagtgatcctcttgcctcagtcttccaagtagctgggactacagatgtgcatcaccacttctgactaatttttaaattgagatggggtcttactgtgttgtgcaggctggttttgaactcctgacctcaagtgatcctcccatatcagcttccaaaagtgctgaaattacaggtgtgagccactgtacctggccttaacaaatatttttaaaggcctttttttttttttttttgagaaggagtttcattctcattgcccaggctggagtgcaatggcatgatcttggctcaccacaacctccacgttccaggttcaagtgattctcctgcctcagcctcccaagtagctgggattacaggcgtgcactgtcacacccagctaattttgtatttttagtagagacggggtttctccatgttggtcaggctggtctcaaactcccaacctcaggtgatccacccgcctcggcctcccaaagtgctgggattacaggcgtgagccactgcacctggccttttttttttttttttttctgagatggagttttgctcttgttgcccaggctggagtgcaatggtgcaatctcagctcaccgcaacctctgcctcccaggttcaagcaattctcctgcctcagcctcccgagtagctgggattacagacatgcaccaacacgccaggctaattttgtatttttagtagagacggggtttctccttattggtcaggctggtctcgaactcccaacctcaggtgatccacccgcctcagcctcctaaagtgctgggattataggtatgagccactgcgcccggccttaaagagctttttatgtgccaagcagggtactaggcatgggaacagttgctgagaataagactgactcaaggaggtcagtttagtagaaaagacagacctataaatacataaatagcaatccggagggtagtgcctgttcatctgtgtatgtgtgctgaatatcttctgtttgctctcaagacccattctccatccttctccaccctgtctgtcccccaggaggctgcctggacagattgcctcagctggctcccttaccctccatcttccagtggggctaacgtaaatggagcgtgtcagcaggagatgggaggaagggaagaatgacgttgaagtatctattctcctggcttcccccctgcatggttcctcccctttgtgacactttgagcaggtgctgtccctccactgaaggtgcctttatcaggcggctctctacacaaaattactcactgtgggatccaacgaccttccttcttctccttcaggcccagggcataactctctaggtagctactcaccctggatactacactgtatctcgtggctttcctataccctgctctcgtgtctgtaaatcattcctttaaaaaaaaatctcttcaaattacccggtctgagagtgccgcctgttcccagctgtgactctgattgatacaggaggccaacaaatctcctcagtcccaagtcaactaattttttaaaacagtttttgctttgataaaggcattttgaaattctaaatgaatttggcccactgatttccccggttcaagtgctaatttaattgttcaaaaaacactctgctgtataaatcaaagaacctttcccttcagaaataccttgttccttttccccagtaggtcatgtttgtttaactgtattataatttctaccagcttgtaccatactgaagtgaggcacctaattcatcatatcccagtgcctgtagcatcctttctcatggtaaacctgttggtactatgaaccatgaatttgtgatgcccatttaggtcaataattctataatctcactgttgaatttcttcctaatatgtggtatttgcaaattggcactggggagttagagttgtttgcatctatttgtattgatcatgtctaaaacattttgtatgttttccattatttattcctgagcagtcttcctcaaaaagtaattacaagactctctctcttgtatatgtgcctgcattcaagtgttaaataaacactgattgccaaccaagcacgtattaggaagaaacatgaatgaagactaacacactgccttcaggaatcgtattgtttaaaaacgcctaaaatccgatgtaaataatttaatttagatactataaattattttttggctcaagtttttccccaattcaatgatgactgaccactctcagatattatttgggacgagctaatttccttgcagaaagaaataaagaaaatttagttggggctaaaggatactcacattagaatggatttttaaagtaaaaagggaaacagttctaagatctcaaaaaaaccacttttcctacatagcaacaaggacaagaaactgtaggtgaagtagtcaggttgaaagagtattaggctatgcctactcacataaccagacttgaaaacggtgactttgccatcacatcccaggtggaaagaccagaagatatttcagaactcatagaattctcctatggggttcccactctagtgagactcttatgagttacaatactttaatttcaagcaacagaaaatcaacctaaagtggcataaacaataaagggaatttattggcctatgtaactaaaaagtctaaaggtaatggcttcaggtaaggcttgatctaacagctcaaaaaatgcccccaaatgacatctcttctttctattttttacctctacttcctcaataatggctacattgtaagatagtgctcactcggtggtctctggtgattgctggcacctcctaggacttcagctttgcagttcaagtagagaaagaaaaagagaatctgctttttggtatctccaacaaaagttctggaataagagttgcactggtactaattgttctgatttgaactgtgcatctactttaaaattaatcacttgctggtggaggagcaagggagagtgtgtgtcaatatgctgattggtgttagtgattctcacaactacagggctggttgggaagattattggttggcagggggaactaggaattggatgctggaggaggggctaccaaatgtctgcaggagccactaaacactctggagtctaagaatatgaagaacaggaggatatttccttatagtgcccaaataaagccagccagagggtaacacccctatattcacctttgaacttctatctttctcaacagatctggcagttcagcagcctcttctccaaaatcaagagctgggagtttaatgaagtcacctccatgtctgagcacctgaagtcctgtcctttcaacattgtagagcacaaaactgacccgattcttttgactagcatgtgtcagccccgtgagcaggcccgagagagcttagtctccacctttagaatcagaccacgaggaagatacgtctcctaaaaattcagatgccactcgatgcacccttcttggatttcttctcggagttcctgaagtaggacagagtgtgtggttttgaggactcccttctgtaaactgcctatttgcttatcggggtgtattggaacacgcaatgtccttcgaaacctcaacacgaggcctaagaatttcctaagccatgtcttgtaccatagtgccacattgatgacttgtttccttttttcttttcttttcttttcttttttctttctttctaaaatagattggtctgagaagaaaataagtaatttgaggccatttggaagatgggcccaatttcttaagtgatgagagagcacgaaattccataaccagtacaggcctgtgcttttacatgggctttttagttcacaaagcactttcaaatttatgggacaggaaatgcaggatgggactccccagggaacgcagggtgaagggaacaaagctggaggctctggagctgggtctgttttgacggtcaagtccagggctcattttggttattctactgcctctaggccagggtagtcctaacacagcctgacataggagagcccctggctgagcatggcagccttgaagacaccacaggccaaaacatgaggggcagaaatgggatcacagagtctgttgctagaatcttggcaacatacagcaggaaagccttgataaatcgggagtccaaaggagacaccatatttatggagaacattaggacaaaaagtcaccaacttactttgtaacattttaataatgacttaagggtcaagatttttttcttctgaaaattatgttctgagttaggcagaacatagccatggccctgggccaccctgtgctatctgaaatgacctcaatacactaatgccaacctcagcgtcatgccagaatgcacagggcagcccagggagatcacacctttggcaaagtccagacaaggcccactgcagttcctatggcgccagtcaccagctcctagacagcacttgggtaccccattggggtcttggagaggaagacatgtgaacataacggctccctgaaattgctcctacccatccatatttctggtcatgctttcagtctgacaaaaatggatgatactgctgtttttggtaacaaacagtgaatattcataagaacaaaagtaaaagaaaaaaagacacagtagaaactggcatcccctaaagcagggcttcttagccttggaactattgacatttttaaatggataattctttttttttttttctaggtggggaggggatggagttcactcttgttgcccaggctggagcgcaatgacatgatctcggctcaccgcaacctccgcctcctgggttcaagcgattctcctgcctcagcctcccgagtagctgggattactcgcctggctaattttgtatttttagtagagacgggctttctccatgttgttcaggctggtctcaaactcccgacctcaggtgactcgcccgccttggccttccaaagtgctgggtttacaggtgtgagccactgcgccctgcctgaactggataattctttgttgcaagggactgttctgtgtactacaggatacttggcagcatccttggcctatccattaaatgtcagtagcacccccacagtggcaacaatcaaaaatgtcaccagacattgctaaatattggggagcaaaatggctccccgttgaaaatccctaaaggatgtcatactagtgacaataagttaggatatgcttattttttagtacagcaaaatcttatcgcacatagctatccacaatagttatgatttaatgcagctctttatttatgaaataggttttagacatgtggtgattttaagttgggaaccagaaggaaatgattcgtttggtatggcttcatgtccttcagccacccccaagaatgtatcctttcagctctctttggttatacctgaagccaggagcgttgagttattagccttgtgtttatattcctctcactgtaattggtgtcattttcccagcagtcctagcagtcctcaagcaagtgggaaatcggaaaagaaaaggacaggcattgtagggaagcagaggataaagaatttagccaacaaaagaaacaatctagtcaatctgggtgcttttatttcctgggttctctctaaacatggctcagagctggtgtagatgaagtaggtgaaacctctgaaaagagtctagaaggcagtagagcaagtcccagaccagaaacatgctcatcttttcatcgtaatgtgccactcggtactatttggtaatgtcactctatttttcctaatcccatcctttggtttgtatttcatatttgtatataaggcaccattttctaaaaatatgactagggtgtgacctaaggttttattctgtgaagatgagtaactggaaagaagctaacactgcagtgggaaggaaggaagagagttgtccaggtggtagttcgacgtgttttgaatctagtccttcctacatggaggataaaagctcctaaagtccactctgggtttgtgattttaatagaaatagaaagggaaactatagaccaatggagatgaaaatcaggggctatcgacagatggaggagaaataaggtgctacatagagaaaggaagagggcagaaggctttcccttcccaaactgggtgagctggggaagccttggttcaggagagtggcactgcccacaactgctttgtgggttgtgcacttccagccgcactctccccctccagttgctgccttcagagccgtactgaagcacgagcttcaataagacaagcacacttcatagtgagagggcagcggtaccaaagcctttcagagagactatggattagacagaaatgatttgtgagaggaagctggagtgaacagcatgaacagcgagtgttacctgacagaggcaagacagctagaagtggcttcagatttagaaacagctgaggggagcaaagacggactgtgtacacagggagggaggatgtctatgggcagagcccttggtgagtatcatcaccaagaaaggcagtccagagtagagatcagccgaatatggaggctgaggtctgtagaactgggccagagaggaccttactgccttagtagcataagggtctggaaaagaagtttctatctcacaacaaaggaaaaagtgaaaagcaaggtggaacttgaagatacgtcacgaaaatcactataaaagtctgatttatgtgtgatgtcaaatcaaactgaaatgaagaatgagattgagtatatctgtggtgactgacctctgtatactagaaacctcaacatctctagaagaggaaataaaagctgctttgcactctg

SEQ ID NO: 624 - DNA, 29546 bp, Homo sapiens
tacaggtgaaccatagtctcactttatttcgaattttaggactgaacagaaagaaggttcagatatttcttcagggaaggaaagtgggcaaatagcacaatgaggcaaaccacacaatctagacgtactttcccgggtaaacaaactgggaagcccagagctcacagaggaggagagcagagcttggggtggcagagaggtgttcattgggaaggagtcaggaacacaagagaaatgttcatgagctcatccaggatagagaggactcttggggaaggggacctccttccccatgctgtctctgccccaagcccttaatgaagcaggagagggaagtctgtccagaacctcatctggttagacatttgcagcaggaatagggagggggtggaggcagagccactttggacatgggaaatcacagttgcagtagacagtgagctctagtcactccagaagcttgacataatttgcagggaagagtccaaagtggccatggcaacgtccccgccaccagccctcgtccaccatctcaatgtcagtgattacgtcgtccggatcaaaggaaagctcatcacttccctctggggagaaagttgaggggatattagaatggtcagacatgaatctcttttcacatgtccccctgtcttatatcaggggcctccatgtaccaggctcctcgggccactcccaacctacctccttggtaatcatatacagccacagctgagatccccagagccacagccccagccccagccccagccgggcagcctgatgatcctgcataatgagaaacacaaacatgggatcatcaacatgaagaaggcaaacagagaaagatcctactggggcaatagagaaattcttcttcctcttaccctcccctggacatgagcaaattctcctgcttctcctcccatcactcaccagccagagcagaagaaaaagaagaatcttcaggctcgagcacctcctcatagtccccctctggttcatcctcctgctcatgcctgtccatctcctcaacgtcctcatagtcattctcaggctcgggctcaggctcgggctcaggctcaggctctgcttcgtacactggctcttcctccacctggaggccttccagagtcctagggggcagagctgggggctcctcattgtcctgagaagagacagtgtggagcactgtgacttccactttccaggaggaatcaatggaggactgataagatcccccgcccttcaccaccctgcctcttctcccctctacccttgcctccatctaacagcctctcctggggaacacagcctttcatccatcttcattcttcaatctcctcccacacccacccacccaaaacacattccagagacaatgggaagagaatgtaaaaggtgtgaggggagggaagtagaaaacaagtcagattctttgggagaccaagaaaacattgaagcaagagcacattgttgagctaccacagctaggataatcatctatactagtttgcccaggacagaggagtttcccagaaggcaaggtcttcagtgctaacaccagaacagtgcaaggcaaaccaggatggttggccaccctgcacagcccacattcctaagactcgagaagatggggtgggggcagagaatctttgggggtttgcttacctccgggagagtctgcctaatgggcagcaagggcactgggtgttccctgctggttctcacaggctcagactctgatgatggaggagtcccaactggaggccaggcctgtggaaaatgaagcatctctcaagtaagcaagcctccatcttcactccttttttttttttgagatagactctcgctctgtagcccaggctggagtgcagtggtgcgatctcagctcattgcaacctccgcctcccaggttcaagcgattctcctgcctcagccccctgagtagctgggattacaggcacacgccactatgcctggctaatttttgtatttttaatagagacagggtttcactatgttggtcaggctggtcttgaactcctgacttcctgacctcgtgatctgtctgccttgacctcccaaagtgctgggattacaggcatgagccaccacgctcggcccatcttcattctttttattttattttatgcattttttgagacagggtctcactctgctgccctggctggagcacagtgagatcatagctcactgtagcctcaaactcttgggctcaaacaatcctcctctctaagcctcccaagtagctgggactataggcacacaccaccatgcccagctaattttttaattgtttttatagcgataggttcttactatgttgcccaggttggtctagaactcctggcttcaagtgatcctctcaccttggccacctcaagtgctaggattacaggcatgagccaccacaccatgcatgtcttcactgttacatttaccaggaacaccctctcccactctctgccaattcaaatggaactcatccctcaagatgggctccagcctgaagtgacggccccttcctcatagttcctacagcaataattggctgtgctggctggtgacttgctttctgttgtactatgtaaatcttgagggttttttctaacattctgataggaggtccaattacagtcagactgaagtcttctaaagacagagacaacagaccttgcctaacccaggggaggactttgccttattttctgccaatggtttggaccccttaggctcctgtctgggcaagagatcctggatgtggatcccagagggccaggcgctcacctctgaggagattttcttgggcagtggggccggtactgctggctcttccatagctatcactggctgtggagcctcagggctcctctttgtcacagcctttcgctcctgttgcctcctggccacctgctgtgccttctcctcttcctctcgcttcctcttctcctcagccatggactcaaatttcgccttcagcccacgggtaccactagaagctgcagacacaggcaagaaaaattagggttgtcttggattggagagtggggaagggcatggcacttgaaggaagaaggggaatcagttaaatatccgggaggagggatttgtgggacaggatggtaaagaggtatcgatagaggaacaagggataataggaggatggcatagccctgaagcctggatttttataaagccaggctatacgacctaagactcgtgtcttttttttttcttgagacagggtctcagcccaggctagagtgcagtggtgcagtcatgggacactgcagcctcaacctcccaggctcaagcaatcctcctacctcagcctctggagtagttgggaccacagatgtgcaccaccacacccagctaatttttgtattttttgtagagaggggatcttgctgtgttgcccagcctcatcttgaactcctgggttcaagtgattatcctacttcagcatcccaaagtgctgggattacaggtgtgagccaccatgcccagctgacttgtgtcctttctaaattgtaaactttgggcttccaaaaagcatcctcccctgtccatattccataaatctgtatgccttcttcaagccaccactcatcctcaacctcatccgaaactcctgtccctgtgtgttcttcccaagtggttcctcaccaatgttcccatgccaccccacccctgtcccaagccacactgtgttctctgcctccgattccttccccgacgtcactctgtctatccacttgactttctctctttctttcttttctttctttctctctctctctctcttctctcccttttctctctctctctctctctctctctctctctctctctcctctctctcctctctctctctttctttcgtctcactctgtcacccaggctggagttgagtggcatgatctcagctcactccgacttccgcctcctgggttcaagtgattctcctgcctcagcctcccaagtagctgggattataggtgtgcacctccatgcctggctaatttttgtattttttatagagatgaggtttccccatgttgtccaagctgttcttaaattcctgagctcaagcagtcctcccactttagccaccaaagtgctgggattacagatgtgagctccgccttacctggtttttctaggaaagacagaatctgggaatatgaggatagggatcaggtctaactcagctaatctaggtagttaaaggcatggaggatatagtctggggaagaaaaagaatgagggagaaggaagtgaggtgcatggagagtgaatcactaagcctcaccggcttctatgggcgtcgtcttcttataagctgtggtcggggcctccatttcattgaagccgacagcgctctgcaggcaggagaacagcatgtgtgttgcgggagaggggcaagggtagtggtgacctggaggtagtattgggggttgggggccactataagaggtatccctaaccattggatgctcaacagctggacagcatgttccaatgttgttttgtggtagagagggggtaaagaagttcttaagtgctgagttcagctccccctttcagcagctcagtgaccttagaatctcacatctccaagcccagttgcctagaatgtagcagggccccctggctcatgcatgaggaggaactagtgtagggaggacagtggcatggggtgggaagagacttaagattgggttaagcaatgccaagaaatcaatacaatttccagtccaatacgacctttcccggcggtttacctgtctctctgtatgcctctcccactgtcctcaaagctcaggctttggcagacatgccccttagatgctgagggcagtcagtggggactgcaggacgccagcaggacaggctctgtgtgcccagcaccaccgtcccctccctctcccagccttcttcacgctcttctctgcacactttcctaaacttagggaactcttcttaagacattggtgttccggtgctttaccttatccactcggtccttctggattccatactggccaccaaagcccttggcataatctgcaggacagaaagttctgagttataggagatcaaaatgctgggaatgggtggtgagaagaatcagtgggaagaaaaacaggaatgtggaaaacaaatgtaggaggaaatgtgagaatcagaggatagagggaggcatggatgggaagagagggaaacagatggggaaaaaatctgggagcgaatggagaagacaaagatggaagtagggaaacatggaaagcagaaagcaacagataaggaaaaatgtaaaagaaataggaaaaaatacagagagcacttcagccatccgtatgggttccagggaagcagtaaacctctttatcctctgtgaggacagcagagatccctctaagactcatggcaaaccatcttctgaccatcactcagcttgtctgtcctcattccttcctcaacgcccccttctctctcacctccctcctaggccctgctcttaatccttctgttttcctctccatctctcctctctcccctcactaccaccacctgtccccacacatgtgcttactgccctggcaccccctgctctgcacatctgcccctctgtattctggggcacccgggtgagcttccagaaaggaaggaaggagatccctgtgctatctgtgaccttcccccttccaaccccaactcacctctctgggactcgtgtttctccgtctctcccttgtagtcatatcccagagctgctttgtcccatttatccttctccaccccgtaccggccaccaaagccacgagagtaatctgtggtcgaaggagcagtcatgagagcccacccttaggctccagcacacagggaagcgctggagaagagaggtcagcaggaatgggtacagagtgttaggggcctgggaaaagagcagggcttgaatacaggggaattaaagagaagccatgtcttaagtagtcttttaattgaatattgcttactttttccctctcttctctcatttccatgccaagatgagaagaacattcccattttctcccttcttcttcaagaaggggaaagtatagagagtgaggagattgcagaaaaaaaaaggcagatacatgaaatgtatgcctttcccctactcccatataagcacatagaaatgtcagataaaacataacaattgtgttttaaagagtgaagctcaggccgagcacggtgctcatgcctgtaatcccagcacttcaggggccgaggcaggtggatcacctgaggtcaggaatttgagaccagcctggccaaaatggggaaaccctgtctctactaaaaaatacaaaaattatccaggcatggtgatgtgcgtctgtagccccagctactggggaggctgagacaggagagtcacttgaacatggggggtggaggttgcagtgagccaagattgcaccattgcactccagcctgggtgacagagcgagactccatctcaaaaaaaaaaaaagtgaagctcagcagaaaggaagggaaaaaatcctggctccagaaaccagagacaaagagatgaatcaaagctgtatgtgtgaagataattatgaactgacaccacagaaaacccaagggcatttttgggggattttttgtttttagaggtagagtcttgctcttttgctcaagctatagtgcagagtacaatcatggctcactgtaaccttgaactcctggggtcaagcaatcctcctgagtaactgggaccacaggcaggtgccaccatgacttgctaatttaaaaaaaaatctgtagtgataggatctcactgtgttgcccaggctagccttaaactcctgggctcaaaggacccacccacctcagcctcccaaaatgctgcaattacaggtgtgaactaccacacctggtcagattttaaattccaaatgtaatgaatagggattaggatcgaggctctgtgattctaatttccatttaagaatgggggaggagggaagaaagccagaaacgaagctctgtccactcctataagagagtgctagaaaaattctactcatttactcaggaaaatcatgaagggggcttgtaacctgttcaatatttgatagggggaaaatttgcttatgagacttggaaactccaagcctacatctgagtgtagaatgcaaatacacattttttttccacttatgtgatgcaggaattctaagctgagaaattaactaaatactgatccaggaaaatatacattttggaaagagtaagcataagaaagatggcatgaatatgagataaagtgatctcaagacaaagtgcattctaagagacaagaaagacatgctccaatgataaaagaacaataccttacatcaggagtatgtatgctggcataaacctattcacagaaccaaaattcatgaagctctcaaataaaagaaaaatgtaaaaaaccaggtgtggtgaatgcctgtagtcccagctactcagaaggctgaggcaggagggtgacttgagcccgggagttcgagaccagcctgagaaacatcgcaagactccaacacacacacacacgcacacacacacacacacacacacacacacacaaataatgcaaaagctgacagaagtagaaagagaaatagacaaatctgtaatagtagttgaacatttaacaccattctttcattaattaataggtattttaggcaaaaacgaatcagtaaaattatagaagatccaaacattatcaactaataaacctaattgactcttatacaacactataccccaaactacagaatatacttttttcatgcatatagaacattgaccaaatagaccatgtgccagtccataagtctctaagacagtaagtctcagtacatttcaaaagactgaaatatcagagatcatattctgatcacaatagaattaaagtagaagtcaataccaataaaattatctagaaaatttccctgatgctcagaaaatcaataacagcttttaaataatacatgtgtcaaagaagaaattacaagggaaataagaaaatatttttaactgaatgattttattttttgttgttgttgttgttgttgttgttgttgttttttgagacagggtctcactctgttgcccaggccaaaatgtagtggcacaatcatggcttgctgcagcctcaacctcctgggctcaagtgatcctcccacattagtcccctgaatagctgggaccacgggtttgtgatgaatgaaaattaaaacacacacattcaaatatttgttgaatgtagcaaatgtttgtagcaaatgaaggtagtgttcagagggaaatgtatagcttttcaagtgcccatatagtaaaggaaggcttaaaatcaattatctaagtttctactttaagaggctaggaaaagaacaaactaaattaatactaagtagaagaaaaacataataaagataagagcagaaaccaatacattttttaaaacaagtaaataatagagaaaattagcaaagccaaaagcttgttctttggaaagagtaataaaattgataaacttctagtaagaataattaaaaagagaaaaaacacaagtaagtaagatcagaaatgaaaataggcatttcatatcactagaaatcttacagaagttaaaaagaagagaatattataaatgaatttatgccaataaacctgacaacacagacaaaatgaacaaattccttgaaaagcacaacataccataaccaacttaaaaaccagaaagacttgaactccatgggaaaaaataataataaaggaaaaaaaatgtccgttactattaagacctctagagttgagccagaagtagaggcaatatttccctggatgaggtacttactaaacccagggcacatgaaattctcataaaacaaatatccctctccttcactaaaataagtttataaacaagattacaaaccatcaaggaaataaataaccatgaggaacgcagattagtcagaagaaatggcacagccaagaactgcaaataatataaaatatgaaagaaactgcaaagtacatgtttaaaataattaaacagcttaaagaagtggcacagggaaccataatgaaaccataatgtcttatggaaaatgaatcagcagatatgcaatagaaccaaaagaaactccagaaatgaaaatatctgatgtggtggctcatgcctgtaatcccagcactttgggaggccaaggcagaaggatcacttcagcccaggagtttgaggccagcctgggcaacataataagactttatctaaaaaaagagagggaaggcaagggaaggggaggggaggggaggggaggggaggggagggcaggggaggggaggggacgggagggcagggcagggcagggcagggcagggcagggaagagaagggaaaggaagggaagggaagatatttgaaagaaagtttaaaatgcaatggacagcttaaacaataatgaaatacagctaaaggaagaattagtgaacttaacctagagctaaaggaataacccagaatgcggcacaaggacataaagagaagagagaagaggtattattccaagagaaaatgcctgagaacttcctataatgaaagtcacatctgaggttgaaaaagggcagtaagtcccatataggataataaaagtagatctaacattcagacacaccctaataatagtgaagaatatcagagaccaaaagaaaatctttaattaaaaaaaacccggagatataagacatgttacctactcaggaatgatagtctgacacaagagagatgtcagagacgatgaaataagatcttcaaagtgatgaagggaaaataaaaatgaagaatgatgcaacataaagacatttttcaaagactgaaagttctttcatagactcattgaaagaattatcaatggaatattttagcaagaaggaaatagaagacacaaaggtgaaacaatgaaatacaataagcaatgttgagctaggaaataggtaaataccttggtcaatttaaataagcatttactaagtaataataatgattcatttttgtggggtttataagatggaatcaataataagatggaataagatggaaccaatatactgaacaacaacaatatggttggttaaaaagaatgtagttaaaatattctatgtttccaatacactcaggaagagattgtgattaattttaaatttaagtcaaagatgcatgttaaaatttaggaataaccttctaaaataaaggaatagaataccttattttcaacccattagagaaaaaagagggattcaaaaacttgatcaatatggccaggcgcggtgactcaagcctgtaatcccagcactttgggaagccgaggcaggcagatcacgaggtcagaagatcgagaccatcctggctaacatggtgaaaccccgtctccactaaaaatacaaaaattagcccggcgtagtggcgggtgcctgtagtcccagctactcgggaggctgaggcaggagaatggcgtgaacccggaaggcggaacttgcagtgagccgagatccagccactgcactccagcctgggcgacagagccagactccgtcgcaaaaaaaaaaaaaaaaaaacttgatcaatattatagaaagcgatcacggagaaaaagagaagcaagtgcacactgggtttaaaaagcatataaaatagggccgggcacggtggctcacacctataatcccagcactttgggaggccgagtcgggtggatcacgaggtcaggagatcgacaccatcctggctaacacagtgaaaccccgtctctactaaaaatacaaaaaaaaaaaaaaaattagccaggcgtgctggcagtcgcctgtagtcccagctacttgggaggctgaggcaggagaatggcgtgaacccaggacacagagcttgcggtgagccaatatagtgccactgcactctagcctgggtgacagagcgagactccctctcaaaaaaataaaaaagtatgtaaaatagcggtgggtgtggtggctcatgcctgtaatcccagcactttgagagggtgagaggggagaatcacttgagccaaaaggtttgacactgcctgggcaacatagtgagactccatctctacaaagaataaaaaattagccaggcatggtggtgcacacttgtagtcacagctactcagaacgctgaggtgggaggatcgcttgagcccaggaagtcgaagctgcagtgacccatgattgtgtcactgcactcccgcctgggtgacagtgcaagaccctgtctcaaaaacaaacaaatgaacaaaaagtaaataaaatagtggtgcgctgggtcatggaagttaaaaagctgatgacaactgctggaagataaagtcttagcagaagagcctgccggtcagattgctgaggctgagtgaagtacagtgtccttgcctttctgagatgtgtgcttctccacttctcctttataatcaaagccgactgctgactacagagaagaggagacagaattggttagagtcagagctgacaggttttcctcttcctaacctccccttactcccagccagccccagaggtagtttgtaggggcttcaggctgagtataggtgtttaatgtagaaacaggctggtatggacacaggatactacagagcaatgaacataggccctggacacagacagttttaggttcaaaccctacatcccctatttatagttgttgaagtttaagcacgttcctttatattactaagccccagtctctttcaatataaaatcaggagaggcatgcctgccttatctacctcgactgtaaaatgagagaaatgatccctcttcatctgggatgtcatgagaactaaatgggacaaggtaaagtgtctacttagtttcattcactaacttagcgcttttcttcctaacgaatcctcacaaaagtgaaatgtgatacctagaaaagtgccttgtaaagtataaagcactctgctcatgaagagacattaccctattcccagttgataatgctgtgcctcttctctttcattactcaataatggaaacacaaatatgtggattttggtgggataactgcaaccaggagagtctggatcctagctggctctgggactggatatgttgcccagatacccaacattaccgcagagttttggagctttgttctccatctggctcaggaactatgggtatctaagcaagtctgggtttttgcatattaagaactaattaacatgtattgtttcttgatttacatgacacactgactgggtgattccatttgtggcttgtgagcaaaagatgtaagaatcggtgattaagcaaaggcaggcaagagtggtgccaagatggaacagggaattccatcctgattctagaacactgcatgctccatatttcactattgccttctacatcttcccttagctttgcagtatgttttaaactttcctgattttgtttttcatggttttaccccccatgatgcaaacaattaattttctagaacttagctgccttagcttccaatccttagctttaaggatgcatgtccacctaattaacaactgttggtaaaaacaaagaaaaaatctcagctaactgtgaaggagctgtcctctctctgtgtgcagctgcagggcaggagacaccattctgcaccataaaaaatgagttcaaagaatccgacctaataaggcgtggaactaaaaacatcgatgagttatcaatcttactctcctgtcaacgatatgatgctgtaatcatacggtacttttttttctctttaaaacaacattttgttttgttttgtacaaaggagtctttaaagatatctggacttcatagattgatgctaaattctgtaaatagtaaccctaattagttgtttaacttgattatctgctgctatggcaataatatttaaactgatgaatctgttttcctaaacggcatgagtatttataaggttttgatgttaagccaaaagaagagcttagatgattctctgttctatcttcatgcatatgagtataataaaaaccagtggcttgaggaattattcattcaaacacacagtttgagagtcttctcctatttgaatcactgtctttcagctcagcatgtggcttccaacattggcaccaaggaacttgctgagggaggtatccctgtgacggtgtcaggtcctcacagcatccactgtcctgtctttcaacaaagaagcatgtgcctccatccaggggtgatcgtgggcaattttcacaggactggaggtgggtggttgggagagagagtggtcacttaccttgtctgccctgtccctctcaactccgtacttgcccccaaagcctttggcagcatccgtctgagaagagtgcttctccacctcggcaacatactcatggcccactgcactctgagaaaaatcaaggatggagtgagtgaaaagataaaaatgaccttaaaaaaataaatacagatatggagtgggatgtaggcatgtaagaaattccattctgggtcagatctatagcctctgacagtggtgccaaggaatacgcgatgggagagcaagatgactttttctggagacctgctcatccctgttcttctctaataccattaggaatccttcattctgaacactcccataggatgggctgggaaccaggggatagagacaaggtagacagagcagtgtttaaaccagaaacaaaaagagctgaaacaagagcattgtgcagcagaacagagtgtagtgtggggtagtgtggaggagagaccaaggggactgaccggacgccatagccgggatggaatatttcactaggagagccaatgattttgttctagatctttgctcctgtatggccatcaaagttcagaagtgaactctgagctttatacaccatgtaatgtaggacatgtatacaaaaaaaatcactaaatacacagtaaataaaataataaagagaagttgcaacatagacataatacataaacatttaaatgcagcaaataattttaaaacatattttttccttctccacttgtgctccctgtcttcttggtctaggagttacaatgtggttggggctacaacaggccagcagttctaatatcttggttcttattttctgccatgtatatcttatgtgttgagatcagaaaaatttgatacaaataatatgtggacattatattttagaccaaatgactactgtacttttgaatgagttttaactcatgaaccaatgaatgagtcaaaaaatatatattttgatctagaacaaaagtatctgggtgttttagcaaaatttttaaatatacttaaatattatatactatatatttatgaataaactatatatttataatataaatatgttatatcatataattataatatattaaaatatacataatataaatttatatatttacatttacttataattatgtaacatatattaataatatatatttataaatatatttataaataattatataagtatataatatataatgtattaatatataatatattaattatatacttgtattaatatataatatattaattatatacttatatataatatatacttatatataacagatactatatataagtatatatataatatatcttataattaatatataataatataatattaaatatattatttatatttttatatattttatatatttatatatattttatatatatttataaataaaaatatataatatatattatattttatgtattatattttatatacttatataatataatatatattatatattaattatagtatataatatattacattatattacatattattactatgtaatatattactatgtaatatattacatagtaataatatgtaatataatgtattaataatgtagattatatattatatatgatatataatatataatatagatatattatatattatatatacttatatatagtatctgttatatataagtatataagtatatattatatatattaatatatatttattacatatattaatatatataatatatattaatatatatacttattatatattatatattataagtatatattatattatatatacttataatatatatacacttatatataatatataaaatataatatacattatattatatttataacatatataaaatatataagtatatataataaatatatacttatataattatatacttacatataattggctcttatagagccaattattttatagccaattattatagagccaattatttattatagagtcaattatatatacttatatatagttggctcttattatagaggtatataattatatataagtatataattatacatatttacaaaatatataagtatatatatcaattttttaatgtattatttatttattttatttattttttttttttttgagacagagtctcgctctgtctcccaggctggagtgcagtggcatgatctcggctcactgcaagctctgcctcccaggttcacgccattctcctgcctcagcctcctgagtagctgggactacaggcacccaccacgacgcacggctaattttttgtatttttagtagagatggggtttcaccgtgttagccaggatggtctcgatctcctaacctcatgatccacccaccttggccttccaaagtgctgggattacaggcgtgagccaccgcacccggcttgtatttttttaaagcaaatctttccctttcaacttaccttgtccattcggtctctttctactccaaaccgacctccatagccatgggatgctttgggccctgactccatctctttcttcctgagaacatcatgctcctctgatactttgttcctcagctggtggatgctggaagaaaccacatgaccaaggctcatctatcctagggagatcaagaaacccatcttcccagaaaaatggaagccttgaagtctgtcctgtttactttcagtaataacctgggcccccaaaatatactagtgatgggtctggaagtaaaagatcagtctggcctgcataccatagcctgatttaaactctccataggccaataatatttcctctagtctgttatttgctcactaaaataaccttctgatctttagtcccatttttcatgttcttaaatattagaggacaatggtacctatattctgataactggaaagttattttcttttctgaatggatctgctttctatcaattagaggatgtgtctcaaaaagcagaaaaatattcacataccattggacctacacattctagttttagcagtctacaccagggaaatgattttaaatatggcaaagcttaatgtccttaatgtctaaatgatactcattgaagcatcgtatataatagcaataactaagaaacaatctatatgaccaatggttggataatagttaaataaattgaaatactacctttcactagtgtactaggaagtcattaaatataatgcttataaaaacacagaactggggaaatttatgtaaacattagtggtattttttatgctttttggtcatgaattaagatcttctgccccttccccccaggctgataatacctgagaaaactaaggactaatgaaaactaactaagaaaatccactcacagttattgctataacactttaagcctcaaattatcttgatttgaagggacacctctatccctaagagaaagtaccaccaaaaaaggcattatctttcttacttcacacccacttccatctttaccatgaaggtgactgcaacaattaagagggcagaaagccatcttggccaacctctttggcttgaggatatgaagtgatagctcagccccacgtgacaatcagatctgttatttggacacatataaggatccggggattcttggaaacatttgggcaagagaaccctaaataagaaatttgactttctgcagcaagcaatgagggtttagggtattaagatagtgatgttagatggtgagctgggactttaccagcgcaggacaaccagacacattggttatacgtagaatggctgtctcacagcagaaattgtcttcttttaaggaagaatagatccatctggtggcctttagtggataattctaccaaaggtctttttaaaaagccttctcagctttagccgcagttaattttagaaagctggctatgaaccagatgaaattaagccaagtgctggaagaaccccctgttcccatgcctcctctaaactctctggcagcgttgaaagcagagatcttgtgttgtcagttcaacaccaacactgtgtcataagctactagtaccaaggacatgtaaatgcctgcccaatatcttccaactgaagtattcagatgaaagatcaagaaaatggggccaaaatttactttcaaatggaaaaaatctgcaattttttaatgaatataataattgttaaatgggttataactatattatagttaaaacaagtttttaaaagggattagaaaatgatactcagaaatattcatctaaaggataacagaaaaactagtcaggggatcataccaatgatataatttgaatgaaattgttgaggcccaaagaaaacagacttctttaggttatagtggaagtcattctaaacaggtctttattattattattattattgagacagaatcttgctctgtcgcccaggctggagtgcagtggtatgatctcagctcactgtaatctccgcctcccgggttcaagtgattctcttgcctcagcctccagagtagctgggattacaggcatgcatgtcatgccccgctagattttgtatttttagtagagacagggtttcaccatgttggccaggctggtctcaaactcctgacctcaagtgatcctcttgccttggcctcccaaagtgctgggattacaggcgtgagccaccacgcctggcctaaacaggtcttaatcacatcattccttcattttataactattaactaaacaacttttaagtgtgaggtactgttaggctctgaggacacaaaaatgttttatgtatggagatagaggacagctagaagagatagagaggaaaacaaaaaattccaattcaatatgctgtgttgtgcctaagaaacttttgacatattaactctcagatatccaatttaagttttaaaagactttgtattgataaagcaatgcagtttatgtgaaccaagcaaaatgtagcacctcaaagatgactcattcctcaatctgtgtttgttttttattacaaaactaaaagcacaaatgtgagtgactcagaatataaggtttttattcacagatgacctgatcatgtatgtagaaaatcctaaagaattcacacaaaaaaagctactaaagcattgtgcatttggctaggtcacaggatacaaggtcattatatcaaaatcaattgtatttttacatactggccataaacatttggaaactggaagttaaatataaatacatgaaataacatgaaacattttaggataaacttaacaaagtatgtgcaagacctaaacactaaaaaatatttctgaaaatattaaagaagatctaaataaatggagagatatcccatgttcatggattggaaaactcaatatcattaagatgtcagttctccctaaaatgatctatagattcaatgcaatcccaatcaaaatctgaacaggcattcttgtaggaattgactagtgaattataaaatttatgtgaaaatgtaaagtcctggaatagtaaaatcttttgtttctttttttttttttaaggagagcaaagttgaggactacataatttcttgacttataaagctacaataatcagtgcagtatggtatgctgtcagggtagaaaatagatcaacagaacagaatagagtccagaaatagacccacatgtatgtggtcaaagatgccaggtaagtcaatgggaacagaatactcttttaatattgttgaacaactaaataatcacatggagaaaaatgaacctcaatcttgacctcacactgcacagaaaagtctacttgaaatgggtcatagacttaaatgtaaaagctaaaactgtcagtcctttaggacaaaacatcaaagaaagtcttcacaactttggggtaggtaaatatttcttagacacataaagcattagccccataaattttttttcaataaattagacatcatcaggattaagatcttttgctcttaaaaagatgccattaataaaatgaaaaagtggccaggtgtggtggctcacgcctgtaatctcagcactttgggaggtcaaggcgggtggatcacaaggtcaggagctcaagaccagcctagccactatggtgaaaccccgtctctaccaaaaatacaaaaattagctgggcttggtggtgggcgcctgagtcccagctactcaggaggctgaagcagcagaatcgcttgaacccaggaggcagaggttgcagtgagctgagatcatgtcactgcactccagcctgggcaacagagcaatcaatcaataaataatcaatcaatcaatcaataaagtgaaaaagcaagttatgttctgggagaatacacttgtaaaacacatatttcacaaaagacttacatccagaatatataaagaactttcagcaacttaataaaaagacaaacaactcactttaaaagtgagaaaaagatgtgaacagatacttcataaagaagatatatgaagatatatgaatggcaaatgaaaatatactcaataaaactggtcatcagagaaattcaaattaacttaaaagagtggttaagttggttttgttgttgttgttgttgttttgttttgtttgtcttttagagaggatctcagtctgtcacccaggctggagtgcagtggggcaaacatggctcactgcagcctcaaccccctgggctcaagtgcttctcctgcctcagcctcctgaatagctcagaccacagccagccaatttttaatttttttgtagactctgaatctctccacattgtccagatggtcttgaactcctgggctcaagtcatcctcctgccttggcctcctaaagtgctgggattacaggcatgagccactgcacccagctaaatttaaaaatactaacaataacaaatgttgacaaaaatgtggagcatctgaaacccacacattactggtaggaatgaaagagggtaaattccctttggaaaagagtttgagagtctctcaaaatgtttaacatacacttattatatgactcagcaattctactcctggcaattttccaagagaaataaggatatgtcaacaaaaagatttgtacccaaatgcccatgacagtttcatttgtaatagatccaaattgtcaataatccaaatggctattgacaggataatgaataataaaactgtgacatatccatacaatgggacactacatgacaatataaaagaacaaaagacttatatacacaacaccatggataaatctggaaaacattatgctgaaagaagacaacacaaaacaatacattctatattattctgtttgcatgaaattctatgccagacaaaactaatctatagtgacaaaaagatcagtatggggtgtattgactgcaaagaggtgcagggaaattttcatggtaatagatatattctatatcttgattgcattggtggttatattatatatatatagtcaaaactcattgaactatttgcttataatgattaggtatcaataaatttaatttttgcctgggcaatggtggcttacacctgtaatcccagcactgtaggaggccgaggcaggcggatcacttgaggtcaggagttcaagaccagtctggccaacatggttaaaccccgtctctactaaaaatacacaaattagctgggcaaggtggcacatgcctgtaatcccagctactcgggaagctgaggtaggagaatcacttgaagctgggaggcagaggcggaggtttcagtgagccgagatcgtaccactgcactccagcctggatgacagagcgaaactccgtctcaaaaaaaacaaagttaatttttgaaaaataataaagtgaagaaaaccttaaatgaaagagactttgggcactcataaagaggtttgtttatgaagtgattgtagtattattaaggccaacttatcaagtactttgtcactgtaaacagaatagcaagcagccttagggaattggcaatagcttagttcatgggaatttgcatttcatttcaacaaaagaattacggacatgacgatattatgtttattagacaaaaacaatatattggttaagatttcagcccatggagtcagactgagccgaattcaaattactacaggttgactatccctcatcccaaacgcttgggaccagaagtgttttggattcaggattttttcaggttttggaatatttgcatatacataatgagatatcttggggacgagacccatgtgtaaacaggaaattcatttatgtgtcatatacactatattaaggaaggtattaaagaagaactaaataaatgaaggtaactttatttttcccttggggacgctgaaaaaactgttgtgcacctgtattttgactgagacccatcacatgtagtcaggtgtggaattttctacttgtggtatcatgtgggctttcaaaaatttcagattttggaacattttagattttgaatttttggattagggatgctcaacctgtatctctgtatcctcggacaaattgctaaacattaatatatccattcacttttctgtgaaatcaggatgccaacgtcatctatgatataggattgtttttaaaaagtactctgtgttttgcaagacatataatagcttaataaatgttagtcattattcttaagttatagccatggctcttcccagtacccctgtgaggtaaacagggatggtactataatctccagtcagcgctggaaatcaagataggatggtaaaatattattactctcctcagcatcataagcctttttacagcagagctggaatcagtccctagagctccagaattctatttctatactcttggcattacaccattctttatttccacttgctataaaatgtcagggcacgagaagaggacagggccactgaggcagacatcctatggttatagctcagtaaagatttaatctaaaggccagactggttccaggaagtgctgaaagattattccagagcagtgccactcagtgtgtggtccacaagctgaactgtttctgtttcacagggaaataagaataaaaattgagaatatgtgtttagaaacttttatagcaatttgacatagtgattttattctttttctttttcttttttagaaatggggtctcactgttgcccaggctggagtacagtggctactcacagacacaatcccactactgatcagcactggagttttgacctgctccatttctgacctgggcaagttcaccccttcttaggcaacctatggtcccctgctcctgggaggtgggaggtcactatattgattcagaattcagcgtggagacccaatcagcatagagcactatagcccagaactactggactcaagtgatcctcctgcctcagcctcctgagtagttgggtctataggcacagactagcatgcctgacaacatcgtgattttatatctgttgaatttaaaaataaaaactgtgtttgtattgtctatgttatttttaaccatttatttttccagaaacttaattgtattttattttacaaaagtatcagtctgtgacagatttgaaaataaacaaacaggtcaagggaaaagacacccttgagtcttgagaatgaatgggcaagagtggagaaaagaaggtggagagaagggtgatagttcttgaaaaccaggcagttcctttacagaatggataagggatgcataggaccatttgaattattcactgaattaccaaattactatccaaactaaatttattcaagacagacctaaaaagagacatcacggtgtggggaaggtagtaagattagtaagaactgcaaccacttccttttcctgcttttagtcgtctcagctctacagctactgttttgttttgtttgtttgttttttgttttttcattttgggatctgtcagtgttagcatctacagctactgttctcctctccaatttccctctcctttccaaggaccatggtgattcccatcagatgttaaagactgacttagcccacactaacgagagggaatccccaaatagtggagacttactactggaaagtcctctagaggtctttttgatccagatgggcaaaatgagaatcagagaggaaaagggacttgtctaaagccacctggcctgttaccagcagataccaggctttcactccttgataacctgggtaaatgggagatgagcgagatttttttgtcaatatctccatcgtttattctatctgatagattcagttaggttaacaaggaaatgtgcagggtcaccatgttgtaccactccaggcagcacccgtcagagtgatctgtgtataggagttgtgcaatccaacagtccaggtagacaccacttaggagaaaaaagggctgttgtctgtttacatgtttgttagattttagaaaggaaatctgattaaactaacctatattaacaggaaacaaaactaacatcactgagctgctcagaagtgctaagtactgcattagacattggctatcccattgacctgtaactatacatcttcagggtggctatttttttttaagttatttcatttttttatgagggttgcttgctcttttttttttttttttttttttttttgccaatgcctactatattgcaagtcgtcatggcggagtgttgggaagttttcaattagcaataatcacacctcggataaacctcattggctacaataccaccaaaggcatgaagtgtgcatcctcatctggacaattcccagaataccagcgttgagtggcctttattcagaaaaggaaaagggtcttgtggtttttttttttttttttttgatctatgagtctatagaggggtatcacagaagcttcctgaatgaccctgttccattgtttcaatctttttccagaatggcatggtttaagaataatattcattatagctacttaattgaaaccatttatttatttatttatttatttatttatttatttatttattgagactgagtctcgctctatcaccctggctggagtgcagtggtgcgatctcagctcactgcaacctgtgcctcctgggttcaagagactctcgtgcttcggcctcctgagtagctgggattacaggtgcccgccaccacgcccatctaatttttgtatttttagtagacacagggtttcatcatgttgcccatgctggtcttgaactcctgacctcaagtgatcttcctcgctcggccttccaaagttttgggattacaagcgtgagccaccacgcccggccgaaaccatttatttctgattaaacaatgtggtattgtcatccagttgtagaaacttgtgccaggctttcacagtatgttgcttgtgcaatgtggtcatccactgacactttttaaaatctagaggtaaaaacactgcttttagggtgcggtagggggagttaaaaatggagcttaaaactgtattaatcttgccattttgtgtgtagttgttgaatttttgcttgttacactatttattgtgtctaccttgctactaatgtttgacattctgatactatccaaagcagatggtcctggttagatgatcctgaatcatccgtggaagagagaaggggatctctcagcctgaatgtatgacatatcccacagaaacccctggatatgtctgtaagttccttttatcttctggtatcggagggttttgtttgtttgtttgtttctggtaaaatgcatatggggctataatcttaaagatccctgaacatcgttgccaaaatagtttttatcaacaggttttccaagtgttacatttcttcatattaccattcatggcttccaacttctgtcaaatagctaagtacaaatctgtattttaaaagttatttgggccagttatgggagctgaagtggcctctttttatagcatttattctgagttcttcaccttgacattttactgaattgttcttagttcatctgaaggaagtcaccctgaattctaaatacatatttacatttatctgaagagatagataggagatagatgattgccaggtagatagatagagaggaccttagtatttggtccacttcctctatgaatctctcatgccttactaaaggaagggaggcagttaatccaatagacccacttggggaaatagcagagttgttaggtataaaagatagataatagggttgaggagggtaagaggagagacataaaatggaaatatgcaatgacacacaggtacacacaggaacagactctagaaaaaaaacaaacacaataatacatagacatgaactaccctatccttttcctccctcaccttcccccaagtctccgagttttctttgggctcttcccataacccccttccttttctccagtcctttcggcacctacttgatgtgttctgtgcgtccagacccctcgatggtcttggctccccatcgttgctccttttcagagatgtcattctgcaaacgacagcacgcagtaatacatgacggcaagaaatgtgccacattgagaagggccacccaactgacacatgccctccatgtcccctgtgtccactgccttcttcagtctgggtctttattcacatcccctctatatttatcccatcctgaccccatgtaagaattaaactggtgaggccaggcgtggtggcttatgcctgtaatcctagcattttaggaggccgaggcgggtggatctctttaggtcaggagctcaagactagcttggccaacatggtgaaaccccatctctaccaaaaaaatacaaaaattagccaggtgtggtggcatgcacctgtagtcccaactgcagggactacttgggaggctgaggtaggagaatcgcttgaacctgggaggcagaggttgcagtgagctgagattgcaccaccgtactccagcctgggtgacagagtgagactctgtctcaaaaaacaaacaagaaaacacaaagaattaaactagtgagctctgaaacctccgttcctcctctgcctacttcatgcctaccccatctggtctcctacagctttttaatcccccaattacacatgcccagcttgaatcctggatcatgggccaggggagacccaggttcacctgcttctcaccttcagtgtagcctgccatggcctgtcaatcacactgtcaaactcacccacacctgtctcttttcatccctgataccaggtatcgtgcatgccccacaggtgacagccaattgtcctaccaattagtcccagtatgagggctgtctcagtcctagaaggcccttttccaagcatcctcaaagatcacagagtggcccagatgccctcctcaccccaccctctgcactgtccaagcaaagctacttccaaactcaccacaaagtcaggatctgtgtcccaatcatcaccctgggtctccacggaaacagacacatcatggcccactacagacttccacatctgagagtgaccggagatgggaataattagggacaaaaaaggatcaagaggagggaaaataggaatgctgaagtcaaaatatagcagcccaatatttcctgccattttttttttcttagaagaaaatagaaaatgaagcaaagcaaatgggagttgtaggaaggcttttctgctcagttacaagatgagagatgggactttaatcaagacgaattgatgtgggctgggcccacctggggctagagagaagtcatcatgggtgtgggtaacactaggtaacccacgagtcaaaattgctggaattgttcacttgtgtcccgaggccagccaggcagtggctggaggtggttggcaatgagcggtgctataatatccctagaattatggccttatttcactcaggtttctatatatgattcctttgttgctgttgaaatacaaattggttctgcttctcacaaagtgaacatctacatccctctttacaacctgctgaactacactgagaatttttccagcctctggtccaagtgctgtcccacctccaccctgagtctggtcacctcacagctgtgtaaggtcagcagcgacagtcggctgaaatttccacatggaacaatgcattgggagagcattatttgctgggaataagtcagttattactcaattttttaaaaatggttcaattaattgctaaagtcaaaaaatagcatgttttcaagttgacaatttaccgtagaaaagaaaaaagaataatatgtaataaatctgattttgaacattaagaggtactcagtttttatcaactaaataaatgttgcagaaatatttagagaaccctagcttggaagggtgccaaacttattctgctggggcattcccagtgttctagacggccttccggactgtgcagaaggaagagcggcacagttgctctgcatctgtggatttggtgtgaagaagtaacaacagacaatgctcatctgctgtggtcaccactgagacttcttgaccctggcagcacttgctagctggcaatccttccctcctcagacacctcatcccattggagaccttccccatgctctccatcgtctccaaagagtccctttacaaccactcctcgggttctcctgtctccacctaggccttcagattctccagttttctatttccacttgaaagctccatcttctccattgagcaacctcttaaaaaccagcccaggggaagtctgggtaaatcagttaaagagatgctaaggggacaccggagagatattgactgagtcagccgggagtcatggctgaaagcagcttggctttccctgatgcggttggagacagcaaaacatccttactacctgcatccttactacccctctgcttctcatcccctggctcctgggctgctgtgcaacaacaaaaggactgtcacacagaaaactggaatggagaagtttctgaaatagtcatgagcaataaggaagcaatgaggactgatggtcccatcctccttcctgtggctcctctgaggcctcagcctgactctcccattcacccatttttgaaataaagagtttctgaaatagagacaatttatctaatatccttgacctattgaccagaaaccagaaaggtaagaagtgctatctagaggtgagaaccagagagtaatctggtgaggccttgttgcgatgctgacctcctgcatcaaagtacacagactgggagtcagaagccctggctgtcaccccagctctgtgactaagcctctgagggaccatcacaagggcatcaacagagtaggtactcatttgccaggtatcagaccaggcgattaagaaatactaactttaataatttggcaaatcagcaattatctctgattttcccagtggaaaataatgaaggggttaacgtagctcatctgtggtctccttgatttctgacattctgagattctgtgatctacgaacacagaaactagccccagcagaacaatcatgccttctcttgggctccatcagcacttggtactcagtgctagtgtacatcagtgactacttcctgatctgttacatttcctgtgtgggtttgtttccctgagaccatatgctcttcaagggcagacactgttttcgtctcctgtggtcctcctcccagctcagtacctaggggagacaggccttagagtgggttgtagattgtcagcagaaaccaggcaacactttgcttgatgttggtgctagatggctcctgaaacacttgccttgggtttaagcccctcccttttgtttctatctccagatgctgatttgctacaaccactcacaaccaggccttctggccataaaaggataaaagcctactagtggtgaccttgcccatcaccaaggactaagagccaggtaggttcctcctcaactcttactctgtgtttcccaactgtcccatggctcagagtacccacctccacctgtgcaagcctctgttctaagcgcccggctcctcgcgtccacaccgactccctctctggctgctgccacttcggagtgagaaactgagctgctgcttcagttccgtattcaggttttc

SEQ ID NO: 625 - DNA, 86569 bp, Homo sapiens
tcttcattctgaaaataattttattattttacagttgttcaggaaacttcccaggatgttgtaaccaagatttaatcaccacagtagatttagagcagatcagtcagcccacttgtcttctctcttctttagggagaggctaggcagtgaacacatcacgtatgcaatgagaaaataaccaactggtaggatgggggaggggaggggaggcagggaataggcacaaatggaattctatcctggctgtccttctcaggtctatctatatttaattttgtcttctctatattctccttccattgccacagagggcagagacaatggggctgagaaactgtaataactgtcactaacagcaaagtagcttagtacttcaagaggtcaggagttgcagtgtggtgttagaccagtcagactcctggctgagagtcaatgcctaatattggctcccagtggcccctgagcactgtctcagggtccacattccaggaatattcagatattcctggaatgacaagaattggaaccctgctgtccatagacacttctccctgccctttggtgaaaggaaagacttgggccacttaataccttagtatacatgtgatcaagggcaaaagcaaagggattctatccttatagtctaagacctgaaattctccctccaattatatctgaaattggcagggaagaagatgctgtcctcccatgtgatctaacagctaaaacccctagggagttccttcagctttcaccaccctattctgcaagagacctaaatcagatgtcctatgaggtgacatgttcatttccctgaactctgtttatggcagagccaccttccccctgaaacaggagaaaatacaggcaaacaaggcaaagaaagttatcaatcaaaatgatactgaacttcagattattaggtttattgaaaccatcctcttggcttggctgaaagacattcctcagtatcttttacaggaccacaaaagatcagggtcctgcaaaatctcaacaaatattaggctcaacaaaccaaatgtgattctcagattaagcagaagcgttcaggctcagggcagtagaagaaagcagactcgccagtccctgcagctccaacctgtcctcgtatccacctctgtttttgcaggcactttccgtgaagagttggagagaagacctgtaaatgggaagactgttccactggaattgatgttctgatgttagaggtgagagaattccaagttttgaggggagtggtccaaagagtaacaactaagtctatagatggcccgtaaaacacagaatgagcaggacatgaatcattagaaagtagatggctgctagaagtggcactcgggtccgtgaatgacagagtgaacgcaggactcgcttccatccaacgccactccgggtctgaaagaaaaatgtgaaagtcagagagttttcaccctatagggctatgttgctttccctcctactagtcttgcacttaagcaaagctgacccaaccactgtagaaaggggtattctgagaggaaagttgcctcagagtcaacaacttggcaaattccaccaggttctaatcttccacgcccttccagccttagactcattcgctgctcagtggctggacttccacattccttctcctcagctccttgcccccagtatagccagccctgtcagataataaaacaccctctctttatccttcttcctcttacccttcgacaactgttgcttgtaagatctattaacagtgcctgctcctgagtgccacaggagccaatgataggagtccgggaagagtcccattcactgtgctctaacctgagttgagaaaaaaaagaggcatagcattggttcatagcatgagaggctgatcaggcccagtcttcccagtcatcctgccacacaatgcagcacaggaggagacttgcagcaaaagctgctcccataaacccaaacccatgcaaggggggtaccagcagatacgtttccttcagcagcagcaaaatgtgacaataactatcaggaattgactgcctactcactatgtatcaggctctaggctgggtgctttacatacatttaatcctcaggttctgaggttggtcttattatcttcaaagtgctaaggcttacagaggttaaattacttgcccatggcggcacagccagtaagcggcagagccagaattcaatacccaactttgtctttcaagcctcacgttcttttttccaccacaccacacctgacttggagaaactcattacatttttttcttttattaaaggctaataggcaaaagcatccaaagaagatttctgtggggttttaaaaattaaattgaactaaaaaaaattaaattgaattggcagtctccactgccttctggctcagtttttgctgatttgcttatttaatactggaacttctccatttaatgaagaagctgccattactcactcaatggttatgtcaaacaaacaaaggagctgcatgtaacacagcacgtttgatcaagcatttgcctatagggatgaactttttcaatagggaagagaggatgaaactcttgcctctactctttgtgttttctccttctgaaaggatatctattagtttaatattcttgggctctctgcaggacacattcttttccccgggagagaagaaacaccttaatccaatttgtgagtctagaaagagaactgagcatgcacagcctagctccttctttcctgcttccctcctgagagccaggctgactaaaaaatacaccttctgtgtctattcctccatgtgataagcttttcagaagcagctttgatctggaacagcatggtctgttactatggaggtcagtctgtcaatgtaggctatgctgaggaaggatgagaagtctgtaggtattgatgaggaagatggtactggctgcctttaaactggagggccactgagttccacctgctctttagagtacatgtgagattctaacattacaatggcagtacctggactaggcaggcagcccttaattagctaccccaacttccattctgcatcagagctaaagagggaattgtggcttgaattaatacggcttgcccacaggctcaagagtcatcatcccacacatgcagtctcagttggtttgggacaggttagttacacaagagggagatcaacctccccattggccaggtttcaccggtctaaacaattcaatagcaagtagaagagaaacagtcatgagggcacaggcctgaaaatgctcggcagagatggcaagacaccacacaaggcattaagcaaagctggcccaccctcaaagctgcatatcaaggcctgaataggtgatgaaaattaagaagttgtgaatatgttggattggaaagaaaggtatctcaagtaagacctgctcaatggggctgtcacctctgccacataaactttacaagaaagcattaatatcagaaatgtcattctctgaggaaagtgatcatatacataggtggctttctcccaaaatataataaaagtgcctgcttttaacgatattttccgtggaaagggacttccagcagcaaaatacttgtagcaactctctatcctctcatgcatagtgattcttttgatgagaataaggaactagggatgtgtagctctgcccttccaaattacacttggagcaaactgctcataggaagcacagttcactctgttattccaatactcttgtttggcaagagcaggattttctgtgaaggaggtctaccttggcccaacattgtctgtgactgggaggggaagttcagggttaggaagtgcatttgccaacaaataaaaagctacattcttttaacatcatttataaagcagtcttttaatctctcaatcttttaatcttttaaaaaagatttccatggattcagatctcaggtagaaaatgaggttgtcacttatttggtcctctagagaacccaacacctacctcatatagttatggttagggtgaaataaaatatctttcagtaatggtagatatcattattattctctaagaacaactgttttagaaaacactgactctcttatactccaaaagtacagtgttctcttgggtgaccacaatgttggtaaactcattgcagcaactacctcaagatgagaaaaagatcttaagaaatcctaagtctggcaggaaatgtacatgagtttgatcagaaaggatcggaagggaacagaggctatctccttcagcctttaccgtctgatctgctcctcggccacagagagagcattctcagcagccactctttggtctcgttcttcttccagcagcttccttaattcattcacttcctgtctggtgttgcatagctgctgctgagcttcagaaaagctttaggatgagaggaaaacaaaaagcatcatcagatgcagaaaacagttgctaatacaagggattcaaagtcttcataaggttgtaaagcaagaaaatccatagaagcttgtctaaacacaatattttaaaagcaaagctgtagagggattaaatgaagctgcagaaaatacctaaagaaatttcaggaactgattatctttcattttactatcatagagtagttgttagtggtgtgtgtgtgttggtgttgctctttttgttttacaaacttttcacacacaaatgttagttattattgttactatttgatcctcacatcacttctgtgaggctaataagataacaagacatattaaatccatataaaggactccagttaaatctagattactgcccaatttctggactctggtgtatgctccagggtttagagagccactcccctacctttgctgcggttcccttagttcctcagggtcactctttctgtgaactccattcttttcctggggagctcctggagcaacatctatatttagtggcccctggaagaagaataagcttagtaattcagtgatgaaagctcttaagaaagtgtatttgagcaaaatgagagctcgtttacagaggactatccccgcttataattctcaagtccaaatttagaagtgagaagcttctgctctagcagattactcacctacataaaactcttgtcttgattagatttttctcccagattctcattcttgaatttctcctcttaaaagttaagtctgggccgggcgccgtggctcaagcctgtaatcccagcactttgggaggccgaggtgggtggatcacaagatcaggagttcaagaccagcctggccaagatggtgaaaccctgtctccactaaaaatacaaaaaattagccgggtgtggtggcaggcgcctgtaatcccagcaactcgggaggctgaggcagagaattgcttgaacccaggaggtggaggttgcagtgagccgagatcgtgctactgcattccagcctgggcgacagagcgagactccgtctcaaaaaaaaaaaaaaaaaaaaaaaagttaagtctgctgtggatgcttatggcttttccagaagccactttgatccttcccttgcttgtccagcccctcccaacccccttttcctcctccgtatcctatacgtctccatactaattctcagtctcctccaacttcaatgctgtactcctctccctggctgtcaacagtgctgcctgttttgttctcagatccaaagtttcctacaattttcttataacttaaagcaaaatcaacactttctctgtttcagagtaccaaatgtctcagtcatcactgtttcctactcatgttttgatttctctcccaccatctcactgatcttttttcttctaattgcttcactgtaatttttctcagaccttattcccatctcaattaactctttcttctctcccactttcttccctgacccctaattacattaacttcttccatactgctctgtagtgcttcaccacttgcactaaatttcatcacacttctcccagtctctcaccttctctttactcaccgcctgcagctcttgaacctgcttctccaagactgcacagtgatttaaaaggtcaccatagtgctgctggttctcacgaagactctgactggtatcgcagagctgaatggaaagggtgtttttctcttccagtagctgagagaactgaaacagaggcgaggataagcatcatcctgcagtactgtaagcagtgctgaggtgaaatgttctgagttttcaggatctaattttcctatggaagacctttgtttcagcaacagcaacaatagcactttgtgtgccttcaaagttggaaaaagcataatttttttttgaccaagacagaaaacaattctggaggagtagcagaaaggtttttttgttttgttctgttttgtttttttaaatggtgcccagtacattaactgaaaaaccatgaagcagaagtccataagcaatctaattacataggctattctgggtacataagagggagaaggcagtacctcagggtcaaagttcatggtactaacaaatgactataatctccagaactcaatatggctggagagagctgtcaccccaaaatctgtgcaataatattcctaggcagattcctcaatgccataaagagttataagttactgagagaatagaataaaaaattataatatgtggtagaagggagaaacagaataaatcccaacatgtatatgtatatgtcagaaactgttgagagcatagattctcccaggtagaaacatttcagtcccttaaagcaggactctcctctactgcatgactaacaggtcatcgttcagtcttcccttgaacatgttcagtgtcagggcgcccactgcctgacaaagcaacccaaaccatttaaaaaactgaaaattcatttttatattgaatgaaaaatttacctattgtagcttctacccattgatttgaatttggtactctggaactataattctctcacttgcaggctgtcaagttttaagttttagctgtgattagcctccaggtacattaataaccatggagatgtctctccaagttatctactctaggaccatgtacattatatgagaggaacccagtataccagttgcatgttcaattttttcttgatgattcttttttgtaagtttttgtgaaaaaaagttgaaacaaacaatgttttagaggagagacgacagttttctagagacaactgtgaggaagggcatttgatgcaaatagaaaattagaacaagataatccatacatacttgtaaaagtgctctgttagctgaaaattgctcttcagatgtagggttgttttttgtgtttgtcattctgaagagcaatgttagcttacaaagtactttcaccagtatcatcttatttgagagaggtagagaaaggatttctgtccttgtttacaaatggctagtagatgtcaaaccaggactcaagtgtggttcttgattccaagtctagagctctatctactatctgatggtgtccagtctgatagtctagcaaggaaagctaagaaaatcatagggttttcttttgggggggggggtgtgggaggaggtgggaatagttaggaaaggatataaatatttgggaagtgatactaatttgaagacagttaactgggtacaatgacaactattggattctgagacagggcacaacatgttcttcccttaacctaagaggaagttaattttcctggccacaatgaacagtccaaaccataccaaaaacaaaaacatagatccttctagtttaggggttggcaaactatgatccagggcctgctgcccttttatcataaataaggttttactggaacacaaccagcccaattgattctatattgtctatggctgcgtttgtgttacaactgcaaagatgagtagttgttaacaaagaccatacagtcaacaaacctaaaatattgtctgagcctgaaggaaaagtttgctgacctctcctctagcttataagctactatatttcactgtatctatacctgtaaaaacaaaataggagggaacaatttagactacattatgtcactaatcatccatctcatgtttttaagtttctagcacattcttacattacatactaacatccaaacagctggtagaaatgcagtcatcccttgttatctatggggtattggtttcagaaccacccctggacccccaactcccagtataccaaaattcgaggacgctcaaattccttatatataatggcagggtatttgcatataacttatacacaacctcccagatacttaaaaaattttttaattcatgtataatagatatacatagtttcaggatacatgctataatgtaatatattcatataatttgtaaagatcaaatcagtgtatctggaatatccatcaccttaagtatttgtctttcctttacgctagaagcatttaaattcttctcttctagctattttgaaatatacaatagattgtggtaaactataatcacctattgatttacctaacactaggtcttatttcttctatcaaaccatgtatttgcacccattaatcaacttctcttcattccctcctctcctttatccttcccagcctttagtaactaccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttttgttttttatgaacagtgctccaataaacatgggagtacagatgtctttttgatatattgattttctttcttgtagatacgtgggttgctggatcatatggtagttctatttttagctttttgagatacctccatactgttctccacagtggctgtactaacttacattgctaacagtgtatgggagttccccctttctctgcatccttgccagaatctgttactacctgtctttttgataaaagctatttcagcaaaggtgagatgacatctcactatagctttgatttacaattctctgatgtttagggatgctgagtatttttttttatatctgttggccatttgtatgtcttcttttgagaaacgtctattcagatcttttgcccacttttaagttgagttatttgttttcctgctatttaattgtttgagtcccttatatattctggttattaatcccttgttagatgggtagtttgcaaatgttttctctcattctgtggattgtctcttcactctgttgattgcttcctttgctgaacagaagccttttacttgctgtaatcccatttgtctatttttgccttggttgcctgtactcttcaggacttacacaaaaaaagccttggctagatccatgtcctgaagcatttccacaagttttgctctagtagtttcatagtttcagatcttagaattaagtctttaatccattttgatttgatttttgtatgatgagagataggagtctagttttatttttctgcatatagatatccagttttcccagcaccatttattagagagattgtcctttctccatcatatgttcttggtgcctttgtcaaagacaagttgcccctaaatgcctggctttatacctgggtttctaattgtttcattggtggtctgtgtgtctgtttttatgccagtatcatgctcattaaacaggtagtgtgatgcttccagctttgttttgtgtgtttttttgttttttggttttttttttttttgagacggagtctcgctctgtcacccaggctggagtgcagtggcgcgatctcggctcactgtaacttccacctcccgggttcaagcaattctctgcctcagtctcccaagtagctgggattacaggcccccgccatcacgcccagctaatttttgtatttttagtagagacggggtttcaccatgttggccaggatggtctcgaactcctgacctcaggtgatccactcatcttggcttcccaaagtgctgggattacaggcataagccaccacactcgacccagttttcctctttttaatcaagattgctttggctagttaggagtttttgtggttacatacatattaaattttttttcccatttttgtgaagaatgtcattggtattttgatagggattgcatttaatctgtagattgctttgtgtagtactgtcattttaatgatattaattcttctaatccatgagcacgaaatatctttcctttttttagtgtcctcttcaatttctttcacagtgttttataaatctttcatttctttggttaaattgattcctaagtattttaaattctttgtagctattataaatgggattgctatctatctatctatctatctatctatctatctatctatctatctatttttgaaacacagtctcgctctgtcacctaggctggagtgcaggggtgcgatctcagctcactgcaacctccgcctcccaagttcaagtgattcacatgcctcagccacccgagtagctgggattacaggcgtgcaccaccatggctggctaatttttgtatttttagtagagaagggatttcgccatgttggcaagactggtctcaaactcctggcctcaagtgatccactcaccttggcctcccaaagtgcaaggattacaggcatgagccaccatggctgactgggattgctttcttgatttcttttccagattgtttgctgttggcatatataaatgctactgatttttgcctgttgattttgtctcctgcaactttactgaattcatttatcagttctaacagttttttggtggattctttaggtttttctaagtataaggtcatatcatctgcaaaaaaggctaatttgacctcttcctttccaatctggatgtgcttttttttttgttttgtttttgcctaattgctctagctagggtatctaataatatattgaataacagtggtgaaagtaggcatccttgtcttatttcagatcttagaggaaaggccttcaatttttccctgttcagtacaatgttacctgtggcctcccatatactttaaataatctctagattacttataatacctaatacaatacaaatgctatataaatagttgttatactgtatttttaaaattcatgttttcctgaatattttcaatctacagttagttaaatctgtgaatgcagaaattaccaatatgaagggccaactataaatataaaacctgaacatctgaagaaagaattagggaagtggcttagagaagaacaatctatgctgacagcccatctactacaatctcattctggggcccaagaagcaattctcctatttagctgggactcattcagagtgaggctaagctcatgaaggaatatgtatatcctcagtatctagcatatagccaggctcatggaagacaaataatagttattgttttaatgactgaataaggctaggaatgaggtgcctttctttttttttttttttttttttgagacggagtctcgctctgtcgcccaggccggactgcggactgcagtggcgcaatctcggctcactgcaagctccgcttcccgggttcacgctattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgaggtgcctttcttacagttgagttctaaaggaaaaactgtttctcactcagaatgacagtgacctatgcagtgtttctcacactttaagtggaattacatatctcaataaaggtgttaaaaaacacaactttatgacttagaacccagtatataaatatatacaattaaaactaaagttttccaaagacagacatattctttattatatattacatacgtgtttttacctcatttcttttttttgtaaaaacaccaactgcactatttgtaatagccccaaactggagaagcccaaatgtccttcaacagaatagagattgtggtatatgcctaaaatgcaatactacacagcatgagagtggaaaaatgacactatatgcaacgacatggatgaatctcacaaaataaatgaagcaatataaaagaaaaggtatgactccatttatatgtagttctaagtgggtaggagtgaacagaagacacaagggacttctggagttctggtatgttctgattctagatctgggtgctgattatatgggtatcttcactttgtgaaaatatatcatgctgtacttatgatttgtttacttttctgtatgttttacttcaataaaacattaaaaattttttttagttgttgcccaccaaaatgatttcatcatttattaatggtcctgaatttcagtttaaaacactgtcctagacagacaaatgcccaatgtgattcagagtctaatgtttggagagcaaatgtaacaggcctgagacgggagttagttgacggaaaaaagagacaggctagagctgtaaagggtggaacttccggaaatagctgatttgctggaaggggaactccatgggagctgctctggagtccctttgaaaactcccagacaaatctaccaataaagagtctacagtttaactaattcatttgggcctgcagactttaaaaactgcaaatgtctcctctctgatacttcagtgtcaattagttgaatttaactacatttaataagtaccctctacatatgcaggcactgtgcttttccacatgcatgatcacgtttatttcagactgacttcgtcctaacacctcaggcaagttacttactactccagggcctttttcctcatctgtgaaaacagcctagtgatctttttaatttttggatcacagaccccttggtcaactgatgagttcttgtgatgaaaagcttacgcacacacacactattgtgcatacaatttttgggcattcttggctctcctcaaagctaatctctggacttctgattctgattgatctctaaatatcttgtagttctatcatagactacttagctgagttcctctcaagagggcagaactagggcaggtgccactaaagaatattttgaatagtcagtgaacaacaggaggacaattcttaagagggtggggtagggagtagcctcagcattactacaagtgatacaggtcagggggaaggcttcctaaagtagttggcttctttacttttactgtctggatttatccaatcattcccaaggactcaccaagggcaaaggacaagaaatggccctgtgtccagtgctttggaataagcacccaggttctgagaaaggtgaaacttctgtaccctaagatatgctacagctgggactctatgctgaattggcttctacttgccttcttgttccagtcatggaaaaaagaaactgaattccagtctaacaagaaacacttacgttgctgttcagttgctgaattcttaactccttttggtgaatttcctttaagctgtcattgagctgggtcctgagaagttctgtctcataaaccagattttgtgacccatctggggaagctgatgtctctggggatgcctgccaggacacaaacattgatcagattctctcctaagattgcgcatgcttaattccttccctctagaaatcctgtccgccccatagaagtcataaggtggcttatgggcacttaatagtggcagatgggcacttaatttgtaggaagctgatgctttctgggtagcgtcttaaaaaaaaaacaaaaccctgcaatcatcatcatttgtttaaaaatttatctctgagtaacaatcagcattgaaattactcacctgtctttggtattgcactttgagaggctgagtctgggaggaagaagacctcaattcccttataagattctgcagatgactgagctgctgatctttatctgagatagccataaggtactgttccttcattctcctctcatgtatttcccaggaactcttctccatcctagaaaaaacatgacacaatcacaggtaaaaatatacttgtaactgggcatggtagctcgcacctgtaacctcagcactttgcttatcttcaaagttactcaaatctggaaggtaaagaaagaaaggctaagaaaaaggtggaaagagagaaaatgtgggggaaaaaacaggaatctttttttctctatctccttttctcttccctaagggtcaattatataaggaaataaggaaaataaatatccttttagattgccattagaggaaatttaaagaagaaaggctgcaggaaataagcctttagagctttgcagctcttcttaggtttacactagtagctgaacactttaatatttctgtagttctaggtgatgtggagataagatgagaggcatcaagcgatgctctgatacggtaccaatcacctttggagggccctaaattcaagtgcatctgaaggacacagcaagcacctaaacttctgatgataaattaagattctaacagaataaagctggggtgctattccctgaagaaaaatggaggttaaaatggagcaatttatcttttctcttgagattcaatttcaaaagaagaaacaaatttatatttctagagagcaaaactcagttgttttgccattttctttttacttgctctgcaatcatcatcatttgtttaaacaaaaaatttgttcttgtattatctggggaagctgccaactccatgcaatgagcttgataaatgttcacttataatcaagtccataaagatgttaaatatgaaaatcttttagatgtaattttactccataaagtttaaatcattaaattccaaaaagcattttgctatatcaatgttgcttaaggtttgaaatctcctgtgtctgaacattaagaactctcttagagatgttatgatatttatactatattgacagttgtcattctaatggccccttgtaagctggatagaaattgagattccaactcatattttctgtattcatttgcctcttgtcctctagcattggtgaaacaaagcaggtgctgcttgatcagcagcaatgtccaacatggtaattctccttttaatatcaaatcttgaaagctttttgaattttttttttttttgaaacagggtctcactctgttgcccaggttagagtgcagtggcatgatgttggctcactgcaacctccacctcccgggttcaagcaattctcctgcctcagtctcccaagcagctgggattacaggcgcacgccaccatgcccagctaatttttgtatttttggtagagatggccaggctggtctcaaactcctgacctcacatgatctacctgccttggcctcccaaagtgctaggattacaggtgtgagccaccgcacccagccaagtatgaatttattaaggcagcatgaaccatcttaagttaaacagtaacaacctcccaaaaatgaggctgcaacaactagacctgtttttatacactaagtgtttaatcttgggattaaatttgtcagaaaaactgaattaaaaaaaaaatcagaattatagctcctatcttaatttcttctgccatgatagcattattattgttctgttccttaaaaagaaaagagctaggatttctggttctagacaaaataaaatagacacatttctccttattcttccaactaaggctgagcaaccctaatcagaaaatcagaaatacttcaaaatccaaaactttttgagcactgacatgacactcaaaggaaatgctcattagataatgcaaatattccaaaatccaaaaaaatccgcaatccaaaacacttccaatcccaagcatttcagataaggaatacttaacctgcatagataaaactcttgggccttataaataaaaacaaacataagaaaatttagaaagatggtggcaaaccagctagggatccccagacttgaggaatgacatggtggcaagttctttggtttaccatttgtattctgcatatcccaaaccggatactggagaattccatgacccggaaacaccaatgagtaccaagtttactcagtcttgccaaaggaccaggaagggacagtctagctagacagagccattaatgatactaaccaccatactccaggcaaacaacatggaaaaaacacagtatctcaccactcccattaacaaagacctggtagataagctaggtacattcttggctggtggtaacaaggtacacctcaccctccttactggagtagtgtcagaaaaggccaggtatggagcttggactcttacaatcacctagtgctaagaaggtgcctctctccgactgcccctcctcccccactcccactgtggtatcagtggaggcaacatgtggggcctggacatccccctccaccataacaaggttaataaggcactcttccttgtccctgcagaggtggtatcagaagagatcaagtggggattctggactttgagtactacccagtggtaacaagatgcccctcttaaccattccccatagtgtcagtggaggctaagcggatagcctggacttttaccaccacctggcaataatgaggtgcccctctccactccttccagcacagtatcaatggaggccatgtggggagcatggacttccacttcctcctggcagtatcagggcatcccttccttttaggggtatcaacgaaagttgaatggggtgcctggagttcaccatccacctagtgtcttccttcccctgccggtgtggtgtcagtgaagcctgctaacacagaagattcaaataagactgaaagtcttataatctccaaaatgtccagaatgtaactaaaaatcactcatcataccaagaaccaggaaaaccacaacttgattaagaaaaggaaatcaacagtttataacactgaggtgacacaaatattagaattatatgacaaggattttacagcagctgtcatagaaatgcttaaacaagcgattactaacatactggaaaaagtatagaaagcttcagcaaagaaatagaagatataaagaagaactgaatggaaattttagaactgaaaaatacaatatccaaaataaaaagctaactcactgggtgccatagcagaatggaggtaggaagcagagaacttgaaaatcaaatagaaaataccaaatctgaatgataaagagaaaataataaattggatttcatcaaaattaaaaagaccctgttgagggagatgaaaagataaactgcaaattgggaaaaaatatttgcaaaccgcaaatcaaacacagaatgcatacctataatatataaagaacgcttaaaacttaacagtaaaaaattaacccaattagaaaacggacaaaagacatgaacagatatttcatcaaagaggatatatggatgtcaaatacacacattaaaaagatgttcagccattatgcaaagtggttttgcagtttcttaaaaaacaaaacattcacttattgtatgagctagcatttgcactcctgggcaattatcccaaagaaatgaaaacttaggtccacacaaaaacttatacacaaatgttcatagtagtattattagaatagctaaaaattaaaaacaatatgcatgtccttcaacaggtgaatacagtggtatattcataatatgaaacattatttatactgaaaagaatgaactattgatacatacaacaaaactgatggatctcaagggcattatggcacatgaaaaaagccaatttcaaagggttatatactgcaagattccagttagaaaacattctcaaaatgacaaaattgaacacagattagtggttgctaggggttaaggatgtgaggaaggtagggaagggaggaatgtgactataaactagtagcacaaaggacgtatttgtggtgatggagtagctctgtattttggttttggtggtgcttaaatatacatgtcacaaaattgcatagaaccacacacacagatagtcaaatcagtgcatgtaaaactggtggaatctgaatgtggtccgcgaattgtaccaatggcagtttcctggttttgatactgtgctacagttatgtaagatgtcaccactggaagaaactgggtgaagggtacatagaagctctctgcactattttcccaaatctacaattatttcaaaataaaaagttaaaatgaaaagagttgaaaaggagggattatatatagtacctgagctgatgcagctcatgctgccaggagaggttttcctgcctgagctcttcttgcataatctgaaatgcttttgtcttatcttgatactcctgaagttgagccttcagtggatgtaactcagtgatctcttgattaatctgtaagtattgctgctgcagattcttcaattccttcagctttaaccaaagggaaagtaaaatgattatttgtcacatctcattcatctaactgtaagtcattggtagctccctactaagtagtcagacaccacaacatgaaaccagcacctaacagtccactgatgacatatcactgcaacataagtctctaaagtagtgaaatacatgcagctaggctggtggaaatcacccatggagctgccatcaaggctacagggtgtgactattcctgcaacttctactccttcccctggctcctaaggtcctaagttcactttagggctacaattctgacgtggggtagacttaagagacctagagcttcactgtgggtggtcacatcctaaaacaagaactagtcatgtgtccttgttagggttcttaactttcctacagggctatcaatcttaactgtagcttagcggatactgattataaagaaggcagtgctgctcagtggttaaggacacttaggctctggagttagatatcctactacttcttggacgtgtgacccaatgcatgttcctcatactcttcttttttttttgagagggagtcttgctctgttgcccaggctaattttcctcatctattaaatgaagataattatagtacctttttcataagaatatgagaagtaaatgagcaaattaatgcacttcacacataaagttagtgatgatgacagacttgcctttaattaacaacactgcctacctacatttcagatatattttcaacttctttatctccaatactcattaaaagcttagtaagggagaaataatatcaggacatctgggcaaagatgggggtcttgttcacatacctctttcacccacttagagacatcgctaaagctaaaataatagcattttttaaagcacaaaacacaagaacaggaaaaacaatagaggaatcagcagcaataaaattaattttggaagctgaaaagcagatgagtaagtggtaactgacttaacagatctgagaaagcagaatctaaagctggtagtaagaaaatccaagaatcagtggaacttactctgcagaatcttcaaaaggctcaggaattaacagcatcaggcacctctggaaaagatggtgatgggggtgggagggaggtgatagctgagataaggaggtctagatgaaagctgcttaagaagcaatttcttttaatttttttttttttttttttttttttttttggagagacggagtctcagtatgttgcccaggctggtctcaaactcctggactcaagtgatccctccaccttggcctcccgaagtgctgggattacaggcgtgagccactgcgcccggccagaaaacaacttcatttataggtaccctcttcagctccacactttttgttaccccaacagacaactaattttattctctggacaggtaaaagaagtctctgtggactatggcacctgaggcacagttacaagtaagggtattgttccaaataaagtgaatgcatgcttcctgagtgcttgaagtctttcccctactgagcttgaagagtgctggtaaaaggccttttccctccacaaaggaaatgaaaagtcttctcttgaaaatctgaccagcccaagaaaaactaaagatactgagataagggctaccaataagctcaataagatcatcatgcaatgaaactccgttggtaagtcctacccacaaggttttagaccctccccttaaacatgaagagtacattgaggattaaccttcacctgaagaatggctaacattaaggaagggaagaaaaccaactagagaaggtaatttagaagagattatcaggggagaaaatgtaatgtactcaaagatttaagagataacattgtaaataagaaacattacagcataaattaaaaattataaagaaaaactcattataagaaaacgtcaaaaaacaaaactaccaccattagccttagaaagagaagaaaatctaccggccggggacggtggctcatgcctgtaatcccagcactttggggggccgaggtgggcagatcacgaggtcaagagatcgagaccatcctggccaacatggtgaaaccctgtctctgttaaaaatataaaaattagctgggcgtggtggcgggagcctatagtcccagctactcattaggctgaggcaggagaatcgcttgaattcaggaggcggaggttgcagtaagccaagatcatgccattgcactccagcctggatgacagagcgagacgccgtctcaaaaaaaaaaaaaaaaaaaaaaaaacaagaaaatctgtctatgagacacagaaaaaaaatccttagaaattaagaatataatggcaaaaatgaaaaaaatgttggaatcaaaagacgaaggcaagaaaatcttccagaaatacagcaaaaaaaaaaaaaaagggaaaagttaagaaaattagagaagcaatcaagaaggtcctacatctaaataacaaacatttcagaaataagacaacagagaaaaaggatagaggaaaatggtaaaaaataatttaatgaaatttccaaaaagctgctagtatgatttcttagattcaaaggactagttagcatgatgaagaaaaaaagacctataccaaattatactatcaaaaaatttcagaataggggagaaagggagggaaggtggggtgaggggaagggaagtgagaaacagatcacatacaaaggatcaggaatcagaatagctttagacttgtgaaccacatataagctaaaaagcaataaaccaatgtcttcacaattttgaagggaaattattttcagcctagaattctatatccagcaaaactatcaatcagataagagagataaaaagacattttcaataaatttaccttccacataccatttcttagggatctactgaatgatttattccaggaaaaagatggcacaaaaccaagaaaaggaatacatagaatagacaaaataggagatctaatataggagaaaggtaaagggaaatattctgggatagaaagggtatcctaggagtacagggccactggttgatataggagcaaatcaggtactccaggagaattttcttcctgaagatgaaattgatgggaataaacatcttgaaaggagatgtggacaaatggcagtaaatctgaggttaaattacattaagtacaaagaaaactaaggaacaacaataacaaaaacttattaatctgggaaaaacagaaagactcaggaaaataaaagtaacatgtctctaacgctctagtagcatttgtagtcataaaaaatgtaactctgaattgatttaaccaaaattaaaattaaattacatcaagaaaatgaggaaggggtttgtattaaaatgtgcacacactggccgggtgcagtggctcacgcctgtaatcccaacactttgggaggctgaggcaggtggatcacgaggtcaaaagattgagaccaccctggccaacatggtgaaaccctgtctctactaaaaatacaaaaattagccgggcaaggtggcgtgcacctgtagtcccagctactcgggaggctgaggcagaagaatcgcttgaacccgggaggtggagggtgcagtgagctgagatggcgccactgcactccagcctggcaacagagcgagactctgtttctaaataaataaataaataaataaataaataaataaataaataaaaagtgcatacactaacagggtttactgtgaaagcagggagagtacagagagctaaaccctgttagtgtaaagaaaatcaatagttgatgcaacaaagagccaaaaatgcaatataagcatgatatttacatacacaggaaatactgaaagaataagctaaaagggttgaaagcaaattgcctcagaagaaatggggttgaggtagtgctactcttagcttttcccaccaaacattgtagaatttagtgactaattaaatatgggtcatataactttatttttaacccaaaccccaaaacatatttttgttttgatttaaggtaaaaacatattcctttatgcaatccactcactcctctagtctagatactagactagaggtatcctagaatggaccatcagaaagctgtgtgcctgggactgcattttagctccttggagtggtagttttagtgaactggacgtaattcttttgctctgcacttacattaagggacagctaaataaaaaccctaaaaaacacattattatatttactgtagagaagtaatggatgtttcacaactgcacagtgttctctttatgggaacacagaagaaatttcttacaggcctcaatacttaaagactattcttgtcttgagtaggtgatttttctttctccttttctcctagactataaatactgcagttcatgcatgcggttttcattccctctttctgatggctaatagaaacctcagagcaaactatggatccctctttctaacacagtacaggatatggtgacttccccttgggacactaaccttactcctggtttgatctttttctagcctatcctctttttctcctccttctcagtcccttttattttatcttgaaaaattgtttatatctttatatgctaccccaagtcattttcagaatgaggagagtatagataaatacaggcacccctagagatatgtcatctgcttagtcagttctatgctaaagatgtacaaataagtataagacatgacacttaccaggagtttgcaatctaattggggaaataaaaaatagtgtacagaaattaaacatatacacacacacacacacacaataaggcaatatgggacaaatgataagtaaaatactagggaagtacaaaggcaaaagacaatcaggcaatcacgaaatgtaagaagaggatctgagctctggaatgacctttaaatagtgggaaatagacactcaaaaaaggaaagcaattgggagaacattttggctgctgaagataatatgggtaagtaggaagtaccaggtgtgattattgcatactgagtagatcagtttggtgtgaatgaagggtatgagtagggagcagtaaaagggaacgctggaaaggtatggataaattacagggtcttggccaggtgtggtggctcacgcctgtaattccagcactttgggagccgaggcaggtggatcacttgagaccaggagtttaagaccagcctggccaatatggtgaaaccccatctctactaaaaatacaaaaattagctaggcatggtgtagtcccagctacttgggaggctgaggcaggagaattgcttgaacctgggaggcggaggttgcagtgagccaagattgcaccactgcactccagcctgggtgagagagcaagactccatctcaaaaaacaaacaaacaaaaaaacagggtcttaaatgccagactaaagggggtttgaatactaagtctattctagagatagtacaacttttaaatatttttgagtagtgcagtaatacagtagagtttcagaaagacttatatggtgatggtctgaaaatactggtgagatgataacctggaagcaacattattagaacagtttaagggtaaagtgttagagcttatcttaggatgttgaagatggaaaataaaaatacttgaggcacactgtgaataaaggagtgatacatcttgatggttaaaataaaatcacagttatgagcatttgggaacagaataatatgactctgaattacagaaacacgaaaataaaaaagttggcttggctgtaactatccagcagacaaaaatgtgcaaagtttagtgcctagtgtttataacagataagaataataaagcaattcactgaattaaacatagttagctaattcagaatctatcctaacagctccatgaaaaaagattttgacttagaagataatcaataccagcatatcataaattacagctttgaggcacataccatcctgatgaatagaaccttttgcatttacggtctgaaaagacagacaaaaggccaagctcccagggcaaagtcagctaaactcaaattatttaaaaaatataaacaagtatgtgtatgttggaagtaaaaaccataactgaacagagaggctttgttcggattacaaaaggggaaagactgtctataaatatgggatattaagtgagataggaatgaatacaattacctacaataaaaaggaaaaactcactctacagttaggggtaataatcttttcactagagctcatcttaaaaattagaattttcgctctccctctccctctccctctctctctccccatggtctccctctccctctctttccacggtctccctctgatgccgagccaaagctggactgtactgctgccatctcggctcactgcaacctccctccctgattcttctgcctcagcctgccgagtgcctgcgattgcaggcgcgcgccgccacgcctgactggttttcgtattttttggatggagacggggtttcgctgtgttggccgggctggtctccagctcctaaccgcgagtgatccgccaacctcggcctcccgaggtgccgggattgcagacggagtctggttcactcagtgctcaatggtgcccaggctggagtgcagtggtgtgatctcggcttgctacaacctccacctcccagccgcctgccttggcctcccaaagtgccgagagtgcagcctctgccccgccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggctgcccatcgtctgagatgtggagagcgcctctgctccgccgccccgtctgggatgtgaggagcgcctctgcccggccgcgaccccgtctgggaggtgaggagcatctctgcccagccgccccgtctgagaagtgaggagaccctccgcctggcaactgccccatctgagaagtgaggagccccttggcctggcaaccaccccgtctgggaagtgaggagcgtctccgcccggcagccaccccctccgggagggaggtgggggggtcagccccccgcccagccagccgccccgtccgggagggaggtgggggggtcagccccccgcccggccagccgccccgtccgggaggtgaggggcacctctgcccggccgccaccccgtctgggaggtgtacccagcagctcattgagaacgggccatgatgacaatggcggttttgtggaatagaaaggggggaaaggtggggaaaagattgagaaatcggatggttgccatgtctgtgtagaaagaagtagacatgggaaacttttcattttgttctgtactaagaaaaaatcttcggccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaattaaaaaaaaaaaaaaaaaattagaattttcagattctgggtatgggtcacatttcaaaatggaaagcctagcctttcaaaactccatttatttcctatttggcctattttcctacaaatacaaagccttgatagagttaacagactatcatgaaagtgaagacagtaatgttgccaagtagaatcccctaacaagccaagagtggtggctcatgcctgtaatcccagctacttgggcggctgaggcaggaggactgcttgagcctaggagcagtagaatcctgacaacctggcttggctcatacagttccagttttgcccctgaatcttgggagacctggattaaactcctgactcctactaaaagctgtcaaatgtcagcattaggaagcctctttagctttttctcccattggaaatgttgggtattaaaaggaagtgggtaaatggttcagcctgcaaataaaactttactaaaaagtcatttcaacttatttaaaggaactctttttacgtcacttttttttatttttgacaaattagggttgagttacccatgagatgaactgagtcctttctgctccaaattctaccagataatctattgctaaattgtaaacaagacactaaatgatccttatacttcactgtaagaaggcactaagtgatccttttactttctttcagttaagctatgacaaattctggaaacatttacacatgtctttgtgtatataaaatatataaaacagttctccacctcttagtccttttataaccaatggagagttttgtgccaaggaaatttctgattttttttctaatggtattggcaggtttagcaatttaaatcatgtttctgtgcttctctaagaccaaacagaacctgtgggatacataatactttccctgcgttcccagataatatgtataagaatgtgtttatccttttctataaaaataaatttaaagaaaggttcaaaaactcttaaacagatcagaaagaaagaactagctactcactagtctgtctctgtcattttggagtgaagacatagctttttttaaactctgtacttcagctgggctggtggaaggctgagctgcagacctctgcttcccttcctctgactttcgaaatttctccagctcattccacaggtgatctctctcattctgcagactggccatagccttggaaaaggactgcacttggttataagaatcttctagttgtgaggacaagtgaagcaattgctcatctttggataggagctgttggttaagtttctcaaggtgagacaagctattctcctcagtggagttcattgaaaaggcggtttcagaaagaagagcatctctctctctgtttaagagtccctgttctttcaactgtgccaattccttcagactggcatcatatttccttttcagttcatcaagttcctcattggcatgatctctactattttgcaaggaactcatagaccttccaaaagactgaatttgtgctgtgagacctttattttctttggtgaccatgagtaatttctgttccatctccaccaaatctcttgctagctctgccactctctcttctgctgtttcagtttcatttctcattatccctgcatcatgatgaagatgctttaattctttcttcagtttatcttcaatttcacctaccttcttggcagcttccttttgaacacaaaccaattcttcttccagttctgcaattctcttttgagaggaggaaaacaaagcacttaacctgtgtacctcttcttcttttacttttaactgggcatgatagagtcctaaagtaccttcttcttgcaaggctgttacttgtcttgttagctgggatatagatactttcaaactctcaatctctttagataaatcttgtttctcttcttgtagggcattaaaggacctccgcagatcctcatttgcttcctcagattccttcagcttttcttctaatttagcatatttattttccagctccttattttgctgaagttgaacttcaagaagctgcttttgttggctgtcctttattgttatcacttggttcaggtcttctctatattggatcagttctgcatctagcttggcattctcagaattgagatcatccatatgacttctcaagcctcgtatttcttctttaagcttattattctctgcagcagcctcttggatgagttggtctttttccaagattatagagagatgtcgctcttccagctgttgatagtcacccactatgcggtctcgatcattttggagagaagacatggatttaacaaaggaatccaactgtgccttttgctgaatgttttcctttttgatggttttcagtgtttccataagctgattggttttatcaacagcctttttgttctcctcttctaaaacaatattctcctcttcctcctgggacagcaggttttccagctctttaatttctttatcatgttgctgacgcagttcagcaatagctacttggattgcctcttccttgccagaaagcaggcttataatcttttgctctttcatatttatttcttcatgcagcctactggtcagttctctggaggcctgaagatcagtctccagttgttcataactgaacttagaattttgaatatcagcctcttgctgccttatgatcccttccaagtttcctttttgttccttacatttttctaaagagttacttaaatcagtcaactggtctttgagactcttaagttctgattccaacttagctaattcattctgagaactgtggtataggtggcgtgtctcttctagctgggacaaaagttctttgttttccccctgtagagtatcacagaccttctgctgaagctggacctctgtctgggccttggactcccaaatctgcttgtcatgttcaagcctgaaacagagagaaggtcattagttacagatttcaagaaaaaaactgtgtttcccaaggaacaaatactataacatgtactcaatagatttacaaatgaattaacattcataacaggtgttaaatattttactgaagaggtattaattctctgcacctacatgtttatctactgagtgctatgtattaaaggtatatcatacttaagggttcatatatttaagtcataaactccaaaatatgtcacttattttagtgacatggttttcaacactgaaaagtaacattttctcctattttattctactttgctccagacaagctaacgtttggcttctctaagggataatcttgatatgaaagacagtgagaaaatctgttttagaacagaagggtcctattggaagtaaggaatacaaaggatgagagacattattagttctatagattaaaaagtgacagaaaattgaaatttgagaaaaaataactctaagaggtatatgcagtatgaattaatgtggactaaaggaagaagaaaagacgagactagacaattaatttgagagtactgtggtaaaaatccaggcaagagtagttgaaatggaaatgaaaagaaatacagaggccaggtgcaatggctcatgcctgtaatcccagcactttgggaggccgaggtgggtggatcacctgaggtcaggagttcgagaccagcctggccaacatggtgaaaccccctctctactaaaaatacaaaaaattagctgggcgtgttggtaggctcctgtaatcccagctactcgggaggctgaggcaggagaattgcttgaacccaggaggcagaggttgcagtgagccaaaatcgtgccattgcattccagcctgggtgacaagagcaagactccatcttaaacaaaacaaaacagaagtacagaaatctctcaatagaaagatgggaagagaagatgcgaacttttcatgttcatgcagttgtagcaggattgttgtttgccaaaaaaaagtcagaagtgagagagaatatatcttccatggacatttatgccaaaattagtcccattgtctaaaaggaaacagaaatagtttagagactttctttgcttgaagttacctctggaggaggaaaaattcactactcatttacctggaaatgttaatctttaattcttccatatggatggacatctgtctaagttgatcctttagaacactgcaattatcttctttgagtctaatttcttcttctttgctttgaatcgcatcactaaacttcctctcccatttcttagcttcatctatcaccctgtcacgatcatcctggagggaagacatgctcttagtaaaggctgcaagctgggtcacagtactgtccaagttttcctgaagttgctgaacttccttgtctttcttgttcaaagtaacctgaatctctccaattgtctcttccaagtggactttttctctgcgcaaagcatccagtttctcttgcatattcttcttctctttcaggtgcttctcttctgcctgttccagtcttcgctcaagatcttcatccttttgtttcatctggcttttaactgattctttatttgactgaagttcctttttcaacttgagattgtctgctaggacccttgctgcttcactttgagtgtcatctagcaggactttgaagctagctaattctgcttgtgcctttttgcggtgttcaactgcttgagccagattttctttggttatttccaaatctttttgagattcagtttgaacaaattctagagctttaacagttctctccagagcactaattttctcttgatacctgatgcagtccttctgtagctgctttacttcttgttgtttttcttttaacagttcctgaagttcctttgcatggcttttatttccgggttctttctgagcaccttgtattttctccaaatattcctttcgtatttctgattccaccttagttttttccttgactaactgctgcttttcttcttccaattcactcacacactttttaaggttcttcatttcagattccaatagctcattttttatttgggcatctgtaacatcctgacagtaattcccaatgcttccattaagttctgctaattgattcataagcctctcttccaaatcatctttctcttcttctgctgtctcctttagtttggtaactctggagagttcttcttggatttgctgatttaacaggttcattttggttacttcctcctgaagcatttttagttcaccatcctttgttgatatctgactcagtaaggtatttttctcattttctaaagtctggctaaattccttgtttttctgcttctcctcctctaatccagcaattctttctttgagctgatcaatctgctgtaggtagttattaatttcatcatgtgagctgaaatccttacttacagcagggttggcactcttcgctgatggaaccgattctgaacatgtaggtcttgtgctcatactcagagagtcttgctcttcagtctcacctggtatagactgtgttccctcttcagtgacattcgtttggttatcatgtttctcggtggcctctaggttagcttgtttagatacattaccttctatctgatgctttaaatcttgaacctcttcacttagagagtctttctcagacattaaagactgaaacttcttagaaagggtttcatactccattttgaccctttcaagttcttccttcatgctggcattggaagaaagaagtgtttccatacactctttagctgtatctcctgcagggtgcacctctgccctaagccggtcattctcttcttccagctctaggattttctgctgtttagatttagcaaactttctcatcttttctttcatttcctccatttcttgctcagcttcctgcaactgcttttctgtctccttcttgtttgcctctgtgcttcttaacttgccatacagttcttgtttctcttgcctcacagcttccaccacatgctgaatcctttctgcttcattactaacattctcataggactgcagaagaatttcatactctttttgtagctccttgtgtttctcttgccactcagtactttctgcaatcttagaagatttcaaagattcaatttccttcactaacttttccttgtcttcagtaagaccctctagagctagttttagactttcacaggagctgctgagactctgattttccaataaagacctgtccatttctgtaatgagtttgtctctttcttcttgaagaagagctaaccttcctaagaccgtatctttttctttattttgagcagaaacttggctttccacatctgccagagacttggtgagacgttcaatggtacctctggccaaagacaattcctcttggagacttttgttttcttttagtgcttcttttcgggaaataagggcagcttgcagtttcctttgtatttgttgctttgctctactttcttctccaatctcttctggtttttgcttcatttcacaaagttccacctgtagctgctttatcctctcatcatgctctttggcttgcatttctagctgtgtatgcagagccttaattaaatcttcttgttctattatctctgtctgtattttagtgagagctgcttctttctcactaagttgtccagaaaggtagctaacgtcttcttcctttttgcttatgagtttttgcagttcatccagtttaggttgcaattctcttagatgttctaggccagcaatttgtagttggctgctttccaatttctgctgcaggctttcggcatggacttcagcttcatgggatactgtctttagactctcgatttctaaaccctgtttatttatctgctcttgtaactgaaatacctcttctgattttttagtaagctcacttgttgtagaactaactttcaattctaactctactttctcagcctctatttccttcagctgggccttaatctgggcaacagaagttccgccctgcagagcactcgcatcttcagaatgagaaggccagtctgggcacaagttggactctaaaacaggttgagtgtgatgctgttctgtggctttgaataaaggttcttctaaacctggagtggaagaacacgattcctgctggtctgtgcttgggagttttccgtctatggattcccttacttgaatctggagttgccttagctggtctccaatattctcattttccttgctttgctcatcaaactgttcttgcaagcgattatagtcatctttctgttgctttagctcctccctgagatgtctttctttctcctgtgcctttttaagaattgccttgcgggaggttaaggcttcctgtagcttcttttgaagttgctccttttctttttcaagggccagtatcttttcttctagttctggtttccagtgttcactactacctgtacaaggtggacttatcaccactgtttcctttacaagtgctacggagtccccatcacttgcatccgtgttacttgtgattaacttctggataattgcttggttttcactgatttctgcttggagcaaatctatttggtttgttttatcttgcaaggtctgattcatctgtttgaccagagcctggaattgctcttcagctgccagcttttcttccaaatccttccttatatgctgtagttccacttctttctcagatattgtctgttttaaataaatttctatttcttggcacttagaagtcacacatttttctgagtattctttgttttctttatcttcttccacttctcccctctcagtctcactgagtgggatttctttcttagattcatctttcaagttggctaattcttcttccaatctactgactctttgcagaagctcctttctgttaataagagctgcctggagctttctctttctctgctcattttctttcttcagaaggtcaaattcatgctgaagttcttccttacttatttgtcctgctgggctcatctcatcataattttgtttaaggccagaagaaacttcattatcttcttccacctgctctttttttgcttcctcagctctggataataaatttagctgttctttaagagtcttaatttcaaccccaagagaaaacttctcttcattaagctgaaccattttctcagtcatactaaagctgatttctgtcacttgttgatccttctcctcgatggtttgttggagggtttccacatctctctttttctctagtaagagctgatccatttttgttatttcaagttccttctgtgaaagagcctgggacagttcttccactttacttgagatatgccttacacgttctgccccctcaagcacttcactttccttattttgcagctggctttgcaggcttcttatcagggtactctgctcagaaaactgaagctgcacatcatccagttcattctgtaaaacttcaattttcacatctttagatttggcttctatgctgagactatggatctgttcagtgagcaggttgtcatgggcagtttggctttcataatcaagtcttctttgcctttctgcttctgcaaggttcatttccagttgctttacctgagccctcaattctgttaccatgctaagttccttcacctgagagagaagctggtctctttcttcagacaaagcagtgaatgcactgctgttgttgtcagcatttttcttaaactcctcaatcaactggtttaggttgctaatttccttagctttctcatctaaatttttctcatagatttcttgtgctttatgaaagtttagctcgagctccaaaatttgactttttaacctttccaactcatcctgatgacactgaccaatatctggtacagcagaaagggatttatcaccatcctgctttgttgatttcaattctactccagcatcatttaaagatatttcctcagatgttctactttgatgttcagtgctcgcctgttctttttcaactgctggaagactgctctcttcatttggcattaagggaaaatcttgccctgtatcttcaagaaatactttcattttaattggagctattccctcaccctccatctgtttcatttctttctggtcaaggacctcatgatctgcttcctcagccctttttccctggagctgtaatttaagaaatgcaatttcctcttgagcttctttcatttccaacaataaaactgataattctttatgtttctgagaaaatgtgttttctagaacatcttgtccactttcctcagcagaagagctcctcttgttggcaatatcaacaatgctgatctatttttaaaaaagaaaaaaaaagctgtaatcaaatgttttataacattaaaaaaatagcccaactaaaaacttgtatttcatcttctaaaacttcagactttttggtcaaaaccttctttgtaccataacactgctaaatccttttaaaatcagtttgtatctcccagctggacctccaagggcactctgccaatcctgcactgaagtcaagccctattcataagacctaaggaaattgggaattcattttctagatattccttacataagaagctttttttccttcagaataaaactcctaattgattttttttaaaaagtaagcagatacttttgttaggaagccacattactcctcaagggcatgtataattctatcactgacttactgattagaaaaacacagctaactaaacaaaacgcagctaacaatactcttaaatcaacagaatgatactaagcaaccatacccttcttatagtaattttcagattattaaaaggatcattctccaaagatccctttttatttaatcttagtaaaactatgccagtcttatctaatctcttcactgagaaacttttctgagatgaacaaagaagttgagatagatgataacccagtataaaaaaatgtgttatcaaatcccaaattagtagctactgtatttgtgttgctttagaacaatgaattttaatattcagaaacaagtaacaataaatgagatataataaccattatgaatctctttaatagatcttactctataggtaatgtacttctctggcaacactagaaaattatggacgtattttcatatgaagctaccttctcttaatctagctcatgttctggttatattaagaacacatcacttacctcactgacttctctgtctgcctccccagttctattctgagcctctaggagagtaatctgagaagacagtttttctgaaagtcacaaaataaatatctttagaagatatatgtggagtgtgtgaaaaaacaggattgcatgtgaagctatttgaattgtatgaaataattttttaaaaaataaacaaaatagcttgggagaggtgaaagccttattaaagaagtggcaagaggatatgattacatgagatataagatagaacagtactaggtgatgataatgaacctgaatgaagtatactaaatagtggaaggtttgaaaggagaaggatgccaggatgcaggacataaagcagctatttctgtggcataatctggaacttctaggacaatacatataatttatccataatcctactatgtttgtaatatatattttgcattaatatagcacttacaatgttcttcaatgttcataaagatatcaaattttagcactaaaagggagctatcctatctcctcaatgatcatataaggaaacaaagaaatgacacaacccgaaaggttacgcagctagttcagggagctgggattagaatccaagtcttcagagttttaacccaagttctgtgacaatgtgtatatattgagcatcaatatcaatatcctcaagaagcttatattctttctgagaagataacacagatacaccaaaggaaaaaaatatatatattttttacactgtatccaaatgtcttaatgtgacctacaggaaccctcatgctttgaccctactaattctccaacctcctcttcttgtattgccccctttttgttcactctgctctaaaaacactggtctgttttctcttctgcaaacttatcaagttcattcacacctgagaacatttgtactgcttttttctctgcctggaatgctctctgcttagcctctttgcatggctgtccccttttcatcattcaggtttaaagtcctcagaaaggcctactctcactactccaattctgcgttcctcttctccaaggcatacttgaaatactctgttttattttaagcctaatacttatcattctctgaaattttcttatgtgtataaacaggtttgtagtctgtcttcccctccaatatgttcatagctatatacccagcaactggaatagtgcctggcacataggaaagccaccatagatgagacaagggaattcaagacagtatatatgttcagacatttcacaagattacttgaaaaaggagtacagtggtagaaatgtcagtgcaaaaggtgagttgaaaacaacatgacatacaaggtaaaagtaatctatgaggccagacacaaaaaccaatacagaaaaccttaaggtcagtgatccctgcaggaaagagcaaaggaatggaacccatataatacctccaaaccatgtgaagccacatggataggatacagactgtttgcaaaactgcaaaataagcatcatggataaggtctcaaagaagtgctctgaatgggttaaataatgagctgaatttgtggtgttctttacttattagaaatagtgggaatcgtctaatacaagtgcataagcttccatttagatctaagtggaaaactgtaaaatggttaagttagaaatactggctctagagtttaataaaagttttacaacctttacttgctattcattctcactcctagatgataaagtgtagtagtcagttaaagatgaattagatcaataaagcattaacgacacgctactaaatccataaagtctacatgaagcatatgataagtggaaggagacacgtcttcattctcactaactgttcacacacaatccaataggataaaatgctaagttcagttcaatccaacaaaactttattcagtagccattatttgccaggtggtatactagttttgggtaaagcaaagatggaaaaaaaaatggcccctgcccttgaagagcttatatttaaactttgaagagcttataatatagtaaaaaagacaaacatataaacagatcattttaatacaatgttaaaagtatacaaggatgttatggaagcacaaaaaaatcatttaacccaacttttggggaccaataccaaattcctgaaaaagataatatgctagtcgaggcctgaaagatgagtaacaatcatccagactaaaggaaaggagcaggattctaagcagggtacagcacgagcataaaccactcactcacaacatagtttctacctttaaacctttatactgatctctgttacctcatcccacaaatttattaccagaatgtcctttctttcttcattttacctattttaaaaatcatcttattaaggtcctgttcaagccatacttcctataggatacgatgaccattccaaaatgattatgagttataaagaaatcctgcagcatgtatagtccatattgcaaaatgttatacttatgtaaacactgatactatgctctaattgtttaatgtgtattatctttgatagttaccagctctattatctaaatctttattatcacggaatcagagaattctacatgttatacataattagtgataaaagtagaggcacttgtgggataagaagacagagaattatggttttcttttatacataccattctcagctttcagctcctccagctctatagaactaaggagcaaggctcccttttcattctctagttctaccactctcttctgcaaagaagcaatattctcctcagtgactgcctaaattgtagaaagacaacaaattaatgattctccagcagaaaattctcacactaacgcccagatagcctccagcatttttgtcttctagaagttctccagccatgaaaatactttaaaaataacatctacttatctgcctaggtaatctttgaagaaaagtgttttatctaaagatttagaaaaagaaataaaatatttcacacaaatatcaagttcattggcttttaaatttaagattgaagcctggattacaaagatagaaatcccaagtctatagcataagaaagaacattttcaggttcacaaacaaatagtattacaagattagattaatgtcaccaagtaacatggtctctctcctgaaggagaatgaacatgaagagaggttccacaaagaggaatagaggcaaaggaatatgtacctcttaagaaaggaagaagatttataaaattgttttttgttttccaagtataataaaaattcccttggcttaatttatacatccagaatttttggttttcctaaggataggcatatatctaattatgtcacatctttagttttatgtctttgtatatattttttattctccatggatattattctataaaattttcatacaattgtagaatttttaagccatgagggtctttacagcatatttgaccccgaaatcttcattcaatgtttaaaataaatagcatgggatgaatttagggtttttatggcttttatcttgagggaagttcccagtttgcagtatgcagggcaagtaaaattccaatagaatagccacagatatttctggcttgaagaatgagaagagtttgggacaaacatagctgccaggatgtgaggagggagatcagagagaagaaaaagagttaggaaggaggagccctgaattctgtgtataaacttagctgaaatttctgactgaacaatggcacaatgtatttgttggactgacttaaagcagcccagctaaggcaaaaataactgaactgagttttgatgcctctctatcataggccagagtttggggtttgagtccaacttactgtctgataaaaagtaattgaaattttagaaataacaaaataaaatcttgagaacaaaacacgacatccagaattcaaaacaaaaccattcacacataaagaaataggaaagagtgacccattctcaaggaaaaaaaatataatcaacagattctagccataaaatgatgcagattttgtaagtagcaaacaagaattttaataaagaagctattatatctatgcttaggacataaatgaatatgctcataatgaatgagaagaaaggaaatcttagtaaaacaaacaaaaaaaaataatgaaccagtttgaaattccagaactaataaacataatatctgaaatgaaaatttcaatgtgataggcttgacagtagaatatagacgacagaagaaagtcttggtgaattgaggatgataaatcaactgaaattatccaatctgaagacagaagaataaaaaaaattgaaaaaaaaaatgaatacaacctcagggacatgtgggacaatattaaaaggttcaatatacgtgtaattggagtaccagaagagacgagggacagaatgggaagaaaaaatattttaagaaatggccaaaaatttctcaaacataacgttatatacgtaagaaactcaacaaaagcaagcaagaaaatgacaaagaaaactataactaagtacttcatagacaaggataaaaggaaagtcttaaaatttccatggaaaaatgatactttacatacagagaaacaataattcgaatgactactgaccaattgttagggaaaaaatataggccagaagagggaaacaccttctttaaagtactgaaagaaaggctggacacagtggctcacgcctataatcccagcagtttgggagggcgaggcaggtggatcatctgaggttgggagttcaagaccagcttgaccaacatggagaaactccgtctctactaaaatacaaaattagccaggcgtggtgactcacgcctgtaatcccagctactcaggaggctgaggcaggagaattgcttgaacccaggaggcacaggttgcggtgagccaagactgtgctattgcactccagcctgggtgacaagagtgaaactccatctcaaaaaaaaaaaaaaaaaaagttctgaaagaaaaattgtcaatcgagaattataatatccagtagcaaatatcattcaagaataaaagtaaaataaagacatttttagataagaaaaaaactaagaaaattttttcacagacagacctatactataatattataggttgttgtagaggctgaagaaaacagtatcaaatagatatctgatcatcagagaggaaagggcattacaaatggtaaatatgtggataaatgttaaggtcaatattttcctcttaatgtctttcaaatatatataaccattttaagcacaaatattaaaattgtgtgctgaggcttattacttttgttaatataatacatacaacaactgtggcatcaggaatagggtgagggtatatgattatgaagattctaccttttaagtgaagtagtacagtattaactcaagaagactgaaaaattatggatatatgttatacttcctagaataaccacttaaaaaatttttgtaaaaagatacagctcaatacccaatagatgacttttgcttctgctaaagactgagtaacatggaacagatttaacctcctacctgaaacaataacaaccaaaaccagacaaaataataaataatcattttcagaatactggatatcaagcaacaaaggataattatctctgagagaggcagaaaacaaagtgatccctaaaactgaccaagcttcatgccttaagagagttttcaggctgtggtccaagaagggggaacataggctgagcctggtagactccctaagttcatgagacagagctgacagtcaagaaagagcaagatggctgcagttcgcagaatagaataccagatgggaaaaagtcacgtaaagagaaaaccctgcagatctgcaaagggactgaacaagtgttcagtgaagtacagggcaggacatgaatgtgaggaaagcatccaaggctatctgaactacccctacctatctgaagagattaaagaatagcacttggtgctcacacaaaacccggaagtgtcagttatatagccaaatgtgaaaaaacacttctcagggcattgagtagaatactcagcaaggtcttgcctcaggagtatcgaatgactgagcactgattcgaaccctcctaacaaatcaaagcagcaggatctgaaaggaccaagtttttttcaaagaatttaactgagtcgcataaaaaaagctccaaaatatgttaacaaaacaaatatagaaacaaaggagaatcacttgaaccccggaggcagaggttgcagtgagctgagactgcatcaatgcactcctgcctgggcaacagagcaagactccatttcaaaaaaaaaaaaaaattaaaagcccattaatgagttttggaacaacttcaagtaatctaatataaatgtaattggaattcccaaagaagagtagggagtcagaaaaatatatatatttgactaattcacggcagaaaatcttccaaaactataaacacagagattgaaaaagctcaatgaaccccaatcacaagaaacatgctatgtcaaggtacattataattcaagtgctcaaaaacagtggtaaaatcctaaaagcaagcaggaaaaaagagagaagcatgacagcagatttcttattaaaaacaaaatgcaagggccgggtgcagtggctcatgcctgtaatcccagcactttgggagactgagggggtggattgcttgagacaagagttcgagactagcctggccaacatggcaaaaccccatctctactaaaaatataaaattagccaggcgtggtggcggttgcctgtaatccaagctacatgggaggctgaggcaggacaatcacttgaatccgggaagtggaggttacagtgagttgagattgcgccactgcactccagcctggatgacacactgagactctgtctcaaaaaaaaaaaaaaaaaaaaaaaaaaccaacaaagaaaacaaaatgcaagaaagaagacagtagagtaatacacttagagaaatgaaagaaaaaaaaactttcaatgtagaattctagtcagcaaaaaataatctttcaacaacaatggtgagataaagatgtcttcagacaaaaagtgttattagaacccatgactggccaggcacggtgactcacacctgcaatcccagcactttgggaggccgaggcgggtggatcatgaggtcaagagattgagatcatcctggccaacacggtgaaaccccgtctctaccaaaaatacaaaaacaaaacaaacaaaaaaatagccaggtgtggtggtgggtgcctgtagtcccagctactcgggaggctgaggcaggagaatcacttgaacccgggaggcggagattgcagtgagtcaagattgcaccactgccctccagcctggtgacaaagtgagactccatctcaaaaaaaaaaaaaaaaacaaaaataaaaacaaacaaacaaaaaaacccatgaccagcagacttgcacacacatccatgtacacacagacacaaaaattaaaagaagtccttcagagccaggtgcagtagctcacacctgtaatcccagcactctgggaggccaaggcaggaggatcatttgagctcaggaggttaaaaccagccagcctaggtaacttagcaagacctcatctctactaaaagcaaaaaaaaaaaaaattagctgggtagcatggtgcatgcctgtagtcacagctactctggaggcaaatatggaagaatcgcttgagcccaggaggatgaggctgcagtgagccatgatcatgccactgcactgtagcctgggtgacaaaatgagaacctgtctcttactaaaaaaaaaaaagaaaaaaaaaaagtccttcagatagaagaaaaatgataccagatggaaatatgaagccagggtttggcaaactttggaggcctgcataaataaagttttattggaacataaccacaaccatttgtttaccttggctctatgtctgttctcactttacaatggcagagttgagtacctgcaacaaagactgtatgacccacaaagcctaaaatatttactatacataaaaggattggcaatctctgatctacaaacgaagaatgaaaagtaccagaaatggtaactgcaatggtagttaagatttattttcttattttaatctccttaaaacataaacataaatgctttatatgtattagccaaaaactgtccacaacccaaattatccatcaatgagtcaatggttacacaaattgtgctgtttacaacatactcaacaatacaatggaatgaattattactaaacaaacattaggatgaatctcaaataagtatgctgagtaaaataagccaacaaaagtgcatatacaacttatataaactttttaaaaatctataatgacagaaagcagatcagtggttgtctaggtagggaaagatgtgagggaaaagattaaaagaggacatgaaaaaacttctagagatgatgaatatgttcattttcttgatagtagtgatggttttatatgtcatcaaattgttctgggtgctatggcttatacctgtaatcccagcacttcgggagacaaaggcaggaggatcacttgagcccaggagttagtttgaggccagcctgggcaacatagtgagaccttgtctctacaaaaaaaaaaatttgccaggcatggtggcacatgcctgtggtcccagctattcaggaggctgaggtgagaggattgcttgagcccaggaagttaaggctatagtgagctgtgatcatgtgactgcactccagcctgggtgagagaacaagaccctgtttcaaaaaacaaatgaacaaacacacaaaaccctctttaaactgtatactttaaatgtgtacacattactgtatgtcaagtatacctttttatacttaatagagctgtttaaaagaaaaagttgtcaataaatgaaaattaaattcaagaaacttctaattatcgaatagaaggcaggaaaaaagaagaagggaaaacagaggggaaaaaacagaaagcaaaatggtagacctaaatccaatcacatcaataattacattaaaaggactaggcactccaatcacaaagaagagaagaaataaaaaagtataacccaactatatgttgccttcaagacatttactttaaagaaaaacaagttaaaagtaaaaggatagaaaagaatataccattcaagcaataaacataagacagaattattttattaatgccagatacagagaaatgtaaataaagaagtattactacagatagagtaacattttgtaagtgaaaaaaggaacactttatctgaaaaataaatgtgtatgtactaataacagagattccaattaccaagaagcaaaaaatgactacattaaaaggagaaacagacaattccacagtcatagttggagatttcaaccccctcttagcaaatgtttcaataaccagacaaaagtcaaagacaaagataacgtgaacaatactatgatctaagtgctatttgtagaacattacatccaataactacagaatacacactatttacaagtgtacaaggtatgttcaccaagacaccatatgctgtgtcataaaataggtctcaataaatttcaaaggattgaagtcacataaaacatattctctgatcataatgaaattatattagaaatcaataagatatctagaaataaaaccaagtatctggatattctacaacaacgtgtttatttagaacacacttctaaacaatccatggtcaatgaaaaaatcacagagaaacttagaaaaatgttcaaaaactgaaatgattaaaaaaccacaacataacaagctatgcttagagggaactgtgttaactttaaatgttcatatgagaaaagaagacttgaaatctttgatacaaagtttcaccttaagaagctataaaaagaagagcaaagtaaatccaagtaagcagaaagaaatactaaagagtagaaatcaatgaaaatgaaaataatcagcaacagagaaaattaacaagaccaaaagtggttctttgaaaagatgggggaaaaaagctgaataaattctagatagactgatgaagaaaatgaagcacaaattaacaacagcagggatcagcgcttacaggcattaaaaggataaaaagtaaacattgtaaccaacattatgacaaaaatagaacattagaacatcttcaatgaaatagacaaaaccccaggaaaaaaaaaaaaagcccaaacaaaccaaaactggcaccgggtggaaaaaaaaaaaaaaatcttattattagccttatatctgtaaaggaaattcaattcattatcaaaaccttcctaaaactccagactcagatggtttcattggtgaattcttttaaaaaaaagtatttaaaaaattattttcaaaaaccgaaataataccaatcacatacaaactctcataaaatagaaagaaaggaaacactcccagaaaatagaaaagggaacatattatgaggctgccatacccttaataccaaaacctgataaagatatcataaaacaagaaaactgtagactaatatccttcataaataagaacacaaaaatccttcacaaaatattagcaaatcaaattcagtactatagaaaaaggataatacagttaactcttgaatatgggtttgaactacatgagttcacttatatatgcacatttttttcaacaaatgtattggggttgggtgtggtggctcatgcctataattccagcattttgggaggccaagggagggggattgcttgagtccagaagttctgtaccagcctgggcaacatgatgaaattccatttccaccaataaataaacaaacaaacaaacacataaaaatagccgggcatggtggcatgtgcctgtagtcccaactacttaggaggctgaggcgggaggatcacttaagcccaggaggttgaggctgcagtgagctgtcatcacaccactacaccccagcctgggtgatggagtgactctgtctcaaaacaaaaaaataagtaaaattttaaaaaaagaaaaaaaaaaggccaggcgcagtggctcacgcctgtaatgtcagcactttgggaggccaagacgggtagatcaccaatggttaggaggtatggttaggagtttcagaccagcctggccaacatggcaaaaccctgtctctactaaaagtaacaaaaattagccgggggtgttggtggacacctgtagtcccaactacctgggaggctgaggcaggagaatcacttgaacctgggaaatggaggctgcagtgagctgagatcacaccactgcactccagcatgggcaacagtgaaactccatctcaaaaaataaataaatagaaaaatttttaggaggattgctacaactagacatttgttattactcatagaagaatcacatagcctagaaatataaaaaaaaaattaagagaaagtttattttaaaaattaagaaaaaattaagaaatatcaaaaaaactaagagaaaaattcctctacaagattgaggatgatctgatagaggaaattccttaaaaacctaaaactagtatcacagccaatggtaaattatggaacactttcctcttagattagaaacaatgcaagaaagtccagtctcaccacttctattaaacagtgtactggaggcataaaaattagaaagaagtaaaatttgtctttattttcagatgacatgattgcttacatagaaaatcctagagaatctacaaaaagagactaaaaccaataaaattaatttgtttatcaaggtcacagaatataagcttaataaaattcagttgtatacttacatattagcatacattggaaaatgaaataaaaataattccatctataatagtatcaaaaatattaactacttcagaataaatgttataatgtgcataatttctccaatgaaaactacaaaacactgctgaaagaaattaaagatctaaataaatggagagatatactatattcgtagatttaaaagtacagtagtgttgtcaattcttaaactgatcaatagactccacacaataccaattcaaaatctcatctgtctttttttaaaaagtagaatttgagaagctgattgtataatttatgtggaaaggacctggaatagtcaaagcaatcttgaaaagaagaacaaagttggaggacttatactattaatacttgacttcaagactaacaacaaactacaataatgaagaccgtgatactggcatagggactgacagatagatcaatataacagaacagaaaattcagaaatagatgtattagtctttgatttgcaacaaaggtaccaaaagaatccaatgaggaaagtaaagtctccttacgaaatggtgctgaaacaacgaaatatccgtacaggaaaaaacaaaacaacttgaccttcaccttacaacacacacaaaaattcatttgagattcagagacttcaaatgaaaactaaaaccataaagcttgtggaagaaagcataagagaatatcttcataaactggggctaagcaaaggtttcacagacaggacacagaaaaaaaaaacaataaaaaatgataaataattaagctcatcaaaatttaaaagtgtgtgctaatgaaaagatatcataatgaaaatgaataggcaagccacaaagccacagcatgggagaaaatattcaccaaacatatatgataatagattggcattcagaatatataaagaattcctacttgataataaaaagacaactcaaatttaagaatggggaaatgatgtgaacagacacttcaccaacagaaggtgtacatatggctaagaatctcaagaaaaaaagttcaacataatttgtcatcagggaaatgcaaatttaaaccacaatgaaataccactacatacccattagaatggctaaaatgttttaaaactgacaccaccaaatcttggagaagatgtggaacaaatggaactctcatatattttaggtgggagtataaaatagtacaaccacagccaggtgcggtggctcatgcctgtaatcccagcactttgggaggccgaggtgggcggatcacgaggtcaggagtttgagaccagcctggccaacatggtgaaaccctgtctctactaaaaatacaaaaattagccgggtgtggtggcgggtacctgtaatcccagctacttgggaggctgaggcaggagaattgcctgaacccgggaggtcgaggttgcagtgagccgagatcgcaccactgttctccagcatgggcgacagaccaagactccgtcttggaaaaaaaaaatagtacaaccactttgggaaaagacctggcagttccttataaagctaaatacataggtactctatgacccagcaaagcaattcctcaactagtatttactgaagataaatgaaaacatatgtccacataactatttgtatgagaatgttcacagcagtttgattcataatagccaaagcatgaaaaagtccaggtgtccatcaataggaaaatgcagtacaatcatgcaaaaggaaaattcagcatgttcataaaataaaatacttctcagcaatattaaagattaaattataatacatgcacaatatggatgaatctccaaatatgctgagtaaaagctttacacataagaggacctattgtatggttaaatgtatatgatgctgtgaaacaggcaaaattaatctatggtgaaaaatcagtagttgtctttggaggggaagggtgaggatgactgtaaaggggtatagggatactttgtgaggtgatggtaatgtgatatatcttgaataggagtttgggtaacacaggtgtatgcatttgacaaaactcaaggaatggtatacttcagatctgtgcatttaaaggtttgtaaatcttacctcaaaagaaaaagaacaattataaataaatattaaaatatagtcaatgatatgaatgctgacaaatttagagagaaatgtactgatgtccacaacttacagtgaaatgtattataaatttaagatgaactgatggatgggcagagggatgaataaatagatagacatttgataaagcaaacgtgctaaaatgttaatgatagaattcagatggtgggtatacagatgttcgctacaaaactcttgcaacttattcgaatggttggaaaacgtcttaacaaaacattggaggaaaaagtcgagaatgggagaacagaagagactggaaagcctagatgctagaaaccaagaggcaaaaatttttatcagtggacagcatagcccaggaatgacaggactctgctgaccaatatgtttgtgagtttggaagggtataatcttacaatggagatgactgaatctagttatctcaacttgacattagtcaattaagaacatcaaactaactgccttcattctgatattcaggctcaatcagcctgaatcagccttcgatgattacaatctagctctctacagagatttttgtagatgaaagaaagaatatactggccaataagaagctacttggccattatatacttttttactgttaattaattaatgggaacaatatgatttccatagtagacttttaagtttgattagactgactcgtgttcactaaacctgatcaaatcttagtttaccaaaaaaaaaaaagacttccgaactgggaaaattaactacagaagcaaaagtaatgattcatctccgatacaaattgttaagaccttagaatcagaaaggcttctgagaccatggtatttgttatctattattttctcattctttattgttgaaacactgcattaatgcctttcatgattcctttcaaatagaattgtcctcaaaaaagtattttttcaggcagaaaaaacagaaggtttatatagctctctggaataaatcctcattagagcaccgaagtacagatacagcaaagacaaacagttaatattcataagaagttcacatttaattacctgtgtgccctcattataaacatctgggaaagaagtctgagatgctgtttcatgttgttgcaagggcagtctatttagaaattggctaatttctttggatttttgctggagctgatctaaggaaaagaaaaaaaataaatgtaatatttgcttcaagtctgaaatgtagttattattatcttctaaagatacactgtatgctgtttactagtttagtttccttagttaaaattatgatgccaatgacaacattattattagctaaatgttaaatgttctcaagaaccaaaggacacctcagtaaatcacttccttcaaaagtaaaataaaataggcctaggcactttttttttttttttttgatacggagtctccctctgttgcctaagctggagtgcagtggtgcgatctcggctcactgtaacctctgactcatgggttcaaggattctcttgcctcagccttccaagtagccaggattacaggcatgcgtcaccatgcctggctaatttttttttttttttttttgtatctttagtagagatggagtttcaccatgttggccaggctggtctcgaactcctgacctcaggtaatcccccccaccttgacctccccaaagtgctggaatagcaggcgtggggaggcctagccctaggcattttttacaagttcattttccctttcccccttgaaaatggctttagggtttttgttttcttcactctcgacttaggtattatggatcccaccaagattccaccacatggttttaaacatcagcatgcttaagagaacagcttgctcatgtaacaccctggtcttgtgtgatgcccttcaaaactgtctggctagggcacaatggctcacgcctgtaatcccagcactttgggatgccgaggcgggcagatcacctgaggtcaggagttcgagaccagcctgaccaacacggagaagccctgtctctactaaaaatacaaaattagccaggtgtggtggtgcatgcctgtaatccaagctacttgggaggctgaggcaggagaatcacttgaacccaggaggcagaggttgcagtgagccgagatcatgccattgcactccatcctgggcaacaagagtgaaactctgtcacaaaaaaaaaaaaacaaaaaacaaaactgtctggctaacattcagttattcaatacaaattttcaacttaattgtttctaaaatctttcctttatgtctatgtcaatatattagtaaaggttataatttggggaagaggattggtgagatggagtattggtgttgaggaagtttcactttttaatttataaagttctaaaatgttcaattttttataggcacatattacttttataataacacattttttaaaagtttcctttataccttcataaaggataaattttcacctgtaagacaagaaatcaggtgaaaagagattttcacctataagaaaagcactgagatccatccttcttcagatttatggataactccatgcaatttagtctcctaacctatgcacctagatctggcctgagttttccaaaaactaattcaaatccttctcgtttcagtcattgaatccttcagatcagtcatatttaacatagcattctatttaatatctggaacatcactatcacatttttagtattgtaatgataattataatattaagaaagattatagccagtcagaggcaagaaaaatgcatcaagaagttcagaagagctgtttttctcagtccttctattggttcaattggtttgagtacagatttcattaacagatccctgaaaatatgaaatacaagccactcagatggtagagatgtggacttcaaaagcaatcagctactgaccttccagttgctgaatggtctgggctgactgaactgcttgctcattcttatcttggagaagctttgaattttgatcctttagagcatcacaggcagactgcagctcttgtccagtcttttgaagactcaaaatatgagaggtcttctcttccatttctgctttgtgcttctgctccaaagcactataccgagactctagttcagcctgggcttggcctgcttgctcaaactgttctaaaagatgatgcatttcttcctgcagattatggaaggataattttctctctgccacttcaagttccatcttttccagtagaatcttggactcctctctttctgtttccacagtgttcctcaaagtattatgctcagcttccatctgctgtaactgctgagagagaatctaagaaaaaagacaaagtctcatgagccataaatacattatttcatttcaacaagcattgtaaagtgctttttcttataggatggaaaaaaatgggaacatgtttctatgctagagagaaagcccttctcaagaaggagagttgaaaattaagaagagaggagatggctgactccccagcagcacacaggcacccagaaaaacaaacagagaatgtggactatagcaccaattctgcattatgatgagactacttggatgtgacaggataggaacacaaggaatccaaggggtagaaaaaaggtagttcaaactgtcaagcatgggtccatataggacacagaaaggagcaagggtaaggaagaattaacatactagagaagcaaagtggaattcaatggaattcaatgagaatgaagatcaggacaatatgagaaagaaaatggcaggatggattatagtcagatcagcattactgattaccttcatactcaagagaatattgcagaacgagatcatttcaatctaacagaaggtcaatttacaaaaacaagaaaagatgggctgtacataaagcacaaaaaccattcaagacagagaagagtaactgatgaaaaagaaactcactaaaggataatacaggtcaagtatcccttattctaaatgcttgggaccagaagtattttagttttccatttttttcagatggtggaatatcttggatatcttgggataggacgcaagtctaaacatgaaattcatttgtttcatatacatcgtatacacatagcctaaagataattttatacagtattttaaatgattttgtgcatatttgcctttgatctgttaccctgttccacaaggtcagttgtggcattttccacttgtggtgtcatgttggtgctcagaaaatttcagattttgcagcattttggattttcagattaggcatactcaatctgtatgacattctagataaactaggaccctagatctaaaatggcaaagggaaagagcaacaataaagaagtgcaatgtatgctccatgagggaaagaactgtatttagttttgctcataattgtactgcatccccaccacttaagtacgaggtatttgttgaaagaatgaataaatggcatcaattctctgaagactttaaataggcttttatatctactgcctggcaaacgaaagtggaaatgaataccctccaaggcaggaagtaaagattaaaaggcagtacctggtttctctgctcagcagcagtcagctcctgttgcagcaagtcaacgacctgagcacggcccaccaaggattcttcgtgttcctcaagcttcctttgcagcaccctcaatttctgagaagaaaacattttagacataatatgctaacaaatgagtgcttgtatttgcttatctttcaaaatgtcatgtagatttgtatacttaaattttggggtgttgaaaatgacagtttaaagagtgggagaccagcatgccatgctccccccatccagcagcaacgaagagtctccaaaatgtcttctccagagcaccaacaacaaccagacccagacacaagcaagtccctgaattagggagtctctttaaaaattagaaaaaacaataacacatatctgccttcaaaatcatacagttaataacctgtacctagatagcataggtacatgtacatcttacccacccaagagaacattctctgcaggcaagaatcatttctcttctcctagtttcatgcactgggcaggcacttgaaaaaaaattgttgaataaataaagcaatgatacacatatacaattagtattctacttaataatatgttgtattctaaaactttatttagtggtgcattctgaaagattgcttagaacttaaaagtttccgttctaattaattctaattaattttcaatctaattaaacagatcaaacataaagtatcactgaagtgcctttcagtaccacaatgcactacacactaagtgaaataaaatactttgagttagtagatggtgaactcaaatacaatgaagccaattttcaaaatctactcaaatttttttaaaaaagaattactgatctaataaaagacttcatgtcttcaaaatcattctttgtcttctctaattttttaaatatttaaaactgacttcattgatttgaagctttgggttaggtgtgtaatgcacaaaggtagctataatcagaaaactgaagagaaaccaatttttgactaccacataaattcaccaactaaactcagcttttgagcaccaacaacctgattagaggggtaaaaggcaagaaaaggataagaaaaaataaataatttttatgcaacagaagacaaggacacaaaagaggccaataaggaaaacactaacaccaagtgaagagcagtgggtaagggtaggaaattggctgtgatggattaaatattaaccaaaatgacagtcattctaccgagttttagcaacacacctgttgcatctctgtttccacatctgcctgggttactaactgaagaagctcatcttcatgaagacgaacttgtgtttcaaagcgggcatctttctctcggaccacctgctgcatggaactcaactgaagacacataccagagaaactatgcaagttacactccccgaatattgcacaaataaaactcacagactactttccaagacagacactgagacttgatagtagctttttaaagtgaaattttgattgtcaaggatgaggatgttggaagagagataggctggacagtaactatgaaatgcgagagaaagcctattttcaaattcagaagttagcctaaacataaattttgatcaaaaattatatgttcatggttactagaaatgttttaaatatacaagaagtgtattttttaaagttctaaaaagattaagatattaaacacataaggtgaagttaagttagatttctattaaaccctggacacttcttgctcatggctgaaaagctttcagtaaaattctcatgccctataaatgaaaattcaaactaacatatcatttattcaagattctctacaactggaaataccaatctatctttctagtcttattttcaaagaattgcttctaccaaagaacctcatgtgcttctaaatccacaccacctccccagacagctgttttcagctgtcattacttgcagccttctagatcatgctcatttttaactggctctgaacagaatgaaatggaaataaatggactgatggtgagctgctcagtatcagtgcttctgtcttgtttttaggttgtgagtgtgtgcatctgcttattcatctccttaagatctatggtggagcatgctgcttagctgttagcttgcctattttgcattggtcctttactgctgatatctcagtttgtgacaccttgaatcaaactttggctttcttttttggtaggagaaaaacaaatcctcagaatgtttttattatctgaattgtgacctcactaggaatttggactcttgtgtttcaagtgtgtaggcactggagtctttcattagccaaacatctctaactcctttcccataactgttccatattcttttccttctctgcagttttgctcacaccgttccccatcactgaaatatctcccccagcttgtctggaatattatctatatatcatggttttgcctaaatcccaacttttccgtgtaattttccttaactgtcaaactcacagtaacctctttcgccttccaaaatattttgtttgtattgctgcttgctttggcacttattcggaaagccttaaattacgatgaatctcttaacacatgtatgtatcttggctttccatattttagcaacacataggttaaaaaccatattttgtatttcttcatcctgcactgtatatagtgcttatacataaaaaggacacaataaaaaataaataaaaaatttaaaaaggacacaataaaagctaataggtaaaaccaagaatttcaggatatacaattttaactgtatacatagcagtaggccaaccacagagagaaggcactactaatactacaaattattaataaagtaaacacctaatggataattagctatgtacaaaggtacttcagggaaaaaaatctttcatgattcataagcattcccccaccgctgcccccaccccccaaaaaaaattacagtgcctgtaatcccagcactttgggaggccgaggtgtgaggatcacttgaactcaggagtgcaaggcctgcctgggcaacatattgagaacctgtctcttcaaaaaatgtaaaaaatttagccagatgcagtggcacatgcctgtagtcccagctacttgggaagctgaggtgagtgagaggatggcttgagcccaggagactgaggctgcagtgagctatgattgtaccacttgtactccagcttgggcaacagagtgagacccaatttcaaaaataaatatgtgggagtgcgtggccaaccaagaaacctagaaaaatagaaaaagttgaggatgccaatccaaatggtctggtcttgacagatgaaaaaaatgggaagaagaatgtcacatactggtgccatttaacataaaatcacatgacctacaccactttctcattacaggctcactaagtaatctaactataatttatttcctattaagatagatattattttgggaaagaatgaacctaattatttttatttcttttggtttacttattggtctcttttgaactcagcatgagtccattcccaaaagactgaatctctgtctgctattaaaattaagtttctggacatgcagaactaagaaacagtcatcaattaggctatagaaaattcatcaaggtaaataacacattgtgaggttttctggtgttccctaatgacacacttacctaccacacatctcctaatctcttctactacatatccttctaatttctagtgcaacacccatgctactatacttttatctactaggattttttaaagtgactcactgaattgacttgtgcgtaataacccactggacttcatagctctttatcctaattttgtgaggtccctacctgtgcagcttgctctgcctgtgtctggctgagctgggcttgtaaagtgctaatgaattcttccttctcctggagctgttgcttcatcattacaaattcttccatctctgtagaactcttatcaaaccgaagacatagaaggaaaaaaaattatttaagcaaaagaatgagcattattaattctttgacctccctttcttgcttaacctaaatgcctaccatatttccttctagtttccattgaacccaaaaggaaattgcatgcattatcaaaattttatttgtcagaagaagacagaagcagtagtggcaatttttcaatttctctgactcctcacatagagacagcacaagatagtaaaaccaaaaaaaccacagataacatttacagttaaattaggcagaccgtcctaaaaaccctaaaatataagctaataaggacaaaccaccaaaacccacaagaactacattgtattagagtcttacattgtgtaagaaaaagaaggcagcaaaagagtgaaatctgatgggtctgagaaagggacagccctaaacagccaatgtatttatttgctggaatgaacagctggccaattttagaatagtggcagggctttgccattctttaatactaggtaaatgcaaggggtgcacagtaaggtaagaaggactaaaagggctagagcaatctaggccccctgaactctcacaactgactcatcatggctcccttctgagacatgaacctgtactaagaagaaactgcgaggagtgaaataaaaattatgcagaaaaggaattaaagagacagaagaaagaggtctacaaacgtattgtataattcagtatcaactagccacatgtggatatagagggcttaaaatgggtctgatagaaaagaaatatttttaatttttaacattatttaattttaatttgaaaactgaaatatagattatttttccattaagtacaactttgttttggcatgactatatttcatcttatctgttgcatcatgtaagttactgttgaggtgctgcacaagcaacaagtgtatatgcagttggtatcaatgggttgattcagtttaacatttttctagacccctatataacactgtaatatgtttatttgtatacttaatgcagacagcattagtaacagttgataccaatttaatcataactaataattaaattgcaatataaacatttattataattgaattattttccaagttcaaaaataaatatagacacatttcaaaatttaaaatgaaggccttctattgttgtatagttggttccttttcacttctaagtagtattccagtgtgtggatataccacagtttaaatatttccctattgatgggcatgtgagttgtttccagtctttaattattacaaataaacctattactattggacagtgctggcataaaccaagtgaagggcagaaggaagaaagccaggaaatctcagaaatccggctcccatatctttgaacacaacacaaaaacaatagaaaaaggaagtctgttaagaaaagctttcctgaatcaagcctccttccaaatagaggtttaggagaataaatttgacacaaaaataaggaacagaaaaggatgaaggtcatatcccatttaagttactattaaaaaaacagagtagcccccactagcaagaggaccctcaccagatgcagcctctcacccttggtcttctcagcctccataacttcttataaattacccagtttcaggtattctgttacacgcaagagaaaacggactaaaaaggaaaattggtattgacaagtggggtcatcgttgataatgattatttgaaaatgtggaagcagttttggaactgggtaatgggcagaggctggaaaaattctgaggaactagctcaaaaaaaaaatgcctagattctgatgagggcttagaagataagacaactacagaaagcttagcactccttggagattggttaagcggttgtgaccacaatgctgatagaaacataaatagtaaagcccattctggtgaggcttcagacagaaatgaggaacaaagtatcagaaactagagtaaagcccagccttgctataaattagcaatgaacttggctgaacttgtccagtttttgtatggccaagaactttgtagaaggctgagcttgagagtgatgaactagggtatatggcaggagaaaattttaagcagcaaactgcttgagctgctatgtggttacttctatctgcttacagtgaacagagaaaaagaaaacagagcaaaaaaaaaaaaaattggaaaatttgcaacctggccatgtggtaaagaatggagaagatttcaggatgggaatccaagaaggcacagccaccacttgctaaagaaattaacacggctaaaagggagccagtttctaacagttaagacaatgggaaaaagccctaaaggcatttcagaatgcattttagaaatctttaaggctgccccaacagcccccatcacaggcccaaagccctaagaggacagaatggtttctgtgaataggccctgagataccactgctctgtgccacttcaggatactgctccttgcagcccagctgttctggttagtgcaaagcagccgcaggtatggctcatgtcacagctcaaaaggtacgagttgtaaaacttggtaacatccacatggtgctaattctgcaggctcacagaaagcaagagctgtggaggcttggtagtctccacttacatgtcgaaggatgtcatcaatagccagggggctcaggcagaggcttgtcttgaggcagaaccaccacagagagccccactagagcaatgccaaggggaaatgaggggttggaattgccctgcagagtccccactagagtaatgcctagtggaatcacggtgtgggactaccactgccataccagaactatagagctaccagtgtgcaatgcaaagtcagcctgggaatgctggctggactaagcccagcaaagccatagggacagaactgcctgaggtcttggggacccaacccctgtaccggcagaggatgctgaaaatggagtaaaagaagattattctggaattttaaggcccaatgtctactctcttggttttcaaacttgcttggggtctgttactctctttcttcttgcctagttctcccttttagaatgagaatgtgaaccctatgcttgtcctaccattgtatcttggaggaagataatgtgtttttatttcacaggctcacagaaattggtgcaggaatgagctaagactttggggctgtggggatgcaattaatgtatttgtatgtgagaagaatatgagttttggagagccaagggtggaaggctatgatgtgaatgtcccctccaaaactcacgttgaaactgaatccccagtgtgacaagaggcctttaagaaaggactggttcaggaggtctctgaactcagcaatggattaacacattcacagattaatggattaatgggttgtcatagaaggggaactggtagctttataagaagaagagagacctgagctggcaaattagcacactcagccccctcactatgtgatgacttgcgctgccttgcgacaccactgagagccctatcagcaagaagaccctcaccagatgcagtccctcaactttagacttctcagcctccataaatgtaagaaataaatttatttaaattaaattaaatttctgttattataaattaaaaacaaaactaaggagcagaatgatatgattataggtgataaaagcataccagagccacactaaaaaaaaaaaaatcaaaattgcaatctatttcaaaaagtttttaaaaattaagaaaattatacaggccaggcatggtggctcacacctgtaataccagcactttgggaggcccaggcaggtggatcacttgaggtcaggagttccagaccagcctagctaacatggtgaaaccccatttctactaaaaatacaaaaaattagccaggcatggtggtgcatgcctgtaatcccagctactcaggaggctgaggcaggagaattgcttgaacctggcaagcagaggttacagagagctgagactgtactgctccactccagcctggccaacagagtgacaccctgtctcaaaaaaaaaaaaaaaaaaaaagaaaagaaaagaaaaaaaaattatacagagatgagagaaaaacataaatcagatttagaaaaatcagaaatgaggtgactgaactcatgaaaaatccaatagaaaagaaaaaatcattgcagtatagaagataaaaaaacagaaaaaacacaaaaacaaacaaaaaatagaaggcctaaagtgaaataaaacaacaaacaaaaaaacaaacttaaaatatgtgaaaccatatattgaaagagtatactgggtatctatgaataacaactaaaaatgacaaacaccaatgcatattctaataaaattaccagacaagaagaaatgaagaaaagaaggagactgatatatacatagataaatgcccattgtgcatctagaaaaatgtatttgtcacataataatccattggttttagtgattcattaacctaatgattatgaagtaacttccacccctacctgtgcaggttgttctgcctgtgcctgagtaagctgggcttgcaaagtgctgattagttcctccttctcctggagcttatgttttatcttttctatttccatctcttcctctgtagaactcttgtcatgctgaaaatgcaggagataaagtcattatttaaaagaattacaattaatatatatttgatattttcttctaatttttcatttacaaccatttagttataattttattaaactgatgggagcaagaaaaaccagctgatctaacaaataagaaatcttagggttgtccagtttttgtatggccaagcagttcctgttagacctaccctccctcacataatagctataaactgtgaaatacatacacacacacacatatatatatatatatatatatatatattttttttttttttttttttttttttttccctcacaccaagcatgtgaacccaaaactgtggacaatatagaaaacagctatctgaaaatactggagagcaaccaaaagcaggaagatactggaggggatgtgataattggaagaaatggtaccgagtttcccattttgacagcttttattctgagggcaaaaccagtcagtgccatgcaggactaaaccttaatagaaaacccgaagtcttgttgccttgaagaatcaaggagagagctcaggaaactatagctgttgctaagtgagaagcaacacatcagaaaagagccagtgaggggaaatccaattttttcaataatctatttttttttccaaaagctctcccttagactgagattctgcctctttgtaaatttagtccctcccaaccccctaaacaaagctatttctgcttactggaattacaaagaatacttttatactttcacataagtcagtcaagcacctgaggactgttgtcatttcttcaactatactttccacagaatacctagctctgtattgagtatataatagttaaagggttgctatgactgattgctgaaacttagaaatcatttctttaacagagaaagaaaatgaactctaagacattactgctttaaggtctcagagctaaaaatgaaattaaaaagcagagtataaaatggataatttaaaaatctgacatcatagctgaggagaagctggagggaacaaagcaatatgaggagagaggttggtgctaccacagtgaggggaagagaactgacagaggaaaaaccaaaaggaaaagaaggatcaaggtgaaattatttgagaagattgagaaaagcttttaaaataggcttcaagaagttaaataagattatcaattcagggaaagtaatgttctctgatcattaggccctgagaggaaagactaagcaggaactgggtcactaactagcgatcccaaaggttgtgcctagaaaactgattaaaatctcatttcccaagaactaaggatactagcaggtcaaagcaaaacaaaatgaaactaaaaaaataaaaagatttcttacacacggtgaagtctaggctcactctataactacagtatgcatgtgatatgcctgcctccatataatctgtatcaaactctccacaaaactgaagtttcttgttctctaaatagctgactgaatgtgaatatgtggagtttaaccatacaggaaagataatgaaaatttgagtactgggacaatattcctcacagggcagtactttccttattcctcctctgtatctccaaccttaaactgctttgttggctgcagtcataaacctagtgagcctcccttttagagagtcccaggtaattcagctgattcagcccacatgcatgaagctttaatccaccactatgtgactatatatgaggacacagaatattctgtgttaagtcattgaattaaaaagtttcagagctggaagaaaccttagagataatctagtttaatcttctaatcaatgatgaaactcctccaaaaggtatgtttccctcctctctaaatgcctcacttcagtacttatttcttcctgtaagccttttttaatccctgaaagtccaggtcacaactggcatttcatatccatgttttctgtacatctttcattctccctgtgtgtggcctacagtccagctgaactacaagctctataagaaaaaaaaaaacaaaacattatttagtgctgtatcattttagcatcctaaatgtttgtgattggtgaagatctgctgtattggtaggttttttcaacttaggaaatatacactacacccagtcaccataccttggaaagttgctcctctgactgaggttctgtaggcagaacagtccctccttgtgctttcatttcttctatgtatttattcaaagaagttaatttggccttcgcatgaagttttagttttttaattttgttatcagcagcttttctctcttcctgcccaaaaacaatgatggtaaatacataaatgtttattcccctcttatctagcacatactaaaagttatttttattattattactttcagagacagggtatctctctgttaccagggctggagtgcagtggcacaatcacaactcactgcagcctctaactcccaggctcaagcgatcctatctcagcctccagagtagctgggactacaggtgcccaataccatgcccagctaattttttttaaatttttttttgtggagacagggtctcactatgttgcccaggctgatctcgaactcctggcctcaagaaatcctcccatctcagcctcccaaaatgctgggattacaggtgtgagctaccacaccgacccaaaagttattttcagtaggcataaggttacagtactagggagataatcagattccctaataatctaagtggagacaaaaattaaagtgagtagtgtatcatctgtcctttatcaaatgctccacaagaaaggataaaaacaatagtacctgtagagcttcatctttctgctgcagttgaacatccttctgtctaataatatcttttagctccaccaccaattgctctgcataagccaggcgctcctgaacatcttcttgtgtagtattattaaattccatgtcagattcttggtgtaattcctaatatttaggaaaaaagttgccagtgcaccaggaaaaggtattagcttcccaacaggagtttcttcattccaactttttatgttttgcccaattcatattcttgttaacttaagaatctaactctgatccaataataatcattatcatagccattacaatatattaagtattttataaatgttaagcattttacaaacattatcccatttaaggtattattatcctaattttaccaaagagaaaaataaaggaaagcaaaaatcataaaccagtaagggtaaaaggccaaaagttaaaattaagagtagttaagtaaaactctcttaaccactacgcattacttcttgtcttttcagaaaactaagaagttttattaattccttatgtggacttcagaaaatataatacatactgccaatttgtatcatcttaaaaaaaaaagaaaatacaatacaaactataggagaagtggtaaatgaaattacaaagcaaacagatattctgaaacccaaaaggtgttccagtttcctcatttgtcacttagacctttcctgtggaaaaggaatagccaaggatgagaacaaaggacttaaaacactctggcaccaaacaaggcccagggagacaaatgagaaagccctttcaaattgtatccaggacttgtttcccatcactgtggcttttaagctaaaaacttacaagagaaggatcacttataaaatttcaatatttttcttaatcctcgcttcacctagtaccagggaggcttcgcacacccttctatcttaaattattttccttagaagaacacagaacatatgtcttaccagtttaaatcagaacagaactactcacagggtctaggggagccctcatattctgatcagtgtcatcatctcctgataattcatgcaaaacaacatttgctaatcctgataatcggctcagcatttctgtaggaaaagaaggggggaaaaaacctaagaatcagcaaaatgaacataggcttctcctatattgataaccatatcatccgtgaatgaaaaaagaatactgtacaggtgatttgtattagacacagtctgcagcacaatgatgtcttcaaaaaggcatttgagtacttccagtgtagtcacacgctgttcttttcagtggcaattgtacagaggttatcaccatcactaacaccatttctaaaataaaatgtaagtacctaatcgttaaacattaatacaatgttaaataccaatctataattgttaaatacaccttaaaggtagtttttatctttaatgcccttctttcatagtagtttcacttacaaacatgaatttcttttttctttttctttttttttttttgagacagggtcttgctctgtcacgcaggctggagtacagggacgcaatctcagcccactgcaacctctgctttctgggctcaagcgatcctgccacctcagcctttcgagtagctgagactacaggcacatgcccaaacatgaatgtcttattctttcttcctctgtcagactgttattctctcccacttgttcaaataaactccatgatactgcaacatttttctttttatgtgccccatgaaccccattctttcagaaagctttcttgataaaccatgtggctttgctaaaatttaaatataaactttgttcaaaatgtacagcattaaatgcatatattagaaaaggaggaaggacagaaatcagtaacctatgattcttctatagaaaattagaaaaagaagaacaaattacagccagtgtaagcagaaaaataaaaataaaaatcagagtagaaattaataaaaatagaaaaatagagaatatcaataaaaccaaaagttgattatctgaaaagatcaataaaattgataaaactctagtcaagatgaccaagaaaaaaacagagaagacacaaattactggcatcataaatgaaagaggaaacatcattaatgatctaacatacattaaaagataataaacactacaaatagccctatacttttaagttcatccatgtagataaaatgggtcagttcactgaaagattcaagctaccaaaagctcaagaagaaatagagaacctgaatataaatgagtagatatgtgtgggtgcatgtgtgtgtacagacacacacacacatatatatacacacatataaatatgaaattgaattcatacattaaaaaccttctaaaaaaagaaaactccagatcaaggtggcttcattagtaggtaacaagaaacatttaaggaataataccaattttatataatctatgccagaagatagaaaaggaaggaacaccttctaacttattttaccagactagcattgccctaatactaaaagcagacaaagatattacaagaaaactaaagaccaatgttcctcatggtcacagtcaacaaaatattcaaatagtccataaaatattagctaattaaatccagtaatatataaaaagataatacatcacaaccaagtggggttcaagaaatgtaatgctaattcaaaatatgaaaatcaatgtaattcaccatattaacagactaaataaggaaaaccacataatgtcaatagattgagaaaaagcatttgacacatttcaatatctattcatgattatgaattcacaataagaataattcattctcagcaaactaagaagtgaatttcctcaacctaataaagggcatctttaaaaaacttacagccaacatcataattaatggtgagaaactgaatgttctcaccatatgagaaacaaggcaaagatgtctcttactacttctatctaacactatactggaagtcccagccaatgcaacaagcaagaaaaagaaaagaaatacaaattggaaaggaagaaataaaactgtctcaactagcaaaatgattgtccatgtagactttccttaaaaaacaactcctagaataagtgaattcagcaaggttgcaggatacaaagtcactatataaaagtcaactgcaggccaggtgcggtagctcacgcctgtaatcccagcactttgggaggccagggcgggcggatcacgaggtcaggagatcgacaccatcttggctaacactgtgaaactccaactctactaaaaatacaaaaaattagccgggtgtggttgtgggtgcctgtagtcccagctactctggaggctgaggcaggagaatggcgtgaacccaggaggtggagcttgcagtgagcctagattgctccgtctcaaaaaaaaaaaaaaaaaaaaaaagtcaactgcattcccattacaatgaacaagaggaatttgaaaccaataagaataccatttacaacagcactgaataaacagagcaggacttgggtaaacagctaacaaaatatatgcagaatttgctgaatgctgaaaactattgaaaacccgaggaagacataaaaaatctaaataaatgtagaaataaaacatatacatgtatttgaactctataatgttaaagtatcaattctccccattttgacctataaaattagtgcaattccaaacttaatcccagcaagcttttagtaaacatcaaaaagctgactctaaaacatatgaaaaggcaaggagtgtggaaattactcactacaattacaagacagggcagcactggtgaaagcatagacacacagataaatggaacaaaatggagagcctagaaatagacacatacaaatcgagtcaactgatttttaacaaaggtacaaatgcaattaagttgagaaaggacaatcttttcaataaatggttgtggaacaattggacatctgaaaaagagtgaaccttgacatacaactcacaccttatacaaagcatatctcaaaatggatcagagacctaaacttaaattgtaaaggttttagaaataaacataggagaacatttttgtgacgctgaatttggcaatgagcttttagacaccaaaaaagcacaatatattataaaaaatattgattaaaaatttatcaaaacatacaacttttgctctgtgaagacaaggttaagaaaatgaaaagacaagtcactgaagccaggcgtggtggctcacacctgtaatcccagcactttgggaggctgaggcaagcagatcagttgaggccaggagttcaacaccagcctggccaacatggcaaaaccccacctctactaaaaatacaaaaataagctgggcatgatggcgcatgcctgtagtcccagctactcaggaggctgaggcacaagaatcggttgaacctggaaggcatggattgcagtgagctgagatcatgccactgcactccagtctaggcaacagagcaagactctgtctcgggaaaaaaaaaaaaaaaaaaacaagtcatagattaggagaaaatatttacaaatagcatatccagtaaataacttgtatccagaatctaaaacaataaaaatatcttaaaactcaacatcaataaagtaacacacctgataaagaaatgtgcaagagatgtgaatagatacttcaccaaagaagatagatggatggtaaataaatatatgaaaagatgcttaagttaatctggcattaggaaaatactcattaaaagcaaaatgaaataccactatctacctattagaattgctaaaatatgtattttttaatgctggcagggatatagagcaacaggaactttcaatgcctgcagattagaatacaaaatggcacagctacttcggaaaactgtttgacagtttctttaaaagttaaacgtacatttaccaatcccactcctaggcatctaaccaagtttatagtaggtttactcataatcacagattctgaaaatagccaagatatccctcaacaagtgaatgaataacaaactgtagcacatccaaacaatggaatactactcagcaaaagaatgaacaattgattcacacaacacaatacttaaacctaaaatgccttttgctacatggaataagctaaacattaaaagatatacatcatattattctatttatataacattttgaacaagtccagaaattaacccacacaaatatagttgtcagggcttgagggaaggagatgtggctgaatataaaagagcaacacaagggaatttttaaggtgaaggaactgttctgtatgatcttgaagtagtaaattcataaccatatgcatttgtcaaaactcactgaactgtacattccaaagagcaaacataattgtatacaatttttttaaaacctcagccaggatgtcaggagttccaaaaatggaatgcagactgtgacaaatagatctaactatattataaatatatgatataacctcactgaaggagatggggctaacctaagaaacaaaaatggtgttttgactgggtactataaggataaagacaaaaagaactgacataaacactgtactctgcttggtaaatttctttctcacagtggtatgggttagcaattctgaaactacttcattgtacactagggttaaatgagtaagtaaattgtagataatgagattcaggttttttactgtcagtgaaagaagttacaaataaggcaagaaagctaggataaaccccatggtactggattagagtcagagatatcagtatgaactcatgtttattttaatatatatgtaaatagataaatgcagaaataagtatagatatgtatgcattataaataatcagttattacagagaaatatatattctagccgtgtccactgaaaagtcctagaaacagtaacacctcagtagcaatgagcgcatccagatctcgatttctaaattgccaatctccaataaaaggaactagggctccttggagaaatggctgcctatctagggttggggcagagagccagaaagtaaggaagtgttcaaaaaagaaaaagaaaaaaaatggggtatgtgaccaggagccaatctgaaggagctcccaatgatcaaggctagaataatttgagtcacagaataaataacaataatattggattatatggattataacccaaataaaaaattaaatacccatcagtcaatactgatataaataaatcattaaataaattaatggtagagacaaatcttccttacaaaagaattccaaataatttatgtagatacgtccccctctaaaaatggagcttaattccctctccttcagtataggctggacctagtgactcacttccaaagaatagaatatgaaaaaagaaaaacagcaacatcagagtggtgagacttggcaaccaccacctcaaccaagtgatcaagattaacatcaccagtgataagtcatcgtaatatcatgtaacccctgatataatgtgatgagaagggtactttacctctggggtattcttctgcaaaacccgtaagcccagtctaatcatgagaaaacactgggaaaacctagattcagggacattctaaaaatacctgaccaatactcttcaaaactgtcaaagtaatgaaaaacaacaaaaaactaagaaacagtcacagattagagaagacaaggagacatgctgattaaatgcaaagtaggccgggcacagtgtctcacgcctgtaatcctggcactttgggaggccgaggcaggcagatcacttgaggtcagtagttcgagaccagcctggccaacatggtgaaactccgtctctactaaaaaatacaaaaattagccgggtgtggtggcatgcacctgtagtcccagctattgggtagtctgagatgggagaatcacttgaacctgggagacagaggttgcagtgagctgagatcgcaccactgcactccagcctgggtgccagagtgagaccctgcctctaaataaataaataaataaacgcaaggcagtatcctggattaggttctgaaacacaataaggacattactggaaaaaatggtgaaatctgaatgaagtctacctatagtttagtttatggcattgcacctatgttctctgttttgaaaaagctaccatggttgtgtaaaatgctaacattagaggatgctttgtgtatacaataactgtctgtctaatcttcccaagttgtatgtaaatctaaggttattccaaaatcaatttacttttataaccactgtgtaggctacatattcagatcagtgtcaactgctagtccataaagtccatgaaaatgagaagcatattaatgctttgataggaaaaatcaaaatagaactggactatgcatagcattagtttacgtgattatgcctaattttacattttgtgataaaatgttatttggcttttaaaaccctcagcaggggccgggcgtggtggctcatgcctgtaatcccagcactttgggaggctgaggcgggtggatcacgaggtcaggagtttgagaccagtctgaccaacatggtgaaatcccgtctctactaaaaatacaaaaattagccgggtgtggtggcacgtgcctgtaatcccagctactcaggaggctgaggcagacgaatcacttgaacctgagaggtggaggttgcagtgagccaagattcgcaccactgcactccagcctgggcaacagagcaagaccgcgtctcaaaaaaaaaaaaaaacctcagcaagaagaaatataaaaactattgtacaaaataaacacttaaatgaaactaggctctgctacagttttcttctactggggataataatagtgtttagggcagccatggttcttaagaaagaagtgatgagagatacctgtttttttaatagattgtcttgggtaatctaagtagcacatcacttggaaaagatacgtgagacagaaatagaaaaagtgaactgttccctaggaaggcagcgcaggatcatatataacttcatatctaaatactggaagggcaacacagtgtcatacatgagtacatagggccatatataactatttattcaagatatgagaaccacagctatagtcaggattaaaaaatcacaattcagcagtatacagattctaaactttcttttcaactttagagatcatattttctttggttaacttttaatgaaggaaatgaataccatcactaaagagtttcttaaacatatagatttctgctaatcaaagaaaatcataatggaacctaacttatcaaacagaatcactttatcttcagatttttcagaccactttggaacaaagaaaacaaaataaccaactgatgggattctgagaagatgggagtagcaaggggccccatggattttgtatcttcctttattcccacataaaaacagacaaagcaactaggtaacaaaagatccatggacagcctttaccaaaaaactacttaacaaagtttcctacaaaccccaaaataaacgtggatatagacaaaccgccaatagtcaaaagatctgggtgtcactggtgttcaactgggaggaaattgagggaagccagaggagtacaacaccaagaggacctcaaaagagccagtgggcattcactggcaaatgcgccaagccaattacagaacagtagttgatacaaggaggggtcttcccattccaataacaggtacctgccaggggcctacgagggctgaaagagctgaggcagtctggacctttattaattctcagaactgaagagttggggctctcttccaggatagggtcccacactgaggagaatctgctgagaggagaattaaaattaagtgactaaggaaagaggaggtccagataaagagcaggtgaaagtggcaaggaaagaaaggcaggaaatccgagaaatccagctgccatatagttgaacaatgtctgaaaatagcacaagaggaaaccttatcaagttagaaaagctgtataaaatctctttctaaaagttcagcaacactaaattcatattaaaaatgaactactgaggccaggcgtgctagctcatcctgtaatcctagcactttgggaggctgaggtgggaggatcacttgagcctaggagttcaagactagcctgagcaacatagcaagatcccatctctacaaaatttttttaaaaagtcagccaggcatggtggcacatgcatgtaggtccagctattcaggtggctgacgtgggaagactgcttgagcccaagaggtggaggctgcagtgagccataatcacacccctacactccagcctgggtgatagagtaagaccctgtcacaaaaaagaaaaaaagagcaactgaaaagtctcacaattcagatacattactagaagaaaaaaaaggaggaaaacgatcatgataacatcccgacagaaaatggaagcacgtcagagagccatgctcaaaaaaacagttcaaaactataaccacttaaatctactgaaggaactaaaaggcattaaaaatgacataagatgtgaaaaaataaacatcagaaatagaaaaacccagaaataaagtgaaaacaagaagtgactgaaaaatttaaaaaatcattttggaaatgaagatgaaactagaaggaacaagaaaatgagtaaatataacaaaccatgtcattaaaaaaaagcaaagttgaaatgaaggataattttaaaaatcaaaaagaaatgacctaaaaaactagatatgcaactaccttatgaccctcaattccactccccagcatttatcttagagaaaagaaaacttaagttcacaagagaacctgctgtatataaacattcatagcagctttatttctattaatagacggttaagcaaactgatatatacaggcaaatggttaaacaaactggtacatacatcccatcacatacttctcagaaataaaaagcaacgaactactgatggacccaacaacttagatggatctccagaaaattacattgaatgaaaaaaagccagtcccaaaaggttacatattatacaattccatacttctataacatttttgaaatgacaaaattttagaaatggaggaaagatgagtgattaccagtggttagagaggggttggggtgggaagtgactgtggtcataacaaggcaacacaagggatccttgtggtgttgcagctgttcaatatcttgactgtggcagtggatacaggaacctacacaggtgatataacactgcaaaacttaatgatacacatacatacatatacaaatgaatatacaagtaaaactggggaatatatctatctcaatatcctaattgtgatattatgtattagttttgcaaaatgttaccactggaagaaacaacaaagtgtataaaagagctctgattatttcctacaactgcatgtgactctacaattgtcttcatatttaaaaaacaaatgaaaaagaaatgaactaaatgcaacatgatatcctgaattgaatcctggaacagaaaatggacattaatggagaaactggtgaaatgtgaacaacgtctggagttcagttaatattaatgtaccaatgttggtttcttaattttgtacactgctaatgtcacatgttaatcttagggaatactaagcaaaggatacaccagacttctgcactatctttgcaaattttctgtagtaaactttctgtagtgatctgaaataattcctaataatttgtttatttttaaaaaatgtaagaaattaagagttacataggatttgcgagaaacagataaatattgaagataagtaatgtgaataacaggattccctgaagaagaaaagcaaagcaaagaaacagcacaaatatgaaaaaccataatccaagaatatttatttgaaaattttttttaaaaagatttgaaactacatcttgaaagagcccacaatgtacctcagaatgtcaactcagaatgaccaacaaaacactctagtaaaattactggacttaaaaaaatcctttaggctttaggctaaaagatcatatgaccagtaagataaagaaaaaaaagcactagatttttcaacagcaatgtttttgccagaaaaaaaaaatgagttacaaatttaagatattcaagaaaagaaaaagtgagccaaggattctatttctggcaaacacaaactttagatataaaaaacacagacaaaatgttatgaacgagcaagaaaattcatgaaatatgaatattcccttaagcctttcctaaagaatttactagaggcaaaacttgaggcaatccaaatgactaaagaaacatcattataagaactagtggtgagcattaaatatacggttactaacagaattaagactaagtaaagactggaggagagacagcatagtatgtaatgattatatgctctgacaatatataggacaaccatgaaaaaaaatcgggaagaatgtgaatagcatatgcaaaaaataaaaaatatttttaaacagttttcaataattaaaagtggttgttgtctacggccataccatcctgaacacacccgatctcgtctaaagtggttgtggtggtgatattcgtatcatcactcctagattactatatgtgaaatgtagaattaaagcaaatgataattatggatacactaattctgtattttcagttatgaaaagaagatacagatgtaatacagaagaaattaagaaccccgaaatacaaactaatctttgaatctgaataggaacactcagtgtgaaatgacaattcagtattttatatttgttcacatattttcctagctctgtccaccaaaaaggcttaaaagtaatgacaaactgagaagcaatgaatatctctagtgcctagattggggtcttgaaatactctttcccatttttaaaaaagtttttaaaagaaggttttcttagagaaatggctaattccatttctaaagtggaaatgtacaaaatgatcctgaaacatcttgtcatacaagataggaagctttcaaaggacacaggttcccattggctaaaaggataatttgaatatgtatgaataagaattacagcacactgggccatactgtccaaggtaatttatagattcaatgccatccccatcaagctaccaatgactttcttcacaaaattggaaaaaactactttaaagttcatatggaaccaaaaaagagcctgcatagccaagacaatcttaagcaaaaagaacaaagctggaggcatcacgctacctgacttcaaactatactacaaggcgacagtaagcaaaacagcatggtactggtaccaaaacacatacatagaccaatggaacagaacagagccctcagaaataacaccacacatctacaaccatctaatctttgacaaacctgacaaaaacaagaaatggggaaaggattccctatttaataaatggtgctgggaaaactggctagccatacgtagaaaggtgaaactggatcccttccttgcaccttatacaaaaattaattcaagatggattaaagacttaaatgttagacctaaaaccataaaaaaccctagaagaaaacctaggcaataccattcaggacataggcatgggcaaagacttcatgactaaaacaccaaaagcaatggcaaaaaaagccaaaatagacaaatgggatctaattaaactaaagagcttctgcacagcaaaagaaactaccatcagagtgaacaggcaacctacagaatgggataaaatttttgcaaactacccatctgacaaagggctaacatccagaacctacaaagaacttaaacaaatttacaagaaaaaaaataacaccatcaaaaagtgggcaaaggatatgaacagacacttctcaaaagaagacatttatgaagccaacagacacatggaaaaatgctcaccatcactggtcatcagagaaatgcaaatccaaactacaatgagataccatctcacaccagttagaatggcaatcattaaaaagtcaggaaacaacaggtgctggagaggttgtggaaaaataggaatgcttttacactattggtggtagtgtaaattagttcaaccattgtggaagacagtgtggcaattcctcaaggatcagaactagaaataccatttgacccagtgatcccattactgggtatatacccaaaggattataaatcatgctactataaagacatatacacatgtatgtttactgcagcactattcacaatagcaaagacttggaaccaatccaaatgtccatcaatgacagactggattaagaaaatgtggcacatatacaccatggaatactatgcagccataaaaaaggatgagttaatgtccttggcagggacatggatgaagctggaaaccatcattctcgccaaactatcacaaggacagaaatcaaacaccgcatgttctcactcataggtgggaattgaacaatgagaacacttggacacagggcagggaacataacacactgggacctgttggaggttgggggctggggaagggatagcattaggagaaatacctaatgtaaatgacgagttgatgggtgcaggaaaccaacatggcacatatatacctatgtaacaaacctgcacgttgtgcacatgtaccctagaacttaaagtataataaaaaaaatacagttaatcaaaattaatacctctaggaatacaaattataaatacacatatttccatggaaaaattataaaataagtcaccaatgctaaaacaccagaaatagttgctattagaaaactttaccaaattgtcaaaaatgagataatctaagtgctacagaagttgctgtttatattgctccaaaacatagaaaaagaaaatgaaaaattacaaaccatctccctatgaatactgatgacaacattctaataaattttaattagaatattaaataaaatattagcaaactaaatctgactagatactgaaaaatattatcaccaagtggatttattctagtaattcaaatatcattaattattatgaaatccattatggaaacccataccactaccacatgagtttctgattgaccctccctagaaaggagcgtgcccatcagcatcctactgaatatcattgaatatcatagcaaatgaggaacacatacacatgaacacaggataataatgataatattaatggcaacaattgagaaacatttaatttaaatgcaaagtgactgtaccactttatatactctttaatcttaacaaaatctgtaagataagtattatcatcatccccattttatagagggaaactgacactcagaaattaagacatttcaaggtccctcagttaaatatataatacaatagcagtcaggcagggtggctcacgcctgtaatcccagcaccttagaaggctgaggtgagaggatggcttgagctcaagagttcaagaccagcctgagcaacatagtgagactgtctctacaaaaaaaaaaaaaaaaaaaaaaatttaattagctgggcatactggcatatgcctgcagtcccagatattcgggaggctgaggcaggaggatcacttgagcccaggagtttgagagtgcagtcagctatgatcacaccactgcactccagcctgggcaacagaacaagaccttgtctcaaaaaaaaaaaaaaaaaaattaaaaagattgatagaataaaacaaaaagctatttaaaggaaaaatagattacttttctcacataaccatttaaaaatatgtacattttaagaaaggaaagactaatatttaaatgagataaaaatctgagagagtgctagagatgtactgttcaggcaggacaaaaggagtctctcatagattgattcaacagtctcagagatccacaggaaagcaggtgacatagtgggaagagcaccaaactggaagccaaggaactgagttttccgtcctggctcaataagaagctgcatcatagtgagtaagtcaccttaaagcgtcagtttcctcatcttaaaatgaagactaacaaggaccattctaatgccccctactctacagctgttgacattaaaggaataatctggaaatgtaaatggaagggcatctcacccacagttgtaggcttttggtagctcaaaggttgggaactacagggcaagaaagccagtaagtagccatgcttaagctaaatgaagaaagatgggtactcccctctattaggctcactgaggacagaaatgggcaaatgtatagataaaaattaataaaggggaaaatattcatagtcatagtcataaatctatgtatgtatatgtatatatacatatgtatacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtatacgtgtatgtatatatatacatatgtatacgtgtatgtatatgtatacatatatgtaaagattaataaaggggaatagtcatattcatagtcataaattcatgtaaggaatatgtatgactgttggacaatgttcttgctgttattttataaggcaccaaaataatgaatagcaactaaggaaaagaataaaacacagagcttcatgccaaggccagggattccataaaacactaaggcaaataaaacaattcctcagtctatgctggtcacagctttcacaaaccctgccacaggaccttaacacttatgtgttgaagtggcactcagaattaagtaagttttattttctccaagtcttcactgttatcaatgattattcttataacaaccacctggtgttcagcattatgctaggaactataaaaatataaaaagaattataaagcatgtccctagccaccgaaaacagaacaatatgcacaggaaaataagcaaaataactgaagacagtgagtgcatgcctgtgtatatatgcatatatgccatctactttggaatttaaatcacattttcccacagaaacacagagaaggtggttaggtttcagttgaggtgactcctcaaacttatttcatgcttatttagttaagcctcagtagctgtccttaattccttaaatctcaaagtgattttcaaccaagttgaggggctaatgggtagtgctgtatagctggaaataacacattcgatattatgacataattttacaattagaaaatgaacaactatttttcatgatgcagaagccactattttaattaaatgaatttgtaagtggtagctataacatacatacacagcgtgacctgccaaacactgctccaatatctttacacataacttacttttcgttatttaactcactttatttatttatttatttatttatttatttaatgttatttattttgagacggagtttcactattgtcgcccaggatggagtgcagtggcgcgatctcactacaatctctgcctcctgggttcaagcgattctcctgcctgagcctccccagtagctgggattactggtacccgctgccacgactggctaatttttggtatttttagtagagacaggggtttcaccatgttggccaggctggtctcaaactcctgactccaagtgatccactcgccttggcctcccaaagtgctgggattacaggcatgagccactgcgcccggcctaactcactttattcttaaaacaaccgcaagagggagtaccgtcaatattcccagttttaaggtgagtaaactaaggcagagggatgttaagtaatttccccagtcacatagttcgacaaagcttcttggtgggtgaagatacacagaaaatattttattttctgaataatctcattatccaatattctttactcgggttgaaaacagaatgaagggataaaggcactatgttaatagttaggtaagtacttttttttaaagcagtaagtaaactaaaatgattcatattagtatggccccaaataattccatattgtttataccacagacaggttcacacaagggccctaagatatatatacatggatgttatatatatatatatatatatatatatatatatatatatatatggatgttacataacaaaacatgttatgtatggatgttacataacaaaacaaaaatccatgtgtgtatatatatatgtatatatgtatatatgtatatatatgtgtatatatgtatatatgtatatatgtgtatatacgtatatatgtatatatatgtgtatatacgtatatatacgtatatgtctatatacgtatatatatacatatatacgtatatatatgtatatatatacatatatacacatggatgttatataacaaaacactacagcagtgttttgatggctaatgactgaaaatctaaatgtccatcaatggggacaggctaaatactatttttatatttttacaaaggactgctgtgtagccatggaaaggatgaggtagttttatacccatggatattgaaagtgcctaatatacagtactaaatggcaaaagcatgtgtattaggattccacttgtgggaaagacagaagggggtatatattatcatgtgctttattatgatcagaaagtttcttaaatataaccaagaaattatttacagtgcttacttctgggaagtggggaatggagatgggtagatcagtagatagaaaagaaaaagactttttttacattgtatccttctgtattaaatttccttttatcaaaagcatatagctgattttaaaatagcttaattaaaaatacagcaatatagagcttagtctccttttacataatggtttctaaccacagactggtatgtaatgatcagtggtattcctaatagtaattaacctagagaaattaatgaatgatttattttataaacaaggataaagtcaacatccctttaattaatccattaatcaaagggagaaaaagaaagggggcctataaaactcaagcagaaggttgaaaaaaatcttctaaagatcatgtttaagaaaggctgcatcccagagtctggatgccagaaatgccaacgaccttcttgaaaaacaaggaagtatctttacgtgattgtcaaattgggttgggaggtcccaaggtgtggacaaggctttttaaaaacttcattcttttacgtttatacttttgcatatttcatattatacacaacatatttacagtggtagtcatacactataaataattaaacacacaacatttggggagatgcatgctcaaaaatgttttactgatagggagtgcaattaaaaggtttggaagctgctgaggtagtaaaaaatattgatgcagtgaaaagaaaaacattaaatggtcattctgtggtcaagggatgagaagtaaaagctatgaagcagttaatgtacaatgcctgcaacttttgagtactcttcaactttttcctgcatctattccaaaaccaaatcctgccatttttccaataggatatttcctgagtttgccccttcataaccattctgaccatctaaatcttatcaattcacgcttttggaaaggcctctggcccttatgtaaagagccctccacttgcttgcatcttgcacagaactgtaaaaaggtcctttaaatgctcagacagcttccaactatctccaaaagtgaaagtacttacccatgattgtaaatatccctgtcccactctcaaactgtccgctccccatagaccaactggagctctttaaataagtcagacaaatatattcctcattcctcaaaggactcaccctccctttcacattccggttgtgcagattaaacatactccacaccatcaaaccaagttatttttcctcgagaactctcttagaggttcctttttctctaacagcctgcccacctctgattcctgggattttcgtgttgacgggatcgttgggatctttcctctcttctcatctttccagtaacccattagcattagcaggattattggacaggcctccgtttgcattaatatctccaatgattctgtgatctccgccctaaagacctttgatttcttttggtcgcgcctccccttcgggacaccaagtttgtttagggcctgagcacaggggcccagcaggttctttccgacgtcagcggctgcgtacggaggccgacttaggcaggccgctccaggaacaaggccgtgcggacaggactgacctaggcgcttttccccgtcgctcccagaggagaaacgtaccggggaggggacagaccgtgagcaagtggtccaagtctgcgcagggtgaccccgaaggcccaccggagaggccgaggcttgtgggctactagaactaggcctggtaggtgaaggaggcgggtgaagggccggatccaggactgaatccgggagaggcggggcgaggaggggactccggtgtagctgcttgggcagctcccgcggcccctctggcgggggtgaccgttattggactcgcagagggaagagttgggtagcgtcccctactcacctagaagcgctgccgcctgaggctccagctgcccccctcccaattcaagccacgtcagctcgggaagcccgtacgcgacaccttccaccgccgcgccccgccagggactcagccactagcagttgggacggaagat

SEQ ID NO: 626 - DNA, 86569 bp, Homo sapiens; identical to SEQ ID NO: 625

SEQ ID NO: 627 - DNA, 86569 bp, Homo sapiens; identical to SEQ ID NO: 625

SEQ ID NO: 628 - DNA, 86569 bp, Homo sapiens; identical to SEQ ID NO: 625

SEQ ID NO: 629 - DNA, 47556 bp, Homo sapiens
aacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtagcccggggcgcgttctcgccctccccgggctcggccccgcgggagccccggggcgggcccatgcgccgagagcgcgcgtctccattcatcggggcgggcgggcgcgcgcgcgcgcgctcggggctgtggggcgtggcctagtgggcgtgtcgggtgtggcccccgccccctcatcgacctgggatttccttacttatttcgccgaggtccgccgccttcagtgctgccaagattttggcgccgcgaggggccccagtggttccgcgctgggttggtttccagtcagacgcaaagaaacgggatattgagttagcccctgcgacgcttgggggactgcactgctgcctttgaccctttttagatgtcgtaaatttcacgtgcacccctccccgtattgctacttgtgggaacctcaaatggcaggctggaaaccctggacttagtgagggctcatccccattgtgtttgttgcctcttaggtgagcagtggaggtcttttgacctttgtttaccggtgaagaaacagattggaggaagatgtttgcttttgggtgaataagggccccatgcctaagctagatctttcagcagttctgaagcgattgacactttccatatctgtgaactgattctgaattattacaggggaaagagcctaaggatgtttaacccttaactagagtggctgcattttgttgcatcaactggatgactgacttcaggaaaactctactggcctttgaatgggtgtttgttccaagtctattaggttcttgttttttgttttttatagagacagggtctggctatgttgcgcaggcaggtctccaactcctgggctcaagcagtctgcccgtctgggtctcccaaagtgctaggattacaggcatgagccaccacacccggccatatattaggtttttacagattgtctcaaactagccttttttgctccaaaggcagtccccagctagtatatgttacctttttaaaaaaattatggatatacagttcagatgtacaaatgtcaagcagtagaatctcatgtaaggaagtaagtgccaatcctggagaattaaagctatcatgaaatgccaagagtttcttctccttatagcagtttttagtatcatattccagcattttattcgtactttattttcttttatttttgaaaaaagatctcactttgtgcagtggtgtgatctcggctcactgcagccttgacctcctgggctcaagcgatcctcctgcctcagcctcccaagtacctgggactacaggtgtgcaccaccgtgcccgactaatttttgtattttttgtagagacagggttttgccatgttgcccaggctggtcttgaactcctgggctcaagtgatccttgcacctcagcctctcaaagtgctggaatgacaggtgtgagctactgcactcacactcagcgcattcatactttttaaacttgtgggttttatccttcacaattgagcatagcatgaatgaatgaagcctcaagatggtcacactgagtcccatggatgagactaaggtcaatagcatcagaactttagtgttagcattttccaccattttttttttctggacgaggtttgactctatcacccaggctggagtgtagtggtgtaatctcggctcactgcaacctccgcctcccaggctcaagccgtcctcccacctcagtctcccaagtagctgggactacacgcacacaccaccacacccggctaatttttatatttttagtaaagatggggttttaccatattgtccaggctggtcttaaacttgtgagctcaagtgatctgcccgcctcggcctcccaaagtgctcgattataggcgtgagccactgtgcctggcctccactaatttttataaaacaaaaaatataggattcaataaaattttcacgttgtcacttaaattacaactgttcaaagatgccagtgctggggaggtagagccagtgcctgtccatctgccacagttcagaatggtcctcattggccagtaggcacctgcctaactgcagaatgcaaaaggtgtcaaatttcagcctgtgatactaggcgagttgtttacctgatctaatgggtgtaaaagtaatcagtttggctctaagtaggtgacacttcaaaagaaagctttcatttattagttggagcaaattgagaagctgtgcgtggccaagtgggaagaaccttgggaggcctggttccagccctgctctgccttgctgtcgtgtttctcatgtgtataatgtgatgcttagactagatggtctccaagatcttccccaaaacacattttagtttctagaaagctaattacagtcttgtctttcagccccttgactcctgggcctcccagtaagaataatcttcctgagacccaggctgtaagagactcagttggagaggcagtttgttcttttgggcctgacttaatcatcagaccttcggagtttagggaagagttcaaggtcagagctctattgaaattcagtagctccagtgatagtagtggatggacggtctcagcccactgccctgtggaaaacaggcactgtattcagagaggtgggccagccatagcaacatacccagtgcctccatgcgccatctgtggagctgtcttgggaaggcatctgcatttactaagagtgtgtgtcactgttctgccattaacagacagctgtatttaccaagccggagtcatggagctttgaggaccctaacagatccccaagtccagcaccttgattttatattcaggaaacctgggtcccaagagggtgaaggctggttcagaggaaagccaggaaggcaagcccagtttcctaagttctgaaggggctttggggggcatctaggagactcagagccctgcagggcctgcaaggtagtcataggggggagtattgtcaatttcttttaaaaaacctaatggaaactctacatttaccatgatactggatgatactgacacacaagccaaataacatagaggggtctgtgccctctatgtggaaagcgagtgacttgctgtgtctgctcttctctcagcgttcagtagccctggttgttgattacagtcactgctgaaaatggagaaacattttatttaatactatgcctgggtctcacacctataatcctagcactttgggaggcccaggcaggagaatcacttgaacccaggagtttaagaccagcctgggcaacatagtgagactcttgtctctacagatttttatttttattttttttaattaggccgggtatgtggctcacacccgtaatcccagcactttgggaggccgaggtgggcagatcgcttgagcccaggagtttgagaccagcctgggcaacatggtgaaactccgtctctacaaaaaatacaaaaattagccggttgtggtggcaagcaactatagtcccagctactcaggaggctgaggcaggaggatcgcttgagccgaggagttcgaggctgcagtgagctatgatcgatcgcaccactgcaatcgagcctgggtgacagagcgagaccctgtctcaaaaataataataaaaattaaaaataaatttaaaaatgcaaaatatatactatgttgcgtagataaaatgggaaacataatagaagtggtccttcatgggggtgaagttcagagttgctgagcatttggcagatgagtaaagggtacccagaaaatgggaagtgatcccaggttacagatggagccagcacctggcacccagtctattggccatcccctgcaatgtgactccgaagtgatcatacttgaaaagtcaacgagacaatagggtaccctcataaaaactttaggtctagatttattttccttaaggaagtcacactttcagtatttgctacaagcaaactgaagccattgtttgagtcagtgatgatttatatagcagtctggtgattgccttgtaaaccttttggaaaattcctttggtatccctggtttgggttttgttactaaacaaagcaacacaggccatgggggaaattatctggcatctgtctaaaattaaaagacctttttggtgtttattacattgtaaagatatcaaagtcttgtccttaagataaaagaaggtcaaggaggccttgcatttctggaaagtgccagagatccttagtccaaaatcaaaatcaccacgaacttcttgctaagctctgggggcctcccactcaggcatctgcccaggcctttcggaacttggttctgttgtcaggatgcacatatgcaggccagatgtgcactgctggtgaacccttcatatcagcagaatgtgttttaatgctgccgaaagcgtggcgcctgggggccacctcaaggcctgtttgtctgttgcttgatgcagtctgcgccaggaccctccccttccctgtggtgctgcgacccttataatgagccttcttgctttactcataggtgggaaactacctccgtatgttccgaggttctctgtacaagagatacccctcactctggaggcgactagccactgtggaagagaggaagaaaatagttgcatcgtcacatggtaaaaaaacaaaacctaacactaagggtgcgtcttcacgagggtttgtaaacctgtttcaaaaccactcgcttatgtcatgaagataaaacgttttcactccagagtgtcttcactgcagccttggccttagtcgggcagggagcatcccggggtgggccgccctgtgagcactccaggcaaggaagtggctccagggagccattggtggtccactgtcagttatttccagcagggccattgggtatgtgagcgggccggggccaggacactagcaggtgctgtgaagacatgttggtctcaaaacgttttaggaatgctgcgatgctctgccatctgtcgtgggtgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtggcaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatttccactcacttgcttaaaacagtttcctttttgttccccctcctcccctagcagagcatcagtcgctaacacagtgagtccccagctttgcttccccctccgcaagtccctgggctaagtcttgggagataccttccccataagcgattgatttctccaggagaagccagactgggcccacagacaggtagctcttgacggagattccccggaagagctaggggtcgagctgcctagaatctgtcctgcttcccaggcagcacgtgtggaccggctcggggatagaaattcgtgtttggtgtgaagcagctctttccaactctctgggctcttgttttaaaagaaaagtattcttcatcttccattccatctccccaccttgcatcgtgttgtggattgtggtggtgtcagacctcttcccactggggtgttactctgggagctttcttttcccctgagtgaggaccaagagaatatgttctggagtcgagtgtccccgctggtcgtgctgtattgtagttgctggtgctgccctgagcacttccctctgccccgagccagtgctcctggggcagattagtccaaatcagtcccattggaggctctacccagcaggacttgtaagtaaagcactcagtccagattgcccttttggaagaggccagcattcagcagtagtaagtttgacaccttgcttttcccacctcccgcatgcgaggaccttgatgtgctgcatccacttggctggctgctgtgtgccaccgccaccagcagagtgacccagtgatgtttgtctgttacagatcacggatacacgactctagccaccagtgtgaccctgttaaaagcctcggaagtggaagagattctggatggcaacgatgagaagtacaaggctgtgtccatcagcacagagccccccacctacctcaggtaatgcgttcctggccagggcatctctggggacacctgtggggtcttttctgagactcaagaactggttgggttgaagttaaattgaaacactttttttttttttttttgagatggaatcttgttcttgtcgcccaggctggagtgcagtggcacgatcttggctcactgcaacctctgcctcccaggttcaagcgattctcctgcctcaacctcccaagtagctgggattacaggtgcctgccactatacctggctagtttttttttctttgagacagagtttcactcttgttgcccaggatggagtgcaatggcgtgatctcagctcactgcaacttctgcctactgggttcaagtgattctcctgcctcagcctcccagatagctgggattacaggcatgcgccaccacgcccagctaattttgtatttttggtagagacgagtctctccatgttggtcaggctggtctcgaaaccccacctcaggtgatccgcccgccttggcatcccagagtgctgggattacaggcgtgagccaccgcgcccggtcctgatttttgtattgaaacactttttaacagttccctctgtttttatacattttcttagccaggtttctaagtttcttctatatcattggaatttctaagaaacgtaagccaagtcctggattccggagaacagttacaaatgcttggaaagtgggactcgtggggcacagtggcttatgtttgtaatcccagcgctttgggaggccgaggcattgcttgaggccaggagtttaagaccagcctggggcaacacagcaagacctcatttcttaaaaaaacatgtaagtgggaccaatttgtcagaaaaatcagtggctcacataaactcacaaaagaaacaacaatagatttgaatgtataaaaacttagaacctggctgggcacggtggctcacacctgtaatcccagcagtttgggaggccgaggtgggcagatcacctgaggtcaggagttagagagcagcctcatccacatggagaaaccccatctctactaaaaatacaaaattagccaggtgtggtggcacatgcctgtaatcccagctactcgggagcctgaggcaggagaattgcttgaacccgggaggtggagattgcagtgagctgaggttgcacctttgcactccagactgggcaacaagagtgaaactccacctcaaaaaaaacaaaaacaaaacaaaacttagaacctttagaagagtatttatagtaacaattaaaaaaccaagtaattgggaagttacgatgttgtatctagaatctatacatctagatttatacaacaaacttggataccccaacaaataggtaaaagatggtccataccttgaagtacaagggagtaaacaaacatggaaagaatttgccctcatgtgtaatttcaaaaattccaagcataagactgggcatggtagcttatgcctgtaatctcagcactttgggaagtcaaggcaggaggatcgcttgagcccacgatttgactgtgttgcccaggagaccagcctgagcaacatagtgagacgttatctctactgaaagttaaaaaaattagctgagtgtggtgatcacaccactgtcctctagcctaggtaacagaacgacactctttgtctcttaaaaaaaataaaaaacaggccgggcacggtggctcacgcctgtaatcccagcactttgggaggccgaggcgggcggatcacctgaggtcaggagttcgagaccagcctgaccaacatggtgaagcctcatctctgctaaacgtacaaagttagcctcgcatggtggtgcatgcctgtaatcccagctactcaggaaggctgaggcaggagaatcacttggacccgggaggcggaggttgcggtgagccgaggttgcgccattgctctccagcctgggcaacgagagtgaaactccatctcaaaataataaaataaaataaaaaataaataaataaaaaataaaaataaaaattccaagcataaaacaaaaaactggcaacataaggaattggggaaggtgtgatagaactgcactcatgtgtgctggaggtgctttttttttttttttttgagatggagttttcactcttgttgcccaggctggagtacggtggcatgatgtcggctcactgcaacctccgcctcctgggttcaagcgattctcttgcctcagcctctggagtagctgggattactggaatgcaccactatgcctggctaatttttttgtatttttattagagacggggtttcaccattgtgcccaggctggtctcgaactcctgacctcaggtaatcctcccgcctcggcctcccaaagtggtgggattacaggtgtgagccactgtgcccagccgggagtgccctttctgtaaagcatcctgacatcaaacttttttgttctctggcccattaataccgcccctgggaatttgtcccaaagaaacattttcaaagaacaaaatgaatcagtaaacccactatatgtacagagattctctgtagcattgtgaataatactggagaatatggagtcgcttaagtatccagcctttaaggaaaggctaggttagtgacgggtcagccacttgaatggacaaaggtgtgacccatacatggtataattaagtagattctgcagtgacccgagacgggtcctgtgggtgagacgtgcagaatacaagattgtacccatctaccttgtgcattcagctctcaacaaagtatgcatttctctgcacaaagcccaaggagcattaagaaaaaggattattgttcagagtgatgtggttatggaaaatcttttttatgattcccctgaaaggtggcacgcctccaggctggccagtgttacagacgtgtgctttgcagattctttttcccccaagggatgtggtaagaacataaggatggcttggccttcccagggaagttgcagaaggaaattgtgtacatatggagggcactttaattctgcacatgtcagctgggaatcttttatggggcgataaaacagtttcttggtgatcatgtcgtgaggaacagctgcaggagtggaatcccgttgccctggaggtcaagtctttaggggtgggggctggcagaggtttgagggaagtggctttggctggctccacactactcagtcagcccaataaggggacttatggcaccctccccatcctgtcatcggacaatttgagcagaggctgggtgccctctctcagggatgctgggattgcaatggaaggaaggttgtttttctttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtgtttttagtagagacggggtttcaccgtgttagccaggatggtcttgatctcctgacctcgtgatccgcccgcctcggcctcccaaagtgctgggattacaggcgtgagccaccgggcctggcctgtttttttttattattattattttttttgagacggagtttcgctctgtcgcccaggctggagtgcagtggcgccatcttggctcactgcaagctccgcctcccaggttcacaccattctcctgcctcagcctcccgagtagctggaactacaggtgtctgtcaccacgcccgtctaattttttttgtatttttagtagagatggagttttattgtgttagccaggatggtctcgatttcctgaccttgtgatccgcccacctcggcctcccaaagtgctgggattacagacatgagccactgcgcctggccttttttttttttttttttttttttttgagatcgagtttcgctctgtcacccaggctggagtgaagtggcgggatctcagctcactgcaacctccccttcccgggttcaagtcattctccttcctcagcctcccaagtagctgggattataggcaccaggcaccacacctagctaatttttcgtagttttagtagagacggggtttcaccatgttggccaggctggtctcgaactcctgacctcaggtgatccgtccgcctcggcctcccaaagtgtcggggttacaggtgtgaaccaccacacctggccagaaggttgaattttatggcttagatttgcagattctgtgtatggctgagcatgttactcacattcactgtgtctagtgacacttgcattgtccacttgagttgatagctagacctggaaatgagaacttgctactgagatagggcaggatgagggggcaggggctcagcccaggctctaacgtatccagtcagaaaagaggaggtggtcaagatctgtggtttgcaaatacaggctcagctacctggaaatcacccgtggaagctgcaaagaacacatcttcttgggcccttcctcagaggtgggaagtcactccacctgggtggggctcaggaatgtgcttcttaaaattttgcattctgggtttgggtgttgtagctcacacctgtactctcagcactttgggaggccaaggtgggaggattgcttgagcccaggagtttgagaccagcctgggcaacatagtgagaccccaccatctctataaaaataaaaaaatttaaaaattgcactctgagcggccaggattaggaactatgacccagataggttgtagaggggacccctgtcttgctgtcccctctcatagtctctgcccaagctgattccatgttccccaaattgggtactacaaaatcctccctacccctaccagcgatcaaggggtagtcccagcctcagcatcagacgtgtaagtgattcccactttagaagggaaaagagttaaagggcccagagtccaggcaggtcttggccattgcttctgccctcccccaccctctggaaaggagaaggacctttgtgctgtcttcccgggtccctccttagagggaactgtcaaacgtttgtcggccgggcgcggtgactgacgcttgtaatcccagcactttgggaggccgaggcgggcggatcacaaggtcaggagatcgagaccatcctggctaacagggtgaaaccccgtctctactaaaaatcaaaaaacttagccgggcgtggtggtgggcgcctgtagtcccagctactcgggaggctgaggcaggagaatggcgtgaacccgggaggcagaccttgcattgagcccagatggcgccactgtactccagcccaggcgacagagcgagactccatctcaaaaaaaaaaaaaaaaaaagtttgtcatgacttgctctgaatggttgaatagttattgtggaagtggttgcgcaggtgttggggttacacagggaagtgacacacagtcgctgcctgctcctgctcacagccttgccagggaaaatggaaaagcacagagcacaacgggcacccaaatgctctcatctgtttcacccagccctggagccttagtttaaaacagcttttggtatttttttttttttttcgagataggatgttgctctctcgcccaggctggagtgcagtggttgatcccggctcactgcaacctccgcctcctgggttcaagtgattctcatgcttcagcctcctgagtagctggattatagacgtgtgccaccacgcctggctaacttttgtatttttggtagggttgaggtttcaccatgttggccaggctggtttcgaactcaccttttggtttttttttttttttttgagatggagtttcgctcttgttgcccaggctggactgcaatggtgtaatctcggctcactgcaacttctgcctcctgggttcaagtgattctcctgcctctgcctcctgagtagctgagattacaggttcctgccatcacacctggctaatttttttttttttttttttttttgagacggagtcttgctctgtctcccactctggagtgcagtggcgcaatgttggctcactgcaagctctgcctcccgggttcacgccattctcctgcctcagcctcctgagtagctgggactgcaggcgcctgccaccacgcccggctaattttttgtatttttagtagagacgggctttcaccatgttggccaggctggtcttgatctcctgacctcgtgatctgcccgcgtcggcctcccaaagtgctgggattacaggcgtgagccaccgcgcccggctacacctggctaattttagtatttttagtagagacagggtttcaccatgttggccaggctggtcttgatctcctgacctcaggtgatccatccgccttggcctcccaaagtgctgggattacaggcgtgagccaccgcacctggcctggtttcgaactcttgacctcaggtggtctgcccatcttgaccttccaaagtgctggagctacaggcatgagccactgcacctggtgcttttggtaaaagcaacctggaatttgggagaaaagatcaaacgcttcatgggacatgggttatttaaattaccttggatgtcacctctggaaggtatttatcaacccatcttctcaacttctactgctgtggaagctgagaggccagaggccttgcctagtccatctcaggatggctggtatgtctaaaatgacagcctgatcatgtctcttccttcaaaaccctggggactcccagccacctgctgagtaaagtcatctcacggagcatgtgagacctgtgatcggtcccctccctggggacctcctccctggactgcccctcagtctctcctccttgctgctgcccgtgcccctccccgcagtgaaccctgactcagtgtctaaggctgtgctctattatccactcctctgggaagtctcccccttgtaccacttccccgcatccaggaagtgcttccgtggagccatgcctggctcatagtgcagtacaccatggccgtgctgtgtctggtgcccctacgtacccttgcccttgcccaggtgcctctagcatctgatgacagcctggggagcaggctcctgcaaagtcaggtgcacagacaactcccatgggagcctcgagcctgacagaggtacagtgggcatccctggagcattagttgattcctggtgggcaggatcaggctcctatactgactgggaggacttttcttgtatctcctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagcacgtttcagttccttcctccccagaaaaacactctgctttgaccttgtgctccccacaacgccacagtacctcctcgcctttgaactgttgtgtttccctgacttccaggacattgtccatagcctccttggctctgtctgctgtcaccttgccatgtcctcctcacctctctggcccctcaagtggagttactcagggcgcggtccttgggccctttctctgccctcagtttcacatgagtgggccacagccagtctgatggtgcagatgccatccacgtgactcccactgtgccaccatttcccagagcctgctggagtaaaccaccacaaactggtggcttcgagcagagcacatttcttccctcacagttctggggcccaggagcctggatttagtttcactagaccagactcatgtgtggacagggccatgctccctccagaggccatcgaggcgattcggtccttgcttcttccagctttgggggctgccacgttccagtctcagcctctgtggtcacgtggccttctctgcatgaaacttccctgtctctctcttagaaggacacttggcgatgtaatttagggcccttctggttaatctctcaggatctttcacttaatcgtatcttcaaagtctccttttttggccatatgagctgacagtcacaggttttggggattaagttgtagatgtcttcggggtctgttttttacctctgtggcccagacttcctcagctgccctcaccccctcagcctcatgctgcctgaagacctctccatctcggcgcgtggagatccagccctctccttgctcaggctgtaggtttctttcccaaggcctgccttttcctcacacagcaagtccagtctctccaggttctcccctgggactgcctcagacagccccccactgctctccctggggtctctagcagcccctacctcccctccctgctgccttctcagctctgcagctggtgtggcctctgctccaggcagatcatgtcacctctccacgcagaatcctccaggctccccatcaccctcggagcagaagcaggagttctcactggggtgccaggcccaacctggcctggtgctgccaccgctgcactctgccccactcaccctgcctcaggcctgagaacgtcctcattgctgtcagacctcccagagctcctgccctgcagttgcctctgctgaggtttagccccgttctccctcctcccctctttcctttcctccttccttccttccatcattcctccttccctccctcccatcctaccccctcctccttttccttctgtcttccttccctctatctcctcttcccatccctagttgactgtccccttctcccttagagtggccaccccttttctgcagcatccctgcccctttccctgtctgtttcccagcgcattcatgcctggcactcagctcacttttctctgtcttccatctacctcccaaggtcactgggggcctttcgcagccctctccatgctcccagacgcccttaggtgtcctgtgtcctccagctccatttcaccaacctgcctgccggactcttccctctttatcttcccaaagtactccattgcttggaatcctcctgggactccctcagggcagtggccagtttgcatagcctgagggaagaactgtgggtgcttcgacacccgctagctttgcagcatccctgaccactgctcctcacggaatctgtgctctgtggtctgtttgtacgtcctcagcagttcctccattcacctgccttggccttgctagaatatttcctcttctggaaatgcccttctcctttcccatagccttccatgaaagtcctgccaaatttcaggcttaaatatcccttcacaggatgtctgggtgttgttccaacactgcccaggtcgattctattgcagacagactggtgcttgttatttatggccccaactgtccccattagaccgtggccccgggacccctgctagcctcgtctgctgcctcagctgttagctgacaagcggccatcttccccagatgggtttgcagaagcctgctgtgcagagagagaggctgaaaatttgcatacctagggctccggccccctcgctgactgttgcttccatttcactttcagctttgatgaccatgacccagctgtgatccatgagaacgcatctcagcccgaggtgctggtccccatccggctggacatggagatcgatgggcagaagctgcgagacgccttcacctggaacatgaatggtacaaggcagtcgggcttggctgggcctggccccaacccctgtgtgttacgtgggaacagtcccgtttcctgccagctgcctgtcaggcagattctggacctgacacgcaggacatcggggcatagttttggagggtgtgggctctgggttcagtcctggttctgttgctgttcactgtggattgggcctgtgaactttggactctttccccatactgaggttgggtggcccaagaggcctggcatgggaggcggctgatctgcatagcatggatgatgatgacaatgccagtcagacctagttcagcccccgagccctgcacacacctgccttgggtcctgtccaccactctgcttctgctgtgtgaggctgcatgtgtgccccgtgcctctctcctcctctaactggtcatctctagacatcctcactctgtaagtcctgggtcagatgccatctcttctggctcttcctgggcttccaaagcctggacagaactcggtctttgtgcaaatgtagacagaaaggttagaaggatatgcatcccaggtgtctagactgcttatcccatctgggagggtggatcatgcatgcatttattgttttctctatttttaagtctgttagaatgtatttttattattttattttatgattactgtttttttagatcttgttgcataccagttttttttttacttagtgtctgtatcctgctgaatttttataatgaacatactatttatattcagacaaaatgcagtgaatatcatctttattttacttatttttttttttaagagacagagtcccactctgttgcccaggctggagtacagtgatactctcatagctcactgtaatcttgaactgcctgggctcaagcagtcctcctgccacagcctcccaaatagctaggaatacaggtgtgcaccactgtgccaagcgttaccatttttaaatgagtaaatgtttaaaatcatcagaatctcaccacctgaataatgttttcagttttaccttttctgtcaattccacatgcaaacatatttaacatagttgtcactatagagcaagtatcgttttatttttcttcacttatcataagtatctttctggtttctcttttttttgggaggggagatggagtctcactctgtcgcccaggctggagtgcggtggcacgatctcggctcactgcaacctccgcctcctaagttcaagcgattctcgtgcctcagcctcctgagtagctggaactacaggcgcgtgccaccatgcctggctaatttttgtatttttagtagagatagggtttcaccatgttagccaggctggtcttgaactgacctcaggtgatccgcctgccgtggcctctcacactgctgggattacaggcgtgagccactgcacccagcctctttctgatttctttaatcttcaaacaatgcagcattttctcctgggtcaaggcgcctttgtttgctaaaactccccctgctgtagacggctccacagcagataacgtagttgcagcatttttctctcagaagggatttcctaagggaggagagtatgagtggttgttgatatgtggctgccttgagctttctgaaggattaggctgcttcctttggtcatccccaggcgctcagcatggtaggcctgagtgctaggcctaccacttgctcacaccagtgccaggcctgagtccgaaggcctctgctcagccctgagaagaaggcctgagagccatgtgccgggtgcttgtcccgtaggtcccacaggtcagctggtgaggggggacgccagtgggaggagacatgggtgagggaggacactggcaagagactccgggaggttgtattgagtgtagatggggacaggtacagttcactggtcatgccccagaacagggacaggacagcccatggggaccaggccaccagtgctgcacaatgcctgttatctctgccaagctccccgtttatctctgctggcccacatcatagttatttgttaattcttttctctccctctccatttcaaccctttaaggtcaggggccttgtttttcattgccgtttttcttcttttttttgagatggagtttcactcttgttgcccaggctggtgtgcaatggcgtgatctcagctcaccacaacttccgcctcccaggttcaagtgattctcctgcctcagcctcccgagtagctgggattacaggcatgcgccaccatgcctggctaattttgtatttttagtggagacgggatttcaccatattggtcaagctggtctcaaactcctgacctcaggtgatccgcccgccttggcctcccaaagtgctgggattacaggcgtgagccaccgcgcccggctgctgtttctcttaacatagaatctagcccagcataggaacttagtgttccaattggatcagtccatgctctgtctcgttacctttctttgggcaacacatagaaagttctggtttgtttatacccccgccctgttccagaaaggatgcaaggaagcttaccataagtacactgggcccaaatgactaaagcaaatgaaaacggagtggttaggaaaaactggataaagaggaaatgttcaagttgaagagggagctcgtactcagcttttatttggtgaacattgctgggagttgggcgtggctctgggcctttttagaaccaggcagaatgagacgtgaaaatcatttgcatactcagtgtggtcaaggttagcagcagcctgtggctctgaagaagtagaatcacacgtggtcctggaatctgagatttcctacagccctcaggaagagggcacagtatagtaaggaagaccaggatcgtccatgaactccacagtgagtttcactgggctgttcctcctaggagttctaatgtaaaatatgatgcccactgaaagtaatttagaacaaagtcttaaccagtggagaaccaaaatagtgttgttctgcgaactcttcctcagctctgggtggtatttggcatttgtaagagctgtgattcttaattggtggttagatgccatgccaaaattgttactgatttgctttgaaatttcagatcatcttaaaggtgggcatgagagtctttatcacagagggattaaatatgtgaagtagcagtacttgagtagcacgaatgaagtgtatgttcagcccaccttcagaatcaggattggccaggcgtggtggctcacgcctgtaatcccagcactttgggagggtgaggtgggaagatcacttgaggccaggagtttgagaccagcctggccatcatggtgaaaccccctctctactaaaaatataaaaattagtcggatgtggtggcacacctgtggtcccagcaacctgggaggccgaggcacaagaatcgcttgaacctgggaggcagaggttgcagttagctgagattgtggcattgcacttcaacctgggcgacagagtgagactctatctcaaaaaaaaaaaaaaaaaaaaaggaatcaggatttttctcaggtttctggtaggtgttgtgatgagtttgaggttattttctctgaaaaggacttgaagtagtgcttctctgaatcactggtgatgtatggtgtcacctggcttaacagcctgctgagggagggaagtattaaaatcctccagaaaagatgagttgcctaaccagaacacatgtggacatagatgccatcttcacccagaaggggaacaaggggatcccctcaggaagagttttggaatctgtcttggcacacaggcaaaggagtgattagggccctgagtgtctacacttggctacagaaggcaagtttttagagatttatatccacatgcttgttttgggctctaaaaaagttaaatgaggctgagcacagttgctcacgcctgaggctgaggtgggcagatcactttaccccgggagttcaagaccagcctgggtgtcacggtgaaaccccatttctacaaaaattcaccagatgtggtagcacgtgcctgtgatctcagctacttgggaggctgaggtgggaggatagcttgagcccgggaggttgaggcttcagtgagccgtgattgagccactgcactccagcctgggcaacagagtgagaccctgtctcaaaaactttttttttaaagttaaaaaaaaaaatcaaatgatagattcaggaagccaagtgaagcccaacatgattaacccaaagcaatccatgccaagacacatcataattaaacttctggaaactcaacacaaagaaaaaaatcttgagagcaatcagagaaaaaggacaacttacctgtagggaaaagacaataagaatggtggtagatttctttttttttcttttttttttttttgagatggagtcttgctctgtcgcccaggctggagtgcagtggcatgatctcggctcactgcaagctccgcctcctgggttcacgccattctcctgcctcagtctcccgagtagctgggactacaggtgcccaccaccacacccggctaattttttttttttttttttgagacggagtctgtcgctcaggctggagtacagtggtgcgatctcagttcactgcaagctccgcctcccgggttcatgccattctcctgcctcagcctcccgagtagctgggactacaggcgcctaccaccaggcccggctaattttttgtatttttttttttgaaacggagtctctgtcgcccactctggagtgcagtggcgcaatttcggctcactgcaagctccgcctcccaggttcacgccattctcctgcctcagcctcccgagcagctgggactacaggtgcccgccgccatgcccggctaattttttgtattttttagtagagacagggtttcaccgtgttagccaggatggtctcgatctcccgacctcgtgatccgcccacctcggcctcccaaagtgttgggattacaggcgtgagccacggcgcctggccaattttttgtattttttagtagagacggggtttcaccgtgttagccaggatggtctcgatctcctgacctcgtgatctgcccgcctcggcctcccaaagtgctgggattacaggcgtgagccactgcgcccggccaaatgatggtagatttctcatgagaaactggacgctagagcaagtggcaggatatttttcaagtactgaaagaaaagaactgttaatctagaatcctgtacccagtgacagtattgttcaggaatgaacgatattggacattcttttttttttttttttgagacggagtttccgctcttgttgcccaggctggagtgcagttgcacagtctcagctcatcacaacctctacctcccgggttcaagtgattctcctgcctcagcctcctgagtagctgggattacaggcatgtgccaccatacccggttaatttttgtatttttagtagagaggggtttctccatgttggtcaggctggccttgaactcccacctcaggtgatccacccaccctcggcctcctaaagtgctgggattacaggcgtgagccactgtgctcggccaattttttgtattttttagtagagatggggtttcaccgtgttagccaggatggtctcgatctcctgacctcatgatctgcccgccttggcctcccaaagtgctgggattacagacgtgagccaccgcgcccagccaaatgatggtagatttctcgtgagaaactggacgctagagcaagtggcaggatatttttcaagtactgaaagaaaagaactgttaatctagaatcctgtacccagtgacaatattgttcaggaatgaacgatattggacattctttttttttttttttttgagacggagtttctgctcttgttgcccaggctggagtgcaatggcacagtctcagctcaccacaacctctacctcccgggttcaagtgattctcctgcctcagtctcctgagtagctgggattacaggcatgtgccaccatacccggttaatttttgtatttttagtagagaggggtttctccatgttggtcaggctggccttgaactccccacctcaggtgatccgcccacctcggcctcccaaagtgctgggattacaggcgtgagccactgtgctcggccaattttttgtattttttagtagagacggggtttcactgtgttagccaggatggtctcgatctcctgacctcgtgttccgcccgccttggcctcccaaagtgctgggattataggcatgagccaccgcgcccagccgaatgatggtagatttctcatgagaaactggaggctagaagaagtggcatgatatttttcaagtactgaaagaaaagaactattaatctagaatcctgtacccagtgacaatattgttcaggaatgaacgatattggacattcttagtcaagacattcttagatgaaagaaaactaagtgctgggcggggtggctcatgcctgtaatccctgcactttgggaggccgaggcgggcggatcacgaggtcaggaattggaggccagcctgaccaacatggtgaaaccccatctctactaaaaatacaaaaacaattagccgggcgtggtggcgcatgcctataatcccagctacttgggaggctgaggcaggagtatcacttgaacccgggaggcagaggttgcagtgagcagagattgcgccattgcactccagcctgggtgacagagcgagactccaactcaaaaaaaaaaaagaaaaagtaaactatcccctgcagaccttccctaaaagagtggctaaaagaaaggaaatgattgccggcatggtggctcccacctgtaatcccagcactttgggaggccaaggcaggcggatcacaaggtcaggagtttgagaccagcctgaccaatatggtgaaaccccatctctactaaaaatacaaaaacaattagccaggcatggtggcgcacgcctgtagtcccagctactcaggaggctgaggcagaagagtcacttgaacctgggaggcggaggttgcagtgagccgagatcacgccactgcactccagcctgggcaacagagcaagactctgtctcaaaaaaaaaaaaaaaaaaaagaaagaaaggaaaagattaaagaagaaacattgagacatcaggaaggaacaaaagaaagcatgataagaaaaaatgtagataaataaaatagactttcctctcctcttgggtttaacaaattatgtttgacagttgaagcaaaaattgtaacagtatctgatacggttctaaaggtatgtagaaagatttaaggctttaaggctgggcatggtggcttatgcctgtaatcgcggcattttgggaggccgaggcaggcggatcacctgaggtcaggagttcaagaccagcctggctaacatggcaaaaccctgtctctactaaaaatacaaaaattagctgggtgtggtggcgggcgcctgtaatcccagctactcgggaacgggaagctgtggcagggataattgcttgaacccgggaggtggaggttgtgttgagctgagatgacaccattgcactccagcctgggcgacagagcaagactgtgtctcaaaaaaaaaaaaaaaaaagatggataaagataaaacgttaatcaaaggaaagcaggagtgacaatgttagtatcagtaaggcagacttcaaagaaaatgaccagagacagagaaggacattaaataatggtaaaaagataagttcatcaagacatagcaatcctaaatatgtatgcagcaaacgacagagctggaaaatatgtgaaacagtatcagatagaaatcagatagaaccaaaaggagaaataaacaaattcacaatcattggagacctcagcattcctctctcaacaaccgatggaactggatggaaaatcagcaaaacgatgtaagatcaaaaacactatcgaccaacagaatctgattagcatttatagaacactccagcacagccgaatgcacattcttttcaagtgcctgagcaacatataccatataatccgtataatggatcataaaacaagttttaacaaatttaaagaattgaaaccatacagagtgtgttctccaaccacaattgactcaaatacttgtaagctaaataacagacttctaaataatctgtggttcaaagaggaagtctgtagggaaatttaaaaacatacacagacctaaatgaaaatgcagcatatcagaatttgtgggataaagctaaacagtgcaatacagattatctgtagcaccagtgcgtacattggaaaacaggaaaagctttcctcaagtcgataatctaagctctaatctcaagaaccaagagaaacaaaaccaaaggaagcagaaggaaggacatttgaagagcagaaatcaatgacattgaaaacagaaatcaaacaatagagaaaattaatgaaaactagctggttttttgaaaaattaataaaactggcaatctctagcaaggctgacaaaaagaatgtaaattatcaatatcaggaatgaaatgggatgtcaccacagaccctgcagatatcaaaaggaatactgcaaacaattctataagtttgacagcttacacaaaatggattaatttcttgcaaaacacaaagtaccacaactcatccaatgtcaaatagataatttgagttgccctataactattaaggaaacagaatttgtaatttaaaaaccccaaaaaatggccaggcacggtggctcttacctgtaatcccagctctttgggaggctgaggtgggaggattacttgaggccaggagttcaagaccagcctgggctacatagcaggatccaatctctaattaaattttaatataaaacattattttaaaaaaggaaaacaattctcccccccaaaaaaatctctgggcccatatgatttcactggagaattctgtctatcaaatgttgacgaatgagttaacaccaattctacacaatctcttccagaaaatggaagaggagaacgcacttcctgatcaattttataaagctcgtattacctagataccaaacctaaagacagtaccaaaaaaagaaaaatacagaccaatatcctttatgactaaagatgcaaaatccttagcaaaatattgcgaaatagaattcagcaatatatagaaataattatatactgtgaccaagtgggatttattgcagggatggaaggctgggtcaatatttgaagctcaatcaatgtaatccaccatattaacacactaatgaagaaaaatcacaggatcagatcagttgatacagaaaaagcattttgtagaactcaacacctgatgataaaaatgctcagaaaaataatagcaggaaacttcctccatttagtaaagagcatctatttagtacaaaaagtcctgttgctattttttttttttttttttagacggagtattgctctgttgtctaggctggagtgcagtggcatgatctcagctcactgcaaactctgcctcctggattcacaccattctcctgcctcagcctccctgatagctgggactacaggtgccctgccaccacacccagctaactttttgtatttttagtagagacggggtttcacagtgttagccaggaatgtctcgaactcctgaccatgtgatccacccgcctcggcctcccaaagtgctgggattacaggcgtgagccacagagcctggccttctgttgctagcatttaatagtgaaaggttgcatgctttctgccagagaccaggaacaagccaaatatgtctgctgtcactattcttattcaacatagtgttggaagttctagctaatccagtaagctgagaaaaggaaataaaagacgtgtagattggaaaggaagaaataaaatcctatttgcagatgacatgattgtccgtgtagaaaatcccaagggatctacagaaaacttggagaactaataactgaattccccagggtcacaagatacaagggatacaaggtaaacatgcagaaatccattttatttctatatgccattaatgagtacctagacacaaattaaaaatacattaccatttatcatcactcaataaaaaaaggaatacttaggtataaatccaacaaaacatttacaggacttatataccaaaaactataaaacactgacgaaagtaatgaaggaagacctaaataagtagacatatcatattcatggattaaaagactcaagatgatgtcagttttccccaaattgatatacagatttaatgcaatttctgtgaaaatcccagcaagattttttttgtagataagatggttctaagatttatatggaaaggcaaagaaactaaaatagctaaagcaatttatttattattattattatttttttttgagatggagttttgctcttttgcccaggctggagtgcagtggcatgatctctgctcactgtaacctccaccttccggtttcaagcgtttctcctgccttagtctcccgagtaggtgggattacaggtgcccgccaccatgcctggctaatttttgtatttttagtagagacagggtattaccatgttggccaggttggtctcaaactcctgagctcaggcagtccgcctgtctcagcctcccaaagtgctgggattacaggcatgagccaccacacccggccagcaattttgaaaaacagtaaagtgggagtaatcattctacccaatctcaaggcttactatatagctacgataatcaaggctgtgtggtattggtggagtgacataccgtgatggaacagaattgagaatccagaaacagacccacacaaacgtgccctcctgatttttacaaagatgcaaatgtgattcaatggaggaaagacagctcattcaacaaaatggcactggagcaattagacaatcataggcaagtaggctggcacagtggcttacgtctgtaatcctagcacttcgggaggctgaggtgggcagatcacctgagatcacgagttcgagaccagcctgaccaagatggagaaacctcgtctctactaaaaatacacaattagctgggcgtggtggcgcatgcctgtaaccccagctactcgggcgggtgaggcaggagaatcgcttgaacctggaaggcagaggttgctgtgagccgagatcacgctgttgcaatccatcctgggcaacaagagtgaaactctgtcccaaaaaagcaacaacaacaaaaaaggctgggcacagtggctcacgcctgtaatcccagcactttgggaggctgaggtgggcggatcacctgaggtcaggagtttgagaccagcttgaccaacgtggagaaacctcgtctctactaaaaatacaaaattagccgggcatggtggcgcatgcctgtaattccagctacttgggaggctgagtcaggagaattgcttgaacccaggaggccgaggttgctgtgagccaagatcacgccgttgcgctccagcctgggcaacaagagcaaaactccgtctcaaaaaaaaaaaaaaaaggcaaaagacaggaagagaaatttcactaaagaagttatataggtggcaaataaacattgaaaagcttttccacattgttagccttagggaaatgcagattaaaattacactgttattccacatctttaaaaagtggtgacagcatcagatgctggcgaggatgtggaggaactgggtcactcacaagctgctgatgggaatgtaaagtggctggaaaactgccctagaaaacagtgtggcaatttctgttaaaaactaaacatgcggccaggcgtggtggctcacacctgtaatcccagcactttgggaggccgaggcgggcggatcacgaggtcaggagatcgagaccatcctggttaacatggtgaaaccctgtctcttctaaaaatacaaaaaattagctgggcgtggtggtggctgcttgtagtcccagctactcgggaggctgaagcaggagaatggcgtgaacccgggaggcggagcttgcagtgagccgatatagcgccactgcactccatcctgggcgacagagcgagactccgtctcaaaacaaacaaaaaactaaacatgcaaccagtgtaccttgagcatttatcctggagaaatgaagacatgtttatacaatagcctacacgtggatgttcatagcagctttatttataatagcgggaaactggaaatgatctagatagccttcagtgagtgaatagttaaagtgaggccccttcgtaccacagaatgtcacttggcagtaaaaggaagtgacaatctggatgaatcactggatacagatacagtcctctatcttgtcttttttggaggaaactgggcgcagtgtgcatggaatttctctgtgttgtttcttgcatctgtacatgaatctacaattacttaaaaattttaaaatgctctgggcagtgtattcactgggtgtttaccccgtgcacctgaggttcctgctgttgctgccccgcaggctgttaggatgctggtctccagcgtgtctttagggcagggaggagatagtggggctgtggtctgttaggccgacctgcttcttgatgatggaatcctactgtctgctctgaggcaatttttcttggctttttcagcttattcctgcaaggcgtcttgtcagtacggtctgggtggagcagggagagaatgttgactgagaggaccttgctgaggtctggctggccacagatggtccctgtgagctcccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacgtctgccaccagttcagcacagaggggagtagagagatggcacgcaagctttgatgtgcctttgctggcctcgcctggatcatctcattagttgggataatctcatgcgcccacccagctatgagtggaatgagggaagtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggcttcaaagaagaaggggtgagggaggccggtccatgcccaagcatggtgcaatctcttggcatcccttccctctcctgatttcagagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaaggtaggtgacttctcacccagcactggagccttcctggccctcagggtgggtgtcatcatggagcactgagggtacaccaaggcctcagcagaagcccgtctttgggttccatatcatctggaaagtcataacacctggctttgctccctgcaatcccccaggaagggcataggctgagttctcatagtaaagtgttatattccggacacattcagggggtgtctctgaggcactgccaggctctgagcaaagcccggaggtctagaggaggtgaaggcagctgattggctgggccaggctgagtgctccaggggggcctagtaacccaataagatgctgccttagtggccatattacaggtgaagaggtgggcacgtggagagctgagatcacctgcggaagttgcaaactggccagttgagaaatggtgaggctggcgattgggcgcaggcctgcaccctgcagagcctatagcataatccttgctgtgctgagccgccactgccagactatgccttgagggtgaggggagctttgaaaataggaagatatgagaagtaggtgaaattggcacatgtgatgaccctaaaaaggtcagtggtttggttagatctgatgctgtgcctttggcttccattttaggaaaacattgatgtataaaaataagagccatgttacaaagggttcctgaaaatagtctttggggtcgaggagcctcgggagggatgcctcctgtgactgagggatgcctctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatttagttagtcaagacagtctcactgtgtcgcccaggctggagtgcagtggctcgatcttgactcattgcaacctccacctcccgggttcaagcaattctcctgtctcagcctcctgagtagctaggattacagttgcccgccactaagccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtgtgtgtgtgtgtcgcagtctcactctgtcgcccaggctggcttgcagtgtgcgatctcagctcactgcaagctccgcctcctgggttcacaccattctcctacctcagcctcccaagtagctgggactacaggcgcttgccaccacgcctggctaattttttgtattttttatagcagagactgggtttcaccgcgttagccaggatggtctcgatctctggacctcgtgatctgcccacctcgacctcccagagtgctgggattacaggcatgagccaccacacctggccaatactttgttttcttgattaatattttaaaattgtggtaacattcataacataaaatttaccattttaaccacttaagtgtaaattcagtggcagtatattcacatccatggctgtgtaattatcaccaccatccatctccagaattctatcatcatgtaaaactgaaactgtccatcaaacactaactccccattccccctccccccacccctggcaagcaccattctgctttctgtctctatgaatttgactactcgaggtgtctcatttacattcctaagggaatcatgcagtatttgtccttttgtgactggcttatttcacttagcagaatgtcttcaaggttcatttatgttgcaccatgtcagaatttccttccctttttaaaatgtatttatttttagacagggtcttactctgttgcccaggctggagtgcagtggcgcagttatggctcactgcaacctctgcttcctgggctcaagtgatccacccggtgcagcctcctgagtagctgggaagctaggactaccggcacactccaccacacccgactgattttttgtattttttttgtagagatggggtttcgccatgttgcccaggctggtctcaaactcctgggctcaagccatctgcccacctgagcctcccaaagtgctgggattacaggcgtgagccactgcgcccagcctcctttcttattaaggctaaataatattctgttgtatggatctatcacatttttatttattcatccctaaatggacagacacttgggttgcttccacattttggctattgtgaataatgctgctatgaacctgggtgtgcaggtatctgttggtgtccctgttttcatttattcattcattcattcattcattcatttagatggagtctcactctgttgctcaggctggagtgcagtggcgcgatcttggctcatggcactcctgcctcccaggttcaagcaatctcctgcttcagcttcctgagtagctgggattactggcacccaccaccatgcccagctaatttttttggatttttaatagagaccgggtttcaccatgttggccagcctggtctcaaactccgcctcagcctcccaaactcaaatgatctgcccacctcggcctcctaaagtgctgggattataggtgtgagcccctgtgtctggcccctgctttcatttcttttgggtgtatacctagaaatggaattcctggatcgtacagtaattccatgtttagttttttgaggatccactatactgcctttctcggtggctgcaccttttatattcctaccagcaaggcgcaggggttccagtttctccacatcctcactcacacttgttagtttttcttttcttttctttttctagacagagtctcgctctgttacccaggctggagtgcagtggcatgatcttggctcactgcaacttccacctcctggattcaagcgattttcctgcttcagcctctcgaggaggagctgggactacaggcgcatgccaccacgcccggctaaattttgtacttttagtagagacggggtctcatcatattgaccaggctggtctcgaactcccgaccacaggtgatccacctgccttggcctcccaaaggattatagacgtgagccactgtgcccggccagtttgccagcatttttttgaggatttttgcatcaacattcataaggggtgtaggtctgtagttttcctttcttgtagtattttttgtctgacttaggtatcagggcaatgagttaaagaatagtttgagaaggattggtgttagctcctatttaaatgtttggtagatggccgggtgcagtggctcacgcctgtaatcccagcactttgggagaccgaggcgggcggatcacctgaggtcgggagttagagactacctgaccaacatggtgaaaccccgtctctactaaaaatacaaaaattagccgggtatggtggcacacacctgtaatcccagctactcaggaggctgaggcaagagaattgcttgagcccgggaggcggaggttgcagtgagccgagatggtgccactgcagtccagcctggctgacagcgagactctgactcagtcagtcaatcagtgtttggtagaattcaccaatgaagccatcaggtctaaggcttttctttgtcaggaagattttattattgattcagtctctttacttgttaatacctttttgagaggaatacaaatttgtttcagtttcacattatggccagctaggaggaaaagaagggacaatggtaggagagaagtggggtggggatgggagtggcagcaagcacctggcctgtgtcctgcatacggtctgctggctctggagggcagccctgagggctccactctgtgcttctctttgtcttgtaaacatgtggaggatgaggctgtgtgggctaacccacccagccacgtggttccaaatgactgggattggccacacaaggggcctcatgaagcctgactggtagcttcccttaacgtttttctcagaattgagcccattttcattgttgttgtcttgacggggcctgcagaggagccatacaggaagttgcccagcagctgtaatcctcctggggctgttccctgccccaccagaagaggcttccccagtgaccctctgacttacctgtgattcccacctgggggatggtggcagctggcaggttgagagactgtccccagccaggtgtcctgctctgccctttgggtcagaccagatgtcacagggtggacacagctggcccagggaagcctgtgttatgtgggacagactgcatttttcaggccagaggcctcctgggcaccgtgaccctgggaacagtgtcctgtcttgcccatgaggaatagaaggtcacacccagggtttcccatctataattgggactcagaagagctgggtatttctttcttccttccttttttttcatggctcactgcagccttgacctcctgggttcaagttatcctgccatcttggcctcctgagtagttggaactataagcacgtaccaccatgcctggctaatttttaaattttctgtaggaaatggagtctcggctgggcaccgtggctcatgcctgtaatcctaagactttggagagctgaggtgggcagattgcctgagctcaggagttcgagacaagcctgggcaacatggtgaaaccctgtctctactaaaaatataaaaaattagctgggcgtggtggcacgttcctgtaatcccagctactctggaggctgaggcatgagaattgcttgaacctgggaggcggaggttgcagtgagccaagattgcgccactacactccagcctgggcaacaggctcttcccatctcactgactctgtctcaaaaaaaaaaaaaagaaaaaagagaaaatggagtctcactttgttgtccaggctggtctcgaactcctgggctcaagcaactcttccaccttggcctcccaaactgctgggattacagacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcagtttgagccatcagaccctgtggcactgtccaggccccgtccagagagtgcatggggtgagatgtgagtcagggctggggaggtgggcaggggcctggccctgctgtgcacctgcttgggagtcctggccccgtcttagctctgtgagtccacctggagtccagcactcctcactaccccaccaaggccactgccagatggctcccttcctccctccccgccttccagtagaggtctcagcatggcagctcagcccatgtctcttgtctgcccaaaataccgcagaagcttcccacatccctctgtggaagccaagcctgtccaaaggcctcagggccctaactgctctctgctacagtccctcgccaccctcatctcctcccttttcccctcactgggcagatccgggtaccagaccttggctcctcagtcttttacatctctgtgtcccccacctgggactgttctcccccagggagccacattcctgctccctgggcacattcacttcttcctaaaggccaccttcctagaagccttcctggcctcctgacttctgaggccagcctggactttctccccctccctccctttcctccctggcactcccgtgctttctggtacaccacatgctcacttaacctacttagtgtctgtcagtgcccccaccagcatagctttttttttttttttttttttttttttttttttttttttttgacacagagtctcgctgtgttgcccaggctggactcaaacacctgagctccagtgatcttcccacctcagcctcccaagtaactgagactacagacatgtaccacctcacctttctcagaacagccttttgaatgtttgtctctcttgtgcctctccttggtagacacacagtctagactttggaataaatgaatgtgttagtgactgaatggcaggggacaggcaactccatccatgagcccagggcagggagggcttgctgggtgggagccatgtgcctatggtcctatggggtcctgttgggtggttccatgggctgtctgctgctgcacgttctttttggacccagcacccacgtggtttgcttggcattagattccagttgggaagggccagtgcctccgattccattcatcatcaggcgtgggcgtatgtggagatagcaaaggacatgggggcccgactgcagtccccattgcctggctgcatgccgtgtacaggacactgcagctctgccctcggcttcctccctctgcgtgaggattccttcattcccagaacaaatacaccctgcctgtgctagaattcctggaggcaaatgattcagattgtttcagacagtcctaagtgctgtgaagaaaataggagaggtgccagcatggtggcccgcacgtatagtcgcagctactcaggagactctcgggggaggatcttttgaggccagcctgggccaacacagagaggcagcagggaagcctgcggggaacagaaggctcaaccacagggtctcttctctgcccaaaacacttgatacattgcctgggccttgtagaaaccttgtctctacaaaatattagccagacatggtagtgcatgtccgtagttccagctactcaggaggctgaggcagaagggtctcttgagcccaggagttcaaggctgtagtgagtcatgatcatgccattgcactccagcctgagtgacagagtgacatcctgtctccaaagggggagaaaatggagagaagggtgtggaaaggggctgatgggaaggggagctctcaggagctggcactttagcttagaccaggatgctgagaagaggctggtcctgccaggtgaggggaagagcattctagcaagtgggtggtgatgtgcagggctcagaggcacagggctttatgaacatgatcggggattggggtaccctaatctctaaaaggaggcagaagtccccggaagggctggactccgaggcagtggtgagttttccctgcagctgcccaccctgatccttgacttaaaagctaagggccaacaatgaatgggcaggtgcactgtgacctggttgccctgtggagcactggatagcagtgagggatgaccccagccccacactctaatgggaggagtcttgcaagcatgatgcagagtgaatgaacctggaccccgaagtgtccatcctattcagaacagccacacctactcaaggggtgagaagtcaaaatggtgcctccccaggggggcaggtgtaggtgggagcccctggggtacagtctgtgttctctcagctgggtgctggcttcccaggtgtccactagtggaaaacccctgacagcacacccggggcctgggccctctggctgtgagtcacgtgctgcagggagtcctctggggaatgtggaggagctggcccagcactgtgatccctgcaggcttccctgtcccctcaccgtgttgacccagagtggggtgcatctgtgaacacgctaggcagggttttccgagaggggcaagctctgtaaagggcatagacattggctcaagacagggcttagggatgccttagctgagccctgcctttctggtgtagtcacgtaagaccgatggcagcaggagcgaagggcagaaaggaaggtccccaccagcacagggcacaggggagatgggatgaaggtaaggtgggactcaggtgcccccggggtcacttcagggcctcccgagggtgactgtgctgggccctgagccagagcccctcatggcagacagggttgtggggtcagccttgttttggggatggggaactggaaggacaaggaccacctgcagttctcagctggtggaccctggtgggcagggcccaccccaggcctggcagggccccgctcctcgcggcctccctgggctgcaaaagctctaacttgtgtcctttggttgttgcctcagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcaggtaggatcatgcatgagtctctccctccctcatctccctgcaaaactgttttgagaaagacttctctgtgtgagcggtgatacctttgaggctttctcacgcttcgcagcacaatctggctggggtctgtgtgtttgctccgtcctcctcctgccctatgtatctctccagggctccgctgtgccaggtagggttagaagcacctaacacaatagctggcaaagacttggagttctgtcagggtgaacctcaagtccttgcctccacggagccctggcctgcccccaccatccaccattcagttgtcctgccccacaccctctctctctgctcttgcccagactgttattttggtcagggtgacccctgcccagggttcttcatctgttgaacttgaattatgtcttaaacacaaaggcccgcccagcttttgagagtcaggggtccctagcagctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggaagtgtgaacagaatattccagtccagtgtcctctgtggtagggatggggatggacccgggagaggccctcctgttcctggcaggaggtgggactcagagttaaaagtgaggtcaaggcccagtgcgatggctcacacctgcagtcctagcacttcgcggagctgaggtggatcaccagaacccagtagttcaagaccagcctgggaaaaacatggtgagaccccacctctacaaaaaaaaaaaaatagaaaaaatgagccgggcatgttggtacatgcctgtagtttcagctactcaggaagctgaggtgggaggatcgcctgagctcaagaggtggaggctgcagtgagccaagatcacaccactgcactccagcctgggtgacagagcgagaccctgtctccaaaaaaaaaaaaaaaaatagcgaggttgaactctcccggctcagcaggactctaggactgggaagccccgtggttcctcaccctgtcctctgtgttgggatggggtgggggtgcagcaagcatccctacatcaaaacaggatgttcagatttagtctgctcatcagactatcatcatccacatctgcagtcatcactcagggatgacagcttaaaatgctacatgaggagcaaataggaaggtctgttttgcaaagccatgacaattaatggagctcgttaggtttgtgtctaacttgttttcccagacatcccaagagacagctttctatgacttcccataaatctgagcaaggaagaaggaatgagagccacccacggggctcaagggcccgggcctgggaaacagctgagtccctgcctgagcgccatggtgctgagatcctgtgacctgccccccagcagccctgccagtcacatggttctgcttcacagacagggcagcccagagaggaggctggggggctggtgtctgatgcctccctgttccctcggggtgttgcctgggagtgcagctgtagcgtgcattcaccctgcacagagccaagccctatggccggagagccagtcaagggtggcctccctccaccagagttgactctgaggccccgggaggcagtcatgttgcgcgcatcaacactgagcacctcctcccgcagaggctgatccagtcagaaccctcgtcttgggctcacaggtgcaggtggtaggctggctgcccccagcatccagcccctacggtgttgaccttcacctagtcctgcagccgctgccagtgcccacagtccagggtcaggaactgaagtccccggggcctcttgacaggtccttgcaacatcccttctttcagccaccatggcaccatccctcctgctctgacccgaaggtgacctgagcctaaattcctttccaagttccgggccctctgcagtttgcagagtggctccagagcagaccccctggggagtccctggtggtggcaggtcaggatttagaggcagaggcgggccccttctttatctcatcgaccacttagtgcattccagttgcagggcctgggggcatcacagaccccctgccccctgctctctcttatgctgagaatgcaggtttcaaatctttggggttaaaggcaaaggccatcccgctgggaccaaggtgagcacacgtccctatcacagcagccagatggagaggcggcctgcctggggaactgggaagtgtcctgagtgggcttttagcatcaggagggctgcgtgtgtcttcccagtccccacactggaagacagctgcaaggataggacagggccttagggttgggctgtcatccctgactccaactcgcgttccccccactgtaccaccccaccccatgggatcttaggagggacttcgtttaactctgtccccagggagaccagtgtcagtcctgcctggccctgcctggggaaaggaggctgggccactgagtccccaggtccaggggccagtcagcccacagagagctagaccaggagtcctggcctggtctctgccacacagaaagcttggcaactgctgtgtcacatgactttttgttttgttttgagatggggtctcgctctgtcgcccaggctggagtgcagtggcgtgatctcggctcactgcaagctctgcctcctgggttcacgccattctcctgcctcaggctcctgagtagatgggactacaggtgcccgccaccacgcccagctaatttttgtgtttttagtagagacggggtttcaccgtattagctaggatggtctggatctcctgaccttgtgatccacccatctcggcctcccaaagtgctgggattacaggcgtgagccaccgcgctcggccacatgacttcttaagaagggttttcaggctaggcatggtggctcacgcctgtaatcccagcactttgggaggccgaggtgggcggatcacctgaggtcaggagttagagacaggccaacatggcaaaaccccgtctctactagaagtagaaaaattagccaggtgtggtggtgggcacccgtaatcccagctactcgggaggctgaggcaggagaattgcttgaacccgtgaggcggagattgcagtgagctgagattgcaccattgtgctccagcccgacagagctagactccatctcaaaaaaaagggttttcagctctggacctaggtcactccataatggaagcactcgctgattccccaagagccagtccctccatctctcccagccagagctcagtgcctgacttccataccctcctcggcagtggggacattgattggatccatggtacagtggggcaagctgctggccacaggacatgtgtgtgcaaggccactatgcccacacctcaggggaaccagggcagagaacagcctgttccctttggcagtgggacagacaggagacaagcatgaaggggaaacaggggcatgtgacaaactggtcagaagccctaggctcctagaggacagactgggaccagagtgacacaggcgtcccagagccagtggagtgggatgaagggccagcgaaaggagggagacagggctcaaggggaaggaggctgggctaggcagagcctctgaggagagctgatcctgcaaagttactggcacctcccctgggccagccctgtgttcctggccagggacgggaggagacagtgccctgtctggcagaggaaacagattcatgtgcatgactatcagtgtgccatggccacagaaagcaccggaggctgtgggcatgaggaagggcagttgggggcatagaacctggggtgaggatggccagggcaggtgctgatgggggactgcagcaggaaggaccgagaggagaccagggacaggcaggtgcttgagaaggaaggtgggccctgtggatcaggcagggtatctgccccagggggctctgcacaccagcagtcctacacgtacagggtggggatgaaaagagactaagggtcagggagcttggtagctgggcctgcatgagggacagagaggcagtgtccctctgatggcacagcatcaggaattaggctggggtatgtcaggtacacgttgggctggttgagcgtaagcctcaggttccttccgaagctctgcccgccagccctggcctgatgtcaggttttgtttgtttttttaacagctttattgtgatataattcataaaccatacaattcacacatttagagtatatagtgcagcggtttttgatatatgcagagagctgtgtaactatcaccactgtcaattttaggactttttcatcaccccactgcaggcagtcccgttcctccccgctgtctctcagccctaggtgtccactcatccactttctatctgtagatttgcctattccgggtacttcatagaaatggaaccatctaatatgtggtcttttatgactggcttgttagcataatgttttcaaggattatccatgttgtagcatcttttatcaggacttcattcttttttatgattgaatattatctcattgcatggatataccacattttattcattcatcagcagattgacttttgggttgtttccatttttcagctattgtgagtactgctgctgagaacatttgtgtatgagtttttgtgtgaacatctgttttcaattttcttggatatatacccaggagtagaattgctgggtcacgtgacaactcagtggttagcattttgaagaatttctagactgttttccaaagtggctgcaccattttgcattcccaccagaagcgtgcgattcccgtttctctggatcctgctggcatttgctgttctctttttgatcgtagccgtctgaggaggtgtgaagtaattgtggttttgatttgcatttttctaatgactgatgatattgagcatctttgcatgtatttctggctgtttgtgtatcttctttggagaaagtgctttgctagtttcttaattgggttttattttattgttgagttgtaattgttctttatatattctacatagaagtccctcatcagatagatacatgatttgaagatattttctctcatttggaggattgccttttcactttcttgatagtgttctttgaagcacaaaagttttcattttgatgtagtccaatttatctttttttttttttttttttttttttttttttttgagacagtctcgctgtgtcaccaggctggagtgtagtgctgtgatcttggctcactgcatcctccgcctcctgagttcaagtgattctcctacctcagcctcccaagtagctgggactacaggcacctgccaccacacccagctaattttttgtttttagtagagacggggtttcaccatgttggccaggatggtctccatctcttgacctcataatccgcccgcctcggcctcccaaagtgctgggattacaggtgtgagccactgcaccaggcctgtaatttatatattgttttagtttgttgctagtgcttttggtttcatatctaagaatccattgtcaatccagagtcatgttgccccagcaccatgttgaaaactgctcttcctccattgagtggacttggcacccttctaaaaatcatttgaggctcctggcggcctcggaggtgtgaattgcaaacataagggtgacaccaagttttggcatctccccttcctggtcgagtggctgtggacaggtcattttcccttgaagtctgtattttgtcatttgtaacttggggataatacttgtgtgttgcatcacatgaggtcatgaaagtgagatcacattgaaagtaaacctcaagatactcgaccggcatcagtcctggctccctctgtccctcagacgtgagcatcccctgcctgggtatctttgtccccacctggacactttgggtggtaggaaggtctggggtccctggcggcttcgaagcccgtgaaccagaattccctggaaggaatggggagcagggtggctcccagggtccccagcactctttggaactcaggacagcatctccatgcccacatgcccccaaaacccaaggcaggctagtgctggctctaggcccgttcttacatggttggtgcgagcatttcttactttagaacaaacccactggagtggaatattcccagcatcaaggggaggtaaacaaaggaccctctgggacccactcgccagctcttgtttaagaggaaaacatgttttgctcccctcgttgtgggcttggtacctttcacgtctgccctccaaggaaggctgctgggagccctcacggtgaggaatgatgtttggggtctgaggctagggtggtccctagactgctaaaccacccggtgctggccagggaccagctgtcaggagctgctgaggatgggtcagccccagagggtgggggtgccgacattgcctctggccctgcctctgcgtcaccagtacgagcttgagcttctgcgactcatgagcatggacctggtgggctgagcttcagctgtgaggggtcaggcctgctgcagggagagccagctgcagccagtgccctgcgctgtgcccacagtccctgagaccccaggctgaggagagcagcactgagcccaacctggaacgggctcacggctactggagctgggtgtgtgctcactggtgtggatgtgcagagccgggactcgctctgcaagcaggctggtcccacaaccttgagccacccactacagggaggctgtgagaaggtccctggcccctaggaagctccctcagtggagatgttttggctgctttaataacagtcatccttccaaagcccttcacagcaataaatgtttccatattccagatgaggtttgcagggacctgtcctctctatcagtgtccacctggcgcctcccccgagtccggcctgcccttgcttctcccagagctcatggtgtttttcagggccgcaggctggcagggtgtccttctcccaggggactgagcctagggagagccaagtggaggtgcccaagtggaggagaaaggaaaggaccacagagaggggaggggaagtgggagagtcatggttaggacctcaggctgaggccttctgccaagccaggggtctggtgtcactcaactgggaaacactgtcagcacccaaagctgctctcagaggtgggggtgacgggaccactgcatgtgggaggcacacgggccctgtggcatccacagctgtggtctccttagtgtcctgtcacagacttgcaaatcaaagcccagagaggcggcagccagccaccctcccacctccccagcactcctgtgcccaccccatgcctgtttagcctctgcccttgctgcccccttcctctgctgtgtccttttggcaagaggaaggtacctcggggcagatttgggtggtccttgtgagacccagggcagagtgtggtccggggatacggcttctgtccagctccctgccagacagctgtctgatcctaagcacagaccagcctctcgggggttttgttcggccaggaggtgggctgaggggcaagtgtgtggaacatgcaggaacaggctgtgcagtggccctcagtagtggggggctggggacttctgggagactcctttgctcccattcgccatccatcccctttccctgatcagtgggccctggctctggacactgagtggagcagacagtcctcctgcccctataggttccacctcctgactggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaaca

SEQ ID NO: 630 - DNA, 47556 bp, Homo sapiens; identical to SEQ ID NO: 629

SEQ ID NO: 631 - DNA, 4510 bp, Homo sapiens
ttcaatttcttcaacaggtcatgttcaatttcttcaaagttttaacataaaaataatgagagccaggagtggggccggggcctggggggacgaaggtggtatgtgaacaaggttggcacacaggcctcaccctcctctgcctcagattcccaagtgggcaggtgggggtgaatggggctccgggtagcacctcagctcctctcagctcccctcagcctgttctccttccagacccagagagctgagaagagtagctgtgaggctcagggcaagaggctctctgcctttcaggaacagccctaaccctgctccccttgcttggcctcaggaaggtgccgcgagctctcctgccgtccctgggccgccctggctctgctgtgtccagatggtcaggctactgccagctggggccttgctgctctgaagtcccctgcggagggcccagtcctgtgtgggcactgctgggctgtcgccagcctgggtgcaggagggctgttctagctccagtggcacccatagccaggtcagctggggccctttcccaccccagcaggtgctgtggcctgggccagctcctgccttacaagccagctgtgaggaatatgggaatagccctcccggcctggtgccagctcttggagttgacacggtacagggaggagacacagcccagggtcccttcccagccctgcctccaaggagttcatgtcccctctgttctcatctgtaatagggaggtgtccccattcttcagaatggacacaggatctgggagggcagcaaactggctcgcagctccagccttactgaagagaatgggcacagatccgggcacagatcccagcacagactgctgccaccctcagctgttggcaggtcccatgctgccagggcagggctagggtcagaggctgctgtgctccctggaagtggggtagggccccatgtggggcagaggcagagctctgattagggattggggttcttggtcgctgagatgtgagaggagggctcctttgagcacatgttagcatgggactcttcccagggagtttgcactcagggcctctgccctccatcaaagagtggaactccccagagccccatgcacagcaaggggacagctgggccttactggaaggccttgaacaaaggggaagattcccagcccagctgctcttagacatgaacaggtttcattgctgaggtgtttgttctgtccatgaggtaggaacctcggcaatgaaagggtgaggcagccctgtgtctccacaactggggggatggaaggaaccttggctgcctcaccccacaggtcgggcagggccacctggctgggaggtgccgggaaggctgggccctcactcctgaccgccagctcacaccgccgcaaagccatctccacaaggtctggctacaacacggagggcagactcaacagagaacagtgttgttaccatgaaaatgacaacctgtctttggaggaggccccgtgccactgagcatccagaaataaaccacaacatggacaggcttagaacaacaaggaaagctgccaggtcagaagagaaaaatgagccacaggggtcggataaggctcacacacgtcctcagctaaaaagggcaggaacagaaccttccagaagtccctgcctcacccagtctcagaactctgctaaggtgaaaacttaggctctgaggtcatagaaagggcagaagacctagtcctggccctcttctgcacctgaatccatggggctttggcatcaccagatgaaaaatgaggcatacgcccacctgtcagggtggctgatgagagacaggagaggctagattggcatcagcctgaaggcaccactggcaggaacatctgtaggctggtttggcacaacctaggagacgcctgtcctggccccagcagccgaaatctggtgaacttccccgctgactggcaggtagcagaggcctatggtgggcaggacttgcccaaggccctggtggggccaggatgagaaccctgagcctgtcacctgtgagctcaaaagctctgcctggcaacctgtgagctcaaagctctgccaggcaaccatgggcagtttctttgccctctgtgggcacccctatcctaccacctgcagttgggctgagaggccacactgagtgaggacggggcaggcatagaaggatgtggccaggtgagatggggaagccagtgctgtgggccaagagactgcagctcattctgtttattcaggtgggcccttgcatgggcccagcctttaggatgggttttttctgccccaagtaggggtcatgggtaggatggaagctgccagaagcctcttaggcctggccctgggtgggggtcactgctgcgggggtggcagatggggtcctggctgttcctcagggaggggcaggtaattggggtcttctgcaggggcatccaggagcagctttctgtggggaggggcccgtgttgagcacaggccagcacaggtccccatcggtggggatccttctgagggtggggagagggagggagggctctcaacactcacaggaagccaggggtctgcaggagcctcttgcctccaggctggttggggaagacgtcctccaggaagtagtagatatggcccaccgcaatccctgtgagacagccacggactgtggggtcaccctccacagcccagagtcctagaccagcagagcctgccccaggcccccatccacagcctggtggccctgcaggccccacagcatgagtgccccaaagccttgcacagagtgccagccccgggttggccgtgaaggacaagcttaaaaggcccagaagcaggcaggacccagggaggggagggcctgagaatagtggaggagtgggagccatggggcaggaaccctgaccctcccatcctcactcccatcaggaccgtgcaagcatcagtagatccgtcctgacgatgcaaattatgtgggccggctggcttgaggggctgtaagagcacagcagctgggagggcaggaagatggggatggagccaggtgtgaggagaactccagcaaggatgggagaggggccccagggcataagcagcgtgtcctgaggggagtggccagcctggggcggactagatgtaccgggaggctcacccagcaggtccacgaggatggagttgcccagcagcagcgagaagcccatgagcgcccaaggcaggaacggtgcctggaaagtgagcaggccgaagaagttgaccctcacccgagggctgcggcggctccacacgtacaccagcatggccatgagggcctggcccaggaagaacaggctgcccaggagtcccagcagctgggccagagtcaaggtgctccggtgcaggcctcagcccaagcccagggcccctctgacttcccaagaccctggaattcttcccctcatctcccctatgtgctattccctcatcaagatgagccagtccaataaaggcgacacactccacgggcttcaggtcccacgaaatctgccctgcacacctacagcctcatcccagggcccaaccactgcctgtccctgccccagtttctcccggctactcgcattcagggctcagctagtggccctgacaacccacctggctcttttgtgcatggctttgtattttgcatacagcactgaagatctagccctgacccctgcagctgagcacagagtgggccctcaacacatactaagctggagacagcgactgtgtccctctctggcatggctgtgttggccccaggaccaacacaggctggacgccgaggcgccctagcccgaggttccagagcctgcgggaaggatacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcccgggagccacgccgtaaccatggcgaccctcacccctcccgccagaggctgtaaccaaggcgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcc

SEQ ID NO: 632 - DNA, 4510 bp, Homo sapiens; identical to SEQ ID NO: 631

SEQ ID NO: 633 - DNA, 4510 bp, Homo sapiens; identical to SEQ ID NO: 631

SEQ ID NO: 634 - DNA, 28667 bp, Homo sapiens
cggacctgcctctcacgcaatggatcccctggcggcaacccgagaccggttctcctacccgcattccgccaagtctctcgctctgcccaggacgcacagatgagagcgctccgaagactggtgggtctatctttcggtctttcctaattttcccgtcctctggggaaaggtcggggatacctgaaccaaagtgtgtgtgtgtgggggggggggggtgtaggtggggcgtgcatagatgtgcacaaccaagggcttggccctccggagaacgcccaggggcagtggcctccgaggttctggcggccggcagtggcgaccggcgcagggaatcgcgcagggttgcggctgaggtcagaccagcgagagacagagacccgcagacatttagtccagagactgtagcaaaggagggggacgaggggccagagccggaatttcgggggaggacttgggagcgcggcgaccagagtcgcttgctggcacttgcgagggcgaatgcaggggcttggccgagatgaccttggaccagagctcccttccggcctgcagagatgagcttggggcttagccgagtaaggagtgagcggcttttcagcctcagtgctgcggcagaggcggatggaggatgaactggagccgtccttacggcctcggacgcaggtgagctcccagcggcggcgacaaaccccgcggcggtgaccccaaaccccccccccgcggcggcgactcccccccaacacgctggggcgaactccccagcacccccagcccttcttaaaaacgctgagtccgcgcatgcgcctcaggcgccctccgcgacactctagcggctctgcgcttcactgcgcctgagcttgagtctcaggccttagtcccggccatcgtttagcgttgcgcgaaccctcagctggtgcggccgctctcaatacccactgcgcttgcgctacagcttcgtctcgacgggtttgctcctctcaaacgctcactgcgcgtgcgctagcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatggtatgaattctcatacttgcccagaccaggcgtttcagatgagggattgcggacctgagtgaactgcgcaggtgcagccacctgggaggcttaactaagtcgtcaaatgttcaaaaatatcgtgcttgtatgtacagtggcgttaggtgctaggctcagatgtgcataggcaggtgtttacgcccagggtcggcctgtgggccagagcaaggttgctggaccctggcatcccagcccccagagatgctaaatcctctgccgatcagccctgacctcagaggcagtaagccctccgagcgctgcaatcctgactgctcgccccctcccgagactgtttcccacccccgcctctttcctcctcatgctccctcagctctgacctgacgtcctgcctcacagagggaaagggcgcagccagaggagagcgcccgcactgcactgcccaccgcttctaggggttccttcccaatctggactgatttctttaggtatttgcatggcacattccctcacctcctttgtcttgatttgcacttgtattccttgacagccttatttaaaatagcaccaactaaggtgggaggatcgcccaggagttcgaagctgcagggatctaataggatctcaccactgcactccagcgtgggcgacgtagcgagaccttgtctctaaaaaataaaaataaaataaaataaaataaaatagcaccacctggtccaaacacttcctacgccccttcactgctttaagtctctgtagcaccagctgatgtactatatattttgcttgttcattttgcgattgcttgtctttctctgctggaaggaaagctctgacagctcatggattttgtctgttgttcactgctgtatcccaacacctagaacagtaggattattgaccataatagggaggcaataaatctttgtttgctgaattaatggtccctatcgtagctaatgtctgaatgcttaccatgaccaggcacggtataggcaatctccatgcatgatctcattgaattcaacgatttcctgtagtcttagagacctgtcaatatctcctgctacatgagctcagctgccatcaagcactgtgttcgctgcttccttcacatctgctgtcttaagggagctctcacttccatgcggcccccgtggagctgtaatttggcctcaatgggaccagatgccaggtttctcacctggcttcttcctaaggcttccagccttagagaaagttacttaggccttattggaactatgggcagccagggcccctgtcaccaacctgtctccagacctatggcaaggccttcagcaggattctgccctccagagccacttcctctgctcccccagcctccagtgcagtatctcactgaatggtgaaagcacagctgtctctttcccagctgtatcttgccccccagcacacttcctggctgagataaacattcagcatttttttttttttgagatggagtctcactctgttgcccaggcaggagggcagtggcgcgatctgggcttactgcaacctccgcctccctcccggattcaagcaattctgcctcagccttctgagtagctgggattacaggtgcccaccaccaagcccggctaatttttgtatttttagtagagacagggttttaccatgttggccaggctggtctcgaactcctgacctcaagtggtctgcccacctcggcctcccaaagtgcagggattgcaggtgtgggccacgacatccggccaacactcagtatttgactaataaatgaataaatagtccgtaggttctggaaacttcagaaaaccttagccaaacatccttctgtcatgaaaattgtatcaaagttttcaaaaataatacatttaattctacagaacaatttgccagaacaagaaaggcagtattttttgggggaagatatcaacgattcaatttttgtaaagtcaactactttgcaaatatctaggaaaatacctgagggaaggagttaattgttgtgcctttggaggagtggagaactttcagtatatactgaattttcaaaaatcttaacaaacgtgtcattttgtaattaaaaatcacaaaagagtgggctgggtatggtggctcacgcctgtaatcctaccactttgggaggccaaggcgagtgtatcgcttgagctcaggagtttgaaaccagcctgggcaatatggtgaaatcccatctctacaaaaaaattagcccagcatgatggtgtgtgcctgtagtcccagctacttggggggctgaggtgggaggatcgcttgagcccaggaggttgaggctgcagtgaatcaagattgcgacactgcactccagcctgggtgacaaaatgagaccttgtctcaaaaaacaaaacagaaaatcaccaaaggagaaagataaatacttctgtgaatccctaagacgacctcaactacaggtcgggtgcggtggctcacgtctgtaatctcagcaatttggaggctgaggtgggcagatcacttgaggtcaggagtctctactaaaaatacaaaaattagctgggtgtggtggtgcatgcctgcaatcccagctactcgggaggctgaggcaggagaatcgcttgaactgggaggcggagattgcagtgagccaagattgcgccattgcactccagcctgggcggcagagcaaaactccgtctcttttttttttttgagacggagtctcactcaacctccacctcctgggttcaagcagttctctgcctcagcctcccgagtagctgggattacagacgcctgccaacacgcccagctaatttttttttttttttgagacggagtctcgctctgtcgcccaggctggagtgcagtggcgctatctcggctcactgctagctccgcctcccgggttcacaccattctcctgcctcagcctccccagtagctgggtctacaggtgcccgccaccacgcctggctaattttttgtatttttagtagaggcgggatttcaccgtgttagccaggatggtctcaatctcctgacctcgtgatccgcccgcctcggcctcccaaagtgctgggattacaggcatgagccactgcgcccggccaatttttgtgtttttagtagagatggggtttcaccatcttggccaggttggtcttaaacttctgacattgtgatccacccgcctcggcctcccaaagtgctgggattacaggtgtgagccactgcgccaggccaagactcagtctcaaaaaaaaaaaaaaaaaaaaaaaaagaaaatcccaactatcccaactacaaaggatgaggcatcagggatgccttggggaattctccctccatctctaagggtgtttcactgtccttttgtgtaccaagtgtgcatgactcatgggtacccagcctagaagtaggcttcattatctgcaggtccaggtaaggaagtcacttaggatgagaaaggaaggggagagctgggatagggaccaggcacctgggccatttatgctgcctctctactactcatatgtccccaagtccttgcacctgcaggtccatgtggcatcttctcttagcctcattgcagaacatgctggtgggaggtaagagaggtggctcagcccagattcctggagcctggccactctgttggagaaggttttcctggggcaagtcagaggctcctgtcctgctggaggcagagccttactctactggggccccagctcaggggactgtcttccccaaacacagcagacgtgctcaggggcagcccaacaaggagggatgggaaccgctctccagctcagggaaatgttggggctatgggtggggtgagggtaaagtggggtcctggactcagaacaggaggcttgggttcctctgctacctgccagccatgtgacccaggtaactcctctctgtgcctcactttcctcatctgcaaagtggagacatcactgcctgattcaaataaattgcaatgctgtgattggcagctctggtccagggagggggtggaggctgttgttggtcactctgtgttctctcctctctcctcagattcagggcaggatcctgctcctgaccatctgcgctgccggcattggtgggacttttcagtttggctataacctctctatcatcaatgccccgaccttggtatgtatcctctctgggtggagactgtccctgtctgagtgggtactggctaacagctgcccactgaggggcttcagccaggcatccactaggtggcactttctgccacaagtttgtctccattgggttggcccacaggttcctgcaggttcaaactgagcatacatcttccccaaacctgcatgtcctcctgagtccctaatctcagcagatgactccatcttccacctagtgatggggggtcagccttgactcttctcttcatctcttggacactaagtccttcctaactacctctggaatccagccacttctccccatgtttccaccacattcccagttctggcccagcctcctcactggcctccttgccttcagcctctccccaccttgatctcttcaagtcactcccctgctcagaaattttttttttttttcgagatggagtttcgctcttgttgcccaggctggagtgcaatggcatgatcttggctcaccacaacctccgcctaccaggttcaagcgattctcctgcctcagcctcccgagtagctgggattgcaggcatgtgccaccatgcccagctaattttgtatttttagtagagacggggtttctccctgttggtcaggctggtctcaaactcccaacctcatgtgatccgcctgcctcagcctcccaaagtactgggattataggcatgagacaccgtgcccggtctcatcaatgttatttataaagtagccagtggagattaagtttccgtgttcagcggtgaagccttgagctatcacggcctcagcttcatggaaaaaggaagaagaaattttaaaaagcaagcagggcaggcagacctgaccaaatgaacccctcggtttcactgtctcacaccttcgctcccccaaccctgataccaaagcaagttaagtatagttcctcaaatacctatgacacagcccttcctctaagcctccttccacggaggggccctctctcttccacctgtagaagcccaccccagataccaccaccttcttgaaacctttttgcctctccagcccttggtgcaggctgtcctctcttaggctgtgtgagggctgttttgtgtccatctcctctctcctgctggtttgctctcagcatctgagtcatctttgaatctctggcccttgatggtagcctggcccgagccaatgttctgtgagtgtctgtggaaaggataggtctttcagccccagtgatagaagcccacctctaacttgcttaagtaagaagggcaagtacctaatcatgtaactgggaatgatgggatgtggggcttcacacagcactgagggagagctgcaggaaccaggccccaggacagaactgtggctgtcctgcccctgttttttctctctctctggttttttttttttttttttttttttttgggacagagtcttgctctctcacccaggctggagtgcagtggtgcaatttcggttcactgcaacctccgccccgtcccgagctcaggcgctcaagcgatcctcctacctcagcctcccaaataattgggaccacaggcatgtacaacaaagcccagctattttatttgtattttttagtagagatggggtctcatcatgttgcccaggctggtctcaaactcctgagctgaagtggtccgcccacctcggcctcttgaagttctaggattacaggcatgagccaccgtgcccagcttggccttgttttcatacccagatggggagctgctgtcaccagattcacttcctgccagctgagaactcaccccaccaacaaaagtcttccaggttagctcatgtagaaaggcagggaagagcctgaggggctggtttggattacatgtccactcccagaccagtaatgtggtcaggaggctgggatgctcagattggccagatctgggccaggtgatcacctttatggggaaccaagggctgtagttgaccatcgagagaacttcctccaaagtaatatttgctagcagaagatagaggtggggatagaaagaatgatagcagcccagcctcttaaagaaaggatgagagtttagaaagggagatctgagctggctgcgttggtttattttttatttatttattttctgagacagagttttgctcttgttgcccaagctggagtgcgatggcgtgatcttggctcactgcaacctccacctcctgggttcaagcgattctgcctcagcctcccgagtagctgggattacaggcgcccaccaccacgcctggctaattttttgtatttgtagtagaaatggggtttcaccatgttagccaggctggtctcaaactcctgacctcaggcgatccgcctgccttggactcccaaagtgctgggattacaggggtgatgcattggtttatttattcattaattcatcaagcatttgagcacccacttcagtgcacactcagactagagaggggtccatcccaggccgggcagggcactctcagaccttacctcccacagccatcaccagcccctacgaaggagactttcctaggctcagaggcttcccctaccctgctgaatggtgttaagttctaattgttaaagaaaaagttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaaaccagaaaacaaaactgggcgcagtggctcacgcctgtaatcccagcactttgggagtctgaggcaggtggatcccctgaggtcgggagttcaagaccagcgtgaccaacatggagaaaccccgtctctactaaaaatacaaaattaaccaagcatggtggcgcatgcctataatcgcagctacttgggaggctgaggcaggagaattgcttgaacctgggaagcagaggttgcagtgagccaagattgcatcattgcactccagcctgggcaacaagagcaaaactccatctcaaaaacaaaaacaaaaaactattcaatgacacttgtcaaagcacagtaatgaagactttattcaagaggtggcaagcactagttgtagggaccgtggcaatggggtcctgccctgaggcagaaaggttggactcaacttcaaatacagcaatgggcaagtgagaactgatagccaaggagcagagtggggtcagcgggtgcacaatgactaagaggatcatcaggcatttgtgggggattctggttaaattgtcctaacaggattcttgttgagggcaggccagggtaactagacatcatggaggatggcagaggataaggaggccgattagattttgagagtgatcagatgtggaggatgaggattctagctaaaccaacttagcacgatacttgctaaaattgaacaaggcagagatgaacacagaagtccaaaagttgagacctagttgaaaaagagctcagaaggccgggtgcagtggtccatgcttctaatccgaacactttgagaggccgaggtgggaggattgcttgagccccggagtttgagaccagcctaagcaacacagtgagacccagtatctacaaaaaagtaaaaaaaatgcaacagggcacaatggcatgggcctgtagttgtagggatctgtgaggctgaggttggaggatggctcgagcccaggagttcgaggctacagtgagctatgatcatgccactgcactctagcctggacaacagagggagacactatctttaaaaaaaaaaaaagaaagaaaaaaggaaaaaagagcttagaaaactctgaggagaatctttgtcaatggtcactcttgaggagttccacccaatgtcaggggaggctggccctggtcccagctcctgtggacagttcctcccccgagaggcagctggtgggcactaggctgacagtcattgccctgagctgggcaggggagagctggcccagcacctgaacccgctgctctcccttgtgttctgttctgtcaggagacctgcaaatgacatttcatctctaaccaagagaagggtgtccatgtcttcctcatgtctttcctaaccatgtggcttcccttcactcacctgaggtttggagtctggggagtccaaactacctggtacaactctgacctgtggctaacgctgtgagcaagtcatttcacctctccctgagcctaatccccagtcttgacagtgaccaaggctgggcatggttgctcatgtctgtaatcccggtgctttgggaggctgaagcaggaggattgcttgaggccaggaattggagaacagcctgggcaacatagtgagaccctgtctctacaaaaaaatttaaaaattagcctggcatgctggtatgtgcctgttagtttcagctactcaggaggctgaggcaggagggtcgcttgagcccaggagctggaggctgctctgagctatgaccagtggatggagagattactgaaattggaaggaaagagacataggtccccttgagaggatcgcagccaggctgaggcaacctcccagggagggagccagggaacagacactcctacttctctctcctgcctcctgatgtcctgctggtgctcaccattggccaagttggtcagtaagggagcctactgatgtgggctgcacaggtggctccctggggcaaaagcagggtgggaggggactgcagtggattcctcgggtatggtataataagaaatataatagatctttgtccttggttccaggcacagagctcctaaaactcttggaattttttttttttcagacgtagttttgctcttgtcactggagtgcaatggtgcaatcttggctcactgcaacctccacctcccgggttcaagcaattcttctgcctcagcctcccaagtagctgggattacaggtgcctgccatcacacctggctaatttttttttttttgtatttttagtagagatgaggtttcaccatgttggccaggctggtcttgaattcctgacctgaggtgatacgcccatctcggcctcccaaagtgctgtgattacaggtgtgagccaccgtgcctggccacggaatttcttgagtgataggagcatcttttgttatttgcaatgagccccatttcatcatacctgcgcttatggtaatgagatgacagggtagggccactagattgcctcaggatggagctggtcaccaaaaagaccaagagattagagggtccgaatgttcagccccactcacggagctctaggaaagggagaggagctgaagattaaggtctataaaaactcttgaatgacaagatttgatgagcttccaggttcatgaacacattgaggtgctgggaaggtggtgctcctggaggggacatggaagcctctagcaacctactctcccaggatcaggcccagtgcatctttcccatctggctattcatgagttgtatccttcataacaaaccagtaaatgtaagtaaagggccttcctgagtttcgtgagccattgttgcaaattatcaaacccacagaaaggatcctaggaatccccaattgatggccagttggtcagaagtgcaggagttgcacttggcatctgaagaggggacagtcttgtggaatggagccctttgacttgtgggatttgatgctaactccaggtggatagtgtcagaatgggattacattgtagtacacccagcttgtgtccggagagttagagaattgcttgatgtgggaaaatatccacacatttgctgtcaggagtattgtgtgagtagagagaaatagtgttttcgcagagaggggcaaatggagcgagtccagtgctaggctctgagagatattgcccatgaaagaaccagcatggtgccctgcacaagggaggtgctcaggcgagttggttcctgctccagggggagctcagaagacacggtgcctgttgtcattgcctgttctgcagaggcatggagccctgttggggagaaggcttgtttcatctagcacccccacgccaccatccccagaaggctgactggcatttctgtccacagcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggtaagtgcttcctgcataccccctgaatgccctttaatgaggagcgctgcagcctgcaggctgaggaatgtggaagaaggaagaggcccggcaagctccaggcccagatcagctcctcatccagcctcttactctgcctggagtttcaccttgcaagacacgtcttcaagggtttggtagagcaaacagtcctgtgctacaagagagggaggactcctggtttctaatttcatgtctgccaacaagtgctaactgaccttaaacaagttattttcttcctgggcctcactctcctcctgcatatctaatgcagttcttggatttcaaagaatacaaactgactctgataacagaatcaaaaatgtaatagctggaaggatagtggggcagctcatagcatgaaagaagttcttagaagccaggcctggtgaggcatggtggctcacccacataatcccagcattttgggaggctgagcggggcagattgcatgggtccaggagtttgagaacagtctgggcaatatggtgagaccccatctctacaaaaaattagctaggaatgggctgggtgcagtggctcatgcccgtaatcccagcactttgagaggctgaggcgggtggatcacctaaggtcaggagcttgagaccagcctgaccaacatggtgaaaacctatctctactaaacatacaaaaattagcagggcgtggtggcacacgcctgtagtcctggctactcgggaggctgaggcaggagaatcgcttgaccccgcaaggcagaggttgcagtgagccaagatcataccactgcactccagcctgggcaacagaacaagactccatctcaaaaaaaaaaaaattaaccagttatggtggtgcatgcctgtagactcagctactcgggaggttgcggcaggaagatcacctgagcccaggagatcgaggctgcagtgagccttgattgtgccactgtactccagcctggatgacacagtgagcccctgtctcaaaacagctcgcttactagcaatcttagtctatttttgttgccataacaaaataactgagactggataatgtataaagaacagaaatttactttctcacagttctggaggctgtgaagtccaagatcaaggcacccagcagatgcagtgtaccgtgagggctactctttctgcttccaagatggtgccttgtccctgtgtcctcacatggcagaaagggcgaatgctgtgtcctcatatggtgaaagacaaaagggcaaaaggcaaaaagagcctgcctagttccctccagcccttttataaagcactagtcccatcaatgaaggtggagttctcatggcctaatcaatctcccaaaggcccacctctaaataccgttgcattggaaattaaatttcaacctgaattttggaagagacacaaaccttcaaaccatagcaccagcactggatcagcaagactggattagaccactgggctcatatctgcaccgtggggagtaggggaacagtcgcaaacaaaagtggggctcttcccacgaagaagacggaggtaataactattgcgcggctatctcatgatacctggtacagttggcataagcatgaaaggaagaaattaaaaattcaagtttagcatgtatgcctattgtaattaaagcaaatgtctgttcccctccccaggacagggggatgtagttcttccattcagcagctgactggagctctgaaatgtgttgccattgttgggtgctcagggttggttgtgtaggggaacacaaccatcttggtgacaggaagcccctattgttcagcccatgtgcattttctgtccttgctaccctatttgctttgtttatcacccaactgagtaagcaccgggatggtcaaggaaggcagttgaatgccatctacagatagagggtcatattgtccatctgcttatgaagagcctctttgtagtgggagggggcttctgataagcagaaatatatttatgtatattttcacgttctgggctaattttattttattttttattttttattttttattttttttgagacggagtttcgctcttgttgcccaggctggagtgcaatggcgtgatctcggctcaccgcaacctccgcctcccgggttccagtgattttcctgcctcagcctcccgagtagttggaattacaggcgcccaccagcacgcctggctaattttgtatttttagtagagatggggtttctccatgttggtcaggctggtctcgaactcctgacctcaggtgattcacccacctcagcctcccaaagtgccgggattacaggcgtgagccaccgcgcccagctatattttcaggttctgggctaattttaaaagattcacccacttagtgtttccccgtacctccttgaaaccagtcttcaaattctgcttcatctaagactttttgtccaaccaaatcttttgaaaaagggacaggccgggtgcagtggctcctgcctgtaatcccagcactttggtagactgaggcggggggatcacctgaggtcaggagttcaagaccagcctggccaacatggtgaaaccccatctctactaaaactacaaaaattagacgggcatggtggtggagacgcctgtaatcccagctactcggcaggctgaggcaggagaatcacctgaacccaggaggcagaggttgcagtgagccaagattgtgccactgcactccagcctggtagacaagagtgagactccatctcaaaaaaaaaaaaaaaaggaaaggaaaagaggcaaaagaagtccatgctagaccaggaacggtggctcacgcctgtaatcccagcactttgggagaccgaggcgggcggatcaggaggtcaggagatcgagaccatcctggctaacatggtgaaaccccatctctactaaaaaaatacaaaataattagccgggcatggtggcgggtgcctgtagtcccagctactcggcagactgaggcaggagaatggcgtgaacctgggaggcggagcttgcggtgagccgagatcatgccaccgcactccagcctgggtgacagagcaagactctgtctcaaaaaaaaaaaagcccatgctaaaaaatctgtctataggataagtttaagtccttcattaccttttgggtccaagctgatgtgagtgacctattcatgggaaactttggggtccacattgggcaagtttggtttataccacttctattcagtgatggagtgctgcaggggacactcaaccttagtaggagggtgtcatacagcacccagttatgatgagtacatggccctgtggcatcccgcagcctggtgtttattccccactagggcctagtgacaaggccaggagctctttctccttaagaggttagcaggctgggcatggtggctcatgcttataattccagcactttaggaggccaaggcaagaggatctcttgagcccaggagtttgagactagcctgggcaacatagcagaaccccatctctacaaaaaaacaaaaaatagaaaaaattagctgggcatcgtggcacacacctatggtcccagctactaaagagtctgaggtgggaggatcacttgagcctgggaggtcgaggctgcagtgagctgttatagcaccactgcactcaagcctaggtgacatagtgagaccctatctctgaatatatatatatatatgtatatggatagtaatttgctgaaggagagtagctcaacttaaaaagctttggttttgcattgtgatccccttttagggtattttaactgccactttgagcaccacaggctctcctaaagctaaagggttgagtggcagagctctttgaacttggcttggggccacgatcatgtatagttgctagtactctgcgatgtgaatttggcttcgacccactagagaatatacttctcttgcttagcaccactcaaagctaccaggttttcaagtcacctgataaatgtgccaggtcacgacacctgatgtggtattctgctgcctccaaaatggaaagaagctctcagaggtttgtccctccttcttagaggaaggggaccaaggtgcagcaatttgtcatgcactttggagaaaatacgctgccacctcttagtcctctagacctcaggaacttcgttggagtggcagccccctatctcgttattaatcttctactctttgtcacactgtgccttaccaagacttctagtgcacttgctgcttcctcttctccaggtcctttctgtgtgaactcatcaaaatagtgggacagcagcatgtcctgtgggatgcacagctccctgtggaatggactgtggcctgcagctgggcagctgctatatcctttttattttttttgcgacggagtctcgctctatcacccaggctagagtgcaatggcatgatctcggctcactgcaacctccgcctcccgggttcaagagattctcctgcctcagcctcctgagtagctgggattacaggcacgtgccaccacgccctgctaaattttgtatttttagtagagacggggtttcactatgttggtcaggctggtcccgaacccctgacctcaggtgatccacccgcctcggccccctcaagctactgattacagacacgtgtgtgtgtgtgtgtgtgtgtgtgtgcacgcgtgtgtgtagcatggtggggggagcacagtgcaagaccttgaatttatttattatttatttattagacgggttcaagcgattctcctgcctcagcctccccactacctgggattacaggtgcctgccaccatgcctggctaatttttgtatttttagtagagatggggtttcaccatgttggccaggctggtctcgaacttctgacctcgtgatccccccacctcagcctccaaaaatgctgggattataggcgtgagctgctgcacccagctgctgctatatacttaaggcagatcggaggaggtatatgactgttccagcaaggtgaatgctaagtgtttttggcaatgtctgtgtattgaaatggagcaaaatgcactcactagattgaagtacttaattattattaatggatttattaattccagtgaggaaaatgtatattattgtaattataattattagttacaattggagttaccactggatcgagtttgttataatctactgtcatttttcattctctagacacaagagacctaagctttggctcatattttatcaccaatgtgctggtgactttgagcagaacactggccacttctggtcttcagtttccctctcagtacagtgagctatatgatcacagtgagctctcctgggtgatctgtatggcagcacttctgagctcaatatgaggagccaaagctaatgcttcatcatgatggagcaggtgacatttccaatgtcccctccttgggttggtgtctgtcccattgaccaaggcattgagatatacagccattctgagttgtgagaagtgactctgtaatacatggaggaaaatataaggaaactctacttgactatctatacgtctcttccttcactcttaaagtccctgttcttcctccctggagttttattgaatctgagaaattacatattagtaccttcattgttgctgttgagacagggtctcactctgtcaccgaggctggagtgcagtggcgtgatcatggctcactgcagcctcgtactcttgggctctagcaatcctcccacctcagcctcctgagtagctgaaattacaggcgtgcgccatcatgcatggctaatttttttttttttttgagatggaattttgctcttgttgcccaggctggagtgcaatggcgcaatcttggctcaccacaacctctacctctcgggttcaagcgactctcctgcctcagtctcgagtagctgggattacaggcatgtgccaccatgcctggctaattttgtattttttttagtagagacagggtttctccatgttggtcaagctggtctcaaactcctgaccttaggtgatccacccacctcagcatcccaaagtgctgggattacaggcgtgagccaccgcgcccagcctaattttttttgtattttttgtagagatagggtttcatcatgttgacctgcctggtctcctgggatcaggtgatctgcccgcttcaacctcccaaagtgttgggattaaaggcatgagccaccatgcccagcccaatttttacagatattttaaaaattatgtgttacaacagacgtgtaagtgtaggagctctcatctcatttgacagcaaggataccaggactcaaagtagttaatggcatactacatacatttgtgtgtgtgtctaattaaggcttgttacagttgcaaagagtggtccccagggatggtcccgctggactgaatcacagcctctctttctgtgtgtttcacttcccccaaggaagaagtccctcctggtgaataacatctttgtggtgtcagcagcaatcctgtttggattcagccgcaaagcaggctcctttgagatgatcatgctgggaagactgctcgtgggagtcaatgcaggtatggggtgggggcttctcatcctgcctctctatgcctattaattaataaattcattaattccttttatttcatttcttccttcatttcctccctttattcattcatttattttttatttatgcctacctttgtcacaaaaggatgtagtatagtttatcttaaagggctcatataactagatatttaaagtaggtacagaacaatggaaaagttgtgtaggggtgggggaataagcatctccaaacttaacactaatacaggtcccatgtttgagtaacactctaagccatgagcttcctggtagccaacgtgtaaagggatataggatgagttttctgatcttctctcagaagcagaatggcctgttaggtactcctcgatttctggggcttttcatgtgagagagcagaattttgagcacatccacctgggtttttaggggctccaaccaacaagtcatctcttgacgccctactgtttatacagcccagtggtgatgttatctatatgatgctatctatattagttatctatttgtgtgaaacaaataaccccaaaattaagtgacttaaaataatcaacatttataatctcacagtttctgtgggccaggaacccaggaatgtcttaggtaggtggctctggcttggggtctctgacggggctgtgctcaagctgtcagggctgcagacatcagaagggttggctggggctggaggatccacttccaagatgctccctcacgtgccattggcaggaggtctcagctgcccactttggggggctctccacagagctgcttgaggatcttcacaacatggcagctggcttcttccagagtgatctgagggggtgaggaggggagggagagagagggagacagggagacagagagagggcatgcacaaggagaagtccaggtgctttttatgtcctaattccagaggtcatacaccattattctgctcattagaagtgagttactaagagtagcccacgatccaggggaaaggaaccaggtcagactttgtcttcatgtcccaagtacccatcagagaaggaatccccagctaaatgtttgtaggaagagcaggggcacctccgagactccttggcaatcagcatagctgccttccttccagttatctttgcccaactcgtagatagaggggcaggaccttgatgggagaacccctaggtcagggagggcatactgcattcccaggggcgtgacaccacaacacagtggcctcttagcttttgccatttgtcaccctctgggagggcgctggggtgctctccagctctctgttttcctgagggcagtgtaggtgccagggtcttccctgggggagccagggtgaggtgagagcagctgtagtgatcaatgaaggaattgacatgagtgctgggacagctggtaggcatccaggatgtggtcctaccttcctcctcccacccccccgcacagccccgtcagagtccttcacactcgggtcccagtgatgggacctaggaagagcccatgaacatgtggtactgtggccagggaccaggatgggagcggatctgagaaagccctccctcagaagttctgaagagtagagttgggatcctgttggcccttcatcaggtgaagcagaacccctgagtgtggggggtgagggatcagccctcagtgccaggatccagttgagtggctggacagtgctgagtggggcaggggagacaggctgggtgtcgtggagtgggggtcccagctggtggctgacgtgcctctgctgtgcacacgtccaggtgtgagcatgaacatccagcccatgtacctgggggagagcgcccctaaggagctccgaggagctgtggccatgagctcagccatctttacggctctggggatcgtgatgggacaggtggtcggactcaggtaagcacccctcccccacatgcattgagtatttcggagataccagtaaaagcgtttcttcacctaaatgtctcccctacccactagtagattaaagcattattgctttgcatgaaggcatcgaatcctctatccacatctctgctgccaattcacgaaatgggtatcagtcaacacactgcaatgtgaatcaccttttcccatcctctccaggtcagggagcaaagaacaggtcttcacagaggagagggtgaagatttgggctttcaaagacaaacgtgttccagtcattccagaaaaaagaggagaaggcagagcctggacccttgggaagaggagttgctagggatgaggtggggcagtggccctgtcctctcttggtcccaacctgggtgggagggatcttgatgttcagacccagacttggataggaagaggcacggggcaattgcagactccctgcagggaggtgtgtaggtgggcaggagagcagggtggtaggactctggcaaagaggcatctggcctggcctctcctctgcctccttagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcaggtgagtctctgtccttgggctcccagactgcccttgaccaagggatgcatctccccagagtatacgggtccccatttcataggtttcatttatcaaggaaaagctatccctctctttgtgcctcaatttcatgatctgcctatacctgccttcaatcagaactctatcaagtggttgtcctaactgccaggcagcagaatggatcagacctagccactgttactcaagaactccagagcggtgcggagaaacacacgcgcacacacacggtgaaacacctgtgcaagacctcacctacccagtgccaactgggtgatggtcatcttatatcagttaactttggctacagtaagaatgcctaaggaacaatcgcaacatttctgctttaaagcaacaattatttactgcttcttttattcatgtacttgcctggctggctgcacagctctgctgatctcagctgggctagttcacagtgtggggcgggggaggggggcagtggtgaggttcagctgctggttggccggtctaggctggtctggactggagccattcagctttgctgcactttctgtcctctcacttttggtaccaacgagttagcctaggaatagcatggtgatggcagagaaacaagaaagcaaatccagttgcataagcgctttccaaacctttggttccctcgtgccattaacattccattggccaaagcgagtcagtcatactgccaaatcccaagtcaagggatgggaaaattgatggcatatcctctcccatcgcaagggctgtggatttaaggaggggtgaagaccggggcccattagtgtactcttctctgtcaccatggccgcaattattacttatgtctctcctctgtgcaaaatgtgttcagtcccatcccaggatcccccaaagtctcatccaatcatggcatcgggcttgaagtcccagatcttacgccacattaagtctatatgggccttttcttgatccagaaacctaggatctagaaagatgagtcttcttcccttcccacactcagcatgcaatggtaaaaagtaagatgaggtaaccaaaattaatgctctcatttcaaaaacgaggaagcaaggcaggcacagtgcagtcactaatctataacaattctgaagcgcccctaggaaaatatggccatgtcccctgccttgggggtagggagtattctttgttcaagttccagctctgtcccctaccccctatgaagggcaccccaggccatggttcttttattttttttattttttttatcttttagagacaggttctcgcttgtccaggctggagtgctgtggctgttcataggcatgacgccattgttgatcagcacggaagttttcttcttttttgttcttgtttttttggttttgtttgggacagggtctcactctgtcgcccaggctggagtggtgtgatctcagctcactgcaacctccacctcccaggcccaatcaattctcccacctcagcctcctgagtagctgggactactggcccgtgccaccacgcttggctaatttttttttattattgtattttttgtaaagatggagtttcacctctttgcctgggcaggtctcaaactcctgagatcaaatgatcctccccccttggcctcccaaagtgcgtggattataggcatgagccattgtatctggctagcatgggagttttgaactgtcccatttccaacctgggccagtgcattcctccttaggcagcctggtggtccctgctcctgggatgtcactatattgatgctgaacttagtgcagacacctgatctgcctagcgtactacaacccagagctcctgggcccaggcgatcctcctgtctcagcctcctgagtagctgggactctaggcacacaccactatgcgtggctctccatgcttcttgggtctaccctctgagatgtttttccttttctttcaccttccttgattccttctgaagagggcgttgcacaatgtgctgcttttgatggttgagcaaatttctcagcctccttcctgcctatagagagttggggcaggctgggcgccagctcacgcctgtaatcccagggaggctgaggcgggcagatcacgaggtcaagacatcaagaccagcctggccaacatggtgaaaccccatctctactaacaatacaaaaattagctgggtatggtggcacgtacctgtagtcccagctactagggaggctgaggcaggagaattgcttgaacccgagaggcggaggttgcagtggcaggagaattgcttgaacccgagaggcggaggttgcagtgagccaagattgtgccagtgcacactgcactccagcctggtgacagagtgagactccatctcaaaaaaaaaaaaaaaaaaaagaaaagaaaagaaaacaaagttggggcacagaagtctttatatttcaaattgtcctggtcttttttttgtccaaactggcagagcttttgccaatacaactttctcaaaaatgatgtgaattttctatgtattcgaggttttttcatgtgtcaacaaaccacgctcacaattatttttgagacaggcttctctcccaaggcctaattgctggtatttagggtatgtcaggctaccgtgaatcaacgccctcaagcctcctaaatgcccccttttctagttgtgagggtctgtgaggcactgctttaagctatacccttgatttgatctttactatgagtccatggcttcctggcagtgctctggatttgatctttgctcacaggctgttacttaatttgggattcttttgctagctggagaggatagaggcgagaaaacattttttgttgttgttttcaactaacccagtgtttctgaaatatgctacgtttaattaaattttgttgcctctgaattctgcttgcaaactggccagttattttctgagctaattcttcatgtcttacagcaagcttagaatatgcatctaacagcaaccagttcatgctttcaacatttggagttttctttgctcaagtccataagttcactgagcccattttctttcttccgtgttactgcactatataacatagcttttcatttctccagcctcatcgccgtcctctgcctcgtcttggaactgataccatatttcacaggtctttgttacggtagcaccaactcctggtgccaatttattgatcagctttctattgctgactaatagatgatcataacatctcggtggtaaagaaacaaaaaaagcaattatttagcctaagcctctaagtcctctgggctgggctgatctaggatggttctggctgatggctctgctgatcttggtcattcctgcaactgcagctcagctgggcattggctggctgatctagaatagtcccagtgagggtggcttagctgggcccctttggctgtccatgtcttgtcatcctcctggctagcctggaatgttctcatgaaggcagaagagcaagtagaagtgagcaaggcctcttaaggcttaggctggaacatggtacgccctcactgcagcctcatcctattggccgagcccagagccaggagcagggatgtaggcagtacttgcccctttagtgggaggaactgcaaaatcacacagcaagcagtgtgggtgcagggaggggtgaagaattgggtttgataatgtgctgcaatagtcatgtcctgtctgatatgtccgcagaaccctgcgtttctttctaaagccttttttcatccatggtggcaacaccgcaacagccctgagaaatgtcagggcaaggaagatcatctccatctgaccagggaggcaaacagagacagagagattgagagagacagaggcagagagagagaaacacacacacacacagacagacacagagacagagagattgagagagacagaggcagagagagagagaaacacacacacacacagacacagagacagagagattgagagagacagaggcagagagagagaaacacacacacacacagacacagagacagagagattgagagagacagaggcagagagagagagaaacacacacacacacacacacacagagacagagagattgagagagacagaggcagagagagagagaaacacacacacagacacagagacagagagattgagaggcagagagagaaacacacacacacacagagacacacacagagacagagagattgagaaagacaggcagagagagagagaaacacacacacacagacacagagacagagagattgagagagacagaggcagagagagagagaaacacacacacacacacagacacagagacagagagattgagaggcagagagagaaacacacacacacacagagacacacacagagacagagagattgagagagacagaggcagagagagagacacacacacacacagacagactcagagacagagagtgagccaagaaggaaaggaatggtgggatggaggggggcgtccctgtagggggaccaaagaggggcttggggacggggagctcagtaccctcctccctggctcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgagacccctgccccgccgcacaccctgggccccgggggcttggtgttgcaggccgctgggagccatgggaggtggaagggagcccaggcctgaaagccaccctctcccaggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccagcttatggtgttaaaatgcagtgaggggccaggtgcggtggctcatgcctgtaagcccagcactttgggaggccgaggtgggtggatcacaaggtcaggagttcgagaccagcctggccaacacagtgaaacccccgtctctactaaaaaatacaaaaaattatcccggcgtggtggcgggcgcctgtaatcccaggtacttgggaggctgaggcaggagaatcgcatgaacccagtaggtggaggttgcagtgagccgagatggtgccattgcactccagcccaggcaatagtgctgaggtgggatcaggagttggagaccagcctgggcaacatggtgaaaccccgtctctacaaaaaatacaaaaattagccaggcgtggtggtcttcgcctgtagtgctagctactggcgaggctgaggtgggaggatcacttgagcctaggaggttgagactgcagtaaaccgagattgtgccactgcactccagcgtgggctggaccagtgagaccctgtctcagctcagtgagaccagtaagaccctgtctcaatcaatcaatcaatgcagtgagttagagagcatctattgagcatctacggtttgcgggtcacttccagcaccattttgagatgcggaaactggctgaagttgggtgattgattgaccaagttcctttgggaaattaataaagtcacactgaagcaataaactaccctcacctccaccaccagctttctcaggagaccccttcccattgcctgccccagacctcagggaccatggctgggtgtgtgggtctgtgctttctgcctttgcagtgtgtggtaatcgagagggtgggtcggcgcgtgctgctcatcggtgggtacagcctgatgacctgctgggggagcatcttcactgtggccctgtgcctgcaggtagctggggtggatgagggctggggggtccaggccgggctgacttccacctcacccccgccccgtccacggcagagctccttcccctggacactctacctggccatggcctgcatctttgccttcatcctcagctttggcattggccctggtgagtgggcccaaggggctctgggcatccatcatcacatagaaggagtgatgggtgcctgggtgcacagtgggtgggtgtgaatgcaatgtcccctgcaggccctcagagaccacctcatgccggggcttctgggagggaatggcaggaggagagcactgaggggccccccatacagactgggcctgggctcccactcccatgtctgggctggggtcggggagaggcaggcagggaaccctggccagcagccccctgtccctgcccctccttctagccggagtgacggggatcctggccacagagctgtttgaccagatggccaggcctgctgcctgcatggtctgcggggcgctcatgtggatcatgctcatcctggtcggcctgggatttccctttatcatggtaggcccgcccctcccgctgggggccctgccttaggctgtgtccctgtcatcctgagaaccccagggggaggcttccatccagggagactgagactgaaagggaggggtcttaggggagcaaagaggggggcaaatgcctcctcacgacctgtcatgggccttctgtttaggggttgatggagacacaccaggtcttggggtcttttttaatccgcaggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaa

SEQ ID NO: 635 - DNA, 28667 bp, Homo sapiens; identical to SEQ ID NO: 634

SEQ ID NO: 636 - DNA, 27685 bp, Homo sapiens
tcactgcgcgtgcgctagcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatggtatgaattctcatacttgcccagaccaggcgtttcagatgagggattgcggacctgagtgaactgcgcaggtgcagccacctgggaggcttaactaagtcgtcaaatgttcaaaaatatcgtgcttgtatgtacagtggcgttaggtgctaggctcagatgtgcataggcaggtgtttacgcccagggtcggcctgtgggccagagcaaggttgctggaccctggcatcccagcccccagagatgctaaatcctctgccgatcagccctgacctcagaggcagtaagccctccgagcgctgcaatcctgactgctcgccccctcccgagactgtttcccacccccgcctctttcctcctcatgctccctcagctctgacctgacgtcctgcctcacagagggaaagggcgcagccagaggagagcgcccgcactgcactgcccaccgcttctaggggttccttcccaatctggactgatttctttaggtatttgcatggcacattccctcacctcctttgtcttgatttgcacttgtattccttgacagccttatttaaaatagcaccaactaaggtgggaggatcgcccaggagttcgaagctgcagggatctaataggatctcaccactgcactccagcgtgggcgacgtagcgagaccttgtctctaaaaaataaaaataaaataaaataaaataaaatagcaccacctggtccaaacacttcctacgccccttcactgctttaagtctctgtagcaccagctgatgtactatatattttgcttgttcattttgcgattgcttgtctttctctgctggaaggaaagctctgacagctcatggattttgtctgttgttcactgctgtatcccaacacctagaacagtaggattattgaccataatagggaggcaataaatctttgtttgctgaattaatggtccctatcgtagctaatgtctgaatgcttaccatgaccaggcacggtataggcaatctccatgcatgatctcattgaattcaacgatttcctgtagtcttagagacctgtcaatatctcctgctacatgagctcagctgccatcaagcactgtgttcgctgcttccttcacatctgctgtcttaagggagctctcacttccatgcggcccccgtggagctgtaatttggcctcaatgggaccagatgccaggtttctcacctggcttcttcctaaggcttccagccttagagaaagttacttaggccttattggaactatgggcagccagggcccctgtcaccaacctgtctccagacctatggcaaggccttcagcaggattctgccctccagagccacttcctctgctcccccagcctccagtgcagtatctcactgaatggtgaaagcacagctgtctctttcccagctgtatcttgccccccagcacacttcctggctgagataaacattcagcatttttttttttttgagatggagtctcactctgttgcccaggcaggagggcagtggcgcgatctgggcttactgcaacctccgcctccctcccggattcaagcaattctgcctcagccttctgagtagctgggattacaggtgcccaccaccaagcccggctaatttttgtatttttagtagagacagggttttaccatgttggccaggctggtctcgaactcctgacctcaagtggtctgcccacctcggcctcccaaagtgcagggattgcaggtgtgggccacgacatccggccaacactcagtatttgactaataaatgaataaatagtccgtaggttctggaaacttcagaaaaccttagccaaacatccttctgtcatgaaaattgtatcaaagttttcaaaaataatacatttaattctacagaacaatttgccagaacaagaaaggcagtattttttgggggaagatatcaacgattcaatttttgtaaagtcaactactttgcaaatatctaggaaaatacctgagggaaggagttaattgttgtgcctttggaggagtggagaactttcagtatatactgaattttcaaaaatcttaacaaacgtgtcattttgtaattaaaaatcacaaaagagtgggctgggtatggtggctcacgcctgtaatcctaccactttgggaggccaaggcgagtgtatcgcttgagctcaggagtttgaaaccagcctgggcaatatggtgaaatcccatctctacaaaaaaattagcccagcatgatggtgtgtgcctgtagtcccagctacttggggggctgaggtgggaggatcgcttgagcccaggaggttgaggctgcagtgaatcaagattgcgacactgcactccagcctgggtgacaaaatgagaccttgtctcaaaaaacaaaacagaaaatcaccaaaggagaaagataaatacttctgtgaatccctaagacgacctcaactacaggtcgggtgcggtggctcacgtctgtaatctcagcaatttggaggctgaggtgggcagatcacttgaggtcaggagtctctactaaaaatacaaaaattagctgggtgtggtggtgcatgcctgcaatcccagctactcgggaggctgaggcaggagaatcgcttgaactgggaggcggagattgcagtgagccaagattgcgccattgcactccagcctgggcggcagagcaaaactccgtctcttttttttttttgagacggagtctcactcaacctccacctcctgggttcaagcagttctctgcctcagcctcccgagtagctgggattacagacgcctgccaacacgcccagctaatttttttttttttttgagacggagtctcgctctgtcgcccaggctggagtgcagtggcgctatctcggctcactgctagctccgcctcccgggttcacaccattctcctgcctcagcctccccagtagctgggtctacaggtgcccgccaccacgcctggctaattttttgtatttttagtagaggcgggatttcaccgtgttagccaggatggtctcaatctcctgacctcgtgatccgcccgcctcggcctcccaaagtgctgggattacaggcatgagccactgcgcccggccaatttttgtgtttttagtagagatggggtttcaccatcttggccaggttggtcttaaacttctgacattgtgatccacccgcctcggcctcccaaagtgctgggattacaggtgtgagccactgcgccaggccaagactcagtctcaaaaaaaaaaaaaaaaaaaaaaaaagaaaatcccaactatcccaactacaaaggatgaggcatcagggatgccttggggaattctccctccatctctaagggtgtttcactgtccttttgtgtaccaagtgtgcatgactcatgggtacccagcctagaagtaggcttcattatctgcaggtccaggtaaggaagtcacttaggatgagaaaggaaggggagagctgggatagggaccaggcacctgggccatttatgctgcctctctactactcatatgtccccaagtccttgcacctgcaggtccatgtggcatcttctcttagcctcattgcagaacatgctggtgggaggtaagagaggtggctcagcccagattcctggagcctggccactctgttggagaaggttttcctggggcaagtcagaggctcctgtcctgctggaggcagagccttactctactggggccccagctcaggggactgtcttccccaaacacagcagacgtgctcaggggcagcccaacaaggagggatgggaaccgctctccagctcagggaaatgttggggctatgggtggggtgagggtaaagtggggtcctggactcagaacaggaggcttgggttcctctgctacctgccagccatgtgacccaggtaactcctctctgtgcctcactttcctcatctgcaaagtggagacatcactgcctgattcaaataaattgcaatgctgtgattggcagctctggtccagggagggggtggaggctgttgttggtcactctgtgttctctcctctctcctcagattcagggcaggatcctgctcctgaccatctgcgctgccggcattggtgggacttttcagtttggctataacctctctatcatcaatgccccgaccttggtatgtatcctctctgggtggagactgtccctgtctgagtgggtactggctaacagctgcccactgaggggcttcagccaggcatccactaggtggcactttctgccacaagtttgtctccattgggttggcccacaggttcctgcaggttcaaactgagcatacatcttccccaaacctgcatgtcctcctgagtccctaatctcagcagatgactccatcttccacctagtgatggggggtcagccttgactcttctcttcatctcttggacactaagtccttcctaactacctctggaatccagccacttctccccatgtttccaccacattcccagttctggcccagcctcctcactggcctccttgccttcagcctctccccaccttgatctcttcaagtcactcccctgctcagaaattttttttttttttcgagatggagtttcgctcttgttgcccaggctggagtgcaatggcatgatcttggctcaccacaacctccgcctaccaggttcaagcgattctcctgcctcagcctcccgagtagctgggattgcaggcatgtgccaccatgcccagctaattttgtatttttagtagagacggggtttctccctgttggtcaggctggtctcaaactcccaacctcatgtgatccgcctgcctcagcctcccaaagtactgggattataggcatgagacaccgtgcccggtctcatcaatgttatttataaagtagccagtggagattaagtttccgtgttcagcggtgaagccttgagctatcacggcctcagcttcatggaaaaaggaagaagaaattttaaaaagcaagcagggcaggcagacctgaccaaatgaacccctcggtttcactgtctcacaccttcgctcccccaaccctgataccaaagcaagttaagtatagttcctcaaatacctatgacacagcccttcctctaagcctccttccacggaggggccctctctcttccacctgtagaagcccaccccagataccaccaccttcttgaaacctttttgcctctccagcccttggtgcaggctgtcctctcttaggctgtgtgagggctgttttgtgtccatctcctctctcctgctggtttgctctcagcatctgagtcatctttgaatctctggcccttgatggtagcctggcccgagccaatgttctgtgagtgtctgtggaaaggataggtctttcagccccagtgatagaagcccacctctaacttgcttaagtaagaagggcaagtacctaatcatgtaactgggaatgatgggatgtggggcttcacacagcactgagggagagctgcaggaaccaggccccaggacagaactgtggctgtcctgcccctgttttttctctctctctggttttttttttttttttttttttttttgggacagagtcttgctctctcacccaggctggagtgcagtggtgcaatttcggttcactgcaacctccgccccgtcccgagctcaggcgctcaagcgatcctcctacctcagcctcccaaataattgggaccacaggcatgtacaacaaagcccagctattttatttgtattttttagtagagatggggtctcatcatgttgcccaggctggtctcaaactcctgagctgaagtggtccgcccacctcggcctcttgaagttctaggattacaggcatgagccaccgtgcccagcttggccttgttttcatacccagatggggagctgctgtcaccagattcacttcctgccagctgagaactcaccccaccaacaaaagtcttccaggttagctcatgtagaaaggcagggaagagcctgaggggctggtttggattacatgtccactcccagaccagtaatgtggtcaggaggctgggatgctcagattggccagatctgggccaggtgatcacctttatggggaaccaagggctgtagttgaccatcgagagaacttcctccaaagtaatatttgctagcagaagatagaggtggggatagaaagaatgatagcagcccagcctcttaaagaaaggatgagagtttagaaagggagatctgagctggctgcgttggtttattttttatttatttattttctgagacagagttttgctcttgttgcccaagctggagtgcgatggcgtgatcttggctcactgcaacctccacctcctgggttcaagcgattctgcctcagcctcccgagtagctgggattacaggcgcccaccaccacgcctggctaattttttgtatttgtagtagaaatggggtttcaccatgttagccaggctggtctcaaactcctgacctcaggcgatccgcctgccttggactcccaaagtgctgggattacaggggtgatgcattggtttatttattcattaattcatcaagcatttgagcacccacttcagtgcacactcagactagagaggggtccatcccaggccgggcagggcactctcagaccttacctcccacagccatcaccagcccctacgaaggagactttcctaggctcagaggcttcccctaccctgctgaatggtgttaagttctaattgttaaagaaaaagttattcaggctgggcgtggtggctcatgcctgtaatcccagcactttgagaggctgaggcaggcggatcatttgaggtcaggagtttgagaccagcctggccaacatgattaaaccctgtctccactaaaaatagaaatattagctgggcatggtggcatgtgccgtgatcccagctcctccagaggctgaggcaggaaaattgcttgaacccaggaagcggaagttgcagtgagctgagatctcgccactgtgctccagcctgggcgacagggagactccctctcaaaaaaaaaaaaaaaaaaaccagaaaacaaaactgggcgcagtggctcacgcctgtaatcccagcactttgggagtctgaggcaggtggatcccctgaggtcgggagttcaagaccagcgtgaccaacatggagaaaccccgtctctactaaaaatacaaaattaaccaagcatggtggcgcatgcctataatcgcagctacttgggaggctgaggcaggagaattgcttgaacctgggaagcagaggttgcagtgagccaagattgcatcattgcactccagcctgggcaacaagagcaaaactccatctcaaaaacaaaaacaaaaaactattcaatgacacttgtcaaagcacagtaatgaagactttattcaagaggtggcaagcactagttgtagggaccgtggcaatggggtcctgccctgaggcagaaaggttggactcaacttcaaatacagcaatgggcaagtgagaactgatagccaaggagcagagtggggtcagcgggtgcacaatgactaagaggatcatcaggcatttgtgggggattctggttaaattgtcctaacaggattcttgttgagggcaggccagggtaactagacatcatggaggatggcagaggataaggaggccgattagattttgagagtgatcagatgtggaggatgaggattctagctaaaccaacttagcacgatacttgctaaaattgaacaaggcagagatgaacacagaagtccaaaagttgagacctagttgaaaaagagctcagaaggccgggtgcagtggtccatgcttctaatccgaacactttgagaggccgaggtgggaggattgcttgagccccggagtttgagaccagcctaagcaacacagtgagacccagtatctacaaaaaagtaaaaaaaatgcaacagggcacaatggcatgggcctgtagttgtagggatctgtgaggctgaggttggaggatggctcgagcccaggagttcgaggctacagtgagctatgatcatgccactgcactctagcctggacaacagagggagacactatctttaaaaaaaaaaaaagaaagaaaaaaggaaaaaagagcttagaaaactctgaggagaatctttgtcaatggtcactcttgaggagttccacccaatgtcaggggaggctggccctggtcccagctcctgtggacagttcctcccccgagaggcagctggtgggcactaggctgacagtcattgccctgagctgggcaggggagagctggcccagcacctgaacccgctgctctcccttgtgttctgttctgtcaggagacctgcaaatgacatttcatctctaaccaagagaagggtgtccatgtcttcctcatgtctttcctaaccatgtggcttcccttcactcacctgaggtttggagtctggggagtccaaactacctggtacaactctgacctgtggctaacgctgtgagcaagtcatttcacctctccctgagcctaatccccagtcttgacagtgaccaaggctgggcatggttgctcatgtctgtaatcccggtgctttgggaggctgaagcaggaggattgcttgaggccaggaattggagaacagcctgggcaacatagtgagaccctgtctctacaaaaaaatttaaaaattagcctggcatgctggtatgtgcctgttagtttcagctactcaggaggctgaggcaggagggtcgcttgagcccaggagctggaggctgctctgagctatgaccagtggatggagagattactgaaattggaaggaaagagacataggtccccttgagaggatcgcagccaggctgaggcaacctcccagggagggagccagggaacagacactcctacttctctctcctgcctcctgatgtcctgctggtgctcaccattggccaagttggtcagtaagggagcctactgatgtgggctgcacaggtggctccctggggcaaaagcagggtgggaggggactgcagtggattcctcgggtatggtataataagaaatataatagatctttgtccttggttccaggcacagagctcctaaaactcttggaattttttttttttcagacgtagttttgctcttgtcactggagtgcaatggtgcaatcttggctcactgcaacctccacctcccgggttcaagcaattcttctgcctcagcctcccaagtagctgggattacaggtgcctgccatcacacctggctaatttttttttttttgtatttttagtagagatgaggtttcaccatgttggccaggctggtcttgaattcctgacctgaggtgatacgcccatctcggcctcccaaagtgctgtgattacaggtgtgagccaccgtgcctggccacggaatttcttgagtgataggagcatcttttgttatttgcaatgagccccatttcatcatacctgcgcttatggtaatgagatgacagggtagggccactagattgcctcaggatggagctggtcaccaaaaagaccaagagattagagggtccgaatgttcagccccactcacggagctctaggaaagggagaggagctgaagattaaggtctataaaaactcttgaatgacaagatttgatgagcttccaggttcatgaacacattgaggtgctgggaaggtggtgctcctggaggggacatggaagcctctagcaacctactctcccaggatcaggcccagtgcatctttcccatctggctattcatgagttgtatccttcataacaaaccagtaaatgtaagtaaagggccttcctgagtttcgtgagccattgttgcaaattatcaaacccacagaaaggatcctaggaatccccaattgatggccagttggtcagaagtgcaggagttgcacttggcatctgaagaggggacagtcttgtggaatggagccctttgacttgtgggatttgatgctaactccaggtggatagtgtcagaatgggattacattgtagtacacccagcttgtgtccggagagttagagaattgcttgatgtgggaaaatatccacacatttgctgtcaggagtattgtgtgagtagagagaaatagtgttttcgcagagaggggcaaatggagcgagtccagtgctaggctctgagagatattgcccatgaaagaaccagcatggtgccctgcacaagggaggtgctcaggcgagttggttcctgctccagggggagctcagaagacacggtgcctgttgtcattgcctgttctgcagaggcatggagccctgttggggagaaggcttgtttcatctagcacccccacgccaccatccccagaaggctgactggcatttctgtccacagcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggtaagtgcttcctgcataccccctgaatgccctttaatgaggagcgctgcagcctgcaggctgaggaatgtggaagaaggaagaggcccggcaagctccaggcccagatcagctcctcatccagcctcttactctgcctggagtttcaccttgcaagacacgtcttcaagggtttggtagagcaaacagtcctgtgctacaagagagggaggactcctggtttctaatttcatgtctgccaacaagtgctaactgaccttaaacaagttattttcttcctgggcctcactctcctcctgcatatctaatgcagttcttggatttcaaagaatacaaactgactctgataacagaatcaaaaatgtaatagctggaaggatagtggggcagctcatagcatgaaagaagttcttagaagccaggcctggtgaggcatggtggctcacccacataatcccagcattttgggaggctgagcggggcagattgcatgggtccaggagtttgagaacagtctgggcaatatggtgagaccccatctctacaaaaaattagctaggaatgggctgggtgcagtggctcatgcccgtaatcccagcactttgagaggctgaggcgggtggatcacctaaggtcaggagcttgagaccagcctgaccaacatggtgaaaacctatctctactaaacatacaaaaattagcagggcgtggtggcacacgcctgtagtcctggctactcgggaggctgaggcaggagaatcgcttgaccccgcaaggcagaggttgcagtgagccaagatcataccactgcactccagcctgggcaacagaacaagactccatctcaaaaaaaaaaaaattaaccagttatggtggtgcatgcctgtagactcagctactcgggaggttgcggcaggaagatcacctgagcccaggagatcgaggctgcagtgagccttgattgtgccactgtactccagcctggatgacacagtgagcccctgtctcaaaacagctcgcttactagcaatcttagtctatttttgttgccataacaaaataactgagactggataatgtataaagaacagaaatttactttctcacagttctggaggctgtgaagtccaagatcaaggcacccagcagatgcagtgtaccgtgagggctactctttctgcttccaagatggtgccttgtccctgtgtcctcacatggcagaaagggcgaatgctgtgtcctcatatggtgaaagacaaaagggcaaaaggcaaaaagagcctgcctagttccctccagcccttttataaagcactagtcccatcaatgaaggtggagttctcatggcctaatcaatctcccaaaggcccacctctaaataccgttgcattggaaattaaatttcaacctgaattttggaagagacacaaaccttcaaaccatagcaccagcactggatcagcaagactggattagaccactgggctcatatctgcaccgtggggagtaggggaacagtcgcaaacaaaagtggggctcttcccacgaagaagacggaggtaataactattgcgcggctatctcatgatacctggtacagttggcataagcatgaaaggaagaaattaaaaattcaagtttagcatgtatgcctattgtaattaaagcaaatgtctgttcccctccccaggacagggggatgtagttcttccattcagcagctgactggagctctgaaatgtgttgccattgttgggtgctcagggttggttgtgtaggggaacacaaccatcttggtgacaggaagcccctattgttcagcccatgtgcattttctgtccttgctaccctatttgctttgtttatcacccaactgagtaagcaccgggatggtcaaggaaggcagttgaatgccatctacagatagagggtcatattgtccatctgcttatgaagagcctctttgtagtgggagggggcttctgataagcagaaatatatttatgtatattttcacgttctgggctaattttattttattttttattttttattttttattttttttgagacggagtttcgctcttgttgcccaggctggagtgcaatggcgtgatctcggctcaccgcaacctccgcctcccgggttccagtgattttcctgcctcagcctcccgagtagttggaattacaggcgcccaccagcacgcctggctaattttgtatttttagtagagatggggtttctccatgttggtcaggctggtctcgaactcctgacctcaggtgattcacccacctcagcctcccaaagtgccgggattacaggcgtgagccaccgcgcccagctatattttcaggttctgggctaattttaaaagattcacccacttagtgtttccccgtacctccttgaaaccagtcttcaaattctgcttcatctaagactttttgtccaaccaaatcttttgaaaaagggacaggccgggtgcagtggctcctgcctgtaatcccagcactttggtagactgaggcggggggatcacctgaggtcaggagttcaagaccagcctggccaacatggtgaaaccccatctctactaaaactacaaaaattagacgggcatggtggtggagacgcctgtaatcccagctactcggcaggctgaggcaggagaatcacctgaacccaggaggcagaggttgcagtgagccaagattgtgccactgcactccagcctggtagacaagagtgagactccatctcaaaaaaaaaaaaaaaaggaaaggaaaagaggcaaaagaagtccatgctagaccaggaacggtggctcacgcctgtaatcccagcactttgggagaccgaggcgggcggatcaggaggtcaggagatcgagaccatcctggctaacatggtgaaaccccatctctactaaaaaaatacaaaataattagccgggcatggtggcgggtgcctgtagtcccagctactcggcagactgaggcaggagaatggcgtgaacctgggaggcggagcttgcggtgagccgagatcatgccaccgcactccagcctgggtgacagagcaagactctgtctcaaaaaaaaaaaagcccatgctaaaaaatctgtctataggataagtttaagtccttcattaccttttgggtccaagctgatgtgagtgacctattcatgggaaactttggggtccacattgggcaagtttggtttataccacttctattcagtgatggagtgctgcaggggacactcaaccttagtaggagggtgtcatacagcacccagttatgatgagtacatggccctgtggcatcccgcagcctggtgtttattccccactagggcctagtgacaaggccaggagctctttctccttaagaggttagcaggctgggcatggtggctcatgcttataattccagcactttaggaggccaaggcaagaggatctcttgagcccaggagtttgagactagcctgggcaacatagcagaaccccatctctacaaaaaaacaaaaaatagaaaaaattagctgggcatcgtggcacacacctatggtcccagctactaaagagtctgaggtgggaggatcacttgagcctgggaggtcgaggctgcagtgagctgttatagcaccactgcactcaagcctaggtgacatagtgagaccctatctctgaatatatatatatatatgtatatggatagtaatttgctgaaggagagtagctcaacttaaaaagctttggttttgcattgtgatccccttttagggtattttaactgccactttgagcaccacaggctctcctaaagctaaagggttgagtggcagagctctttgaacttggcttggggccacgatcatgtatagttgctagtactctgcgatgtgaatttggcttcgacccactagagaatatacttctcttgcttagcaccactcaaagctaccaggttttcaagtcacctgataaatgtgccaggtcacgacacctgatgtggtattctgctgcctccaaaatggaaagaagctctcagaggtttgtccctccttcttagaggaaggggaccaaggtgcagcaatttgtcatgcactttggagaaaatacgctgccacctcttagtcctctagacctcaggaacttcgttggagtggcagccccctatctcgttattaatcttctactctttgtcacactgtgccttaccaagacttctagtgcacttgctgcttcctcttctccaggtcctttctgtgtgaactcatcaaaatagtgggacagcagcatgtcctgtgggatgcacagctccctgtggaatggactgtggcctgcagctgggcagctgctatatcctttttattttttttgcgacggagtctcgctctatcacccaggctagagtgcaatggcatgatctcggctcactgcaacctccgcctcccgggttcaagagattctcctgcctcagcctcctgagtagctgggattacaggcacgtgccaccacgccctgctaaattttgtatttttagtagagacggggtttcactatgttggtcaggctggtcccgaacccctgacctcaggtgatccacccgcctcggccccctcaagctactgattacagacacgtgtgtgtgtgtgtgtgtgtgtgtgtgcacgcgtgtgtgtagcatggtggggggagcacagtgcaagaccttgaatttatttattatttatttattagacgggttcaagcgattctcctgcctcagcctccccactacctgggattacaggtgcctgccaccatgcctggctaatttttgtatttttagtagagatggggtttcaccatgttggccaggctggtctcgaacttctgacctcgtgatccccccacctcagcctccaaaaatgctgggattataggcgtgagctgctgcacccagctgctgctatatacttaaggcagatcggaggaggtatatgactgttccagcaaggtgaatgctaagtgtttttggcaatgtctgtgtattgaaatggagcaaaatgcactcactagattgaagtacttaattattattaatggatttattaattccagtgaggaaaatgtatattattgtaattataattattagttacaattggagttaccactggatcgagtttgttataatctactgtcatttttcattctctagacacaagagacctaagctttggctcatattttatcaccaatgtgctggtgactttgagcagaacactggccacttctggtcttcagtttccctctcagtacagtgagctatatgatcacagtgagctctcctgggtgatctgtatggcagcacttctgagctcaatatgaggagccaaagctaatgcttcatcatgatggagcaggtgacatttccaatgtcccctccttgggttggtgtctgtcccattgaccaaggcattgagatatacagccattctgagttgtgagaagtgactctgtaatacatggaggaaaatataaggaaactctacttgactatctatacgtctcttccttcactcttaaagtccctgttcttcctccctggagttttattgaatctgagaaattacatattagtaccttcattgttgctgttgagacagggtctcactctgtcaccgaggctggagtgcagtggcgtgatcatggctcactgcagcctcgtactcttgggctctagcaatcctcccacctcagcctcctgagtagctgaaattacaggcgtgcgccatcatgcatggctaatttttttttttttttgagatggaattttgctcttgttgcccaggctggagtgcaatggcgcaatcttggctcaccacaacctctacctctcgggttcaagcgactctcctgcctcagtctcgagtagctgggattacaggcatgtgccaccatgcctggctaattttgtattttttttagtagagacagggtttctccatgttggtcaagctggtctcaaactcctgaccttaggtgatccacccacctcagcatcccaaagtgctgggattacaggcgtgagccaccgcgcccagcctaattttttttgtattttttgtagagatagggtttcatcatgttgacctgcctggtctcctgggatcaggtgatctgcccgcttcaacctcccaaagtgttgggattaaaggcatgagccaccatgcccagcccaatttttacagatattttaaaaattatgtgttacaacagacgtgtaagtgtaggagctctcatctcatttgacagcaaggataccaggactcaaagtagttaatggcatactacatacatttgtgtgtgtgtctaattaaggcttgttacagttgcaaagagtggtccccagggatggtcccgctggactgaatcacagcctctctttctgtgtgtttcacttcccccaaggaagaagtccctcctggtgaataacatctttgtggtgtcagcagcaatcctgtttggattcagccgcaaagcaggctcctttgagatgatcatgctgggaagactgctcgtgggagtcaatgcaggtatggggtgggggcttctcatcctgcctctctatgcctattaattaataaattcattaattccttttatttcatttcttccttcatttcctccctttattcattcatttattttttatttatgcctacctttgtcacaaaaggatgtagtatagtttatcttaaagggctcatataactagatatttaaagtaggtacagaacaatggaaaagttgtgtaggggtgggggaataagcatctccaaacttaacactaatacaggtcccatgtttgagtaacactctaagccatgagcttcctggtagccaacgtgtaaagggatataggatgagttttctgatcttctctcagaagcagaatggcctgttaggtactcctcgatttctggggcttttcatgtgagagagcagaattttgagcacatccacctgggtttttaggggctccaaccaacaagtcatctcttgacgccctactgtttatacagcccagtggtgatgttatctatatgatgctatctatattagttatctatttgtgtgaaacaaataaccccaaaattaagtgacttaaaataatcaacatttataatctcacagtttctgtgggccaggaacccaggaatgtcttaggtaggtggctctggcttggggtctctgacggggctgtgctcaagctgtcagggctgcagacatcagaagggttggctggggctggaggatccacttccaagatgctccctcacgtgccattggcaggaggtctcagctgcccactttggggggctctccacagagctgcttgaggatcttcacaacatggcagctggcttcttccagagtgatctgagggggtgaggaggggagggagagagagggagacagggagacagagagagggcatgcacaaggagaagtccaggtgctttttatgtcctaattccagaggtcatacaccattattctgctcattagaagtgagttactaagagtagcccacgatccaggggaaaggaaccaggtcagactttgtcttcatgtcccaagtacccatcagagaaggaatccccagctaaatgtttgtaggaagagcaggggcacctccgagactccttggcaatcagcatagctgccttccttccagttatctttgcccaactcgtagatagaggggcaggaccttgatgggagaacccctaggtcagggagggcatactgcattcccaggggcgtgacaccacaacacagtggcctcttagcttttgccatttgtcaccctctgggagggcgctggggtgctctccagctctctgttttcctgagggcagtgtaggtgccagggtcttccctgggggagccagggtgaggtgagagcagctgtagtgatcaatgaaggaattgacatgagtgctgggacagctggtaggcatccaggatgtggtcctaccttcctcctcccacccccccgcacagccccgtcagagtccttcacactcgggtcccagtgatgggacctaggaagagcccatgaacatgtggtactgtggccagggaccaggatgggagcggatctgagaaagccctccctcagaagttctgaagagtagagttgggatcctgttggcccttcatcaggtgaagcagaacccctgagtgtggggggtgagggatcagccctcagtgccaggatccagttgagtggctggacagtgctgagtggggcaggggagacaggctgggtgtcgtggagtgggggtcccagctggtggctgacgtgcctctgctgtgcacacgtccaggtgtgagcatgaacatccagcccatgtacctgggggagagcgcccctaaggagctccgaggagctgtggccatgagctcagccatctttacggctctggggatcgtgatgggacaggtggtcggactcaggtaagcacccctcccccacatgcattgagtatttcggagataccagtaaaagcgtttcttcacctaaatgtctcccctacccactagtagattaaagcattattgctttgcatgaaggcatcgaatcctctatccacatctctgctgccaattcacgaaatgggtatcagtcaacacactgcaatgtgaatcaccttttcccatcctctccaggtcagggagcaaagaacaggtcttcacagaggagagggtgaagatttgggctttcaaagacaaacgtgttccagtcattccagaaaaaagaggagaaggcagagcctggacccttgggaagaggagttgctagggatgaggtggggcagtggccctgtcctctcttggtcccaacctgggtgggagggatcttgatgttcagacccagacttggataggaagaggcacggggcaattgcagactccctgcagggaggtgtgtaggtgggcaggagagcagggtggtaggactctggcaaagaggcatctggcctggcctctcctctgcctccttagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcaggtgagtctctgtccttgggctcccagactgcccttgaccaagggatgcatctccccagagtatacgggtccccatttcataggtttcatttatcaaggaaaagctatccctctctttgtgcctcaatttcatgatctgcctatacctgccttcaatcagaactctatcaagtggttgtcctaactgccaggcagcagaatggatcagacctagccactgttactcaagaactccagagcggtgcggagaaacacacgcgcacacacacggtgaaacacctgtgcaagacctcacctacccagtgccaactgggtgatggtcatcttatatcagttaactttggctacagtaagaatgcctaaggaacaatcgcaacatttctgctttaaagcaacaattatttactgcttcttttattcatgtacttgcctggctggctgcacagctctgctgatctcagctgggctagttcacagtgtggggcgggggaggggggcagtggtgaggttcagctgctggttggccggtctaggctggtctggactggagccattcagctttgctgcactttctgtcctctcacttttggtaccaacgagttagcctaggaatagcatggtgatggcagagaaacaagaaagcaaatccagttgcataagcgctttccaaacctttggttccctcgtgccattaacattccattggccaaagcgagtcagtcatactgccaaatcccaagtcaagggatgggaaaattgatggcatatcctctcccatcgcaagggctgtggatttaaggaggggtgaagaccggggcccattagtgtactcttctctgtcaccatggccgcaattattacttatgtctctcctctgtgcaaaatgtgttcagtcccatcccaggatcccccaaagtctcatccaatcatggcatcgggcttgaagtcccagatcttacgccacattaagtctatatgggccttttcttgatccagaaacctaggatctagaaagatgagtcttcttcccttcccacactcagcatgcaatggtaaaaagtaagatgaggtaaccaaaattaatgctctcatttcaaaaacgaggaagcaaggcaggcacagtgcagtcactaatctataacaattctgaagcgcccctaggaaaatatggccatgtcccctgccttgggggtagggagtattctttgttcaagttccagctctgtcccctaccccctatgaagggcaccccaggccatggttcttttattttttttattttttttatcttttagagacaggttctcgcttgtccaggctggagtgctgtggctgttcataggcatgacgccattgttgatcagcacggaagttttcttcttttttgttcttgtttttttggttttgtttgggacagggtctcactctgtcgcccaggctggagtggtgtgatctcagctcactgcaacctccacctcccaggcccaatcaattctcccacctcagcctcctgagtagctgggactactggcccgtgccaccacgcttggctaatttttttttattattgtattttttgtaaagatggagtttcacctctttgcctgggcaggtctcaaactcctgagatcaaatgatcctccccccttggcctcccaaagtgcgtggattataggcatgagccattgtatctggctagcatgggagttttgaactgtcccatttccaacctgggccagtgcattcctccttaggcagcctggtggtccctgctcctgggatgtcactatattgatgctgaacttagtgcagacacctgatctgcctagcgtactacaacccagagctcctgggcccaggcgatcctcctgtctcagcctcctgagtagctgggactctaggcacacaccactatgcgtggctctccatgcttcttgggtctaccctctgagatgtttttccttttctttcaccttccttgattccttctgaagagggcgttgcacaatgtgctgcttttgatggttgagcaaatttctcagcctccttcctgcctatagagagttggggcaggctgggcgccagctcacgcctgtaatcccagggaggctgaggcgggcagatcacgaggtcaagacatcaagaccagcctggccaacatggtgaaaccccatctctactaacaatacaaaaattagctgggtatggtggcacgtacctgtagtcccagctactagggaggctgaggcaggagaattgcttgaacccgagaggcggaggttgcagtggcaggagaattgcttgaacccgagaggcggaggttgcagtgagccaagattgtgccagtgcacactgcactccagcctggtgacagagtgagactccatctcaaaaaaaaaaaaaaaaaaaagaaaagaaaagaaaacaaagttggggcacagaagtctttatatttcaaattgtcctggtcttttttttgtccaaactggcagagcttttgccaatacaactttctcaaaaatgatgtgaattttctatgtattcgaggttttttcatgtgtcaacaaaccacgctcacaattatttttgagacaggcttctctcccaaggcctaattgctggtatttagggtatgtcaggctaccgtgaatcaacgccctcaagcctcctaaatgcccccttttctagttgtgagggtctgtgaggcactgctttaagctatacccttgatttgatctttactatgagtccatggcttcctggcagtgctctggatttgatctttgctcacaggctgttacttaatttgggattcttttgctagctggagaggatagaggcgagaaaacattttttgttgttgttttcaactaacccagtgtttctgaaatatgctacgtttaattaaattttgttgcctctgaattctgcttgcaaactggccagttattttctgagctaattcttcatgtcttacagcaagcttagaatatgcatctaacagcaaccagttcatgctttcaacatttggagttttctttgctcaagtccataagttcactgagcccattttctttcttccgtgttactgcactatataacatagcttttcatttctccagcctcatcgccgtcctctgcctcgtcttggaactgataccatatttcacaggtctttgttacggtagcaccaactcctggtgccaatttattgatcagctttctattgctgactaatagatgatcataacatctcggtggtaaagaaacaaaaaaagcaattatttagcctaagcctctaagtcctctgggctgggctgatctaggatggttctggctgatggctctgctgatcttggtcattcctgcaactgcagctcagctgggcattggctggctgatctagaatagtcccagtgagggtggcttagctgggcccctttggctgtccatgtcttgtcatcctcctggctagcctggaatgttctcatgaaggcagaagagcaagtagaagtgagcaaggcctcttaaggcttaggctggaacatggtacgccctcactgcagcctcatcctattggccgagcccagagccaggagcagggatgtaggcagtacttgcccctttagtgggaggaactgcaaaatcacacagcaagcagtgtgggtgcagggaggggtgaagaattgggtttgataatgtgctgcaatagtcatgtcctgtctgatatgtccgcagaaccctgcgtttctttctaaagccttttttcatccatggtggcaacaccgcaacagccctgagaaatgtcagggcaaggaagatcatctccatctgaccagggaggcaaacagagacagagagattgagagagacagaggcagagagagagaaacacacacacacacagacagacacagagacagagagattgagagagacagaggcagagagagagagaaacacacacacacacagacacagagacagagagattgagagagacagaggcagagagagagaaacacacacacacacagacacagagacagagagattgagagagacagaggcagagagagagagaaacacacacacacacacacacacagagacagagagattgagagagacagaggcagagagagagagaaacacacacacagacacagagacagagagattgagaggcagagagagaaacacacacacacacagagacacacacagagacagagagattgagaaagacaggcagagagagagagaaacacacacacacagacacagagacagagagattgagagagacagaggcagagagagagagaaacacacacacacacacagacacagagacagagagattgagaggcagagagagaaacacacacacacacagagacacacacagagacagagagattgagagagacagaggcagagagagagacacacacacacacagacagactcagagacagagagtgagccaagaaggaaaggaatggtgggatggaggggggcgtccctgtagggggaccaaagaggggcttggggacggggagctcagtaccctcctccctggctcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgagacccctgccccgccgcacaccctgggccccgggggcttggtgttgcaggccgctgggagccatgggaggtggaagggagcccaggcctgaaagccaccctctcccaggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccagcttatggtgttaaaatgcagtgaggggccaggtgcggtggctcatgcctgtaagcccagcactttgggaggccgaggtgggtggatcacaaggtcaggagttcgagaccagcctggccaacacagtgaaacccccgtctctactaaaaaatacaaaaaattatcccggcgtggtggcgggcgcctgtaatcccaggtacttgggaggctgaggcaggagaatcgcatgaacccagtaggtggaggttgcagtgagccgagatggtgccattgcactccagcccaggcaatagtgctgaggtgggatcaggagttggagaccagcctgggcaacatggtgaaaccccgtctctacaaaaaatacaaaaattagccaggcgtggtggtcttcgcctgtagtgctagctactggcgaggctgaggtgggaggatcacttgagcctaggaggttgagactgcagtaaaccgagattgtgccactgcactccagcgtgggctggaccagtgagaccctgtctcagctcagtgagaccagtaagaccctgtctcaatcaatcaatcaatgcagtgagttagagagcatctattgagcatctacggtttgcgggtcacttccagcaccattttgagatgcggaaactggctgaagttgggtgattgattgaccaagttcctttgggaaattaataaagtcacactgaagcaataaactaccctcacctccaccaccagctttctcaggagaccccttcccattgcctgccccagacctcagggaccatggctgggtgtgtgggtctgtgctttctgcctttgcagtgtgtggtaatcgagagggtgggtcggcgcgtgctgctcatcggtgggtacagcctgatgacctgctgggggagcatcttcactgtggccctgtgcctgcaggtagctggggtggatgagggctggggggtccaggccgggctgacttccacctcacccccgccccgtccacggcagagctccttcccctggacactctacctggccatggcctgcatctttgccttcatcctcagctttggcattggccctggtgagtgggcccaaggggctctgggcatccatcatcacatagaaggagtgatgggtgcctgggtgcacagtgggtgggtgtgaatgcaatgtcccctgcaggccctcagagaccacctcatgccggggcttctgggagggaatggcaggaggagagcactgaggggccccccatacagactgggcctgggctcccactcccatgtctgggctggggtcggggagaggcaggcagggaaccctggccagcagccccctgtccctgcccctccttctagccggagtgacggggatcctggccacagagctgtttgaccagatggccaggcctgctgcctgcatggtctgcggggcgctcatgtggatcatgctcatcctggtcggcctgggatttccctttatcatggtaggcccgcccctcccgctgggggccctgccttaggctgtgtccctgtcatcctgagaaccccagggggaggcttccatccagggagactgagactgaaagggaggggtcttaggggagcaaagaggggggcaaatgcctcctcacgacctgtcatgggccttctgtttaggggttgatggagacacaccaggtcttggggtcttttttaatccgcaggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaa

SEQ ID NO: 637 - DNA, 5221 bp, Homo sapiens
tgactagggtgtggcttccctgaggagctgaagttgcccagaggcccagagaaggggagctgagcacgtttgaaccactgaacctgctctggacctcgcctccttcccttcggtgcctcccagcatcctatcctctttaaagagcaggggttcagggaagttccctggatggtgattcgcaggggcagctcccctctcacctgccgcgatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaggagtgcctcggggttccttggcttgcgggaggaattggtgcagagccgggatattggggagcgaggtcgggaacggtgttgggggcgggggtcagggccgggttgctctcctccgaacctgctgttcgggagcccttttgtccagcctgtccctcctacgctcctaacagaggagccccagtgtctttccattctatggcgtacgaagggatgaggagaagttggcactctgccctgggctgcagactcgggatctaaggcgctctgcccgccggaatccgttgtacctagggccaccacgtggggtgctggaggtgagccgaccacggaagagggggaggaggagttggagttgggaggagtccgaggtcttctaggcctagacctttctctcagccccaccttccccagccttcttgttgggcagagggtagccagaggacagaaagatcccacccagagccactcactgccatccactttgttaggtgacttcaggagagttttcaggcgggtgggtgggggaggtgcagagttcttggtcataccgccccgtccacccccgaaccccacgccttgggttctgctcccctcagacacccaccaagcctccgccacagcagttccctgaggaaattgggcgtggggtttccattgggaccgttcgtgttctgtggtgccacagacatgtctgtaaaaccttcagttatgtttgggcgcagtggcacaagcctgtgatcccggcactttgggaggtggaggtgagtggagtgtgactcctctgcttctctcagtctccagccacatctcgtctccagtcccctgttcactcggtcatcccgcgcagtactggacagcgagctctccttccagaagagcaatggggctgggtggggtgaagattaggaagaggaaggagaatagaagctccagggagtctggaagggtggcacccatcttgggatggggcaccccttccatgaaggtctctaaagcaaggccctcctcagcttactccctgccagccgagggcctcagtctcattgttaactcagtgagagggcggtggagcccctcgtctacctcccagctgggggagacatggggggcatgggatggctccagctgtagcgggaaggtcccactcctctcagcctggctttcaggcttgaggtttccttcttggatctgagtacctgtggtgtaacaggcaccctcctcggccctggcctttatcacatcccctcagctcctgggtgcccccagccccagcctcccaaggcctgaggctgagctttgcccaggacccccagttccccccacaacaaactctttctgcctcgggccccacaccccaccaagccctggctggccccctggctcccaccccgcctcagcggtctttgctctcggctgtgtcacagatagggagagcaggggcgcagtgccccatgagcatctaatgcaactccctcatttcacagatgaggacactgaccccaggatccagggcatggtcatacactcaatgccatgccccctgcaagggccctgtggcctcacatgagcaagttagactctgagggccgaggagatgggcagggcaggctgggcacctgctgtgtgagggcaggagggttggtgagagctgtcctccaaaagcaggtgagtgtctgaggttctgtggccccctgggggcatccacaaggtcatgggtccttggactccaggaacaaagggggtgtctgtgggtcagggacctatccgcttgccctgcccaaagtgttcctaagtcccctgggactaataaccggcctgcctgctggggaggtcagctgctacatcccaccttcaagccacacctgcccccattgacccccatcccatggccagctccatttcctccaaagcacaggctccactgcccaccaggtggtgggtctcttcctcaaacccctgtttgactgccccaggacctgcagggtcagccttggaaatgcatttccaagtaacgccacaaactctgaggtacaggacagacaggtgtggggtccatctgcctgttctccatcactctggtggtactatgtcatctgctgagaaagacccccggcctacagggtgaccctcactctcctcagggccactgtttgcaacagacagacagcctggcaggccttgaacctcattttgtaggttcaaggcctgtcccccatctgtccactataagcctcacacacaccattcttctgggataccttccctgaggccacctggtcaacacccacaggcccctttgcttcagcccaggtcctgttagctgaggtttccatttctggacatagctccacccagttctgtgatccgttgggctggtggcaccaggggcccctcggtacttgtccattctggacagcccagcaatgtaggcttttcccaagacttcccaccctgcatgtgtcccacctcatcccctccaggaattttgctttgttgcagagactccctccccaccaccccccaccgccagcctccagaccccactcccttctgggagcccgattccagcaagatcaggatcaggctcccactctgctccttctactggcctcagtttttcccatctgtgaaatgaagggattcatcagaagtccttcccacatactcaatcacggaggcatgacagggacatctcacatcctcagaggcacggttaatccaaggaatgccatgggaagggaggagacagcaggtggcctgtgcctgcactcaggtcttgataaattgtgaaatctctccctcaccccttcctcggagggcactattgttcctgatgtgccagccttgatggcagtggatagggaggcagggacagagacaatgaggaagtgtggttaggtatctacttagaagtctccagatggagccgggaagtgctaggaggccagtgaggccagtctgtgcagcagggcaaacgagtggtatcctgctgggatgcaactcaaatgccttcactgggaactgctcccccaccagccccacactgaagggctggctctaccactcacaggagctggcagggcaggcaatgagacaaccctactgcctctaatgcagtagataaaattaatgcagggccaaccctcatatcagagtggtttttcagttacctggacaagtgccaagggaggggcccctggggccaccagcccaaagaccacagaactgagtggagctctctatgtgcaggagacacacacagagatcaactgatccttggagcttgggagatttccaggatttctgggccactgacactgtttctataaagccctctttggccatctcagttcctttccaggctaagcagtgaaagccaagtcttagttctccaggcctgggccttcctgagtaatttacaggactggtgtgagggacaatgtcaacccaccagccaactgcccagatttcccctcctggcgagtgaggccaagccacttcatttctatgtttgaagcccatgtaaaagaaacagagattgtcagtttcagaaaccgactctgtcccttcagtcctggaacctcaggcctcatctggtgactatggggtctcaacttacagtttagctctcaaaacagccagacagagcaccaaattgaaaggctacaaatgagaagtatcgtccccaccgccccagtgacttggc

SEQ ID NO: 638 - DNA, 845 bp, Homo sapiens
accacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 639 - DNA, 108278 bp, Homo sapiens
tgatggggatacccccaaatgatttaggaggttattttattttaatagttttttcttcctgatttttttcagttagttagagttaaatgtacctatagcccctgaatacatgctcaggtagagaaagtctccatagtataagtaagtaatatgaatgtggaatcttggaaagtgatatattttgattggaataattttaattaaatttaatgattttaattaagaattaaaagccagctagccaaattttctttaaaaattggaaactcattatggtcttaaattgtcctcaggcagccttttcctcatcaacccatagagtggtcttttgaactggtatctaaacatacctggttatgaattctcaaaagagaaagcaggtctggggcggggtggtcaggagacagattctagggaaagtgctgaagagattttcttctgaagatgatctaggaaatgcatctttatacatgattgttagctgctgtagctttctgaagaagattgtagaaaagagactaagatatatgcaagggtcaccagtttagagatcagtcaaattggaaaaagtgccaagactggatgtgcagattgttctatgtattatcagtatttttttcctcttaagaaaaaaatttactctctctcctttgtgagtaaatgcctccttaatgccttttaagtaaggtggcaacttttaactgtcatcttgtgagaggcaacctcaaactctaagcagactccctctctccctttctggtgtcttaaatcaagaactagtttgaagccaaggcaaagcaaggtttgttcatcttcctttcctgtcatttaaggtaaaacaggcaatgaactcgctcttcaaataccatagttcaagagtagctgttggccctggttccagattaatatagcagcaggcagattgccccttcttggggccaccaccctccaaagctgtgccaccaatgagagcattgggttcaagtttgcatcaaacatggtattaccaacgctgagcctccagcagagcacttaaaagtcctagtgagagaatagatactatgcaagggaaaaaaatttaaatgccaacgaatagtttttttttttttgaacctgatacactgtttgtttactctcaactctttgtacaaatattattgtcctaagggccttttcccctcctgcctagaaaataggttgtgtattggttttattcaacctgctgtctgctttaggattggagaaggtacctggatccttgtggactgccactgctggctgcctcctctccaactcatcagaagagcattttgacaaagacagaggacttggaccagggcatgccctgttggggatgtttctgtcagcaaggacatggcatggaatcaagtgggctgatgtgttgttatttaaacagtaccaaagtgcattcttcaatgtatgtttgcctgcttgaagcaaggcccaagttgagaatacagtaaaggaaactcatgaaagtggatgttctgtttatagtcagagtcttgtctctggtgaacaatctcagacaaaaacatgggttaagcttaggctgtgtgtggatttttggtgctgtatgtgctctgggagatgccccatgttggatgtcttgctttggcattcagaatggcagtagagattaggagcagggatggggtttccatggtgtacaactacgtcttttggcataagttatgtccagtttacagtttgctccaatttactgtcatgttcacattcaaccattcatgctcctaatgaaggaaccaagaaagagtctgagtaaagaacgaatatacaggatgacactgtccctgcacattagggctgtactcacaagatctggtttttaaaaatacccttttttggagccattgttcaggaatttgttaagatccccttggtgtcagtttctcatacaacagagaacaaatgtatccctgttgcatctgaactggaaaaccatttttagagggaagtgtgacaatgctgctgtggcctgggttccaagaaagaatgcatgtggcacccagtctattgccctgtgcacccactctttattgccgctgggccaggcaccaggtcatgcctgggccaaggaggggagatcctgacaaggggatgccaccttgtggccagcaagtggggcccagctgagctctgaggcctgtggccggctggtcaaccttgaggtgcggtccagggcacagagccctcggggagagctggggcacaggccgggtggtgcacacagcccccatgcacagctctagccttgtgagtcactggctgtgggctcctggcagaactcatccatgaactcgaggaagtggccgaacttgggctggctctcactcagcgctgggcaggccatggggagcggggtagtcccgaacactgtgcgcagagagccactcaccagctgccggtaacgtgcctggaactccttcaacagcctcttggcctccaggtactgcttgtggttcaccagccgccgttctgtccactggtgcaggacagcacctgcaggaaaagaagccaggagaggcaccaagctcatcctggttctcacctagccagaagcaagaggattgggtccagagacccttggaaaatgggatggtgtggcaggaggatgctaaggggctaaaaatggcctttccagcttgggaagtcactgacttcctactgcccctatgcattgactctatcttaagccctggttcaggaccttaacatgctgtgtgattttaggcaactccctgcctcacgctggctctccttttgtccatctacatgtagagactgatgtaggcagttgctctctaagggcctttcctgcactgacacaagccctttctttgcctttagccagcaggcgtgaactggatctgggatcctggcagctgtggcagagccgtacctagtggagcctctgtaatgttccggggatcccgcaagcgaatgaagatgtcatccagaagttgggctctagtcttctttgggggtggaatcgggattctctgggcctggcagaaggtcatggaggagggtgttatcccaggtttatgcacagacttccctggcctaacttcatacagtcacagcaacaggctggggggcatctgggggtgctgggaaagcatggccctcagagggtcccaaggtgacagccacatctgtaattgtgggcggtactcaggggccatttacacattcagtgagctggatgtttacccgtttctctttgtgaacatagggtttctgaagagtgtccagcttgggcttggaggagtggcacaggagtgggtgcttcagcatttgttgcagggcttgtgcattcttctggattcctagggcaagaaggcaagactgagtcaaggcacttccccctcctcctcccagatgcctcccctgattgcttcattcctcagtctcacagcagctctaggtaaaaggatttgagagtccccaaaagaaaacactgcccccaggtttcttccggatctgttccagtgcctgaagttccatcattcttcagtgagtatttgtcccatattataatggaaaaatagcacagattgtaatgggtaaatagtattggagtgggggaaaaggctggctccaatgtgaccccattaacctcagggggttatatcgcaggggctaacacccagaacagcccagctgaatgccagttgctttggaagtactgattaacacagagatgaagctgcctcctttgcctccaaccagataggaacgattttggacgttcagtttgggaacttaacctgggctgggaaaagctcaagaatctggccattctgggtgttcattcatcacacttttcctgaggagagactttatcatccagagcagctaggctgagaccaactagaatctctgaataaactgtggctccccataagccagtgaaggcctaggccaggacaggggtcccaatatgtggggcttcaaacaaaggacaccctaaaaggagccctttgacaggtatttagacagaggacagcaccctagttgggaaaagacagcttggtgccagccttggcttgaccctgacttgctctgagctgtggagatggcctcttgccctagagcaaggatatgccctcacataccctttggctcaatgaaggctggatcaggcttggctgtcagcagttcttcatagccgtggtacttgctgggaaggaaggcagttgggagtttcctccgagtccctttcacctctctgggtgccgttggtggtttcttttggtctttctcctttaactctaaatcatccttatggatgacggaggaaggcagttcactcacctgtgcccaggaagaaaacgcattcatttgtcactcattcattcattcattccatgaacattcggagtatcatctctgtgctggtctctgctgggccctgttaagggcaagggtaagaccaagactgggatggaagaaagcagatataaaaatagacaattgataaatgctttaacagagggaatacagtggttttgggtgatcccagaggaagccccaacctagccaagaagctcccttggaggaatgccttagcctgagctaagtcttgaagagccaggagagccatccctacggagcaatggggagaggtgtggactgcaagtgatgagaaagaatgattgtttcagacaaggaacagcacgagcaaaggcgcagaggtaagaaacatcaaggtgcattttcggggaactaaagattggtacagttaagtacaaagtgaagagataggcaactgcagtggtaagcaggacccggatcggtaaggaccattatatgccaagctgagggtgcgttttattttgtattttctttatgctcactctgatggcaaaccatggaggattttagcctatcctaatggctttataagaaatctgtatgtcatgtagggatgtatttatttattaaaattactcaccaggtggggtggcacatgcctgtagtcctagctactcaggaggctgagatgggaggactgcttgagctcgggagctctaggctgtagtgcattatgctcctcgagtgtccacagtatgtttggcatcaatatggtgacctcccaggagtgggagaccaccaggttgcctaaggagagatgaacttgcctaggtagaaaatggagcaggtcaaaactcgcatcctgatcagtagtgggatggtgcctgtgaacagccattgcactacagcctgggcaacatagtgagaccccaccatgtatatacgtgtgtgtatttgtgaatatatattatatatacacacgtatgtgtgtacatatatatgacctataacaagcaaaaaagctgaattagcaatttttaaacttcccacaaagaaaagccaaggaccagatggtttcactggtgaatgctaccaaacatttaaaaaagaattaacaccaatacttcacaaactcttccaaaaattaaaagaggcttattctctgaggttagtattaccctgaaatccaaactagagaaagacatcacaagaaaggaaaaatacaaagcagtatcacttatgaatataaatgcaaacattctcaaaaaatattagcaaactgaattcaacaagtaaaagggattatatactatgaccaagtgagatttatcctaggaatgaaaggttggtttaacatctggaaatcaattaatataatatatcaaaaccatatgatcatctcagtagacataggaaaagcccactctgtcatgattaaaaaacactcaaactaggaatagaaagtaacttcctcaaccagataaagatcatctatggaaaaccctcacctaatatcataattaatggtgaaagactgaatgctttccccttaagaacaggcacaagacaaggaagtctgctctcaccacttctgttcatcattgtattaaaggttatagccaggacaattaggccagaaaaaaaaagatttttttttttttttctgaaaacatggtgactcataattgattgtattgctttggccgctaggagctcagaactgcattttgtcaaaacacctttattataatagcagcagtgcatgatgtgcatgtttgagtgacagaattacccttgtactatttcctttcctgtccgtattttcttttcatctaactctctcaaattgtttcttttaaaatgcttatttatattctgcattgctccaaaaaggttctgagatatttctttaagatacttttatactgtataaatttatatgtcactataagtcatctgtggaaaaagaaatagatggagagttagacctccatgaatggatagatgtacatcctggaaagatctggcagtgagcagactggaggggcaagactagaggcagggagatcagggagagggatggtacagtaataaagttcaagggggccctgccaactcttctagccttatattaccctttgccacatgccacccttctgctgcactgacactaaacatttgtggtttctgcatgtaccattttaatttccttcctctatcctgtttcatgctgtttcctctgtccagaatgcccttgctgctatatcttcacctttttaattcctactcagcctgtaaatctcagctcagttgagcctcttccaggaagccctcctgggctggggcagaggcatctctccttcctccagactcccagcctctgggattccctcagtctcagcactgattgcataagctgttcctgtctatgttccccattatactgagagcaccttaagggcacgacctgcatctgatctatgttcccaggatccagaggcagcatcaaaagtgaggagacctgaagcagagaggtacaggcagcagcaaacccctctgaaaaactagttggaatcacaccccagtcagaccccagatcttgactgtgccacagaaccatgacttatccccatgggtgtccctatcaggtatccctatcagtgtcctcagaccagagatctcccagaagaggcttgcaagctccaccaagggtgctgacttcttgtttccagacctgccatgtgcttgttgctcccagctgtccacagcaatcgagcctaagggctgcacaggaacctgtgggagctagcaacaagtgggcaggggcagctggatacaggtacctgggtcaggaagatggactctgtgctcttggagtcctcatctgatgggcgctctgggctgaggcggacagttgtgtcactcaggtgggacagggtctcttcactatgcacagtggagttggagcagatgggaggcagtggcacgaaggtccggcaagacggggaatggccttccaggttctcagtgggcatctctgactccacagaagtgcttttggtagtgggcagatcttcagccagctctgcctctggctctagcatatcctttgagggagacttggttgtcgtcatgcgcgggtgatggagcaccagaggctgcttcggcacctttgggatttcgcttttcacctgtcatggagaagggccagaatgaatttgcttcctaattaggattctctcctcctgggcctcactagcctaaggccacttgtatagcagccggagtgctgggtacggactgaggcgggggtggaaagggaaatcatacttgttgggcatctatgatgtgccccatgcatgatgtaagttgttttatttctaccttgaaactacccaatgaataattatccccaattttatagatgaggaaacaggggcttagagaggtaaaatgacctgtccaagtcccagagtgatttggcggtagtgcctggacgatgtaattccagtcctgggctccaggcttcatgctgcatccctgaccatacgtactctggccctcagtagtctcattcttcagatgagggttgaacatggtgcctatggctttccccagggactccgaggagagggtgttggggaatggtcctgtattttctggaagatgacagcaccaggcccctttcaggatgctgttccctataccttatataaagatcctaaagatagatctctctgaaagattcaggaccaagaaaataattcccttaattagtaaaagcctgtgaccattctccctctcctcctcagcctcagctgccaggaggtgtccatgtgccctcagctgggtttagtcctttctttctccccctttacatagtggattgttttcactctttgtcagaggtatttggttcacttatatctgtacttttactgagagatgtaagttgtgtagtggaaagattgcaagcactgtagttagaaaaatgtgggctagaatacaggtctatcctttgagcacctatttcctccttgtgcctgtctcacagagttccacccaatgaaatggtgtgtgcaaatgtacctaatggactaaggagggcgaaggatgacttttataaaatatgttactttaaaaaaatgtatttccttttggaaaatatgtggaacctcagtgtttagactctgagggacccagagtctttgtctgaatccatgccacaaggcacagggcacggacacagcaccgcacctcagcatctaaaacaccaagcgccatcacttggcagctggcgggaagggacagttccccttccctctcatggctctgtgagagagatgtgctagaggaaatgctctttctctatcccaccgctactttccccgccccctcccaagggaggaatgggtaacctaactggccagaggttgagtcactgggccctgcttcagtcgtgggctggattactgctcatcaatgagaccaggctattttatcttccatttgtgtcctcacatcaaagggctcacacagcttcttggttacaggcctgctctggcaggttctccattttcctcctgtctgtccatgcctaggtgtgaggggagggactgcagcctttgtccatgtaaccccaggggtctaatctgcatttctagccccatctctgtatgcacaatgaggacatgcaggcatccccagtctgactcaggactaagtcacgttcttcagtccagaatagagggtgtttgcctacattaacaaagcattgatttgtttctcatttggccactggcatctgtgtttatttaactcatttagctcaaaggttagtcagaacctttgatgggaggaggtgtgaggggtcccctaggacccacactaacttttaacaagtcagttcacctctctgagtctgttgcttcatctactgtgaggattatgggatagcatacacgtaagagctctgcagagtcctgggcatggggctctgtaaaggagagaggattctgcccctccctggctggctgatgggaaatgatggggcagatccttaagaggaggtaacagacaaggaggaagatgatggaaaccttggaatttctatttctgacttcaaatgcttgtccagtcctctgaggacgtcagacaagagcctggctggacagaggcgggctgcagagggggtggcaaggaaacatctgtatttaacttttgggatcagcaatgctcagcccaccttttggctgtagaaagactaaagttcaggagggaggagcatttcacagaaatttttgaaattcttcagatgaaagagggatttcacttactttatggcaaaggaagcagacttctctcaacataaggaaacacttccttaagattcaggcaggagatgtattctggtcctgccttagctattcttttttttgttttgttttgtttttgtagagacaaggtctcacccaggctggtctcaaactcctgccctcaagcgatcctctcgccttggcctccaaagtgctgggattagaggcgtgagccaccacgcctggcccatagccattctcaattactgtaggtgactataactttcaatggtaagagttttaggagtttaaaatatattttcatatctgttgtttcatccagtgctcttcccaaagcaaggaaaggagaaggcaatgctgaacctaatggagagattccaggcactgtggagtgagcagctctacagccaggttggtttgcatacattataataggctgcactcttcctgggggtgggagtcctgccttggaagccctaccttccatgattccttccgagacatcaaaacatgatgcttaggctttactatcttccttcgaattaagtggattcccagtcgctcctggaggaagctcttcagcagtggagggacccctggtgccatgatgggaaaataagattactattagctaaaatttatactggggcttactatgtgccaggcactattcaaattgctttacatgtattactgaaacttattctcaaccctaggaggtaggtcgagaattcctacctcctaggagaattcctacctcctaccattattcccattcaataggcaaggaaactgaggcacagagaggctaaggaatttgtccaagataataaagatagtgtggagtgatgatcagaacttcactggtgtcactccagggcccaggactctaaaatgcctccaactcctgtatcttacacagtggctccactgctgaccactccattcagtgtgctctgggaagagaggctcctgcagttggggctgcacccctctgcaactgggaattgggaaatgaggtcatgacagaactgttccacaaagcagggtgtggttcaaaagagctcatacaggatttaaagaattccatattccattcccaactcagactctttcttgctgtgtgaccttgggcagatcatgaacctccctgagcctcagtttctaccactgtccgtggggacaataatgcctgctcacagggttactgtcaggaagcgctggtacagagctatttcctccattcctcaatgtaccatgaaccttgtccaccccgacacagagtagatcccagggcttggcattgatgaggtggggatgagggtgccacactgctccttgggcactgggttgagagggggcaggtttgcgggcactatacctcgtgtatgggccaccagagggttgttatgaaagacgaactcgcagagagatgggaagagagctactggtaggacagcatcctcttttgcgatctgtaatgaatgcaggagagactctcaggttgacaccacccctcacctctacccaggtatgtctaggcccctcactgcagggctacatgcttgctaggattgggggtggtattgggtaagacatgctgctgtggatgggactcactgctgggtgatgccttgaccctgtaataatacctactcatgcacagagtaccttgcccctcctgtctgaaattccaccatcactgttgcgtgtttaagagctaagagtttttcctcttttttccatgctggatatgtagcctacatcaaatactagggaagctggtggcaaaataataagaacaaacacatttttcgtacgaacaaactctttatctcataaagattctggaaggttggcagggcattgactttaacttcaggatacaatttgacacttcatcttcctcagcacaaacctctacacacttctgatggctctttcactgaggccagtcctgggcacttatttggggatggacagggggaaaggaggacccacacatctaagggataagtagagccagtgttaagagagacctcatggctgtctgggacacagagaatgccctgtgaagccagcctgcaatcggtggcttattggccaagccagcctctgaagggcaaaaaatatacaagctttgttgagcagactgcctggaaaagctggaccatcttggcgagagtatttatttgcaatggaagagtatcagggacatcaggatcgaaggggtcaggagtcaggcagtggccgatcagacccctggacacactgaaaggtattgggtcagatgtaggacccaatgaaggtactgaagtccaagggctggaagagggagggcacttcagtttagcttcctccgcagccttactggatagcactagatttccactaacttctttcatttttattcattcaaccaacaaatatttactgaatacctaccatgtcccaggcactttgttaggaatgagcaaaacagacacaatttctgccctcagagagcactgtctagtgggaaacaagcattggagaaacagtaacacaggagaatagatttacaatgtgataagtgtcacaagagaggtgcatgaagtaccagggtcatgtgacctagtcagagaggtaaaaggtgtctctgaggtctgaaggaggaggaggaggtaattagcgaacgcagtgaggcatggagtgtgtggtagagaaacctctgtattaaccaaaaccatttctctacctctagcacacggattttatctcctagcctcccaggcagctacatgtggtcacatgacccagttccagccaacgcaacttgggcagaagtggtaaatgctacttctatgcacagtctgcaccctcctgtacctcttctactttcttccctttaccacagtccccctgcttgaccatctaacaggatacataggatccagttgagtagtgttaagaccctatgagatgacagaacatagccagagggcatctgggtctctgaatgatcatgtggaaggccacctgccaaccaggaatatccaagatggactttgtaaaagcaagaaatacacttttattgtgttaagtgattaagatgtttaagtttgttgcagtagctagtcttactttaatgcagagaggaagtgtcctatacaaagagaaaaatgtgtgaaaggcctcatagcctgctggaagagtttaaagaaggctagtgtgactaaaagcagagagaaagagggcacctggtgcaaaatggggctggaaatgcaagtaggggccaaacaaaaggtggtttaagatttgggtccttggagaactcattagatggattttagaaatatgaggacctaaatttgacaagacttggtgatgatgtagatactgggggggcggaggatggggaggtacaagagagagaagtatcaaaggtgacagctggtttttgccttgagtaactggatggaagatgaagctattcactaagggaacaatgaaagaacatacaatttgaagaaaaaatttatcaatttgctttgggtatgtgtatgttggcggtacttttgaggcctccaggtagaaatgtcaaataggcagttggatacactggtctggaatacagaggagaggtctgcattagagttagaaatttttgagtcactgttcatgggccagtggctatctgaagtcatccctagggagacagtagggagtgagaggaaagaaactaggagtaggccttgagggactttaacatttgatcttctagaccaggggatcagcaaaccttttctgtcaaagaccatataataagtgttttaggctttgcagaccatatggtttctgttgcagctattcaattttactattgttgtacaaaatcagccatagacaattcataaataggtatggtggcttttttccaatacaattttatttatggaccctgaaatctgaatttcatataattttaacatgtcatgaaattttatccttgttttgatttttttcaatcattaaaaaatgtaaacaccactcttagcaaacaggctataccaaaaccaggattgggcccatggcccaaatctggcccatgatccatttactaaagtttcagtagaatactacctttctctggctgggcgcggtggctcaggcctataatcccaacactttgggaggccgaggcaagtggatcacaaggtcaggagtttgagaccagcctggccaatagggtgaaaccccgtctctactaaaaaaaaaatacaaaacaacaacaacaacaaaaccccacaaaaatcagctgagtgtgctggcgggtgcctgtaatcccagctcctcgggaggctgaggcagaagaatcacttgaacccaggaggtggagattgcagtgagccaagatcatgccactgcactccagcctgggcaacagagtgagactctgtctcaaaaaaaaagaaaaaagaaaaaaaatactacctttctcatttgttgccatattgccttttgtcccacaagggcagagttaagtagttgcaacagagtaaaatataaaattctgctgccattatctagacttcagagatagaggatgaacctaaaaaggtgcccaatatgttttgataaatgactataatggtggtcaaagtgggtgtagagtcttgtgtgtgcaaatcaaggggtcaagagacaatcactaaagaatgggagatgcagaatttaatcttgtcaggatgcaaaattacattcacccgaaccaggtgattaaaaagttgaagaaaattacaattaagaattgataaaaaaattgaatgatactcaggtcatgtgtgtggtattttctgtgaaattaagcccagctgaaaggtatgggcttaggattctggctgacacagcaagcggaaatctggccatggggctagcctgttctctctcgggtgagctgaatgttctggagatgcattcaggttccaatgataactttaaatttcttctcaatctcattggattaaggagagtgtaacaatctgtcacatttaggaactaagtattaaagaccaagtgaaagtgattattttacttttgacacaacaatttctagtgaatattctgagtaattttctgatgaatattctagatgtataagttctgtttaaaggcagaatttattttgaagtttgtaactttaataaattgaatattaatttcaacacagctgtattatttgacatgattaaaacatcattcatggggtcgggtgtggtggctcacgcctgtaatcctagcactttgggaagctgaggcaggtggatcacgaggtcaggagttcaagaccagcctggccaatatggtgaaaccctgtctctgataaaaaacaaaaattagccaggcgtggtagcgggtgcctgtaattccagctacttgggaggctgaggcaggagaattgcttgaacccgggaggtggaggctgcagtgagccaagatcgcaccactgcactccggcctgggctacagagcgaaactccatctgaacaacaacaacaacaaaaatcattcattcatctaacaaacttattgagcacctatcatgtatcaggtaatattctagataatgagcatataagatgtaagcaaaacaaagtcctagtgctaaaaaacaaaagcacattctggtaatagatatgtgacaatagacaaaaagatataatatgttaggtggtaactatcataaagtaaaataccatttaaaaactcaggtgcaaacatagaaaaatggaaagagtgctgctccaaccttaagaaaactactgaataatctataaaatcataacttttcttgagtccaatagagagctaacatcccaggacaatcatgcggcctgaaatctaaggaaatactggcacctccaaggagagatgggacacagacactggcctgcctgtggcagaatgtggcagatgcaagtgccacacaagcacttaagaagaaatcaggtaaaaattttagtgaatttataaagaccaagcgtggcctagagtaaacccctttaagctgcagacatccagggagttcacactcactagtgtgagaaagactggaggcaggagagagattgatgacagccttcctcagtggtgtgagcctggaagaggagatagctcccaccacaaaaaggcagggggccttaccaacccttctccatagttaacgaaagccttcagttgctgaggaagatcagcaaaccctgtcagcttggggcactgcatcttgggtagggaaaaaattaaaacccactactcctgtggttggagcaggaaaccaacctgggcctagcacattagaggtctcctactgctgggagaggggtaggaccactgagaaaagcctatccttgagacacagggttggtcccagggctgcctaagactggggctagagcctccttttggcacctaccaccacttgctacttagcaagcactaagtagcaagcaaaagcagtctactgctagggggaggaacaagcatgtggagataaacttctctgaggtgcaggcactcagggaaggatgaaagctgaggacaaagcaggaaaactgagaaaaacactctggcaccctaggaaaaaccagctatatgctgtctaaaagagacacaccttaactacaaagatataaataggttgcaagtaaatggacagaaagagatacaccatgcaaacagtaagtataaggaagcaaacaaaataagacatcaagacaaggaatatgattagaggcaaaaaaaaaaggcaactcataatttataaaagtatccatacatttggtagatataaatgtatctgcatcaatagcagacttcaaaatacatggagtaaaagctgacagaactaaagggagaaataagtaaattcacaaccacgtctggagattttaacacactgctctcagtgattgatagaacaactatacaacagtacagagaagatctgagtgacacaaccaaccaccttaacttaatatttatagaacactttcccccaaaactgcagaatatacatagtttttgaaatgcacatggaatgttcaccaagacagactgaccatagggtgaatcataaaacaagtttaaatagatttcagaagaatgacatcttacagattatgttatctgcacacaaaatagattagaaataaatacaagacacctagaagagcccccatatatttggaaattaactaacttataaataacctgtggatcaaagaagaaatcacaggaaaaagtgaaaatattttaatcgaatgaaaataaaaagaaaatatattacaatttgtaggactcagctaaagcagtgcttggagaagaaatgtaaagctttacatgcttatattagaaagaagaaaggtctaaatcaattaactaaagttatactgcctaagatgcgagaaaaagaggagcaaattaaaatcattttaagtaaaagaacagaaagttatgagcagaaatcaatgaaatggaaaacagagaaatccagtgaaaccagcagctagtttaataagaaaaagtcaatgaaagaggtaatgtctaactattttggatcaataaaagacataaattaccaatttcaagaagagggacctgtgatacatctatggtccactgattttcggcaagggtgtaacagtgggggaaagaatagtcttttcaataagtggtattgagaaagctggatatccacatgcaaaagaatgaagccgatgcctgtctcacactatatataaagattaagttgaaataaagacctaaatgtaagagctgaaacaataaaactcttagaagaaaacacttggggagtttagctgtatcagctgcttgctgtagaggaatgtaagcagagtatcttacaagtttcctgcatttcagacttgagtagggctcagttagtgggattttacagaaaaccaaacaggacatgaacattggaaaaacatgttaaatctgtcccttatcctttatatctgctgttccccttaggctacaacatttctaccctcacttgactcacccctcttcacctgattaaactcactgattcagatctcagcttaaacaccactttcttgagaaccttccttgatcccaagtattaggttagacacctcccctccatcatttacttcataacactgtgaatttcttcataacactaagcatgctcatattgtgatgatttgtccatatcagtcttcctgtcttccttataggtgataagttgcaaaagggcagagaggccaagtctctttccacagctgtatatctagtgcctaccacagagcctggcacatggtaagtgctaaataaatatctgtgactgaagagatggactcctgccttggcctgaactccttccactttccccaccctgagaattcctgagcccatgtacctgtaatgcagggaattgaatggagggttggtttttaggccagagcaacttgcatcccaccttcccatctgtgcccctgagtaaacaggagaggagcagaaagtcaccttgttgtaggccaggctaaggtatctcagctctgggaagggtggggccagcgtctggttcctggccttcagtgacttcacaggaaggatctcgaatatgggaggaagtgaacatatcttggttgtcttagaaagaaggaaaagtcaaaatcaaagtgcccgataataaataaggccactaagggccaacagaccctttcaatggaacagggtggaatgaatgaccttcctagagagacttggccaaaagagacatgtagggtcataagggtagatgtcgccatcagcccagaattctggctccaagttctcttaggagaattagcttacatgatgagctaattctcaagcacccaaagttccattttcaagttttctgaggccacaggataatatagcactggtgcagacatcagaggtacttggtccccaccccctccctctaccctacagcagcttaccctgaattggcccttctacacagttgggctaaaatttctccagaaggcaaaggggaaggtgcttgtgttcttaaggggaatttttctagggaggagagggagagggaggtgttttgagccttgaacacctgctctgatgggctagcccacatcctcgagtggagggtcttcatttgaggatgaaacaacagtcctaaatgacttcaacctgcccgtgggagctgaatgtggcatgctgcagctggatcccttgcagggtcatgttcttttcatacaacccagactgccacaggttcaacatatttgatcaagcagaaaaaggtaattgttggtttaactatacataactcagtacactcactgattcctgagttcgatgggaccacaggatattataagggtagatgctgggctaatggttaggttcagatgaactagattccatcttaagctgaattaattaatcactatggaatcttgagcaagtcacttaaattttgcttgttcattcagtgaacatttgtggggcacttactttgagccaagtattttgtacccttctgggtcaacttgtaaaaccacacaagtggacaggtcagtcatgggtgagcataaaacaaaaaccagcgactgtgtttgggaactcagatgactcgcctctcccagtgatcccaaggcaatttctgagacgcaagagtggaacatggtggcggtctgataaggcagtatcctccactatgtaattccctacttggagcaaggctgtgtgaactgaagggggtaagtcatactgcagtacagaaaaggaaaagccagagagtcaagatgaggagtatcctgacccaagggcataactggccctgatgggggcagagagggccctgtcttggagggaggtgcatctgattttaatagagtaaggccactaaaagtctcaactatccaactcactttctagattttcagatgtcagagagctgatctgagcactgagcaatcctacaaattatctttgacttgtgtggtagactgtttaatggtcacaagcccctccatcccacatacatgcccttttgcagtgtgaccttgctgctcctcccattcagaggtggagaccatgtgtctaccctcctgaaattagactggctgttacataagaaaaaatttgtctggtctttatcccaggttcctggcactgagcttctaaaactcttggaattttctgagtgataggaatatctttgttatgcaggaccccttgagtcacacctgagtttaggataatgagatgactcaggatggaggctggccatgccagaaagactaaccatgtgactagagagttggggctttgcaccagcatgacccctggggaggataaggaactagaaattaagttcaatcaggtggccagtgagcctccaataaaagctctggactctgaggtgtgggtgagcttcctggttggtgagcacatcaatgtgctgggagggagacatgccctgattccacagggagggggcatgaaagctctcagacctcaccttatatgccttttcatttggctggtcctgattcgtgtcatttatagctggggtccccaaccctcgagccacaaaccggtgccagtccctggcttgttgggaactgggccgcacagcaggaagtgagcagtgggtgagtgaacaaaaacatcatctgtatttacagccactccccgttgctcaaattactgcctgagctgcacctcctgtcggatcagcagtggcattagattctcataggagcacaaaccctgttgtgaactgggcatgcaagggatctaggttgtgtgctcgttatgagaatctaatgcctgatgatctgtcactgtcttccatcaccccaagatgggaccatctaattgcacgaaaacaagctcaaggctcccactgattctacactgtggtgagttgtataattatttcattatatattacaatgtaataataacagaaataaagtacataataaatgtaatgcactttcatcatccgaaaccacccaccccaccccagtccatggaaaaattgtcttccacaaaactggtccctggagccgaaaaggttggggactgctgcattatagtaaaactgtgattgtaagtataaccctttcctgagtttgagttgttctagaaaattactgaacctgagtgggttgtggaaactcttgaatttatcaccagttggtcaaagtgtggatagcctggggacttccaaacttgtggctggcctctgaagtgaaggaaatctttttgggaactaccctcacttgtgggctttgtgcttaacttgtggagtctgcgcaaactcaggggtcagcgtcagaatagtacagcagtataatacggggcttttgacttgctttgaccaatagaatgtggagaagtgacactatttcaatttcagaactttttaattcgcccttgctctcttgaaaccctgatgctgtaatgaaaccatactgcaatgtagcccaggaggaaaagaccacaaagagagaagatgccaagccataccagctgtgtacctgagcccagcctgcagctaccctgccagctaaatgcagctgtataagtgagccttggtggagccagtggaatcacttcgtcgactcaattgtgagtggtgaaaaataatgaattgttattgggttggtttggtaagcagctatagttaactgatagaatttctcacacagttctatctgtggggaggttgtatactgagctgcctctcaaggatgcaggttggctaaatgaagagatatactatttattgtaaatgaataaatcaatatttggtttacatgtaccagtccccacgagcatctgccatgagagaaaaaacaattttctgtgctgatgaaaatcaagggtctaagcctgtgacatcaacgattaggtcctggatagtggtgtatctggcaaggacttttccagctttgggggactcttgttaaggagctgctggtagcagccccacttcaatgccaattttatcacttgaggcagctgccattattacattatgctaaacagcatgtgagaacaatgaaagttagactaggcaggtaaggtcaagacatgtctgtctgtggccagcacaggacctggtacaggtaaggtcaagacatgtctgtctctggccagcacaggacctggtacatgataggtacttggcaactacctattcaatgaatgggcttcctcagtgtgatctatagaaatgactctcatggctccattattttatttgattttgtctattaaaattaatgttctaactcaggaacacaaatataaagtagtcagttcctacctctgaggttgaaaatccagggtaagatgaaaacacaacctctgaaacagaagagaaacagaatgaaggttggtgagaccgctgattgatgcctagagcacccaggatataggtctgccatccactgtgtgcagcagggcacctcctagagggagttctcattggtcctcagccccagtgctaactaggaagaggagctggctgtgacatgcatcaggtaataagtccctttgcacttaggataaaatacaaactgcttatctagtcctctgatgtcctgcatgattgggcccctgcctacttcttcagtctcatttcatgatactctccctcattcactgtatttcagccacactgactgaccttcaatctgactttaaagcacataagcactttcgagcctcagaattactggggagtccatactgagcagaaagctaaccaactgtcttagaagagaaaaatgtatatagaagacattctgtcagaggatttggaaatatttcttatattagtagaaacagaatgtgttgagccagtgaattcaggagagataccaagaacaaccagcacacagtcataaggaggaggctgcagagtgatttcattcttgggaccgtcagaatgagatgagtctaacagctgagttcaacctaacacagcatagcatctgctgggactagatcctgtgcagacattgctcacctttaccctagttaaccgacaccttctacatgttaatgatattataatgagacaagtcacatgaaaatgaagaaaacagtaataggagatggaacaacatggcataaataacttctcctgtgatgagggtctgcaagggagtttgggaaagctttgtgcaatgaacaaagtaggaattccctgggggatgggccatggttgcaagtgtgagtgctaagcaatgaaccctagaaaacaacagcacctctagaaagatgggcacgctgtctgaacgcgcatcctgctctccccacaatcacaggaattactgcattttaagcttctgattgaggattgttacacaaaaagactgaataatcaagaatctcctactatttgaggaaaattaacaatataaaaaagggaagaattatcacctgaataaaaacagtttatttaacaaaagttataaaaacttcaaaatagaataattagtatcctctgagaaattcaaaagtttcactcctgaaacaaaagcagattgttgtggaagcaaagctactaacaaagctgtaaatttataatgaaaataactcatacatgtgctggatagaagaatggacccaggtgaactaattcataaaatggaagactgagtggagagactctcagaatgcaaaaaggcagagagaagatggtggaatagaaagtaacccactcatgtcccctcacaaccacaaaaattccacacccgcccacagtcaaaagtctctctgcaggagcatcaagattcaggtaggagtttttgaaaccctggtggatcccaagacattgaaggattgttttgagggtacagaccaacacccaagtggctgatccaccaagcttgctccccagttcaagcctagaaacaccccaggcttccaaggtcctgggctacagccatatttggccttgagcctgcaaccaaaaccatctgcagagaggtccagaaggagtagtgcacactagtgccttggtggaaaggcttgtctgcctgctgacattgatcttagcagtaagcctgaaagttgccgtttttctgatccaccccctctcagctgaggtccctgctcacagcctcttgcacaaggacccagagggagactcacctatatcttgcagcctgaggctcccagatgagttcaccaacttctgtcccacagcaaattctgaggggacccagtttgagacctggtccctccagctgcaatcagagaactaaccagactgtgcagggacttgctggaagacacatgcccctctgagccaatgaggctgggctttctagcctttaccctacagcaaatcctgagaggacccagtctcagctctgacccctgtcactacagtggagaattatcctatctgtgctgagacctgctgggagacacatgcctgtctgggccaacaagatgggcttcttcccatatcaaatcccagcggggcccagtgtcagccctggcccctcctgctgcaatcaggttactatctcatctgcatagggacttgctaggagacacatgcccctctgagccaatgagactgggctctccagcctctacctcacagcagatcctgtgtgggcccagtctgcgatttggccccgcctgctatagtcagggaactatcctatctgtgcaggaacttgctaggcaatgtgcacctccctgaaccaagacagggctctctagcctctgttccacagcagatcccaagggggcctatggtcagttccagcccctccctctacaatcagggaattattccatctgtgcggagacatgcaggcagatgtgtgcctgtctgaaccaccatgacaggcacaccagcctccatcccacggcagatcccaaggggacccagtctcagttctggtccctcttgttgcagtcaaggaactacttgtgcagggacctgctaggtgacatacacctgtctaagccaatgagatggaccaccagcttcattcctacaacagatcccaacatgccccagtcttaaattcagtccctctggctacagctgggacccatcctgcccatgcagagacctgctgggaggaacacatatctgggccactgggacagtgttctggactcaggtccccttggccaacattcccacatagccccagtcctgtgtttgggtcttcccagagccatttgggccagaaagccacaccaatctcagtctttgcaagacttgcagcaagcctgggtttagaccatcgctcagtgctgagatgccagtagtggtcccaagctcaggaaatgtaacagtcagtctgcctagaatccctggaagtccctctgaagaaggacaggcacacacaaagccagactacaaaggcaaaaataaatacctaatatttcaaggcacggatatcatcacacttctacaaacatcaggaatattcagggaaatatgacgtcaccaaacagacaaaataagatgccagagatcaaacataaagtaatagagatgtgtgatctctcagacaaagaattcaaaagaacatttttttgggtttttttattttttttgttttgttttgtgctttttttggagacaggctctcattctgtcacccaggttggagtacagtgacatgaacattgcttactgcagcctcaacctcctgggctcaagcaatcctcccacctcagcctcccatgtagctgggaccacaggcatgcaccaccatgcctggttaatgtttttatttttttgtagacatgggagactcactttgttgcccaggctggtcttgaactcctgggctcaagcaatcttcctacttcagcctcccaaagtgctgggattataggcatgagtcactatgcccagccaaaacagatgttttaaggaagcacagtgaacttcaagaaaacacagagaatcagttcagaaatttaccagaaaaatttaacaaggagattgaaataattaaaaaaaaaaaaaaatcaaagaaatcctggaattgaaaaatataatgaatgaaatgaaaaagtcaacagagagtatcaacagcagaattaatcaaacagaggaatcagtgagctcaaagattatatgaaaatatacagtcagaggagaaaaaaggaagaagaatgaaaaggaataaaagcttgcaggatctatgggacaacatcaaaaaagaaaatattagggttgctaaagttaaagagggatatgagaaagacaaaaggggtagaaagcttattcaaagaataacagaaaactttccaaatctggagactgggtgggtgtgcacgtaccccaccatgccattactgccagcataagcacacccacttccactgccactgccagcatgaacattaagcatggacaccagtggccctgcaccctggcccatccaaaggatggcaccttcaaagattgaaggaataccagcccacacagatgagaaagaaccagacaagaactctggcaaatcaaaaagccagagtgtctttttacctccaaatgaccacactagttctccagcaatggttcttaaacaggttgaaatgacagaaatggaattcagaatatggatgggaatggagatcactgacattcaggagaaagttgaaacccaatacaaggaatctaaggaataaataaaataatatgggagatgaaagatgaaatggccatgttaagaaagaagcaaagtgagctgatacagctgaaaagctcactttaagaatttcagaatacaactgcaatgttaacagcagaatcaaccaagctgaggaaagactcagagctgaaagactggctcttcaaaataactcagtcagaccaaaataaaaaaatagtaaggaagaatgagcaaaacctctgagaaatatgggattatgtaaagagaccaaaaatatgactcattggtatccctgaaatgcaaggagagaaagcaagcaatttggaaaacacatttcaggttatcatgcatgacaatttccccaactttgctatagaggccaacattcaaattcaggaaatgcagagaacccctgtgaaatactacacaagaagaccatccccaagaaacatagtaattggattctccaaggtcaaaatgatagaaatgttaaaggcagctagagagaaaggacaggtcacctacaaaaaaaaacccatcaactaacaaacagcagacctttcagcacaaaccagaggagaatgggggcctatagtcaatctttttttttttttttttttctgagacagagtcttgctcccgtcatccaggctggagtacaatggtgcgatcttggttcactgcaacctccgcctcccaggttcaagtgattctcatacctcagtctcccaagtaactgggattacaagcatgcgtcaccgcacctaattttttgtatttttagtagagacagggtttcaccatattggccagtctgctcttgaacttctggcctcaagtgatccacctgcctcagcttcccaaagtgctaggattacaggtatgagccactgcgctgggctcaacattcttaaagaaaagaatttccaaccaagaatttcatatccagccaagctaagctttgtaagtgaaggagaaataagatccttttcagacatgcaaatgctaagggatttcattactatccgaccagatatgccttacaagaggtcttgaagggagtgctaaacttggaaagaaaagactgttaccggccactacaaaaacacacttaagtaaatagaccattaacactataaagcaaccacatgaacaagtctgcataataatgaacaaatcctcacatatcaatattaactttgaatataaatgagctaaatggcacagagtgatcagttgaataaagaagcaagacctgatggtatgctgtcttcaagagacccatctcacatgtgatgacacccataggctgaaagcaaacggatggagaaaaatctaccaagcaaatggaaaagagaaaaaaagcaggggttgttgaaattattctaaactcagacaaaacagacattaaaccaacaaagattaaaaaaaaaaagacaaagaaggatattatataatggtaaagagctcaattcaacaagaactatcctaaatatatatgcatccaacagaggagacccagattcaaaaagcaagttgcttttagagacatataaagagacttggataaacatacgataattgtgcaggacatgaataccccaataataatattagatcattgaggcagaaaactgacaaagatattaatgacctgaactcaatacttgaccatatggacccaattgacatctacagaacactccaccccaaaacaacagaatatacattcttctcagctgcacatggcacatattctaaagtcaaccacacaatcagatatagaacaatcctcagtacaattttaaaaaaaaatgaaatcatactaaccacactcttggagcacagcaccataaaatagaaatactaagaaaattgctcaaaaccatataattacattgaaataaacctgctcctgaatgacttttgggtaaataatgaaattaagggagaaatcaagatattctttgaaactaaaggagaacaaagaggcaacatactgatacaggaggtagaaagaaattatttaggcagatagggtaaaagagtcctcagcaaagcttcccttttagcaagaagcagcccaagaaattatttttttctaacaaagagcagcctgaaaaactgagctgaaaacatagataagcaagctggaagtttgcatgggggaatgccagcagttgtgccaatagaaaagggctacctgggagccaggcatgtccaacatggaggctccatcttttctttttttgttaatatgtgtacagtaaagggatgggcaacatggtgcaggccaggcagaggacctgcctgcatattagaagattagtatgggggcgaccatttttttgtgccctatgcaaatgacaaacctagttctaatgagtttttcataccctatgcagatggcacacctggtccaaccaatctttcacaccctatgtaaatcagatactgcctcctcatcaggcacctataagagcccctgcatttaaccacagatctgacaagccatttctctgggatccccctctccagcagaaagctattctctttcacctattaaacttccactcttaacctcactctttgtgtgcccaggtccttgatttcctcagccatgagacaacaaacctcgggtatcacccccaacaatgaggccacttcattgtggggcccatctgggatccaaggtagattcatcagaagggtgagtataggagcagaccccaaatctttactttcattttggggccttctgccctccattttaaaataaaaccaaaaacattcggtgtctgatggccacctagatgcccttagggaatgccacccatctcaagacttagacaacaggcttgctcgggagaacttagtgaatccctcggtaccctcagggtgctgggaatgttgactgtgtttcaaaccagtttcctttcatggagagcctagctattgcatggggctggaagaggtccagaggcaactgatagttcctggccagggctacacccaggtgttacccgaaggcttctggattaacctcagactctgactgcccactgagcatcagtaacaggatctccaagcttttcctattgcatttttccttctttcctgtcgactgccatgtctcctatcccctctctgtatgaaatgctgtgggaatttttacacttcagggaaataatcctgttagatagcatcagcaaatgccatagtaaccaggaatataatgcaaaggattgccatttttgtgattttctaggaatagaaaggatctccctttccctggcagtgagcatctctctccccgcttgctctggagatcacatggtatttcaaggtctacagcaccacctagtggaatagaaatcctctccatgaggtaccttgtcagccctttgcctaaacactctagttttccaattctcctccccttttgtactcctctactagaggccaggctttatgctccttctgtgaatgggaaaactcaacaatgaggaggaaaatgccctccaaaaccaaattttagttttgatattgtcccatcagcaggaaaaccaccattcagttcctacattcttttaaggcacttattctgcctctcattaaaatggtacttaaatagtaaggggatgtaatgtcttaaagttaaccagaaccactgcctaacaataaatattttagtccaggccataatagcagtatagagctcaacccagtacactctctccattaaagggccttgcaaatacaactgttatatagtctttcccaagagccatctatcaggtagccacatagatcacagaagttaggaagtcaaagggaaatcaccagtggaggattagagttgcatgggtgagtgtgactaaatccatcacttagcttctctagatccatgcctgagggacatgcctgcatccaagagtagcaccttttaacagatgccgaggctcagggaaccaagaagggaaaacagttgggggatgctcccattgtcttcctgtctaccttgggccattctaaaggaaggaggggaataagggactccttgtctcccctagctttctagccatctttagcctgcaccccgctcaagtgcattctgaagcactgagactcctttaatcctgaaactgcttttgcacaagggcatggccttcttactagacctttgcatgcactggacaatcaaccaagctcttttagcagtcatatcaggcaatccaaaaggtaatgattccccaaaactaaaaaagcaacttcaggcagctattgagtgtcccggctcttcctgtcccccttatttagggccccctccaactgtgccatcagctcctctagttccactatctccaaaattccccactcccccagcttcactcttacccctgcaggaaatgaccaatggaggtgatgccactagggttcaagttcctgtctcattgcatgaccttaggcaaataaagggatacttaggctgattttctgatgactccgataggtataaagaagctttccaaaatttaactcaggtgtttgacctctcatggagagatgttatgctgctcctaagccaaaccctaaccgcagctgaaaagcaggcagctctgcatgcatcagagaaatttggagacaagcagtatgtttcttacagtaggccaaaaaggaaaagagaaaatagggaaggtgaagagataggggaaccatcattcccagtagagaagagaggcagtacctcttgacaaccctgatttggaaccctgatgactccacaaatgaatggaaaaggaaacacttattaatgtgcatattggagggcctataaagaactaggagagccaaacctcttcattactctaaactgtccaagataaaccaaaagccagatgagaatcctgcagcctttatggaaaggctgagagaagcactaataaaacacacctccttatcccctactcagtcaagggacagctaaccctcaaggacaagtttattatactggcagctcccaatattagaaggaaactgtagaagcaggctataggaccagatagcaccttgaaaaaccacttgagggtggttaccttggtctttcataatagggaccagaaggcggccctggagaaagagaggaaacgcgagagaaggcagaggctctagtagctgctttgcaaacttgcaaagtccaggatccccaaggtgtatccattagttgctaccagtgtggcaagtcagggcactttaagaaggagtgcccaggcagcaagtagaagccaccccaaccatgtccagccagtggttgggaccactggagatcagactgcccctggagatggaggtcactgggttcagaaccagtctcacagatggtccaacaggactgttgggtcctggggttcagacccctggctccagcagctgaaactgtcattactgcacaggagccccaggtgattctgaaaattgaaggaaggaaggaaggtggaccttcttctagacattggaaccagcatccctcttctccctaatccccttttcccatagcatgaccatgatgggcatctcaggtaaagttctaacctgatatttttctcaaccccttagttgtagttgggaggacctattatttactcatgccttcttactcatgcctgaaagtaccactccttcattaggcagagacattttagcttgcatgggggccagcatccttatagccccaagacaaactctttgtttcccccaggtggaagctattattaatccagaagggtgagcaactcaaggaaaaataggccagttcagatccatcttaaggatcccactgcttttcttaaccagagacaatatcccctaaagccaaggctaggaaggggctagaagccattattaataacctgaaaatgcagggcctcctcgaaccttgtagcagcccctgcaacaccccaatattaggagtgcaaaaacccaatggagaatggagactagatcagatcctccacatcattaataaggccatagttccaactcatccagtggtccctaatccctatactttgctaacccaaatacctgagggaactaaatggttcagtcctagatctaaaggatgcctttttctatatagcgttacatcctgactctcaatacctgtttgccttcgaagatccctctggccagatgcccagttaacatggacagtgctgcctcagggattttgagacagtccccacttgtttggacaggtactgtcaaaggacctctctgagttttcccatcctcaggtcagggtcttgccatatgtagatgacatactgttttgtgccccaactgaggaagcatctcaggaaggcagtgaagctcttcttaatttcttagccaacagaagatataaggtttcaaaatctaacatcaagctttgccaaacctcagtgaagtacctgggtgtagtgttgtctgaagggaccagagcattaggggaagaaaggagtaagccaatttcctccttccccctccctaaaaccttcaagcaactaagaggatttgggggcattacaggattctgcaaactcatcttggtatggtgagatagtttaccccctatatcacctcataaaaaaaactcaaggccaggcacggtggctcacacctgtaatcccagcactttgggaggccgaggtgggcggatcatgaagtcaagagatcaagaccatcctggccaacatggtgaaaccccgtctctactaaaaatacaaaaattagctgggcatggtggcacacgcctgtattcccagctacccaggaggctgagacaggagaatcgcatgaacccgggaggtggaggttgcagtgagctgagatcacgccactgcgctccagcctgggtgacagcaagactccgtctcaaaaaaaaaaaaaaaaaaaaaaaaaaaaagaaagaaactcaagtggctaaaactcatttcctaacctgagaacctgaagctcaaaaggcctttaattagttaaaacaagccttacttaaggtaccagtcctcagccttcccatagggagggtcttcaatcttttgtatcagaaaggaagggaatggccctgggagttttaactcaagcccgaggaccagctcaacagccagtgggctccctaagtaaggaacttgatttggtggctaaagaatggctatcatgcctctgagccattgccaaagtggccctactgataccagaggccaccaaattaaccctgggaaatagcttaactgtttataccccacataatgtagcacgattgctgtcctctaagggatgcccttggctaacagaaagctgactccctaaatatcaggctctgatattagaagggtctacaatccagttaaaaacttgctcttgcctaaactcagccactttcctccccaaggaaactgaggaacctgaacatgactgtgaacaagttgtggtacagacctatgcagccagggaagctctcagggaaacttccctagaaaatccagatgggacgctcttcacaaatggaagttcctttgtggaacaaggagtctgtaaggtgggatatgcaatgtacactctgaatgacattgaaagtgcacccctctccccaggcacaagcattcaactagctgaactgatagctcttacaagaacacttgaattaagcaagggaaaggtagctaacatttacacagaatccaagtatgctttcttagttctttatgctcatgctgccatttgggaggaaagacactttcctactactaaagataacctataaaataccatcaggaaattaacaagttattatcctcagttttccttccacgagaggtagcagtgatgcattgtaggacatcagaagggagcagatgaagtagcctaaggaaacaagttagctgatgaggcagccaagtcagcagcaagtcagcctcagggcctcaatgcacctgaagccccctctaatctgggaaggctccataagagaaattaagtctcagtactcccctgcagaggcagagtgggccacttctcaagggtatacttttcagctctcaggatggctacagtaagaggacggcaaactccacttgccagcctcccgccagtggaaagtccttaagatccttcatcaagcttttcacttgggaaaggataaaacttatcagtgtgcccagagatttttcaggagagaacttaataacagtcaagcagcttgttagtgcttgtgaagtctgtcttaaaaataatccctttggctgggcacggtggctcacacctgtaatcccagcactttggcgggtggatcacttgacatcaggagttcgagaccagcctggccaacattgcaaaaccccatctctactaataatacaaagaaattaaccagatgtggtggtgcacgcctgtaatcccggttacttgggaggctgaggcacgataattgctttaacacaggaggtggaggttgcagtgagctgagatcacaccactacactgaagcctgagcaacagagtgaaactgtgtctcaaaataataataatccccttaacaggcatctccttcctcctcaaacctaaaggatgggaagccatccagggaaggactggcagatagacttcacccacgtgccaaagaagaaggacatccaatacatcctggtatgggtagatactttcactaactggatagaagcatttccatgctgtacagaaaaggcctccaaggtaataaaagtgtttgttacttaatgaaataactccccactttagtctacctaagtgccttcaaggtcacaatggccccttgcttaagacagctgtcacataaggggtcacaaaggcactaggcatacagtatcatctccattgtgcttggagaccccagtcctcaggaaaggtagagaagacaaacgatattatcaaaagacatctcagaaaactgttccaagaaactaaccttccttgggtcactcttcttcccatggctttactgtgggtaagaaataccccttcaaagttaggtctgaccccgttttaaatgctgtattaacagcctttccttacaagtgactttctattagaccaagacacctctaaattggttaagcatgtaacctccctagctcacttccaacaggaattaacacaactagcagaagcccaaccccccaaaataggaccatcattatttaacccaggatatgtggtattaataaagactctgccctctgtctccctacctaagcccaagttaggaagggccctacactgttctttcaacccctcagcgataaaagtcacaggaatggactcctggatgcatcactcaagtcaaagcctggaaacctgagagagagagcaaccccagacagcccagaggaatgtcctggatatccatgtgaagaaataggagatcttaagctgaaaatcataaaagataagtaaatgagtaagggctattcatcctactcagtcccactcctaccttatcagatactttcagttatttctacttttcctctcgagattcgctgtgagatactagaacttctttttgatgcatacttgtgggaagattttgattatccatgagattacagttgtaacttcatagactcccaaagggaaattcttggtgagtaaaatttaagatggaaattatctactacaccacccttgtgtaaattgttatacttactctgctatttgcagtaggactatatactgtggtacctgcaatgtagaattctggatggaatattctaattgctgtaatattctgcctaatttttacaacaggattaataattacaggaaagatttagccaaggttaacactaaagttactctagccacccaataatgtgttcctcccaatcacatcacaagtcataaaagatagcccaggcctacaattatcttctaatggcaagtcaagggggaatatatgttttttttcaaagaaaaatgttgcttttatattacacttctggtaaagtacagcgacatctggtggaggcaactagtattacaacccatcaaatggctatcaggtatcaaactctactgtcatggttatagcctatagtactcccactaataatgggattctttttttttattttttattttattatactttaagttttagggtacatgtgcacattgtgcaggttagttacatatgtatacatgtgccatgctggtgcgctgcacccactaacttgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttctgttcttgcgatagtttactgagaatgatgatttccaatttcatccatgtccctacaaaggacatgaactcatcattttttatggctgcatagtattctatggtgtttatgtgccacattttcttaatccagtctatcattgttggacatttgggttggttccaagtctttgctattgtgaataatgctgcaataaacatacgtgtgcatgtgtctttatagcagcatgatttataatcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagaggagtaggttgtgaaaattttctcccattttgtaggttgcctgttcactctgatggtagtttcttttgctgtgcagaagctctttagtttaatcagatcccatttgtcagttttggcttttgttgccattgcttttggtgttttagacatgaagtccttgcccctgcctgtgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttatagtatagtttgaagtcaggtagtgtgatgcctccagctttgttcttttggcttaggattgacttggcgatgtgggttcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttggagaggtccttcacatcccttgtaagttggattcctaggtattttattctctttgaagcaattgtgaatgggagttcactcatgatttggctctctgtttgtctgttgttggtgtataagaatgcttgtgatttttgtacattgactttgtatcctgagactttgctgaagttgcttatcagcttaaggagattttgggctgagacaatggggttttctagatatacaattatgttgtctgcaaagagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttctgcccattcagtatgatattggctgtgggtttgtcatagatagctcttattattttgaaatacgtcccatcaatacctaatttactgagagtttttagcatggagggttgttgaattttgtcaaaggctttttctgcatctgttgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgtcagtattttattgaggatttttgcatcaatgttcatcaaagatatgggtctaaaattctctttttttgctgtgtctctgcctggctttggtatcagaatgatgctggcctcataaaatgagttagggaggattccctctttttctattgattggaatagtttcagaaggaatggtactagttcctccttgtacctctggtagaattcggctgtgaatccatctggtcctggactctttttggttggtaagctattgattattgccacaatttcagctcctgttattggtctattcagagattcaacttcttcctggtttagtcttcagagagtgtatgtgtccaggaatttatccatttcttctagattttctagtttatttgcatagagatgtttgtagtattctctgatggtagtttgtatttctgtgggatcggtggtgatatcccctttatcattttttattgcatctattcgattcttctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacaaactgctttgaatgcgtcccagagattctggtatgttgtgtctttgttctcgttggtttcaaagaacatctttatttctgccttcatttcgttgtgtacccagtagtcattcaggagcaggttgttcagtttccatgtagttgagcggttttgagtgagattcttaatcctgagttccagtttgattgcactgtggtctgagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatttaatggccttctttgtctcttttgatctttgttggtttaaagtctgttttatccgagactaggattgcaacccctgccttttttttgttttccatttgcttggtagatcttcctccatccttttattttgagcctatgtgcgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaaatcccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaaatcagacgtagattttggtcttttcacatagtcccatatttcttggaggctttgctcatttctttttattcttttttctctaaacttcccttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgactttggtttgaatgtcctcccgtagctcagagtaatttgatcgtctgaagccttcttctctcagctcgtcaaagtcattctccatccaggtttgttccgttgctggtgaggaactgcgttcctttggaggaggagaggcgctctgctttttagagtttccagtttttctgttgtgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctgggggggtgcctcccagttaggctgcttgggggtcaggggtcagggacccacttgaggaggcagtctgcctgttctcagatctccagctgcatgctgggataaccactgctctcttcaaagctgtcagacagggacatttaagtctgcagaggttactgctgtctttttgtttgtctgtgccctgcccccagaggtggagcctacagagacaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatctgtgagactccgtgggcgtaggaccctccgagccaggtgcaggatataatctcgtggtgtgccgttttttaagcccgttggaaaagcgcagtatttgggtgggagtgacctgattttccaggtgccgtccgtcacccctttctttgactcaggaagggaactccctgaccccttgcgcttcccaagtgaggcaatgcctcgccctgccttggctcgcacacggtgtgcgcacccactgacctgcgcccactgtctggcactccctagtgagatgaacccggtacctcagatggaaatgcagaaatcacccgtcttctgtgtcgctcacgctgggagctgtagaccggagctgttcctattcggccatcttggctcccagcgggattcttaatattcatattcaaaccctatattctaaaccttcttgtaaaatttatctcttcttgcctagaagctattaaactccaaatggtgctgcagatggaaccacacatggacatgcctttcttccaagaacctttagatcaactccagaaggagccttagctgctgttccccacatgatgcccctcttcagcaggaagtagccagaaagagttgtcctccaatacccctaccagctgtagtgtttccactcctcaggggggaaatatgatacagggggtagaaagaaattattaaggcagatagtgagggtaaaagagtcctcagcagagcttcccttttaacaaaacgcagtacaagaaattatttttttccagccaggcacggtagcttatgcctgtaatcgcagcactttgggaggctgaggcaggcagatcatttgaggtcaggagtttgagaccagcctgggctaacatggtgaaaccccatctttactaaaaatacaaaaattagctaggtgtgttggggcacacctgtaattccagctactcagggggctgaggcaggagaatcacttgaacccactgcactccatcctgggtgacaaagcattactctgtctcaaaaaaaaaattatttttttccaacaaagagaagcctgaaaaatcaagctgcaaacatagataagcgagctggaatcttgcacaggggaatgtcagcagctgtgtcaatagaaaagggctacctgtgggccaggcatgtccaacatagaggctccatcttccctttttttgtttgttaccacatgtacagtaaaggaatgggcagtgtggcacaggccaggcagaggacccacctgcataataaaatttggttaggggtgaccagcttttcataccctatgcaaatggcacagctattcctaaccagtttttagtgtctatgcacacctggtctaatcaatcttttgcaccctatgtaaatcagaaactgcctcctcaccaggcacctataaaaacccctgcatttcactgcagatccagcaacttatttctctaggacccctctctctagcagggagctattctttctttcacctattaaacttacgctctcttaaactcactctttgtgtgtccatatcctttatttccttggccatgagacaatgaaccttaggtatcaccctagacaacagggctgcttcaataccagaatctctgggacacagctaaggtagtgttaagagggaaatttatagcattaaatacccacatcaaaaagttagaaagatctcaaattaacaacctaatatcacaactagagaaactaaagaaacaagaggaaaccaaccccaaagcaagcaaaaaacaagaaataaccaaaatcacagctgaactgaagaaaatttagatgcaaaaaactattcaaaagatccacagcctggatatggtggctaatgcctgtaatcccagcaatttgggaggctgaggtgggatggtttcttgagctcaggagtttgagaccagcctgggcaacacagtgagaccttgtctctacaaaatatcaaaaaattagctgggtatgatgaagtgcacctatagttccagctacttgggaggctgaggtgggaggattgcttgagtatgggaggttgaggctgctgtgaactgagatcacgcaactgcgctccagcctgggtgacagagtgagaccctgtctcaaagaagagaaaaaagatcaacaaatacaggagttgtttttttgaaaaagttaatgagatagagactgctagctagattaataaaagaaagacagaagatacaaataaaaacaattagatatgacaaaggggatgttaccactgaccccacagaattacaaaaaacatcagagactactacgaacatacgaggtataaaacctagaagaaatggataaatccatggacacatacaaccacccaagactgaaccaggaagaaactgaatccctgaatagaccaataacaagttctgaaactgaatcagtaataaaaagcctgccaaccaaaaaaagcccaggacaagacagagtcatagccaaattctatcaggtgtataaagaactggtaccattcctattgaaactattccaaaaattgaggaaggactcctccctaactcattctttgaggccagcatcatcctgataccaaaacccaccagagacacaacaacaacaacaaaatttcaggccaatatccttgatgaacatagatgcaaaaatcctcaaaaaaatactggcaaatcaaatccagcagcacatcaaaaagtttatccaccatgatcaagtaggctttattcctgggatgcaaggttggttcaacatatgcaaatcaataaatgtgatttatcacataaacagaactaaaaacaaaaaccacatgatcatcttaataaatgcagaaaatgcttttgataaaattcaacatcattcatgtttaaacctctcaataaactaggcatttaaggaataaaccttaaaataataagagccatctatgagaaacccattgccaacatcatgctgaatgggcaaaagctggaagcattccccttgagaactggaacaagacaggatgcccactctcaccactcctatttgatatagcactgcaagtcctagccagagcaatcaggcaggagaaagaaatgagaggcctccacataggaagagaggaagtcagactatctctgtttgcaaacaatgtgattctacacctaggaaacgccatagtctctgcccaaaagctcctagatctgataaacaacttcagcaaagtttcaggatacaaaatcaatgtacaaaattcaatagcatttttatacaccaacaacctccaaactgaaagccaaatcaagaacacaatcctgtccacaatagccacaaaaagaataacatacctaggaatacagctacgaggaaggtgaaagagctctacaacaagagttataaaacacggcttaaaaaaaaaaatcagaaatgacacaaacaaatggaaaaacattccatgcccgtgataggaggaatcaatactgttaaactggccatattgcccaaagcaatttatagattcaatgctattcctatcaaactaccaatgccattcttcaccaaattagaaaaaagtatttaaaaatttataaataacctttaaaaaaagcctgaatagccaaggaagtcctaagcaaaaagaacagagctggaggcattatgttacccaacttaaaactatactacaaggctacagtaaccaaaacagcatggtactggcacaagaacagatacataggccaatggaacaggttagagaggccagaaataatgccacacgcctacaaccatctgatctttgacaaagttgatgaacataaacaacaggaaaagattccctattcaatcaatgatgctgagataactggccagccatatgcagaagattgaaactgaaccccttccttacaccatctacaaaaacaaactcaggatgcattaaagacttaaatgtaaaacctaaaattataaaaattctggaagatagatagcctaggaaatacacttctggacataggactgggcaaagagtccatgacaaagatgcctaaagcaaatgtgacagaaacagtaattgacaaatgagacccaattaaactaaagggcttttgcctagcaaaggaaactatcaacagagtaaacagataaagtatagaatcagagaaaatattttcaaactatgtaaccaacaaaggtctactatccagaatctataaggtacttaaatttataagcaaaaaaccaccccattaaaaagtaggcaaacgacatgaacagatacttttcaaaagaagacatagtggggtggagccaagatggccaaataggaacagctccagtctacagctcccagcatgagcgacgcagaacacaggtgatttctgcatttccaactgaggtacggggttcatctcactggggagtgtcggaaagtgggtgcaggacagtgggtgcagcgcaccgagtgtgagccaaagcagggcgaggcattgcctcacccaggtagcgcaaggggtcagggaattccctttcctactcaaagaaaggggtgacagacggcacctggaaaatcgggtcactcccaccctaatactgcgcttttccaacagtcttagcaaacggcacaccaagagattatatcccgcacctggcttggaggatcctaggcccaaggagcctcactcattgctagcacagcagtctgatatcaaactgcaatggggcagtgagtctgggggaggggcacccgccattgccgaggcttgagtaggtaaacaaggcagccaggaagctcgaactgggtagagcccgccgcaactcaaggaggcctgcctgcctctgtagactccacctctgagggcaggacattgccaaacaaaaggcagcagaatcctccgcagacttaaatgtccgtgtctgacagctttgaagagagtggtggttctcccagcatgcagctggagatctgagaatggacagactgcctcctcaagtgggtccctgacccccgagtagcctaactgggaggcaccccccagtaggggcagactgacacctcacatggccaggtactcctcagagacaaaacttccagaggaacgatcaagcagcaacatctgctgttcaccaatatctgctgttctgcagcctccaccgctgatacccaggcaaacagggtctagagtggacctccagcaaactccaacagacctgcagcttagggtcctgactgttagaaggaaaactaacagaaaggacatccacatcaaaaccccatctgtacgtcaccatcatcaaaggccaaaggtagataaaaccacaaagatggggaaaaaacagagcagaaaaactggaaactctaaaaatcagaatgcctctcctcctccaaaggaatgcagctcctcaccagcaacggaacaaagctggatggagaatgactttgacgagttgagagaagaaggcttcggacgatcgaactactccaagctaaaggaggaagttcgaacccatggcaaagaagttaaaaaccttgaaaaagaattagacgaatgactaactagaataaccaatgcagagaagtccttaaaggacctgatggagctgaaaaccatggcacgagaactacgtgatgaatgcacaagcctatttgatcaactggaagaaagggtatcagtgatggaagatcaaatgaatgaaatgaagcgagaagagaaactgagagaaaaaagaataaaaagaaacaaagcctccaagaaatatgggactatgtgaaaagaccaaatctacgtctgattggtgtacctgaaagttacggggagaatggaacaagttggaaaacactctgcaggatattatccaggagaacttccccaacctagcaaggcaggccaacattcaaattcaggaaatacacagaacgccacaaagatactcctcgagaagagcaactccaagatacataattgtcagattcaccaaagttgaaatgaaggaaaaaatgttaggggcagccagagagaaaggtcgggttaccctcaaagggaagcccatcagactaacagctgatctcttgacagaaactctacaagccagaagagagtgggggccaatattcaacattcttaaagaaaagaattttcaacccagaatttcatatccagccaaactaagcttcctaagtgaaggagaaataaaatcctttacagacaagcaaatgctgagagattttgtcaccaccaggcctgcctaaaagagctcctgaaggaagcactaaacatggaaaggaacaaccagtaccagccactgcaaaaacatgccaaattgtaaagactatcgaggctaggaagaaactgcatcaactaacgagcaaaataaccagctaacatcataatgacaggatcaaattcacacataacaatattaaccttaagtgtcaatgggctaaatgctccaattaaaagacacagactggcaaattcgataaagagtcaagaaccatcagtgtgctgtgttcaggaaatccatctcatgtgcagagacacacataggctcaaaataaagggatggaggaagatctaccaagcaagtggaaaacaaaaaaaggcaggggttgcaattctagtctctgataaaacagactttaaaccaacaaagatcaaaggagacgaaggccattacataatggtaaagggatcaattcaacaagaagagctaactatcctaaatatatatgcacccaatacaggagcacccagattcataaagcaagtgcttagagacctacaaagagacttagactcccacacaataataatgggagactttaacaccccactgtcaacattaaacagatcaatgagacagaaagttaacaaggatatccaggaattgaacttagctctgcaccaagcagacctaatagacatctacagaactctccaccccaaatcaacagaatatacattcttctcagcatcacaccacacttatttcaaaattgaccacacagttggaagtaaagcactcatcagcaaatgtaaaagaacagaaattataacaaactgtctctcagaccacagtgcagtcaaactagaactcaggattaagaaactcactcaaacccgctcaactacatggaaactgaacaacctgctcctgaatgactactgggtacacaacgaaatgaaggcagaaataaagatgttctttaaaaccaatgagaacaaagacacaacataccagaatccctgggacacattcaaagcagtgtgtagagggaaatttatagcactaaatgcccacaagagaaagcaggaaatatctaaaattgacaccctaacatcacaattaaaagaactagagaagcaagagcaaacacattcaaaagctagcagaaggcaagaaataactaagatcagagcagaactgaaggaaatagagacacaaaaaacccttcaaaaaaatcaatgaatccaggagctggtgttttgaaaagatcaacaaaattgatagaccgctagcaagactaataaagaagaaaagagagaagaatcaaatagatgcaataaaaagtgataaaggggatatcaccactgatcccacagaaatacaaactaccatcagagaatactataaacacctctatgcaaataaactagaaaatctagaagaaatggataaattcctcaacacatacaccctcccaaggctaaaccaggaagaagttgaatctctgaatagaccaataacaggagctgaaattgagacaataattaatagcttaccaaccaaaaaacgtccaggaccagatggattcacagctgaattctactagaggtacaaggaggagctggtaccattccttctgaaactattccaatcaatagaaaaagagggaatcctccctaattcattttatgaggccagcatcatcctgataccaaagcctggcagagacacaacaaaaaaagagtattttagaccaatatccctgatgaacattgatgcaaaaatcctcaataaaatactggcaaaccgaatccagcagcacatcaaaaagcttatccaccacgatgaagtgggcttcatccctgggatgcaaggctggttcaacatatgcaaatcaataaacataatccaacatataaacagaaccaatgacaaaaaccatatgattatctcaatagatgcagaaaaggcctttgacaaaattcaacagcccttcatgctaaaaactctcaataaattaggtattgattggacatatctgaaaatagtaagagctatttatgacaaacccacagccaatatcatactgaatgggcagaaactggaagcatcccctttgaaaactggcacaagacagggaagccctctctcaccactcctattcaacatagtgttggaagttctggccagggcaatcaggcaggagaaggaaataaagggtattcaatcaagaaaagaggaagtcaaattgtccctgtttgcagatgacatgactgtgtatctagaaaaccccattgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagcaatgtgaaggacctcttcaaggagaactacaaaccactgctcaatgaaataaaagaggatacaaacaaatggaagaaccttccatgctcatggataggaagaatcagtattatgaaaatggccatactgcccaaggtaatttatagattcaatgccatctgcatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactgtactacaaggctacagtaaccaaaacagcatggtaccggtaccaaaacagagatatagaccaatggaacagaacagagccctcagaaataacgctgcatatctacaaccatctgatctttgacaaacctgacaaaaacaagaaatggggaaatgattccctatttaataagtggtgccgggaaaactgcctagccatatgtagaaagctgaaactggatcccgtccttaccccttatacaaaaattaattcaagatggattaaagacttaaatgttagacctaaaaccataaaagccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaataaactaccatcagagtgaacaggcaacctacagaatgggagaacatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccgttgtggaagtcagtgtggcaattcctcagggatctagaactagaaataccatttgacccagaaatcccattactgggtatatacccaaaggattataagtcatgctgctgtaaagacacatgcacatgtatgtttattgtggcactattcacaatagcaaagacttggaaccaacccaaatgtccaacaatgacagactggattaagaaaatgtgccacatatacaccatggaatactatgcagccataaaaaatgatgagttcatgtcctttgtagggacatgtatgaagctggaaatcatcattctcagcaaactatctcaaggacagaaaaccaaacactgcatgttctcactcataggtgggaattgaacaatgagaacacatggacacaggaagggaacatcacacactggggcctgttgtggggtgggggagggggagggatagcatttggagttatacctaacattaaatgatgagctgctgggtgcagcacaccaacatggcacatgtatatatatgtaactaacctgcacgttgtgcacatgtaccctaaaacttgaagtataataaaaaataaaaataaataaaaaaataaagacttcaaaagaaaaaaaaaaggagacatacatcctgccaataagcatatgaaaaaatgctcaacatcactaatcattagaaaaatgcaaatcaaaaccataatgagatattaatatcatgtacgccagtcagaattactattatgaaaatgtcaaaaaaacaacagatgctgtcaaagttgtggagtaaagggaaggcttatacactgctggtggaaatataaattagttcagccattgtggaaagcagttttgcaacttctgaaagaacttaaaaacagaattactattggatccagcaataccactattgggtatatacccaaagggatataaatcaatctattacaaagatatatgcacatgtatgttcaccgcagcactattcacaataacaaagacatggaatcaacctaaataccaatcaatggtagactggatgaagaaaatgtacatattttggtgtgatacatatacaccatggaatactatgtagccataaaaaaagaatgaaatcatgtcctttgcagaaacacagatgagctggagaccattatcctaagaaaattaacacaggaatagaaaaccaagtactgaatgttctcacttgtaagtgggagctaaacatcaagtacatattaacacaaagaaaagaaaaacaggcaccaggatctacttgagggtagagggtgggtaaagggtgaggactgaagaactacctgtccagtactattcttattacctgggtgatgagataatctgtacatcaaaccccccatgacatgcaatttacctatataatgaacttgtacatgtaccccatgttagtccgttctcacattgctataagaactgcctgagactgagtaatttataaagaaaattgactcacagttctgtatggcttaggaggcctcaggaaacttacaatcatggcagaaagcgagggggaggcaggcaccttcttcacaaggtggcaggtgagagaatgaatgaagaagaaacttgccaaacacttaacataactatcagatctaatgagaactcactatcatgagaacaacatggggagaactgccaccatgatccaatgacttcccactgggtggggattatggggattacaattaattcaagatgagatttgagtggagacacagccaaaccatatcaacccttgaacccaaaataaaagattaaaaaatcaagattttctcttaaaaatgtcatctatactattatagataaaattaacataggtagtaataaaagaagatataaaactgtccagggatatgaaataccaattcatagaagtagaaaaccaaatagctaagtaaatggagaatgcttaacactgaccgcagacagaaaagtgcacattaaaacaaatatcagtaaccaaagagggcagagcaagatggcagaatagaagcctacaccatttgtccccccgtcccctaaacaccaaattttaacagttatctacacactgaatagcactatcacaagaacaaaaacgcaggtgagcaattacagtaactggttttaacttcacatcactgaaagaggtattgaggagggcaggagagacagtcttaaatcatcaatgccactcctcctccatcccctggcagaagccatgtggtgcagagacagaatctgtgcattttgcggatggagagcacagcaaccgagggaccttacattgaactccgtgctgccctgtcacagcagagaataaagccatgctgggctcagctggtgctggtgcacagaggcagaatttggactagcccctagccagaggggaatcacccatctcagctgttggaactgaagtttcttggccagccttgccaccattggctgaagtgcaatggagttctagataaacttgaaaggcaatctaggacacaagagctgtaattcttaggcaactcctagtgttaggctgggcttagagtcagtgaactagggtggcacatgacctagagagacaccagctggcgcagctaagggagtgcttgtgccacccctcccctaaccccaggcagtgcagttcacagcaagaaaagtgtctccttccttctacttaaggagaggagagctagtaaagaagatttcgtcttgtatcttggataccagcttaggcacaggatagggcactgggaagacttgtgaggcctcattccaggccctagttcttaaacatttctaaacacactcttggccaaaagggaaaactgctttcaagggaaggactcagtcctggcaggattcatcacatggcccttgataaccctagctccctgacaacatttctaaacacaccctgggccaaaagggaacctgctgctttgaagggaaggacctagtactggcaagattcatcccctgttgactaaagagcccttcggccctgaataaccagcagcaatactgagggagtacactatgggccttaaggcctgagatgtcctggcttcaggggtgatggagcacatttccagatgtagtggctatggtgaaagactcaaacagaagtttgagaaaagcagagggaaaagtaaaagagagtttgtcttgcaccattggcactggctcggccacagtaaggtaaagcaacaagcagcctcttaaggtctctgagtccagacctaggttcctggacagcatttctgggcccactctgggcaagagaggagttcactgctctgaagggtgagtcccaggcctggtagcatttaccacaacctgtgggaagatcccttgggctttaagcaaatattgtcagtggcctggcagaaacccccatgaactggtggtggtagccacagagaggctcctctgcctgtggaaaggggagggaagcgtgggaaggactttgtactatggtttgagtgccagcttagctgcagtagaatagaatatcgtgtaaattgctaaggtgcttgactccactcgctggctcccagacagcatctctggacacacccagggcctggggaaacttgccaacctgaagggaagggcactgggcaaagcccagtgctgtgttggcttcgggtctgacacagcaccagtggtgggggccacaggggtgcttgcatcaccgcaccctcagtttcagatggcttggaaaagagagagattccatatgtttggcagaaagtaagggaaaagaacaagagtctccgcctggtaatccagagaattcttccagatcttacctaagacaaccaagatggtgcatgtacaagtttgcaaaaatcacagcattattgggcttggggtccaagtcccttcaaatacctggaaagccttcccaagaaggacaagcacaaataagcccagattatgatgactacagtaaatcaccagagacatttaagagtgtcaacatgatccaggaaaacatgacctcaccaaatgaactaaataaggcaccagggaccaatcctggagaaacagagatgtatgacctttcagacagagaattcaaaacagctattttgaggaaactcaaagaaattcaagataacacaaagaaggaattcagaattctatcagataaatttaacaaacagatcgaaataattaaaaagaatcaagcagaaattctagagctgaaaaatgtaattgatatactaaagaatgcatcagtctcttgagagcagaaaggatcaagcagaagaattagtgagctcaacagactatttgaaaataccagagaagacaaaagaaaaaagaataaaaaaacagtgaagtatgcctaccagatccagaaaatagccttaaaaagcacaaatctaatggccttaaagaggaggtagaacatgagatagggatagaaagtttattcaaatggataatatcagagaacttcccaaacctagagaaagataccaacattcaagcataagaaagttatagaacaccaagtagatttaagcctaagaagcctacttcaaggcatttaatcaaattcccaaaggtcaaggatcctaaaagcagtaagagataagaaacaacatacaatggagcaccaatatatctggcaggaggcttttcagtggaaaccttacaggccaggagagagtggcatgacatatttaaactgctaaaaaaaaaaaaaaaagaaaaaaaaaaactttaaccccagaatagtagatccagtgaaaatattctttaagcatgaaggagaaataaaaacctttccagacaaacaaaagctgagggatttcattaacacaagatatgtcctacaagaaatgcaaaaggaagttcttcagtctcaataaaggatgttaatgagcaagaagaaatcatctgaaggtccaaaactcactggtaatactaagcacacagaaaaacacaaaatagcataattctgtagtggtcatgtgtaaacttctcttgacttaagtagaaaggctaaatgatgaaccaataaaaaataataattacaacaacttttcaagacatagtataataagacataaatagaaacaacaaaaagttagtaagttgggggacaaagttaaagtgttgagtttttgttagttttcttttgacatgtttgtttgtgcaatcagtgttaagttgtcatcagtttaaaataacgggttataagatagtatttgcaagccttatggcaacctcaaatcaaaaaatatacgatggatacacaaaaaataaaatgcaagaaattaaaacatattaccagagaaaatcaccttcagtaaaaggaagacaagagggaaagaaggaagagaagaccataaaacaacaagaaaatacaacaaaatggcaggagtaagtccctgcttaatagtaacattaaatgtaaataactaaactctccaataaagacaaggtagctaaatggatgtaaaaacaagacccagtaatttgctgcctacaagaaacacacctcatctaaaaagatacacatagactaaaaataaagggatggaaaaagatattccatgcaagtggaaaccaaaaaggggaaggaatagctatacttatatcagacaaaatagatttcaagacaaaaactttaagaagataattaaaaaaacaaagaagataattatataatgataaaggggtcaattcagcaagaagatatactgattacaaatatatatgcacccaccactggagcacccagatatataaagcaagtattattggagatagaatccaacacagtaatagctggagacttcaacaccccactttcagcattggacagatctcccagacagaaaatcaacaaagaaacactggacttaatctgcatcatagaaaaaatggacttaacagatatttacagaacatttcatccagtggcttcagaatacacatttttatcctcagcacatggatcattttcaagtatagaccatatgttaggtcacaaaacaagtcttaaaacatttttaaaaaatcttgaaataatatcaaacatcttctctgaccataatggaataaaattagaaatcaatgataagaggaattttggaaactatacaaacacatagaaattaaacaatatgctactaaatgacccatggatcaatgaagaaattaagatggaaattttaaaattttcttgaaacaaatgataatggacacaacataccaaaacatataagatacagcaaaaacagtactaataggaaaatttatagctccaagtgcctacataaaaaactagaaaaacttcaaataaataacctaatgatgcatcttaaagaactagagaagcaagagcaaaccaaacccaaaagtagtagaagaaaagagataataaatatctgagcacaaataaatgaatttgaaatgaggcaaacactacacaagaccaatgaaacaaaaagttggttttttgaaaagataaacaaaattcagtaacctttagttaggctaagaaaaaaacagaagacccaaataaataaaatcagagataaaaaaggagatattacagctgttactgaagaaattcagaggatcataagtggctactatgaacaactatatgccaataaattggaaaatctagaagaaatggataaattctagacatatacaatctaccaagattgaactatgaggaaattcaaaacctaaacagaccattaacaagtaacgtgattgaaaccataataaaaagtctcccagtaaagaaaagcctgagacatcatggcttcactgctgaattctaccaaacatttaaagaactaataccaatcctattcaaactgttcggaaagataaaggaggagggaatacttccaaactcattctatgaggccagcattaccctgataccaaaaccagacaaacacacattaaaaaaaataataatactgaccagcctggccatcatggtgaaaccctgtctctactaaaaatacaaaaaattagccaggcgtggtggcagacacctgtaatcccagctatttggcaggctgaggcaggagaatctcttgaacccaggaggcggaggttgcagtgagccgagaaaccgccactgcactccagcctgggcaataaaagcgaaactctgtctcaaaaaaatcaataaaataaataaataaaataataataataatacaggccaatatatctgatgaatattgatgcagaaatcctcaacaaaatactagcaaaacaaattcaacagtatattaagaagatcattcatcggccaggcgcagtggctcatgcctgtaatcccagcactttgggaggccaaggtgggcggatcacctgaggtcgggagttcaagaccagcctgatcaacatggagaaaccccatgtctactgaaaatacaaaattagccaggcatggtggcatatgcctgtaatcccagctacttgggaggctgaggcaggagaatcacttgaacctgggaggtggaggctgcggtgagccaagatcgtgccattgcactccagccttggcaacaagagtgaaactccatctcaagaaaaaaaaaaaatcattaattatggccaagtgggatttatcccagggatgcaaggatgtttcaacacacacaaatcaatcaatgtgatacatcacatcaacagaatgaaggactaaaaccatatgatcatttcaattgatgctgaaaaagcatttgatatagttcaacatcccttcataataaaaaccctcaaaaaactaggtatagaagaaccacacctcaacatattaaaagctatatatgacagacacatagttagtatcgtactaaatggggaaaaactgaaagcctttcctcttatatgtggaacatgacaaggatacccacttttaccaccattattcaactgattactggaagtcttagctacagcaatcaaagagaaagaaataaaggggatccaaaccggaagggaggaagttgaattatccctgtttgcagatgatatgatcttatattggaaaaacctaaagactccaccaaaaaatgattagaactgataagcagattcagtaaagtttcaggactcgaagtcaacatacaaaattggtagcatttctatatgccaacagtgaacaatctgaaaaagaaataaaaaaggaatcccatttacaatagccaccaataaaatacctaggaattaaccaaagaagtaaaagatctctacaataaaaactataaaacaccaatgaaagaaattgaaaaggacacataaaaatggaaagatatcccatgttcatggattggaggaatcaatattgttaaaatgtccacagtactgaaagcattctagagattcaatacaatccctacaaaataccaatgacattcttcacagaaatagaaaaaaactatcttaaaatttatatggaaccacaaaagacccagaatggccaaatctatcctgagcaaaaagaacaaaactagaggaatcacattacctgacttcaaattatactataaagctacagtaaccaaaacagtatggtactggcataaaaatggacacacagaccaatggaacagaatagagaacctagaaataaatccacacacctacagtaaaccgattttcgacaagggtgccaagaacacacattggggaaaagacagtctcttcaataaatggttctgggataagaggatatccatatgcagaagaattaaacttgactccatctcttgccttttatttgaattaaatataagacctcaaactgtgaaacacctacaagaaaacattgaggaaactttccaggacactggtctgggcaaaattttcttgagtagtaatatctcacaagcacaggcaaccaaagcaaaaatagacaaatgggatcacatcaagttaaaaagcttctgtacaacaaaggaaataatcaacaaagagacaacccacagaatgggagaaaacatgtgcaaactacccatctgacaagggattaataatcagaatatataaggagctcaaacaactccacagggaaaaatctaataatctgactaaaaaatgggcaaaagatctgaataaacatttttcaaaagaagtcattcaaatggaaaacagcatatcaaaaggttcttaacatcactgaccatcagagaaatgcaaatcaaaactacaatgagatatcatctcaccctagttaaaatggctgttatccaaaagtcaggcaataacaaatgctggtgaggatgtggagaaaagggaaccctcatacactgttgctgggaatgtaaattagcacaaccactatgaagaacagtttggaagttcctcacaaaactaaaaatacagctaccatatgatccagcaatcccaatgctgagtatatacccaaaagaagggaaatcggtatatcagagagatatctgcactcttatgtttgttgcagcagtgttcacaatagccaagatttggaagcaacctacgcatccatcaacagatgaatggataaagaaaatgtggtacatatatacaatggagtactattcggccattaaaaagaatgagattctatcatttgcaagaacgtggatggaactggaggtccctatgttaagtgaaataagccaggcacagaaggacaaaaattgcatattctcacttatttgtgggatctgaaaatcaaaacaattgaactcatggacacagagagtagaaagatggttaccagaggctgggaaggatagtgggggcctgggggagaggtggggatggttaattgatacaaaaaaaatagaatgaataagacctagtatttggtagcacaacagggggactatagtcaataatactttaatttaattgtacatttaaaaataactaaaagagtatattacatgcctataccaaaatatctcatgtgccccataaatatgtacatctactatgtacccacaaaaattataaattaaaaagtttttaaagataaatatcactttacacctacccagaataataaaacttagaaaaactataaagtaagataataccaagtattgataaggacataggaagacaagaacccttatgtactacttgtgtgagtgtacactgaagcaactattttgaagaacaatcaggtggcaatttttaaaactacatatacatatactctgtcatccatcaatcccacttctgggtaaatactccaggaaaaccctggcacagtggtatatgcaaaagatgttcacaaggttgttcattgtagcaccatttgtagtaagagagttataagcaacctaagtgttcatcagtaagggaagagatgtgtgaaatgtgtttagagcatatattgtagaatactctgcattagttaaaagtcagtaactaggctgggcgcggtggctcacgcctgtaatcccaacactttgggaggctgaggcaggcagatcatgaggtcaggagatcgagaccatcctggctaacatgatgaaaccctgtctccactaaaaatacaaaaaattagccgggcatggtggcgggcgcttgtagtcccaggaactcaagaggctgaggcaggagaatggcgagaacccaggaggcagagcttgcagtgagcggagatcgcaccattgcactccagcctgggcaacagcgtgagactccgtctcaaaaaaataaaataaaaagccaataactagatggacatatggcaagaaggaaaggtcttaaaaacaatgttgactgaaaaaatcaagtaacagaaagagctcaagaccatattaccattatgtaaattacaaacacattacacacaaaataatatatattttacaaagataaatacatatatgcaggaaaatatatccaagataaaagtagacatttatatgaaaacaggaaatgggagtaggaattaaggatgaaagaaaaaaaataagagggtaagaagaactttgaagagattaaaaattatactgtattaggacctgagttgtattgtaaacagaagtctctgctcctaagttatacatatgtacacatgataaagaacctaagaatgaggttcaatctttcagtctaaagaatcattggtatataattttaaaaattaaaaccaatctaaattattgttagagtttattacattatgggaagtgatgggagtagggtggcatagatagatgcatattaaaattttcttattaaaaaagaagacatgtatttggttgattctaggtgttgatagacaaaagtgagttttaaaatgtgaattaaaagttttagggtaatagccaggtgcagtggtcccagctacttgggaggctgaggcaggaggatcacttgagccccagagttcaacaatacagtttgagcacgatcgtgtaaccgcacttcagcctggggtgatagggtgagactctgtctctaaaaagaaaaaaaaaaaagttttagggtaaccattagagatacagacatgagatttcttgctttaaacaattagtgaaaagattggaattgaaagaaaacttagtgctcacaagaagaaaaaaaagaaaaagcataggtaaatagaaaacacactaatggtagaaataaggtgaaatgtatcaataatcaccatgtgagttaaattcttctatgaaaaaagactcattaagaatcatataagcaaaaatatgcagtactatattgtttttaagatatcctaaaataaatattcatatcaaacaaaatagaggcccaagtcaaaaccaaaattatttatctacctgggatattttacaacgattaaaatacacaacctaccaagataaaagtcacaaacctaataacagagaaccaaaccaacttcacagtaaaaaaaaaaaaaaaaaaagccagaaatgcaaggagatactgacaaatctacaacagtggggacagactttaatatacctatttccaaagttaacaaaccaagcagacagaaaattattttagggagaatctgaataacataattgtgccctttattaagttgttactattattatttgtagagacagggtctcactctgctgccaggctggagagcagtggcgtgatcatagctcactacaggctcaagggatcctcctgcctcagcccccagtagccaggactataggtgcatgccatcacacccagctaattttttaattttttatagagatagggtctcgttctgtcatccaggccagagggcagtggcatgatcatagctcactgcatgcctgaaactcctggcctcaaacaattctccagccttggcctcccaaaataactgccactgtgcccggccagttattagtattatttttaactttgaaatccatctttctttattctgctttagaatgctggagctgaggctctcaaaaccgtatttctgctttgaccgctggtttcctgttagactctgacaatatgggtggtgctaaagggagactgcaaagctggaagaggaaaaaggggcttatctcttcctatctgcttcccatgggtttcctaactgcttgtgcttcctgtgaatgccactggaataatgtggtttttgatttgttttgtttttgctgtagtctagcaagtctttccccagcagtagctgaatctagtttgcagtttttccaacttttataaactagcttcactgtgactcctccacaggcaccagcaccagctggccagtatcctcagagatctgggtctcagctacatgaagcccatcatagctcggagacaccagcagccaagcagcaccgcttccccagaggtctaaatttcaggtgtcaggagcacctcttccaagcttctaaagttgcataatttcaacctcattctacaaagaaaactccaggctcaggtggtctcatggtgaattcttccaaaatttaaggataaaataataatagtatataaactttcctaggaaacagaaataaaacttccaaaacacattttatcaggcaagcataaccttgattataaatcctaacaagaatactgtaacaaaagaaatcaatacaccaacacatctcccaaacatagatgcaaacatccttgacaaagaatcagcaaattcaattcgtgatattcaccatgaccaagtgagactttcagaataaactctcagaagtgtatttccaccatgagggtagaatttctgggacaaggggtgtcactcacctgtccggtcaacatcctttttcatgggcagtacagtataatccagttgctcatctgagtcctcaagcatccttggcttggactgcagcatgaattggggctctttatggggacttcccctgcctccattccagtctactgactcgtcatagagctgaacttgctgtaggtatgggatcctgataatcctgttttcatccaagcttaacttcttcagtcttcaattaaggaaagtgaatatagaatcatagcaataatgatacctcaggattgtttaccaagcaactttagggaaaaaacatggaatcaggcttggatacttattcctcttgtgtgacgttgagccggtgacttactctctctgggattcaatatccctgtctctaaaatggggataatatttattaacctttcagggttcttgtgaagatttaatgaggcaatatgtaaatggcctggcacaaagtagtattcagtaaatggtagttgaaaccaaagtaaattttccagagaagtaaagcttaacaatgtaaatgccactattttctttacttcagttagaattcaggaattaaatttctctttctgattctcaatattttaaaaaattttcctgtctctactgtcagggtccgaatcctatcttgggtaaaatctcctcctgttttcctttctctttgctgcttctaattcagtcatgtgatcagaaatgtcctcactcatggccatttttatggaggagccaaagctcagaggggagaaatgacttacccatggccacacagtagagataaattgtggagctaggctttaaacccaaaccttttggcttccagaacagcactcagagtgtgagcaagcctggggattagaggaggcccagcagagaaaggcttatggctttacctcctgagcccagccaggctggcaaagcaactggggttggagagtctgttgtcatccagcatcagtgtctccagcgctgggaacctcaggatgtacctcttgcttgtcagcgatgttacagatgcctccctgtgagtgcaaagatcttgggtaatgagcaaggtcgagggacaaattccaccattcccaggaagccatggaggacagggaatcaattaggaggactaaccagcttaggaacggttctagtgcccaaaagaggtccccatagggatgcacagaaagtataattccttccccaccttctcctttcccaaacactattatacataccatattgtcttctgtatggagaaaggttacacacatcattgaaaccaggttagggcaggatgggggattgtataggtagtgcttatagaaaatgccaggtgaaagaggcatgaccaagctggagggagcattctgcagatcactgcacaattttgactcaggaagactccttgttatgctgtgtcacctagtagactggtaactgggagcaccaggagacaatgcccttgttatagaccacagctttgccacctagtagggtaaagtagggtgggttgagggcaccacccctggctgcagtgaggctctcttctcaagtggcttcataaaatgaacacatgagtaaggagtggagaagtttctccttaaactcaaactctctgaagattcccagaaatacctaagagtgagatttatgggggtgatgccctgaattacaggggtgggcaggaagtggtggcattttaagtaccgccattaatgtgacctcacttgtgtcctccaggtagatgagacctaggtaactctcttccacacaggcagatgacacaaataacgttttcattcttccctccatactgtatgccacccacacaccaaaatagtacacataggcacaaatgcatatagtatacacatatataagccacaaacacacacacaactagaggaagggaaacaaacatttctttagcacctaatgcatttctggcattgtgcgatatgttttgtatgtgttatccaaggataggtattatttatctcctttacagattaacaaaatgaagctcagagcaacttgcctgaagtcgcatagctagaaagtgggatgactcaaactagaacctgggtctgcctgactccaaatcccatgccctttccactgccaaatcacacctttcacattcacctctactagccccatgtggattaaagggtggggaaatggaagggggagctgatgcctgagctagagagagcttaacaaaggttggcagtgagttcaaaagctaggacagtaatgtatacctgaagtcagggatatttcacaggtgcatttagagagggtatattctaaatgaatgtattactaattaattcgttcattcacactcatgaatttctttaacatatatttatgtggccaggtactgagactacaaataaaagaacacatccctcccctctaggtggagtaggtggacacgcagcctgtggtgagacaaacaccataaaagaagtatgtggggaaggcgcctattcgggaaaggcaatgtttaagcaaaaccatgaggaatggagagggaattgtcatgcttttaaccaatgtgaaaaagagagaacagggaaaaaaataatctcttcgtggctggatctgtaacataattagtagctataggcagccatgtttcccatcatgaggtctagaaagacacaggcagcccacctgtaaagaaaaatgtggcaagtcacagagaggaggaggtgtgaaagctgagagacagaacttccaggctgctccacggtgctcagggtctatgttcagcatgaccctcaggcacggctgtgagattccccaatgttcttacaatcaattcccccctgcctttttttctgtatcctaacactgacagacttctatagattatgacagttctgactggaaaaagggacaggtcagataaactttcagaaagagacctggcagcactgtagagaacaggcttgaagtccaaagaccagagacacttaacagagaaggcaggaagcttttatacttcataatatttcaaggtcatgagtgtgccctttcctctttctggaaggaccaactttcatacattgaatttttaatctctatctgagctattacagaacagtgcacagcagctgtgttgatttataattgattggccaatcttaattttactctagtgaaatatgaaacagctaagaaataagcctttaaaaaattcctcttaagctccataatgcagaagctggctctgtctcgtctcttgtgacaagttacactacttcgtctttttaaagttctaccctaattatagcatgggaaagtttcattttttgtctctaaaatagacatcttaaaatagaggggcagccatcagatgggtgagaagacagatgtctagcttcagaggaaagcagcaggctttcccaccgagcccctcctgtggcagttttggaagaaaagctcttcaaagtggcaaagtctgtcagtagtggagaagccggggtttccagctgttcagagtggtgctatttttattatcacttctcttgccaaacagaattactactacttaaaatctgagagatttaatgaaagtttttcagaagctaagggtatgtgcagtggttggattcagcaatgggaatttgtgtaccatattagaagatgcatgggaagggtggccaggatccctgagctctggctccggtgctgctgctgctttgcttgctgtgtgacttccggctggtgttgagcatctctgggcctagatcctctatctgtatggtaaagggggatttcttttactttacactgtaagactttcgattaggctaaaaatattgctcaaaagactgaaccaagggctgcaacaaacaagatgaaacttagcaagtacttacattacgacaaatgtcagatcagcttctgtgttaagatacagaacaccaactgtgcaaacacacagaataagggagacatggcttaacaaactgtgtgtgtgtaaaaggggattatgatgtggctactaaaaagctagtgctctttcaggtggcgttatttggaatatagtgactaaaagaaaggaggtaacaattcatcctctgctctgtgctggtcgtgcctgagaacgccgacttgtatggtctgaagcagaaagagagtaggcctaatgaaagagccaaagtagcagattccagctcaaaacaagcaatagagtagtctacgtatagaatgggtcaaatatgattcccctaactcacccagacaaaaaaaatagcaagaaatggagacacaaatagttcagaatagatgaggtatatgatgaatggaaaaagtgaagagaaaggaggatggagaagcaggcagagtcaggccatgaaaagctttgagcgatgttaatggagtttatctttaggatagtgggaacctgctaaaggactttaagcagggcagtgatagaatcacatgtgcatttcagaaagatcactctggctgacagataggaggatgggctgggaggcaagaaactgcagactgggaccaaacaggaggataacagcaatgagcaggtttgagaagaatttagaaagtacaattcacagcacctggtgattgaatgtatgtgtggaatgagggaggccaaaatttgggctaatgctcaggttctagcctggacaactacatagtaggtgggaagaagtgccagtcaatgaggccaggaaaggaaagaaaggaggagagagcgagaaggagggcttaatggcatggggatgtgtgtgaggagtttgataagtaggctaaacaggcttataattcagaagacttgcgaagaggaggccaccaataaagagtataaagataaagaaaaatagtaggttaagggtggatgactggggagcaccaacgtttaagaggctagcagaaaaggaacccacagagcatactgaatctagatagatgagtgggaagaaaataatgacaatggtattggtctggagccccacagctttatttttatttttgtagagataaggtctcactacgttgcccaggctggcctcaaactcctgggctcaaacaatcctcctgcctcagcctcccaaagtgctgggattacaagtgtgagtgaccatgcctggccaacccacagctttcaaagcgtgctgatttcaactgctactctgatgcaggtaggaatacatttattctccccctcatatataagaacatgaaagtgcagggtgggggagacttgccttattttatgtaactaggctttccactgaaaacaactagaatgatgaataaaatataaaaagaaaaaagatccatcattttatttattttcttttgtagagatggggtcttgctatggttgcctaggctggacttgaactcctggcctaaaacgatcttcccaccttggcctcccaagtagctggcactacaggcacacaccaccattccccgtggtggtggatccatcattttaatatgtataagagatgtgaagagagaaaggaagcagtatgccaaatctaaaaacccagagggagaaacttaacataggaagccactcaagccttgagggcatatacttatcctgttgaaactgaactatggtttaacagtatcatggggctagagaatcaaagcccagggtaccctgaaggtggggagtttaatcagagaccctttatatgaatttcggatcctaaagggatacaccctcagggtgaaattaaccaaaactaaacctattctccttatcccatagccaggagaaaactgtcttggagtgaacagagaaagacaaggggaagggcagactggtcctcttgcaaaactgtagcccaaatctgtatcatcagagtgattcagaaaacacccagtcaggaatttagcttaagctgattccatcctgagtgactctaggtaccaaaataaatagaaaggtttatagtgttgcaaactaaataatgtgggaccaactcttccctgagtaaaaaactagaaaacccagacaaaatatacatttaaaaacaatctgccttaagatacctgggaactaacaagctgtgaagaattatggcgctaagatttgaaaaaagaaggaaatccaaaggggttcatgcaacacttttcccctaggactgtctgctgactccagaagtggctgagaggctgagaagttgagcagagattctgacaaccctgctgggccaggggcgaaaattggaatccaaggcatgccacagaatagaagcctgactactcatgctctaagttaggtcattagaaaaccaaaccctcggaggacgtatacactagaaatagtatggacgttgcagagactgaagactagcttcaaataatttcaatttttataattgaattaagatgatttgaaattattagtgatgtagatcaccagaaaacccttgatctggtgggcaaaaagtgatttgagttgtccaaagaaagagccatggcctctcattcagttcctatttacatttaacttaaaactaattaagcttaaataaaattgaacattcagttcctgtatcacactagctacatttcaagtgctcaagagctcaatatgcctagtagctacactatgaacaacacagatatagaacatttccaacactgtagtaagttctactgaacagtgctaaattaggccttgtaaggattactagacagtgtctgcaaattggtgctcatctctggggatatgaaaggcatggtggaccatcactcaaaagtgggggatcataaaggtcagatggaagaatgaaaatttagccaaagtctgtttcacaatggacccagtgaagtcacatatctaccctgaacgtgtaactgaaactgacatactaaacaactggcagaacacccacatttatttactgagcaacaaagtatatagcccattatagtaggaagtgtccaattgaaaccccaggaacttttcttcccaatagtaaaccaaaaacaatactgaatccctgaggtaattgcagagattactgccatcactaaagattaaaaagatggaaggataatgattcctatgacatccctgtttaacatctcttgtttagaagattgttatgtattgtgaagaagatatcctttgtttatttagcttgtacagaaaacaggttttgaagaatgattgtagattcctgtaagcttaatcaagaggtgactcccactttcagctgctattccaggtgtggaatctttttactggagcaaatcaaccaagcccctggcactgtggatacagctaaggacctatcaaatgtttctttctctctctttatcaattaataagaactaccaaaagcagtctgctttcacctgacagggacaacagtacacctttttcctcttctcttggggccatatcaactccgggatcttggttattttgatatcctacagaatatcatactgactggacctggcgagcaggaaaagttgcaaacaccctagatgccttagtaagatacctgtgtgttacaggatggaggtaagccccctcccccatcaaaattcagggtactacgatatggattaattttttgttgttatccaggtatctgaagcatgttgtgatgtacttctaatgtgaaagacataatcctgtaccttgcttcttatttatcttacactacttgtaggaaaaaaatcacaaagtttcactggcctttgtggattttatttttatttattttatttatttattttttgagatggagtctcactctgtcgcctggggttggagtgcagtggtgtgatcttggctcactgaaaccactgcctcccaggttcaagcgattctcctgcttcagtctcccgagtagctgggattacaggcgcccgccaccacatctgactaatttttgtatttttagtagagacagggttttgccacattggccaagctggtctcgaactcctgacctcaagtgatccacctgcctcggcctcccaaagtgttgggattacaggcgtgagccaccgtgcccatcccccttttaaattttagaagtgacataaaatatttggtgctgttctaactcatttactaagtatcccacaaggctgctagttttgagtgaggtccagagcaaggcaaggttctacaacaggtcccaactgtaatgcaagttgctcttccattgggcatatgactcagcaggtccaaatggcttctaaaggactatggcaaataggtgtgctgtacagatagggtaccatacatcctggatttcaatgatagcctgagttttcacctgttatcgccaaataattattactactgtcccttttccctctcatatatgtcctggtttggatgataaagtacatggtcattctatgaatagagccttttctcggtacccatagcagattcatttttgagcaaagttatgccctattctgcagataaccttttttttttttttttgaaaaacaatttcttgcttactagtgcatgttggtagaggccaaatacctgaccacaggatactatgtgatcatgcaacctgagccactcatcatgaactgaacatgcaacagaaatcccccatcaagtgaaagcaatatttgaaatcaggctccagcaagactggaaaagttgcaggaatatatggcttagattcctatggcgcatactcctgctgtactgctacctcttcatcaacccttaactaaggtcctgtggccatctaatataggaagaaaaacctctagcttggtttacaaatgacttagcatgatatgctgataccttctcaaagtcaactattacaatattatagccccacacaggagtgaccaaaaacacaggggaagagaaatcttctaagcaggcagaacttagagcaatgtatctgattggccatttgcttggtcagagagatagccagaaatacagatctatactgattcacgggcagtggctgatggtttagctgaatagtcaaagcttggaaaaaatatgggaaagttgcttaaagtatagagaaaaattatgtgacttaacctctcagaatggatagagtgtgaagaccgtgtctcatatgactgtttccccaagacaatcccctgtggcggagactctcaatggtcaggaagataaggtaacccaatccatgaatgtcagttgccctctttcccttggtggcagggatgaaggctacacacttcctttcaccatagcaaatctggttatgacccttgctgagtactcaacctgccaatggcagaggccactgctgaacccctaatatggcaccgaatttctagagggattatacagctgtctagtatcaagttgactttaaaaagcagcagcaagtttcctttactagattataaatgtatttttggatatagatttgccttccctgcccacaatgttctacaagtggaatagaaactgttgatacaataatactagcttttgtaattgcccatgtatttacctttaatgagagctttattccttcttacagctttgagttactgtctagcatcctttcatttcaacctgcaaaactccctccagtatttacgcagggcgggactggtggtaatgaattttttttaccttttgtttatctgggaatgtcttaatttcttccatactttggaagaacacttctgctggatgtaggattcctgattgacaggtttttttttcttttagcactttaaatatttaatatatcagcccactgccttctggccttaaaagtttctgacaagaagtctgctgataatcttattgaagattccttgtatgtgatgagttgcttctctctcactgctttcaagatcctctgtcttttaacagtctgattataatatgactcagtggaggtctctttgagttcatcctatcttggagttcactgagcctcatgtatgtttatattcatgtcattcatcaaacttgggaagttttaggctattatttcttcaaataatctctccgtgctttctctcttctccttctgggactttcataatacataggttggtttgcttgatggtatcccaatcccacaggtcccttaggctttgttcaagtcaatctttttttttcctcttgtttctctgacttgatacatttaattgttctgtcttcaagtttgctgattctctcttctgactgctcgaatctgcctttgaaactctccagtgaatttttcatttcttattctaattttcaggttcaaaatttctttttaggttgtctatctctttgttgatatttccattttgttaatatatcattttcttgactttattcatatctttcattagttctttgaaaacctttaagacagctgttttaaagtctttatctagtaagtactcactttctcagggatagtttctgttgcttaattttttcctttggatgggccatatttttctgtttctttgtatgccttgtgatttttttgttgaaagctgaatatttgaatctattaatatggtaactctagaaatcagattcttccctttaccagggtttgctgggtttttttgtttcgtgtttgattattgcaggctgtctctgtgtcaaggatcaggctgatgtgtaaatgtaagttcttctcaggtcttttctaagcctgtgcatttctctggatatatgtggtgacattctaatttcctctgtatatgcagctgattttgaatgtcctagactttaatgcctggctcccaaaagatggggaaaggaatgaggattaagaaaagaaatcctttaaattccctggaagtctcttcagctggagcagaaagggcttatgacagttgtggatgggtgtgtgtgcaacaatggttgtgtgcctctgtgtgcacctcaatgatgagaagtagcaatcagtgatcacagcacaaatctctaaaatttggaggacagagatctttttgtccaccctggctcctgcaagctgcatgtgaattacccaatgaatatatttcttattctaattttcaggtttaaaatttgaaccatgagattgggagttaggggatgggtagctgctaccgggttaaagctgtaattgactgaaattagttgcagtttgtcatctaaatcttcccctggaagacgtaaacttttaatagagtgtgaagattatttgtgtccacagtttcaaaattgttacatcagactgattctggcaatgaaattgttgtctagatgaggagacagattcttggtgcttcctactccatcatcttcccagaatcctctagtgaaatagtctttgatgatttatctactataccaattagatatagttagggaagttgggaccctaacttaacagcataggatatcacataaaccaaaactgatactgtttttctcataaccacaacctaaggtcctaggaattaatggaaatgaaagtagctcctcttacaattatatctaatagtccacttgcagaatttttgcttctcattctacaacttttggcacttctgatttacaggtcttagttcctaaggaggtacttttaccaagagacacaatcatggttccactgaactggaagtcgagattgctaccagccacttgcatttctcatttcactgaaccaacagtcagacaaagaggggttcattctactggctaggtgactgatattgtttataaaaataaatataattgctgttataccttgaggttaaaaaaaaaaaagtatctctgggactagagtattatctggtgctcctctaagaagttccatgtcttttagtcttttaatgaagactacagcaacccagtaaaagcaggaccttaaaggactcagacccttcagaagtgaaggttcagaagaccacatcagttaaagaaccccaaccagccaaggtgctggaagatgacagaggaacattaaataggtgatggaaaaaaggatttacaaatatccactatggcctcctgaccagttaagaaaagatcactgtagcaactatgcatattttcgtgtgcattttcttccttccttagtgtgtgtgtgtgtgtgtgtgtgtgtgcactcgcatgcacacttaaactgctagtggtgactgactttacaacttagtttttaggatataaaatatccataaatttctttagaagagaaaataatatcatccagcaatggctacagtaactgatggaactgtgtctcatccttcttgaggggatggtgaaagtgtcttcagtataagaggaagagttccttcatgttaggtaaaagcatgttgcagttgctattgttgtatggaaattaaatatggagggaagcaggagggtagctattggggttccaagggttgaatggtgccagttatctgcctatttgctctcagccttcaccccttccttctgtgttcttctatgtattgtagggggctggagccatctccttaactacacttcccagactgcctttccaactagttggatactgccaatagaagggattcatgagagactggaaggccagagccagggagaagcaactctcttgtctggcttctgatagcatttctgtcagcagcagcagtgatagtgcaacagcaatggcagtactaaccatggtaactgcgttggcagagattccagccttggttgaggcatcacatcttcagcaggtctacaattacagtgacaccctccctgaaagcccagcagtggatatagacttgttgacttcagtttagcagtgatgcagcttctgatctctggttatcaacgcttcttactttttgttcttcccatacccctcttctccacttagctcttccatcccttctaacagccatgtaaccaattccctctctatcactggtgatattttaggtggaataatggttctctgggtatgatttttaagagtgcttaccttttagagctacatactggaatatttatagatgaaataatatgaaacatttatggctgtatatatctgagatttttcttcagaatattccaggagggggcgtgatgggggcatagatgaaacaagattggccatgacttgataattgtcaggtgataattgttggtgataggtacctggagtcaattttatgatagactctaattttatatgtgtttaaaaactttccataacaaaataccaattacctctccctgccaagaattaataaatgaataaaccaatcagtaaaccaattaataccatctatttgtaataccttgagtgggttttgtatttctgtctacagcctgactggctcatggagaaagcctacctaagaatgaagccgggacccggcagaatggctcctgtgaagaagggtggcaagaagaaaaagggccgttctgccatcaatgaggtggtgacccgagaatacaccatcaacattcacaagtgcatccatggagtgggcttcaagaagcatgccccttgagcactcaaagagattcggaaatttgtcaggaaggagatgggaactctagatgtgcacaactgataccaggctcaacaaggctgtctgggccaaaggaataaggaatgtcccatgccgaatccatgtgcagttgtccagagaatataatgaggatgaagattcaccaaataagctctgtacttcggttacctatgtacctgttaccactttcaaaaatctatagacagtcattgtggatgagaactaatcactgattgtcaactatatcaaacaaagttataaaactgcaaaaaaaaaaaaaaaaatgaagccaacaccaaggaaaacaaagatgtcttcatgtgtatgacagaacaagtaacagactaacagaagctgcacacatgctcaagaaatagagatgcacgcagagacctgacaacatcctgtgcgcctatatccagccaaagcatccagcagactgacctcatgatttttcacatacatgaaccaataaattcccttttttgtttaagccactttgaattggacttctgttacttgcaaacaaaacaaccctaactaatgaaacccctaataaatgatcactactattatctcaacccccttgagcaactagccaaccacaatcatcaccatataaaatctaagtaacttattacatatatacacatatatatattaggcataagccacaatagaatgtgctaagtattaaattaactgtggaaacactaaattaaactgatccttagagaagggattaagaggcatgggctaaagcagtcagagaaggctcctggtagggaaaggaggaaggtctgagctgggccttagaaaatgtacagaatctacatgagaatataatataacagtcatgagtatggtctctggagtctgatagacttgattcaaatcctggatctgttaccaactagctttgcaactttgggcaagttacttaaatgtctgtacttatttcctcatctaaaaaatgtggataataataggagacctacctcacagagctgttatgaggatttaatgagttaacatacataatgccgagaatactgtctggcacattgtaagtactacatatgtgtttttattactattaagaggaaggaccagccagaggaatggcctcagcaaaggtgcagagtgggaaggtacaaaggttatctagagaccagggaacagacttactgagctgacacagggggctcatgaaggagaattgtctggcaagacagtttacagatgaccagtcagaggcagggaaagtggcttgccaaacacctggatctctcctaacagcacacaggaaattgggggcgtgtgtctgaggcctttctgggagcttcagtaggtgccattatccctgctttgagcacttacagcctatctttatggcacttcaagctgctatgggctatttccttggatatttgtacacaaaaacacagaatggactccaggaggtagaacttactgttctgcgacggccaaattgggcggcagggaggtaaggccattgcctgtgaggagcaggacacggaggtgtggcagaatccccaaatcacagatggcctccacagtcaggctgttgaaggaaaggtccaagaactgccatgcaaagatgaaagatggggaaggtaagcactctgtgtgacaacaatgctcatatatgatgtgggagctactttctagagtgccccatcgcccacaggacaaaaccctcctggatctccagattaatattcaaggtctactagagtcagtacccaactggttttctagccttagttgccactacaaatctttgtttatcctgtagtgctaggcaaatagactcctccccgctgtttgcctcatccacctatagatctttgcttgtgctttttgcttaaatgggaatgccattcttccatgtatcctaatccaagcccccaaaagacagctcaaaagctgcctccttgtaaaaccttctcaattccccagacagatggaatctctacctcccctaactttgactgctttatctaaactgctttcagggtacttatcaaagtcggctaggtatctggcatatgtatatgcctagcacagtgcttggcacacagtggtggactagatcataaactggtacttggaagactgtggggtcaagtgccatgccactgtaacactgtatccttgtaagttagcataagacctggcacaaagtaggtgcacagaaaaaatgagctgaataaactggcttcagtggctcacgcctgtaatcccagcactttgggaggcagaggtgggcagatcatgaggtcaggagattaagactatcctggctaacacggtgaaaccccatctctactaaaaatacaaaaaattagccaggcatggtggcacacgcctgtagtgccagctactcaggaggctgaggcaggagaatcgtgtgaacctgggaggcagaggttgcagtgagctgagatcacaccactgcactccagcctgggcaacagagcaagactctgcctcaaaaaaaaaaaaaaaaaaaaaagacaaaagaaataaactggcttatgaggacaataaccccaaattgtcaccctattgtcaaccaccttctaactggccttctggattcatgacatagttgactggggtcaaggggccaaggggtcagtcagaaaaccgtgtttctctgcagagacaaagacaatcaggataaatgacatctgtccaatatttgttctccttctcctaagcctccatagacactatatatacaagttggctcccttccatcacccctatttcttatgtgcttccctgtgcccccctcctcaacatacattgaagtctattgaatggggtcagtttcagcaacttattcaattggtacaggagcaagtctttggtcagccacatcagtattacatagtcagacatatacacgctacaggttaccctcagagaaggactgggtttggtctgactctgctgtaataattgatagctctgcagacctgggtgtttaagtcctgactaaccatgtgatattaggcaaattacttaatctgggtttccttatctgtaaagtagaaataagtggttcttatgtagataaagcctttatactggagtctagtatacagtaaatgcttaatgttggctgtcatcatcatcatcatcatttcattcctcaaccctatgtataaggcttactttgtacctgtccctgccctttaggagctcccagcctactcagctaaatacatgtatatgttcattatgtagcaatgctgctgggatagatgtctgaagacagaccaatcagggcacaaaggaaggatatggtcaggtctaccaggggatcaggacaggcttcacagggtaggtaacatgtgagctgtcctcagagaccagtaggtattcaccaaattgttaagggcaaagagacattcagggcagaaagtggcatgtatagaagccaggaggcaggaggcagcctttcttgttctgagaaccatgaatagtttgggtatgactgaagtccctggcataagaaatggcttgataggactagccaagtactacagaagctccaagttcatgccaccatcagcaaattccaaggtttgagggttcagacaatgaggcaatcccacttggctggagcaaacagagaagcctacaggaggaagacctggaaaggtgcctgagataagcacagggaaaagtggggaacattctcccctcatactcatgtgtgaacagtcagcctatggattctatctacctccttaatatctctcatgcttgttctctctaatctattttttatacagaagccagaatggtttttctaaaatgcagttctgaccctaccacttagcttaaaacccttcaatggatccctattctccttaaggtttaaactcctcagcaaagtttccaaggttctccccagtctcttttctgctacccctccaggttcacatatcactacactctactgtgtctcagtctctattccagccatacggagctgtttcattagggttctagctcagaagctgacctactgctattttgtgtaacccaggagctaagaataatttttgcttttttctttttgagacagggtctcattctgttacccattggtatgaacatggctagagggcagtggtgtgaacatggctcactgaagcctcaagctgctgggctcaagtgatcctcctgcctcagcctcctgtgggtccacaggcacgcaccaccatgctaattttttttatttttgtagagacacggtctcattttgttcccaggctggtcttgaacctctgggctcaagcgatcctcccatcctggcctcccaaagtgctgggattacaggtgtgagccaccctgcccagccaatttttacatttttaaatggttgaaaaaaataaaaaaaaagagtaagagtgggccgggcgcggtggctcacgcctgtaatcccagcactttgggaggccgagacgggcagatcacgaggtcaggagatcgagaccatcctggctaacacggtgaaaccccgtctctactaaaaatacaaaaattagccgggcatggtggcatgcacctgtagccccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaagaataagagtgtgtttcatgtgcaaattatgtgaagttcagatttcagtgtcatgaagttttaggctgggcgtggtggctcacgcctgtaatcccagctttttgggaggttgaggtgggcagatcacttgaggccaggagttcgagactagcctggccaacaaggtgaaacccttctctaccaaaaatacaaaaattagctgggtgtggtggtgcacactcatagtcccagctacttgggaggctgaggcatgagaatcgcttgaacccaggaggcggaggttgcaataagctgagattgtgccacttactcctgcctgggtgacagagggagactgtctcaaaaaataaattaattaattaaaataaacaaagttttattggaacacagccatgctcatttctcatttgtttacatattgtctatggctgttttccattatacaacagcagagctgactagctatgattagttatgaccatatgaaccacaaagcctaaaatattaggcctgctgtacagaaaaagtttgctgacctcattctagctgctttggctatttaatgtaggatccgaatttgctttctatagaattaagggcaatttaaagaaatgaatagccttagaatcacaggctacagaatttcagagctgacccagaatttacagaggggaaatgtcccagagagggtacgttgtttggccaggtaggcatggcaaagtactggcaaaaccaagacaaaaggtcttctgactgccagggcagggctccagctgaaccttcttcagatctgtaatccgagaatcaaaccatggcaaagttaagtttttctaaattgactcctgaagaattattctactctgggcttttcctcctggggcagcctttttggcaaacaagaacagaagattcctaacctggctactacatctgctgagtcacatcaagttttattacacatcaaaatattacattactgtgagctgcaaattcaggatatttgacaggtttatacttcttcttagggagcccttgcaaatcacagatagatgaaaacagatgactgggcaagagatttcctgttttcatttatattctgcatcttaactttggtctgttctcttacgtaaataccctttcgtaagggtaggtctgctggataaatcatcttcatcagatgcgatcacactataaagtaaagtaaggcctccaaaaaagtcactcatgatcaatcactagatccaagctagtcagttgtggggtcagagcctatagtcatgtctcctcccttcagcccactggtacttgaaacaggggtttgaaatggtaggggaagaagacaagatgcatggtacaacgcacaacacaggagctcaatgactactctctgaaaaagtaaaagaacaaataaatgcaagttcttaagaagctcccaggctcaaaggtcagggacatggctccctgtatctctagaccatctgaaacctgtttcctgctgtctattccaaaatctactgttaaatatttataaacacagaaaaaaaatgcatcagttgttgtaaacttactttctctctattttattcaactttcaagagctttgcttcctagacaagtgtgaggactacttttgtctcaaatcatagaaaattactgttatcttcaatatgacttgagaccatggagagaaggttccattacagtcagcagaatatgctttaaaaatgcaaagatatataatccaattaggaaggtggccatcccaagaggttaaaaccttttaaagctttggcatatgaaggccatcaactctgaaaaactcactcttgtagaaggtccccctcactgacaagaccaggttaagtgaggcttttgtgaagaatggctgacccttgatgtttgcagatgaaatcatttaagttaacagctttttggggttgacctcaaggttcatgacacgcacacattttactgaaatttgactctgaaacacttctactccaggatgtggagaagagtctattactcagtgagtgagcgtggtcagatgcccagcccacacacgtggctccacctctgttgtcctttactctccacatatgttgtcctttactactgccgtgactctcaggtagtgacaaaagctttgttcctttgtaaaaagtggcccacaaatcttcatgaaagctaaataagtaatcaacttgaactataaggacatgtgcagaaaatgcatgactatgggaaaatttaggagaaaaccaagaatgcaaacaaaattttctgtattttctaatttgcggtttgaagaacagctgtgaatgtacaaatgttcaagactctgctgctgatcccaaaggatccctattcatactcatctccgaggttatggactaggcctatagcctgctctatcccagccaccgagactgattcagctcacttagaccaggatgagtctctggaatcagtctataatgtctctagttcagccgatccaatctgctgcacctagctcttaagctccatggctcctcaatccccactagatccagatctcccctcaaaattctccctccttcaatactctgttttaaaactcacttttctgcacagactcccttggacatgacctttggcatttattttccaggaccatgcaccatggttaagtctttggtatcaactatttgctgccacttctaccattaccactatctccatcactgtaactacccttacaacccccacccccaccctccctggaggccagcaatgaagcaagggcctggctgtacaggcccagcaagccccttcccaacagttataatcagtaaagctctatgctcattccttacaggggaacttggtgggcaccaaaaactccctacctccaacttacttctaataacttaaagtctccatatttcacgtagatagttttgatgccattaaatgcgagatccagttcctttagggctggaaacgtgtgaaatgcctctacatggggaagagaaagagagagtctgcagcttgtaaaggacttaagagaaagatattaataattaccatttactgtgtccctactgggttaggccaggcactgtataaggtactttacatacatggcctctaaatctctaacaacccagaaaaatagggattactacttccattctatggctgactaaggctcagccaagctaagtgatttgccagaatggaattgctggtaagtgaaagagccaagaattgaatctaagtctgctcaacagcaaagcccattttaaaaattatctttattaatcctgattacaaaaattaaaacacaactaagaaaaacagtcaaacatcacagaaaaataaaaagttctgtttaatcccaacatccagagacaagtattaaaagttccatatatagcactcaactttttctcatgtatatatcaaaatacatacctcttttaacaaaaatagagtcatactgtacacactgtactgacttgctttttcccttaacaatgtaacttaaagattattccatgtcaaaacatatagatatgcctaatgtcttctgatgttctacagtatagatatatcctagtttactaatccatttccccattggtagcctttaggctatatgaataaaaggtaagaaactatatgaataaatgtttctctctttgaatgagaactgaactttttctagccttgttcctctggtaacctgaaaccaatgatacagtaactgcatttccaggcagtatcacttgcggtaaaaatcaccctaggttggcaaattacatctgggctaggagaaactataaatgaatgataaacacctgaagggggcaccataattttgggcttccctgtgtgtagtgattcctataattggatatatcctttgcagaaactctaggagctatgcctatacgtgttacaatgtatattggctcctgtgaggaatgagatttctaagccagggtggcttttgcatccacccaatgacagtctcactgtcttgtacctgagctgacactgggggccagatggaggggcacaaagaatgcctcatggatggctttgggaactccattgaagagaaactcctgatgctgttgtactggcattctgtgtggaattacttagagccttctaagtgaacctgatgttaaatatggtagtcttgtaagtcagaatgttcagtagaacctaataaaggctgctttgtgaatatttctggatgtttccaatgaacagccttgtacgagtgtgttactatagaataatttcctggaagtaaagctactagattaaaggcaatgactactttaaattttaagaaacattaccaaattacctccaagatgctacaccaatgactatacttccacagttcaatgcaagagtatccatctccctaccaatgctggctgtcatcagcccttttcactcctgccaatatttgacaggcagaaaacagtatcttgatccactgtaattattagtgaggttgaacaccttttcatatacctattggcctttgtatttccagcccaagctcctgacagaccaccctgtctcctaaagggcagggacctcatcatatgcttctttgaaaacaatcttcaaactcaatgcaacaaaactgaacttatcctatttccctctgacttgccttttctctaatgtgccctatctcaatgaaatgccccttgattcctccctctccctacatccctatcagtctatcaactaccaagtcctgtggtttctactcctcctaaatctctgtctgtctctctctctctcaatcctctgcacccttcttgtcacaatcctggctcaggcctcatctcccctcccctgaaaacctgaaataatctcccaggtttcctggcctccaccttcttcttctcttataatccactctcctcacagctgccactgagcttctctatttaaaacccttccaagactctcttttgcctgcagcattaagtccaattcactcccggtccttgataatccagtcgctgccaatctgtctagtttcaattgtcccccacatgcttcccttgcaagcatacaaaacctcttcagtcttcctgatcagacaatgccattccacatctgctccagcagccggaaatgccttcttaccttctagttcctgaatcactcctattcatttttctggtctcagcttaggtgctcctcttctcagttcctcctgacactctggcctggcttgaagtcccacgtatatgcttgcatagtatttcctgattctctctttcactgctctcccctcatcctgacctaactatctgtatctgagtccatctctctcaccaaaccatgagctcaccagagcaggactgtatgcactcatttctaaaagccaagtattcacacagtcctaatatccagcaggggtcgctgtggacttgctgaataagaaggctttatgctcctacaggagtactttacaggcttagaaacatttttatacacccatctcatatgagcctgcaaggtatcctgcaaggggaggaaaaaaagaagggaattatctccattgacagatagagaagtagaagatcacagaaaaatgttctaagtaggtagcgccagagcaggactggaatcgaggtctttgtgctctccagcacccagcctattgtactccaaaaaagagatgtgtggccaatcatagatggttggacagacaaatcctaacacacgtgaatggctgtgctggctaagaggaggaagagagctttcaagaaagaaaaagcttacctagaggcagcaggttttctgaggcattgatataaatcacagaatgaaaatgcttgaagtcattttccttggcctgtaggaaagcatttcagaaaaaaaaaaaaatccacaagattagttccctgcctagaagccttgctgaagcttcagggccactgtcagaagaaacaaagacctaaaggaataagggacatccctagcacaggagcagacacttgagtgctgtaagggttttcctgctttttttccactatgaaacatttcaaatgtacagaaaagtatacggaatgacactctgaagacccatataaccactatccagaggtaagtatttaatacagctgaatattttgctgtctttgctttaaataaatttccttaaagaaaatattatatagggtgaaccaccaccattaccacccctgtccatgtatcccctcactaatcccataacagctatcctgaattggagactatcattcccatactcaatagtttttgtgtgtttgtttgtttgtttttgagacagggtctcacttccattgcccagattggagtgcagtgacacaatcttggctcactgcagcctcaacttccccagctcgggtgatccttccacctcagcctcttgagtatctaggactgcaggcacacgccaccaagactggctaatttttttgtatttttagctgagatggggttttgccatgatgcccaggctggtctcgaactgctgcgctcaagtaatccgcctgcctcagcctcccaaagtgctaggattacaggcgtgagccactgcacccagctcccatatctttttttatgcttatacgtgtgtgtgtgtgtgtgtgtatcaactatatataatgctagatacaggtagtaaaactttacgttaaatgcaacaatattttaggtatcattctgcaacctgccttttcactcaacactgtttttgagaattacctgtgtcgatatatgctgcttttgaaatttacatatgttgacagttgtagttctagttcaattttttttttttttttgagacaaagtctcgctctgtcactcaggctggagtgcaatggcacaatcttggctcaccgcaacctccaccttctgggttcaagtgattctcctgcctcagcctcctgagtaggtgggattacaggtgtctgccaccatgcccagttaatttttttatttttagtagggacaaggtttcaccatgttgtccaggctagtctcaaactcctgacctcaagtgatcctcctacctcagcctcccaaagtgctaggattacaggcatgagccaccacgcctagccctagttcaaccattttaattcctgtatagtattccattgtttgaatatattgcaagtttattcattctcatttagtctgtttctaaattttattacaaacaattatgtaattaatattcttatacacacctcctattcataagagtttctttaatgatatgctcctatcaagctgtggggaatacacagctttatgagatggtagcacattgttctccaaagtagttaaaacaatttacagtcctacctgcagtgtatgagaagtcctatttctttaaatccttgcaattggcattataaaactaatttttgccagtctgattattgtaaaatggcactgcattttcctgattatttatgaggctgaatatctttttctatatttattggcctttcaagttcctcttctgtatactaacatatttatctgttgtctatttttctactgggtttctctttcttcctattgttttgtaggagctcttgacacattctggatcccaatactttttggttatattacttgctaatatcttctcccagtctcagcttatcttttacctttgtttgtggtaacttttgttagatagatatttttaattaaatttcatagatattttcctttatggtttaaccacaaagctagcaagcatccactcatcccgtgggtctcagctaagctaccaccctctccagggtgtgtttcctgtgtaaggctgagtcaggggcctgtcctctgaggtcatatttcgcaccctcgtgtttccctcattgactgcattagctagtcctgtctaactccatatccatctaagcccagcctcctccctctctactggactatatgctccagagggcaggcagtgtctgagccacctctgtaccctccagcaaatagcacagagacacaccaggcctcggtaatgtttggtgagcacgtgagtgaataagtaaaagaagaacatacggtatccaatgaggggactgagctttgaccagccatgttgtagccctcaaaaggtgaattgataaagagacctctgaaatcttctatgactttgtctcaccgttatatgtgaactatatattataatctctgggaccatgtgctggcctagaatggagggcctctcagccacaagatgaatatatttctaaggttaacctgtccctaagtaactcaattctgaaaacatgagtgctaaatgaagtgaagcagaaccctgttaaaggagcagtctgctttaccacaaacttggccatcctgtgggttagagcctctactctatggtttatacaagtaatctctcttggtatgccacgaaagccaacataccaaagatgtatgttataatatcctgtatatacactggctaatggtgggtcacaaatatggctccaagctgcctataagccaatacaaagaaagaaacatgattcattgcatgagtcacagcacctgtaagttaggaacgaaccagcttcttgggaaaaccattacaattgctggcattgaaacttaagaaatatctcttgtagggtcttgtgatgggaactcagtgtcacacaatgaattatgtacccacaaaattacatggcaaattcaaaaccagtttcataaggcaattttcttttcttttctttttttttttggtgacagagtctcactgtcacccaggctggagtgcactggcacgatcttggctcactgcaacctctgcctcaggggttcaagcaattctctgcctcagcctcccaagtagctgggattacaggtgcctgctaccatgcttggctgattttttgtatttttagtagagatggagtttcaccatcttggccaggctggtcttgagctcctgaccttgtgatccacccacctcggcctcccaaagtgctgggattacagccctgagccaccacgcctggcccataaggcaattttctttaattcatatcaaataggacaagggcaatataaaatttgtagcaaaagtttgtgtctgaatattgtttcaacccaataaatccttgtctgactctcctctccctccttcttcgtgaccagatttccagtccctagggactctggaggtgcaagagacaaaccacaacagccaggtgcgccacctcaagtctggctcaccccaatcacatctttgctggctgacctcaccttggagaacttcaggccactcacattaatggtgcacagatctgatggcttcctcacacagtggtgcttcagctggaacataatacaaagagttgtctcttaaggcccctacaaagtttaattaatctattaccactcagccttctcttgttgggcaatcatatacttgtcataatttgtttgcttgttcattcattcattcattcattcattcattattcatccattcattcgccaaatatttaccaaacactaaattgggccatacgctttgctgaatacattaacaaactttcttctaatcctaattaagccctttgattataaagtaagattatctcctctttttaatgagaaaaacaaggttaagagaagttatgtgccttgccaaaggtcccacagttagtaagtgacagatcttactaatccaaatctgtaatcactagactctatgcacttttgactgccatatgtcacccgacataatttaaaagttagaggtaaattttagctttggagcttccatttatgtttaatcaaacctcattctttttttgttaatcatttatttatggtacccaccatgtttaggcactgaaaggcattgggaagacaatgaagaaaaagcagagacattccataacctcatagagcttacagtgtcatgggaagccaagtagcaagtacgtatttataaatgtgataaatattttaaaggagaaatttaagatgctatgagacatataacaggaggtcctaacctcagtctgaatgaggaaatacttacttgaggaagtaatatttcagaaacctaagagctaaataggtctcatgaaagtgggtagtagggattatgaagtctaccaaggcaggaaaaagcaaggtgcttctgagaggatgaaaaacaagataaggttagtgagacggccattagatcatataagtccacgctggctctataaaggagtgtggattttatcctacgacaaatagaaagcagatttttagcagggggctgatagtaattttataaaaattgtaatgtcggatacacatagacatatcagacagagtacatcacatagatgagaagacaggaaaggaaggggaaagacgaatgtaccagattggttaattactttcctaataaccactactcctccttgttaaagaacaccaatgttattcacatttctccaaatggaatgttcttaagccacagctccaagcaataagtcgtgatctgtgtaaaccaatcatggaggtctcattcccctaactcatgactgttcgggcatgttatataggtctggataatgagatactggctgcttggagttgaggagggggaccggttttggaaagcattttcttacttctgaaaagacattagtcagtaacaatcccttctctacctcaggatgttatattctgtatgtgatgaccacaattgctgcagccatctcaggatcatgaaggcaatcagcccaagaggacaagataacatgtaaagtggcacagcacaaagacagaaggaacacaggccttgcaagacgtcattaagcctgtaaattaatctaccctaaacaatgcctctggcttatttttatgtgaaataaaagcatcctaattagtttacaacatatagaaagtttctgaattagtccaataagagatgatggtggcccagataagggtcatggcagtcgagatgagaagacagatttgacaactatcttgtaaaagtgccaggacttggtaaaagttggggtggggacagtgtgggagaggcaaatgtcaaggataacctcaggtactggcttggcaactgggtagatggtagtgccaacagagagagtaaagtagatactggaaaaagaggtctgttttgggatttggagtaggagcattggtgctgtaattcaactgtcaatgaaacattcaagtggaactatccaataggcagagtggataccccatgattctgaaaaacatccttgttgctcctgtctcccacggtggcaagacgggtaacaagctgtatttattgaatatgggaatgtataagtatttggaaacaagggaagaaaaaaaggccactatgggaagtgtttctgcccctcctcagtataattatttcagtcctcctcattcccaatgagaagtggacctaataatgaaactgattccacaggactgcaaaaagcttatactacccacttgaggtgagatgaaaccaacaaagttctctttcaacatctgatttatgcaggcacccatctcttgggaaccatagcagaatctggaaacaaagtaggcagccagggagttcttagggagctatgagaactcgactgcacattaatattgatttacaaaatgcatccttcttagcaaagccactgaggcattgcacagagcagatgtgaaactacctggctggtctccaacacagccaccccagtcctctttgtaaagcctgcccccggcactaagtaatatctggtcagctcccttggctttcagccagacactaaagtcaaaggacaaaggctgtgggagagcaggacccagtcccactcaatcctgtagagatcaccccaaagagcacagcaggaatctctcaaccctactaggtgctggaatgcaattttcaattgactgtttcccctgacctgctcctttgtctctccaactcagtaagagtttttacctcatataatgtaaaagtacaggctttggagtcagtagaccagagttctaatcctggatcagccatttactagctgtggaacctcagccaaggcaaactacttcttggagcctcagttttcccatctgcccaatggcaacaacacaaaagggacgacaatacctatctcactaggtagatgtcaagaaagctttacatgtcaagaaacttttgggtcccttcattatcctggctgtactcaatttgccaatatcactctaacagtttggagtagattgggggtagttgtgccagagcagggcaaatccttccccacttcctccccaccctagctgatgtgctggccactccaggatgcatttactctcaccagaaaagcctggtccaggatatgtccaggaaggtccacctgattttcccgccgagactctttcttccccttgaactcaaaagaagtcgccttcaggctttcccgacgttcagcttgtgctccaaccaaacccttgggcttcttcttgaggttacctttctgaaccactaaccagtgtccttggcctgttgagaaaattagaacagtgaaaaggggaaaactccaaagctacaacgagtgcagttatagactttgtttataatactaaaaccaaaaatagctcctgattatctaacatgcaccagatacaatactgcagctgggggtaggggagatatctacctatctatgtcatttaattggcctccaaacccagtgaaaaacatgtcactgtcatgattttatacatgaaaaggctgcgacaaaaggaggtggaatgacttgccgaattccttccttcacatttttatctccaaattctattattccttcaaaaactaagatcaagtatttcctgttctgtgaagtcttcccttttgcccctcagtagagctgatccctctttctcatgcatgccagttactctcctattggtcatctcttgagtaaagcccaatgtgtgacctcaactcaataggttccatcttcccagacctctatcagtatacagaaaagatggtgttagaaacttggaataagaaaatgtaggacagatggcattaaaaaaaaaaaacctaataatacatgtctactgtagaaagaattttaaaatgtgtataagcaaaaagaatatgaggtttactagtaagctcaccaaacaaaaatcataacgtattttggaatctgttctttctcgcaccagcagtttacttgctgtgtggtattcattgcaatctgtaattattttatttgttcacttattcattgtctgtctccctctctagagtggaagctccgtaagagcagggactttatctgactcattcatctcagtattcccaaggcctgcacagagctcaccgcattgtgactgttgctgaacaaatgactgaatgaaccctgtcttatagcccctgcccacacagtcatccattcctatcttttctgagcatctactttatgctgggaactgggagtatgagaatgaataaaaaggaagccctaactcaaaggagtcataataatataacatcttatattatatacaatagtataataataatataaggggtgctgtgggaaccagctttgtgcctctaaccactggctgtcttctggaaaagcccactatctctgccttgggggcttgccctggctcacagaccactgctgacaatcctgcttcttggatgcagttcctgccctatgtctcatatgagtcatttcccatttccattatgggcctgatactccagttaccccatttcccagggctgcccccatctggggcatgaactttgcttctactttatcctatcttcatatccctgactcctggggacctcagtctgagttggtgccaaaacccccaacaaggtcagaaaggaaggttcagagtgtgtcaggagatcaacgggagagaaaagagactatgcaaatatcctgtttctcatcatacttttacccacttattctagtatctgtgatggttaattttatccatcaactttgctaaagctataatatgcagttattcaatcaaacactaatctaggtgttgctgtgatggtattttgtagatgtaattagtatttacaataagttgatgttaagtaaaagagattatccttgataatgtgagtgccctcacccaatgaattgaaagacattaagagcaaaacaggtttcctagaggaagaggaaattttgctttaacactacagcttcagctcctccccaggggtttccagcttgccagcctgccctacgaattttggacttgccatcccccacaatcacacaaagtcaattccttgaaaaaaaaaatctgtctacccacctacctacctatctcctactagtcctgtttatctactaccagttctgtttctctgaagaactctaatgcaacatcctataatggttcttacctacaaaaattattactgtagtgtttgaatagtgactttctatttccctcattccttctacattttctagttggaattctactataagaaagagctggctgggagtggtggctcatgcctgtaatcctagcactttgggaggctgaggcgggtggatcacttgaggtcaggagttcgagaccagtctggccatcatggtgaaaccccatctctataaaaaatacaaaaattagctgggcatggtggcaagtgcctgtaatcccaactactcaggaggctggggcaggagaatctcttgaacctgggaggtgaaggttgcagtgagccaagattgcactgctgcactccagtctgggcaacagagagagactccatctcaaaaaaagaaaagaaagagctattttgtttccccccacatatttacatattcaaatatttatattagtagactcatttattattccatggtttacaacccaattccgccattatttatttcattgctcaaactgtcccagctttggtgattgggagcaccttcaagtcagctgcgtcctttcaacatgccctcattattttcctgagcacttctttacttctggcaccataagatactccaactcaacttgtattttttctgccctagtcctgcaaacaactatttctccaagaagcccatgttcttttcactggagaatggtatttagaaagcaagatgtagatactaggtatgctttttgctgctgaggtgtcattgctgtcagtggactggtaaatatacatatgtacactaaaacatatagatatatacaactatatttatttctgtagctatccatctatgtgtgtctgtgtgtgagagagtgacatagagagagagagagagagagcgagagcaagagagagagagagcgagagcaagagagagacaaagagagaaactatgagctcacactgatagctccatctgaaggtgtctgataggtaggtggccagggaaagtctctgtgtgaaaaacaaaatcactctagagaagcagagaggacaggcaggaagagaagtttcttccaatattccatatacagagtgaccaacaagttacaacatctggagtaaacaaggtttacttctcctttgccctaccctttcaaagcaacaaagccaatccagagaaccaatacttagtgtttcacctatagggctcttattatgacaattccctgctccagggaagtttttaactagataaatatttgaaaatctacctggcagagtcgaatttaagccattttatttaggagtttggcagaccatgatcactcatcaaataagaaatacagacaggaagacagctcacgagaggatgggccctgaggactagggtagtcagacatgctttactggaagaagtagaagaagagctgggatttgtggaatgggaagagtttggctaacaagaatgagggctggaacattcagggcaaataaaaaagctatgtgaaaagcaagcaccgtggaacagagcataaataaagaaatgggttatcacagaggataagagcaggttaaactcagaatgacacagaatgccagttaaaggagttagcaatgagaagtcactgaacagaaggggcactgtggttaaatatgcactttagaagtcccatggaggctactaggactggagggggaaggattaggtagagcagggaacagtagtgaaggggttggagaagaacaagtagatgtgagatggtctaaagcacgagctaggtatgaggaaaaggtagctatttgagaagtcacctgaccttcctccggcacgcgaagcagatttctggctgggaagcagttgttcaggtaaggcttcccatcatccagcttgtagattcctgagaaggccatctccctgagagccaggcaaggaaagcaaggaagcagaagagtgaaaaggcacagcagagcactcttactccagtgcagctcatgagcccaccaggaccaccacacccgcacacaccctgcctccgacaccctggaggccccactgcccttgcttcagaaatgggctggctgtttacatgaagagagaaacaagaccctgggtttttcagttcaaatcaatcctaacccaatggaaccctagaaagaacatgatcctccagctcagacttggtttgaatcctggctctgtctttccttgctctgtgactgggcaagttactctactcctctgaacttcagtttcctcacctgcaaaatgggggttataatacctaccttaaaagacaagaggatcaagtgagaaagacagtgcctaatacatattaagtctgtgctagatgttttgttttaacagagttcagagaagaggctcacattttagagaaaatagtgtacaaataatgagacttgaactggataaatagtatttgagggattgagttttctgatagagagaaggataaacattccaaacagcaagggccacaggagggcagctgtgcacagtaaagaaacaatgtgacccaagaaggagagggatgtatgtttagtagtcttgaacaataaagctggacaggaaggatggtgcctgctcctgaagggcttgaggtaccaggctaggagctcaggcttcatcttgtaggtgactgagagccatggataatttctgagctggacagagccataatccaagctgtactttacaaagagagatctgacaaaaatagcagtaggtgaaagtggcacccagtggcaactgggattgcagttaggggagtattgcagcaacccagggatagctgatgagagttcatgttaataaactaaagaattaaaaaaagaaggatggacagaaaaaaggaatgagaaagggagggacagtagagaaaaagaggagcaagaccaattagaagtatgagcatttcatgtgtggacacagcctaggcaacacagtgagaccctgtctctgcaaaaaattaaaaaaaattagccagcacagtggtacatgcctgtggtcccagctacttgggaggctgaagtgggaggactgcttaagcccaggatgtccaggctgcagtgagccgtgatcatgcctgggtgacagtgagaccccatatttaaaaaaaaaaatgtgtggacaaaggaggagaagcccctggaggattcagaaaagaaaataattttagagaagtaggagaaccggggggtggagagtgggagctgccaagtaagccaagggaagagaaaactctatgaaagaggcagggaagtcaggcaaggtggggaccgaaaataggccatgagcaagtaggaggtcagtttcagaagaagggtggagttaaagtcagactttatgtatgaaagagtgaatggaaggcaaggcaatacaaaaagtgaatataagcaagtttttcaagacgcttgattgtgaaagggagaaaagcaagacagcagtgagatggaaggtaaaattgcgagatgggtgaatatcagggccagcactgggggaaggtgagcaaggtgcctgaggaacacgtagggggacatgtgctctctctcagagttgtgcaaatgcagtgttagcacttggcctccaccctagtcccagccctggcagacagagtcactaccaagaataaattctggaagctcactgcatgggttcagatcctagctatgccatttactagctgtgtggccttgagcaagttacttgtctatgccttggctttttcctcagtgaaatgtagacagtaagtgcacctacttcatagggctgttttgatgattacaggagaaaatgccttagtatctgccacatggctaactcatgctgctcattttccattactatgctattaacaggatgagaaaagcttcactacatctagactgagaggaaggagacagcaagggaggaaaggctgacaatgcaggagagagatgggcagacccgcagagccatccctgagaaagcaggaagaagggcacccagcatccaggggaggggttccctcactgaggatgagggagggcaggctccttcagggacagttgtgatgggagagagacttcaaatatcccaagtgttccatttccctaacacctagagaataaaaagagcacaaaagaaataaccttccatcctctatctgctatggggtggctccgagactcttcaataccaatttacagtgagtcagaaattctttaggggtgtgtgtgtgcccatgcatgcacacacatgcaaaaaagttggaaaaagaatatagttctgactctagggtatgactcagtcttttcttcatcaaatgattattctcttcagagagacaggcataaaaacgattcctcaaaggcatggatagccctaatcacaactgcacttatcatttgtcattcacagattgttcaccacagtctgatgtcaaaccttggaaaaacctacattttaccgaggacttgcaaacacaaatggttacagaagttgggcaggctatgtgagtgagtgaagaaagctggaggcgaggggaagagagtaggagggtgtgtgtgtgtgtgtgtgtgtgtgtgtgtgtgtgtgtatgtgtcagagagagagagagagagagtgcacctgctcatagaggcagcaactagtcagctcttaccaactgctgccatgcagaaacctaagtcactgttgccagagcttcacttttttttcaaggaaagtctgccttatacgtgaaatctcctatttgagagtcagcaactaatttgccattttagaacaatgtgcaggccaaaccaaacacctgagaatcagattcaactccaggctacatttcttttttctgattcatcttttttttttcttttgagacagtgtcttactttgtcacctaggctacagtacagtggcacaatcacggctcattgtagcctcaacctcctgggctcaaacaatcctcctacctcagcctcctgagtagctgggactataggcacatgccaccatgtctggctaattttcgtattttttgtaggcacagggtttcgccatattgcccagactggtctcaaactcctgtgctcaagccatccacccaccttggcctcccactggaaggccagtggaaataactgctgcttttgctaagctgtgaagtctttcatcagtatttctttcgtggcccgacctcacaagattattaatgatcatgaaggggtaccttcaatggactatgaatttccaagtctggaaacacatctaattcactgtctctcttccaccattgggacttagctcataggaagcacgcaatagacatgtgagccaagtgaaggatatgatggcactcctaggaccaagacatatatatctgctacacacgcacacacacatatcctcaattagactctaaaaccttcctaagaaagggcaatatcaatggtagtcatcaatttattcctaacaaagcacctaacataacagatgttatgacataacagattccataaatatttgtggaataaatgaatcaatgttggtacctcctttggtccaacacagggcactatgagtttcctgatccctgattttccctgcaaagggatggaggcttgtcttatgtattcctacaacactccatacttcgcctagtatagcacttatgactttattataattgtttgctcccctcatcaacttctcacctgttgtggggcctataattaccttattcacctgtgtaatcccagcatgtagcatagagcctacgactcactaaaaatatgttggtaagattaatggatagatggatggatggggacaaatttatattcagtcaatatgtctttcaggaactctctctcatgaccaatcacacacatctgctagaggtaaatgaaagaatgaatgagtaacttgctggctggaaaatgttagatgtgatgtaatttgctggctggaaaatgttaaatatgatggctgttggagaagccttcagtaacttacagaatatggtgacctggcttcaggtctccagagtacttacttgatctttgactttgggaatggccccttaacttccttttttttttgtttcttcacttgtttctttgcctgtaagataaatattatattccttcttagcctgctattcagagctcttgaacttcctcattaattatattctactgtgagccttccactccaatatttgtcttgcctttagtccttgcccgtaggactaaggatccaagaaacagatagataccaatacagagatggagacaaagacaagacatagatgggaaggtggtataggagaatataattatgatagtggggtatggctggagtgcttaaatcagacacacgaagcacaaacctgaaaggacgggatcgtttacatgattatttacacaaaataaatttctgccagataaaaataggaaagtcaaagttgaaagataagacacagtctgggaaaagatatttgccatgcatataatacaaaagatgactcacactgaagcctgtaggaggcatgcagacctggatgctatcgcagaaattctagttccctattaggaatattaggtgagaaggtgtagatctacaactaatgggccaagaagggcacataacccctggttacattatctaagacaagtaagatctttatatggtagaaaaaaaagtcaaagttccagatttggaggctgacttcctggttagctttagttacctctggtctccatctcaaacttgatgcagctaatgccaatctgactgtagcgcttcctccaaaacaaacatctctctttctctctctctcacacacacacacacagagtaaggcatatttttgcttgttccattcctttggcctatcacatttctgcccctcttccttgcccggctacatacagattagctttcctgtatctccctctccttaggctgagcctcctcaagcccacttctttttttatttattttttctttttttcttgagacaaggtctcactctgttacccaggctggagtgcagtggcatgatctcagctcactgcaacctccacctcccagactcaagcaatcctcccaccttagcctcccaagtagctggaccacagacgtgtgctaccatgcccagctaaatttctatatttttgatagagatgggttttcaccatgttgcccaggctgcctcaaactcccaactcagcctctcaaagtgttgggattacaggcgtgaacccccttgcccagccatcaggcccacttcttaatggaggcactaacatggttaggctttgtgtccccacccaaatctcatcttgaattgtaatccccataatccccatgtgttgagagagagacctagtaggaagtgattggatcaaggaggtggtcccccatgctgtcctcaccatagtgagtgagctctcacgagatctgatggttttataactgacagttcctccttcacactcttgccctctcttgcctgttgccatgtaagacttgcctcttccctttccgccatgattgtaaatttcctgaggcctccccagccatgcagaaccgtgagtcaattaaacctctttcctttataaattacccagtcttgagcagttctttatagcagtgtgaaaatggactaatacaggcactataccacactgtattataatgcctgcttccttgtttgttccccacctcactacaggctgtgagtatctccaaggtcaggtcaggcctgggtcctacttacctctttttctttttttttttttttgagacggagtcttgctctgtcacccaggctggagtgcagtgtcgctatctcagctcactgcaagctccgcctcccgggctcacgccattctcctgcctcagcctccctagaagctgggactacaggcgcccgccaccatgcctgggtaattttttgtatttttagtagagacggggtttcaacatgttagccatgatggtcttgatctcctgacctcgtgatccgcccgcctcggcctcccaaagtgctgggattacaggcgtgagcctgtacttatctctttatcctgcatctcacacaggacctggcctactgaaggaagagtctcaatgattgttaattgaactaacccaacccatgaacaaaatgccacaggagcacttcatgcagtgggtgaagaaagaagaagcaagtatcagaaatagtttcacagggtaggtgacattaaagctggatcttgaaagatgagaagttggcctggtgtggtggttcatgcctgtaatcccagcactttgggaggccgaagcagacggatcacttgaggtcatgagttcaagactaggctgtccaacacggcgaaatcctgtctctactaaaaatataaaaattagccaggtgtggtggcatgtgcctgtagtcccagctacaaagactacagcttgggaggctgaggcacaagaactgcttgaacccaggaggcagaggttgcagtgagccaagatcccaccactgcactccagcctgggtgacagagtgagactctgtctcaaaaaataaaaaataaaataaaaagtgactagggcaatgctgtatcatctcactttattttaaataaaagaaaaatgagaagttgtaaaagataaactgcaacaacaagctacaggggatctgactagtgtccacggattgcttcacagaggtaatgaaatatcatctgatgttattgctatttagtgatatttattttctttttagtaataatttagttatttagtgataattattttcttttctttctgatctcggctcactgcaacctccgcctccccggttcaagcaattctcctgcctcagcctcccaagtagctgggattacaggtgcccgctaccacgcccggctcatttttgtatttttagtagagacggggtttcaccatgttggccaggctggtctttaactcctgacctcaggtgatccgcctgccttggcggggattacaaccatgagcccccacgcccggccgagataattattttcacatgaattttggcttccccaagacaagtttttgtctgttttattcagggatatatccctggtgactagaatagtgcctgttacatagtaagaaactcaaaaatatttgtttaattctttagacgcttatgggggatatataggaattaaaaaacaatacaacgtaatagagcatggtataatacaatactgctatttgataactctgtcatggagtagtagttccaccagagtagcaaccaggtctatcttgatcccctgtatccgttagtacaatattggtgctcaatatacatttgtgaaaaaaattaattaaaatacaacgtaatagagcatggtataatacaatactgctatttgataactctgtcatggagtagtagtccaccagagtagcaaccaggtctatcttgatcccctgtatccgttagtacaatattggtgctcaatatacatttgtgaaaaaaataattaaaatctagaatactattacatcctaaaaccgtaaaagcagagtgtcagaagggatatatattggttttgattttttttaaatgccggcttgaaaaccgagttcagatacatgctatctggctttgggtaggttctttagtttcctcctcatctaacagggctgttgtgggactcagtgagagagaggatggctggaagtgcacataggatactgcctggcagactgtaggcactcagtaaacgcgagttctccgttaacacgaaaacattacaaacagctaaaatgacagctgcttgagagaataatcggtaagtgccacaaccgggctagaaaaggatgaaggacaagctcctgcccactcctttggaaactccacacctgggccggagaaagactcgaattcgaaaactaagtttcagtcgcacctgcctccggcgtcgcttcagcctccgaggggtctgcggaggcgacgtcccagtcaggagggatgcgcgcctgcgagccccccggggatctcggagccgctccactgcggtgcctgccgctatcttccccacgccttagtaactgcgacgcgacggcagacagtgtaggcggcaaccgacggccgggacgtctaacctcaagtcccagcaagccccgcggccacgtcctctgactacctcgcgccagcaagacccaaact

SEQ ID NO: 640 - DNA, 108278 bp, Homo sapiens; identical to SEQ ID NO: 639

SEQ ID NO: 641 - DNA, 108278 bp, Homo sapiens; identical to SEQ ID NO: 639

SEQ ID NO: 642 - DNA, 29785 bp, Homo sapiens
agacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataaggtgaggagccggttcttgggaacagttgaatcctggggaggcctgggaggcggcgagccaaccttcccatcccggtctcccttattttctacggccttttgaggggagcccttgtgtgaccactatcacaaccctacgcacgcttggagcctgcccttgccctcatcacacttcaaacctggacccggtcctctttagaacttcttcttttctcgcaagtgttctggtcctggtcgccacacctttttcggtaatttgatttttcctatatttaatcgtgtccatctcttttctcctggggggctgggtgcactgttgtcagtgcccatttcacagacacggaaaaccgaagcccaaagattaaagaatcagtatcccccaaactctctaccaccatcacccttgcgtgctgctacagattccaaagtgcttcttgtccttttgcttactgaagtttttaggcgttttatcatgataggcgaatactgaaaatatttgagtattgactgttctactgggctgacaagaagcctttaagatttttctttttttcctgttgtttttccccgccctctcctctcttccctccacctccctctttgctaccaagtgcactgctgcccgctcacgcttgcccctttcctccctctgctcatccaaaaaaattttttttaactgcagtcctagcaacaagggtttaaaagaaaagaaaaaaaggaaaactgtccctgggttggcctttcttgctctttgcacagcatcttggaagaaacagttgcacggagaacaacgtcctggtgttgattttgcctctaattagctttgtgaccttgaaatatgcttgctctctctatatctgttttctcatctgcaaagtgagagatttagccttaaaatgagggacttaactctaaattcccttccagttctctcattgtagggccctgggctggtttgatgagaattgttaagcatggtgtctttaatatagtaagcagaatttttgaatataattgaaaacagctttcagacttccctgtgcataacacatggtaggtgcttaagaaatgaaaacatgattatgttgaggggttaagatccaggtctttttacttgtctttttgagtgtcattggttttgaaagacatggttctcacactcttctcttgtgagaggggtcacgctccattgcccagaatggatcttagctcactgcggccttgaactcttaagcttaggtgatcttcccaccccagcttcctgagtagctgggactgcaaatgtgcaccactatgcctgactaatttttttgcttttaacttttctgtagagtcagggtcttactgtgttgccctggctggtctcaaattcctgggcctcaagagatcctcccaccttggctccccaaagtgctgggattacaggcataagtcaccatgcacctggcctcacactcaaaccttaagatacagaaacatattctggaggttgggatggtaaattgcttcaagacatgtgagagtatggggaattgatggtcatttgtgtacacaaatccttccctcttgctaggtaagcacctcatagcctgtgcttacctgccccactaactgctcttgctcttccttgcacttggatcatcatcagcaaacattaagtatgggcattctgctaaggcagtatagaatactattattatggaatagtgtatatggcaccattgtgttattgaaagaacccggatgtggggatcataagatttcagctttgaagtatttctgctacttgctaacagtatgaagattggcaagtcacttaacctttcttcatttggaattttggaatctctggcacctagatcacagggttttgggaagaaccaagtaagacagtacacattaatgatctccattacctgtagtgtccagtacagatgtgtgatggtggaggagtaaatcaagaatcctactgtcagagagcactcagaatagccaaatataggagatggggtaattgaatctatttaaggaagtatatggtatattcgctcaagtgtgtacttgttacggaagttcaaatgagagaaatagagtgaaccctgcgagcttattgataagagtaagagcctcggccgggcgcagtggctcacacctgtaaacccagcactttgagaggccaaggcaggcggatcacctgaggtcggaagttcaagaccagccagaccaagatggagaaaccccatctctactaaaaatacaaaattagcgaagtgtggtggtgcatgcctgtaatcccacctactcgggaggctgaggcaggagaatcgcttgaacccgggaggtggaggttgcagtgagccgagatcacgccattgcagtccagcctgggcaacaagagggaaactctgtctcaaaaaaaaaaaaaaaaaaagagtaagagcctgaaggaaaggcctcattcctgaaagtggaactggcaccttatttggggggagaaaagaaagacatgccaggtaaaaaagtctccttgagtaaagttacacagatgtgatggtgttttatgtttctcaggtattgagttgactagaaggctctctaaaggaactgtagtgacaagtagatagcatctgattagggaggccgtggattgcttgaagtagaggaaagctgttgaagggttttgagactgtgtaaagtggtttttaggaaaactattcagatggtttggagagacagaaattagaagacttcttaataaggccgtatacacagtagtgtataatatataataaaaagagacaaatttgagttctagtgccgcatgttattaggttggtgcaaaagtaattgctgtttttgccattgaaagtaatggcaaaaaccacgataacttttgcacctacctaataaaagccacatgaccttggataagttgtgtgatattactgaatttaaatttccttatgtaaatattgtggacattcatacatattataggcttgttgtaaggatcaaattgtatagtgctggtaaatgttctttgggttttttagtttggtttcctctgccctttttattttatttttatttttatttttggtagagacaaggtctcactgtgttgcccagactaatcgtgaactcctggcctcaagtgatctgcccacctcagcctcccaaagtactggaattacaggcatgagccaccgcacccagctctgttccctgtcctttggaatctactagaagtaaatgttctttgtaaagggctgtctgtggtaaaaaatagaatgacaaggtgatgagaaccccaacatgagtagcagaaatagataaaaggtctcacaaaagagtgcttggaagatttaaccaataagtgagggacagaagagaatagtcaagagctgcttgagtgccttttcttggaaaacttagtttcagccttacattgaactgttccctccctgaattcctctagcacttacactgcacatgggaattaagctgtcacttaatatgacatactgtcttgtattatttcaccaatttgtatttgcccgttttcctgtgagtgcttctctgtagtgatcaacacaagataagtacttttagcattgaatttcgcagagaaaaaacttgagatctgccacctcagtcttcagaaacagctttagaggatggtgcctctaattgtttgaagactgagggtactgtgggagagaacttggggaaaaaaatgttattctcagtggagcaggatctgaatgaatagagaggcttttgctgtgtgggaatgagaagctattacctttaatataatttttttttttttttgagacagagtctcgatttgtcgcaatctccactcactgcaacccccgcctcccaggttcaaacaattctcctgcctcagtctcccgagtagctgggattacaggcatgtgcctccatacccggctaatttttgtatatttagtagagacagggtttcaccatgttggccaggctggtctcaaactcctgacctcaggtgatccaacggcctcggcctcccaaagtgcggggtttacaagcgtgcgccaccacacccagcctaatataatttatttaatttgatgtgtcttgatttgggcggggagggtttttattttatttctgcagctgtagtttcacttgccataaagaagtgtaataaagagatgcaaatatgctcctagttttccctaagcagatgtgaatttctactcttatgaaactgactttaagaacacagcaattcttgtttcctgatcttaaaaataagtatgcaaatataatctttccgcctccatcacagaataacttgacttagatcattgcagtatgttattttgccccaaatacatcaaagcattttcttctgcctggcagttataaagaaaagctgcttgcttaatttgttttggctattaaagttgatatgtggtgttaaaccatgctttccagaagctattatctagacccttttagccttatacctggatttctgtctcctggctggcctgtcagcctgatcttaaagcacagctttaatctgtttacatcagactcctttgagaattagttaaaattaacagatttttggacctttttttaggcctgaatatctgcatttttcttcacatgtctctattacctctgcattttaacagttacctccaggttgagaactactggcttaaatgattttttaaagtctcttctggttctgacattttaaggtttttgttttgtttttaaaagctattctgcttaatagtggtttctttaaaatgtttataatgaagagatcctgaaactcatatgatacttcagcctcattttgtagacaaggacacaagcaaagcaacttgcccaagaccacacagtgaattagtaacacttacagaacctggctcccccagtgcttaatccagtgctctttctttactcagcacattgcttcccataccagagtgtgccttgtgctatctaatgtgctagctaacgtagtagtgggatgagcatctgttgtgaggtggaagacctaggctgtggccttggctttgtcacccaccaaccatatgtccttaggtatctcctcttttactctactggaagatatcttagcttgtcagacttccaggtgatatgcttgtgccctgttacctagctctgacaaagaagatgaacggttttataacattactataattgtgtgtgtgtgtttaatgaaacaaggtgctggccttttaatactgttgcaaactgatctttattagcgtctcaaaactcattattttttatttcctcaaaataaaaagtatgtgtgtgtcaaaggccactatcaagaaagtgaaaaaagacaatctacagaatgagagaaaacattttcaaatcatatatctgataagggtctagcatctagactatataaagaattttacaactcagtaataaaaagacagcaacctagtttttaaaagggcaaaagatgtaaatagacatttctccatagaagacgtacgaatggcccatagcacatggaaagatgcgcaacatcatcagtcattagagaaatgcaaagtaaaaccacaatgagaaaccacttcacgtccactaagattgctataataaagggggaaaaaaaaggaaaataacctgttttggtgagaatatggagaaatcagaatcttcatatatcgctaacagggatgtaaaatgtggtggcactcttggaaacagtttgacagttcctcagaaaattcaacgtaaagttaaccatatgacccaacaattccactcctaggtgtatacccaagagaactgaaaatgtgtgtccacaggaaaacttggcacacaaatgttcataacacagttatcataatggcctaaaggtagaaacagtctgtcagctgatgaatggataaatgcaatgtgatatatctatacaatggaatataatttgaccgttagaataaagtattgatacatactacaatatggatgaatcctgaaaatgcgctaagtgaaagaaaccgatcacaaaaggccatatatagtatgactgcatttgtatatccatagagacagaaagtagattgttggctgcccggggataggggacaggaataagatgtgactgctaatgggtatggagtttctttttgagggtatgcatatattctagaattagatagtggtgatggttgcataaccttgtgagtatactaaaaaccactgaattggcattatttttaaatagtgaattttatagtgtgtgaactatatcgcaattttagaaacttatttttgtctttcctggagtaacccttaaagtttcaaattattatttctttaaactatatgtcatgtaacacagtggtatcacagacactgattactttaatactattactttaattactaattaaaatatatatatatatatatatatatatatatatatatctgcctgcctaggtacctttttcagctgttgctagcaccatttctctgctctgatctccatcttatcaaatttcaatagtagttttttatattacttagcctttcagtagcatttgacttattgatcacttcttttttcttgaaatactttctttacttggcttctaggacaccacttgcccccagctttcctcctacgtcaactagtctttgttgtcttcattgttctttggtcttcttcctgacctgtgtaaatattgccagtccctgagcttatgagcttattacccctggccctctcctctgtctaccctcatcccaaggtgatacccaatgtcatgacttaaataacatgtagaagttgctgacttctacatttatattctcaacctggacctttcctataagtcccagacttttctgtccaaccgcctacttgtcatctccacttaaatgtctaaaacatgtatcaggcatcaatagccagagccaatctcttgatttccgcttacccctcaaagtgcttctctcccagtcttcttcatttcaggtagatacctccattcatctaatttattcaaacaaaaacctgagagttacccttgattcttctctttgctttgtactccacagccatctcattgtcgtattttcctggctgtacatccagaatctgaccactcctacctagagagctgtagtagccctttcaactggtcttccagcttccgtgcttggctccgttacattttgttctccacacagcagccagactgatgttttaaaacatagatcactcactctcttgctgaatctctccagtaacttcccatctcagttagctaaactccaaatccctaattgtggcctattttatagcccctgcatgttcttgatcctgcttgtttctgtcatcctcatctgtcagtttctgcttgagtcattatactctggaaaccctggcttttctgctgttcctcaaacacgttaagcttgggggattttggtgtactgttttcactgggacactccagattttctcatgggttactcctttattcaactctgctcagatgttaactattttccctcactattttttagtctttttaaaaactctattgcatttttctgtataatcttttttagagcctggaattatatgcgtatttgtttactttttatcttccatacaagaagaagctctttgagtgcagaatttgtcttgtttatgactatatccctagtggctagaacagtgcttggcacatagcaagcagccattcaatattaatttaaagaaaataaagagtgtaattgccataaaggttgtgtttaaaaatattatttttttcttttaaaagaatgtccaacactggaatgaattgctattgagaggcttggcagtttccttaaaaagaaaaagaaacccagaaaagtcatataacagttaatatttttccaggcagtaggagatggatttcagatgaaacggctgtatggtcctctccctgaatttgcactcagctgcatttttcagaactgattgcatgtaattcttaaatggagcacgtgatctgccacctttctagaataaggactcatcgcacatctgtatcaatgtagtacattcctagccagtcttcgtgccttaattcaggtcttccttggcagcatccctctctcttccaaccctccccagtcagctttgctgcagattgatatccctgaggaaataggtaacattttatccaaaatcttttttgcagatccttgaacttgtagtgtgcccttgcccctctatgtctacttcttaccatttagcacttagcatagtttataattcattgtaagtataggattttccttaactaaattgtaaagaccattttttttgtatatctgatttcttgtctacccattgcaaaggtaagaaattcatactggatgattatgccaacaattcagtcagactttagaagatgttagttgctagtagtgaaaggattgttgactacatttcagtttgctggtagaaaaaaatacttcgttgttggagcattactgattaatatgctgaatcaagttgttttaactttaagctcttttcagccttagatctcacacttactgggttcagtggtgggatgtttaagtcatggatccagtgatctggccctcaaagagcttcagtcatgtaggcttctctattcatgggctgggttgatgtagaagcagccccgtcactgctaaatgcagtttgtggtggagtagagaaggcagtgtaaaacctaagaatcagtttctctggggttgtcactaatgtgtgtgctcataatttaattaacacatggtaatttcctaacttctaactccagtgatgaatgcagtcagtaataagcactgttaagctagtaattttctttgcagtgtatcttggccatttttataaaaaatagattgaaattgaagattcagtgtgttgctaagagcataatctctttgagataccatgtttttgctgaattgggatctaaattagatgacagtgcacattcttaagatagacatcattttcttcccaaactgaacattttcctttcttgctaaatatgtgtgtgtgggggggatataggcactatatatttccaactgaaattgtaatctcagcttctgagtttgccatcagtttttattatctccttattttagtttagaactccacatatacaaatgggtatttatcctttttcctcctgtattcttcttcttggaaaatgacatgatggctccaacaagtcatccaagccctaattctagtaggtggtcatctctgtctcttctctttcatgttccttataactagtctgttactaagtcctgccaattctacctcagaatactccctttcagtccccctactgctgctctgttgagcattgaggctctgcacttacatcaggccccatctgcatctctatgtccagtgttactcccctccagatcatctgccaggttgccactaaaatgacttaaaaaaaaaacgtaaatttgattgttattcccatgcttaaaatactctccattgcctgcttcagaataaagttcaagttctttagcctaataactaggaaatggtttctctcggatgcctcatctcctactactttccccctttgcagcttctgtctactttctaaactgggataaaggagagaaaaagtttatttttcttaaagccatgctcagttctgtctaaatcagaacagggtcaccattgacaccactctcacccttggtaattcttcatctctccagtgtgaattgaggaatcctttgagtcttattatcaagccagggaactttatgaagcaatccactcaggtcttttatatcactgcataacttctgttttcactgtgattaaaataagataattgaaggtgttcatgtgtcatactcaaaacaattttgttttgctggacatatcctaatgaccaaggattttgtccttttgttttttgagatggattctcactctattgtccaggctggagtgcagtggcacaatcacggctcactgcagcctatacctcctgagctcaagccatcttcctgcctctgtctcccaagtagctgggactttaggtgggcaccaccacacctggctaattttttaaattacatttttttgtagatacggaggagtcttgctatgttgcccaggctgatctcagactcctgaactcaagcgatccttccaccttggcctcccaaagtgctgaagttataaacatgttgccactgtgcctggcttattttgtctctttttttgatcccaccctatccctttgagtgtggtgagatgcatgggaacagaaggctgtattccctcaaatgagttaatttggaaaatgccttcctgtactgactacatatccttcagacctgagttgtgtttaatatccttcctaagcacttatggagttcctgatgccataccttcagtgaagtgtctttgtagaattttttattattcaaatgtgcagtggagaaacgtaactgaaatgattcttcataatgttctattaaagctatcaaatgcctgttttctttgaactggttagccagccagctctggcatcaggtgtgttagtctgacaaaagttgtctttatcttggccgggtgtggtggcactttgggaggctgaggtacgtggatcacttgaggccaggagttcgagactagcctggccaacatggtgaaaccccatctctattaaaaaatacaaaaattagctgactgtgatgacacttgtctgtaatcccagctactcgggaggctgaggcatgagaattgcttgaacccaggaggcggaggttacagtgagctgagatcgcgccactgcgctcagcctgggtgacagagtaagactctgtctcaaaaaaaagttgtctttatctcttcagtgggtggtgtaggggagtaatttctttaagatagtactttttgagctctgttttcagccaaattgcagttggttttacattggggggggaggttcaacatttttgataccctgtgagttttgtggtcctattcaagattaacatcttttttttttttttaggtttttaaaatgttattactagagcttgttaggaatcaagatacaatgtatagctgtcacttcagggatctctttgtttcctgttctttgtgtttttgatggctaataattcctttccttgcacttcatgggaaagcagtgtagaataatgagagagcatgggttttgagtcctggctttaccactttctgcctttcacctttggcaggttttttaaacccttagtgttatctgtaaaaggaggattttaactgttcttaccttgtagagttattgtggaaattaagtgagatagtgtatataaaatacttagcacatccgtagcacatgttaggcattcaggaaatggtagctatgattataccttctgtctgccctccatcccttaaagaaattctgtgaataagaaccaagtgagatcattttgaccatgtttacatttgctaaatttaaactggagagtaacattttagagatctttttcttccctttttttctttataaggatttagacattaaaaaaaaaaaaaagctattgagagtatattgtgttccaggctctgagaatacaaaagtgtatagtccctgtgacccagtgagggagacaatacatacagtcaggtaaccatgatgcagtgtattatatagttttatatcattaatagcaacagcaatagctaatttttatgaagtacttgctaggtaccaggcactgtgcactgtgctatgttttataattacactatttacttctcataccaacctgtgaaatagatactttcaccatcttaattttacaatttagcaaactaataaggctttagagaggttaaattatttgcccagtgccttccagtattaagtggaaaagtgaggattaaaataaagtagcctgactccattctcccttggataataaggattcaccttattgggtaaggaaaaaaagcatttgcctacatacatttgtatttagtctaaatccagtcagcttgttttttgttgttgttgttgtttgtttgtttgtttgtttgttttttgagatggagtcttcctctgttcacccaggctagagtgcaatggcaccatctcggctcactgcaacctctgcctcctggattcaagtgatctcttgcctcagcctcccaagtagctgggattacttagcctggctaagttttgtacttttagtagagatggggtttcacaatgttggccaggctggtctcggactcctaacctcaaatgatccatctgcctcagcctcccaaagtgctgggattataggtgtgagccactgcacctgaccagaaccaatcagcttgtgatttgaagtacagtacacctttaagaataaggccacaatctgctttgggattgagttcagggattaaggcaaataaaaataagtttatatcactgaagaagagacagttttataatgagccatgtatttgtaatttagccctaaagaattttgttggcctgtcatttactatttgtatggcacttaacatctttgaactctagttttctaatctgaaggacattggtttctggattgagggtctgcttagtgctgcaataaaaagatgagtggcaatagcagttttacagtgggtgaaaattgacctgtgtaagggatatcatcttgaaattttagatactggcaacataaagaactttttctagatttccagaaggaaaggtgttcaacataaatcacatcatttatacaaacagttgaggcacagtgagccattcttatcactgagggaatgtatttatatcagtgtagggatttgttttatcagccagcttgtcagataccagccaagggccaaccttgcaaacaagccttgctaaagatggcagtcttggacccaggttcacttatttctgcacactgcccttctttttaatttatcctgtgaggtcccacataaaagaaactaatttttgctttctctttttattattacaaaaggaaagcaatttgcaattagtgttgaggaagacaaaattgaggcaaaaaaaaaaaaaagatagcttttaaaatacccgaattagtagtagagagaacatgaggagcagcatacattttagttgatgagcagtttttgagcatgatgagaagtaataatcagaaaaagaagcacctaatagcaactccccttcttccagatggttctccatactgtagtagagacattacttgcttcgaaatgggctgtgttgccgtaaagtcaaattataacctttcttgtgatttcatgtaattcactggaaatgtttcttttccacttactgaagattgcttctaggtaccaggcagtgaagttagagctgaggctatttcaatacattgtaatggctgcttctgcattttattctcccaaattggttaagacattatcctctgacttttaaaggcaagtttcttttctgtgatgcaatgcaggcagtgaagtgtggctaggtgtctgagaatatgattttcctgtttttgaatgacccataatttttaaatgactttattctgactttatttcacaaataattcaaatgctatggtggatttggctctacaagttggttcttttgcatgtcttcaaagagggatttacttgacagtgtaaatgagctatctagctagaaaacctgctaatttctttttggttcagtttgtatctttaaaattagatgtcgtgtttgatttgtaggctggcagtctatggcagtcaatagtgcagtatgctgccatgagtaattttctcaaagaaaaatttttgcttttacagggcaccaagggggaaaaaaaacttgattgacttttaatcactttaagtatggctatttttagctcatgttatttcttctaacaaacttcacagaacaggttttctcttttgtgtaataatatatagaatcacagttaaaaaaaaaacaaggttgatgaattgtatttctgtagttgtttaaaatctttacaattatttttatcccatctcttattttattttttattgtttgtttgtttgtttgtttgtttatttatttatttatttattttcagagacaagctctcactatattgcccaggctggactcgagctcctgggctcaagctgttctgccacctcagcctcccaagtatctgggatggcaggtactcaccactgccatctctttatttcttataggcattatctttgtacttgtgctcaatccgaaagataaatatgacattctctgtctttcagtaaaataatccattctaaatccagatgaacgttggattgcttgctggtttgtaatttttatggaatacaatatttgttcacttgatctaaaaaattaagagttggccattaatggtctacaaaaaacaggtttgtcagattatttgtagcaccctgttcctcttaagctatatttacttaaatacttgcatttgagaaaattttttactatgtaatatattcacatggttaaaaaattttaaaggcacacatagagtaatcttactcctccccgtatttctctaccctgataagatatctggatgtaccgtagtttgtttaaccaatccccttgtaaatgagcactcgagttacctccagcttttcactattacagacaatgctgcagtgagtagccttgtatttcatttcacatgtattcagttatagaaacattcctggaagtgggaagttgaattcagggtgctaagttggcattcgtaggtgctgtaacattttgaacttctacatgagcagtgagagaattatttgcttctgaatagcagtgtttgggaaactttctaaacctctatagataagggaaatagaagtagagtttgtccactcaactcgtgttgggactgagtctgggacttggtttgtaatttaaaatgtagtgttgtttccaacaggctatcctggaattgctatcttaaagttaagacatgctggtaaaataataaaagttgttagctgacaaagtgatattaaaggagatcctccccattttgttagtatctgtaaattcatgtatctgtattttctgagttttgtggtcacagaaagaaagaatgaacaaatagagtaattttctgtactcacatttcggtaaaatgaaggtgggatatacaagtttacacttacagtctgtgcagcccatatacgttttctggttctggggttgtttttatattctctgcatggagactggcaacatcagcatcacatgagtaccacctgactctagtgacctagtctctttcaacctgatttttaattgtttggtcttttttgtttgtttttaactgcttcttgcagggctaccccataggagtgtgcccagaatagcctgttttgtcttttagttctgcaacatcagaagacaaagagtaaatattatatgtgcatgagggatgctcttaaaaaatggttcattttactttcagtaagaggccaggtttcttgatgcacaacttttttgtttgttttacagtggaagatagatgataagcctgtaaaaattgacaagtgggatggatcagctgtgaaaaactctttggatgattctgccaaaaaggtactttcttgaggaggggttggttagtatctatacagctgatggccatctctcctgggaaatcttttccttttgtaacttggagtgaccttagttttcagtgttagaaattaagtcagaaagcagtttctaaaatttctcacagaaaaagtcagaggaagtgtgttgaaatatcaccaacatggcacatgtatacatatgtaacaaacctgcacgttgtgcacatgtaccctaaaacttaaagtataataataataaaattaaaaaaaaaagaaatatagatgttggctatctcaagaaagctggtaattttttgtttttgagattaattagcctagagcacagaagggtgagagaagataggacattcattcatgataaatcatctctccatttgtaaaagtaaaacattttagctgtgggaaaagttgaggagtttaaagttttttatatgagggattgatgaactttttctcttggttctttatagaaggcttgagttttacttgtttggtgtggtaaaatcccaactggagggaactacttggtaattcatatgattcttttatcatggaaatcaagaataaaagcacatactggggaggaagtattcctattagcttgattccttgtttttctcaccaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcatatcctttatttatgctcaggttgttttctagtgactatttttttaaatctgctgatatttctccctacaaaaaacaaaacggactttcatattagggcttgctaatgttagaattcaacattttgagctgtgatgtttatatagtaaatatctatcagtttatatagtaactgtcactgatattttatgttttgtatggttattttatcgtaattcatttttgttattaatgtagaggttattgtcctaatatgagcacttaatagcaaaacacatagtaatagtgaacccagctcttctcatttctagcccagaacttttcccgttagacgtggctgcttcaagccactcattctaggatattaggaaaggatctgattttggagactcagatctgtattaagtttacttgaagctgaggagctgaactggaaagtactgagcatgagatacaagtgtggcttgtattacagtggaattaagaacttattctggagctagagaatatgggtttgaaatccaaggtatctgtgatcttgtgctaatgaaaatttacttatttttgagatgatttgaataccactcatttataaatatgggtagcattcagaattatcataaagattaaatgagagattttatattgtatttgatacataatcatttcctttcccctcttttttatgataaatgtaagatcatggtcgttgcctacccagcgtgattttttttctcaagaagttgaatataaagaacttaattatacttcactattaaaataggtaattttggttggtagtttacttttttaaacaatgttaccactacctaaattttgttttgttttcttttttttgagacagggtcttaccgtgtcacccaggctgaagtacagtggtgtgatcatgactcactgcagcgtcagcctcctggctcgagcaattctcccacctcaacctcctgagtagacgggcacatgccaccatgtctgcctaatttttaaattttttacagagacaaggtcctactacgttgcctaggctggtctcaaaactcctgggcccaagcaatcctcccaaagtgctgggattacaggcataagccactgtgcccagccaacctgaaatatgttttaaaacttcatgttggggatttatcttcagaggcagttagcaaacctctgataaagcagatcctagtcaaaaattgtattatccagattgccccacatttcccccagaagtggcaccaggtgatccttgactcctttcagtaatcagattaatcatcccagtatgaatttttcactattaaggcagttcagaagaataatattccataggttctagagacagttcccaggggaattccaaagagatttgaaaatgatagcaacattattacaaatatctggcctcccaagagaactaccttgatggtaattcatttgtttggttatatttgtttaataaaacaaggtcttatttttgtcatgtcagttttatttataatgtagggactaccattataaatgtcttctgttgctgggcatcgtggctcatgcctgtaatcccaacactttgagaggccaaggcgggcgaatcacttgagcccaagagttcaaggccagcctgagcaacttggagaaatctgtcactactaaaaatacaaaaattagctgggcatggtggcgcatgcctgtagtcccagatagttgggaggctgaggcacaagaatcacttgaatccagggggcggaagtcacagtgagccgagatctgctactgcactccagcctgggcgatagagcaagactctgtctcaaaataaataaattaattagataaaataaaaaataaattagctgggtgtagtggcacacacctataatcccagctactgaggaagctgagatgggaggattgcttgagcctgggatgttgaggctgcagtgagctgagatcatgccactgtactctagcctgggtgacagagtgagaccctgtctcaaaaaaaaaagtcttctgtatcctagactgcatatatccttcatctctaaatctcatgataattctaaaacatcagtattatcccaattttaaaggtaaggatactaagacttggggaaggaagttatttgttacaatcatactgattaaaggccaagatttaaatctaggattatctctactctaaagtccatatactttgtactatattttcctgcctttcctgttcatgaaatttatctattttttaactcttctttaatggaatgcttcatgaatttgcctgtcatccttgtgctagggccatgctaacctctgtatcgttctaattttagtatatgtgctgccgaagcgagcactgttcatgaaatttatttttattttatttattttatttttattttttgatacagggtctcactctgttgcccaggctggagtgcagtggcacgatcttgcctcactatagcctctgcctcccaggttcaagtgattctcctgcctcagccacacaagtagctgggattacgggcctgcaccactacatccagctaatttttttttggtttttgtgggttttttttgtttttttttttttttgagacagagtcttgctgtgtcacacaggctggagcacagtggcacgatctcggctcactgcaaccctgcaacctctgcttcctgggttcaagccattctcatgcctcagcctcctgagtagcaggactacaggcatgtaccaccatgcccagctaatttttgtatttttggtagagacatggggtttcaccatgttggccaggctcatctcgaactcctgacctcaagtgatctgcccacctcagcctcccaaagtgctgggattacaggtgtgagccaccacgcctagccttaatttttgtatttttagtagaaatggggtctcccattgttccttgttggccaggctggtttcaaactccaggtctcaagcaatccacctgcctcggcctcccagagtgctggtattaaaggtgtgagccatcgtgcccagccttgtttatgaaatttaaatggcacagtatacacaaagctcttatgccagtttttggcaaactataagtgcttattaactatggtacttaatactgtcaaaaacaatataataataagtctatatgcatataggaagtaatcgtagtactatttgacatactctcttatagtaaactatttgggtcacttttcttctcttaataacccttaaaatcagttgaacatggtcaagtccactgggactattcgttgttttttataaagaaataagcactattataacaaagtcttgacaaactaggtatcttattatacatgttgtctttgaacataaagatgagagctagtttatgctctgtatctttttcttttcttcctttctgaggtgtttgcagaattaaccagagagagccttgcttctcttggtatataaacataaggatgaaaatgaaatagctaaattttcagtgttttggcagcaagacaaagctgtcttctttaggactatcattatgaaagtttttatatctgttgcttgtcaatttgtgttacttctcttttatgtttgggtattttccccttaactttatttgaacctattttgtgatgatggggattctgaccatttatacctcatataaggagaagagcatctttctcgtggcccacaggaaagatcctacaggaatggatcctgatgatatttggcagctgtcctccagtcttaaaaggtatgactatcctcacagatttttaaatcctggtgttggatttgccctggcatgttgtcattatcaacagaagacttattatgtgcctactctatgtggatcatagggctagtcatataaaatgaagaaaggagtatggatgatctagaaggtttgtcctagccctatagttctgagattgcgttatcacagaaatgctctgaggataaactgtgggagaaggtactttttcctgtggccagttaacagagacgattaagcatacaaaagtataaaggccaaagatgtgagatcagttatctttgaagaattccattagcttctgtgtcttctatgatcctgtcttctctccacgaatacaatcaagaatatctggagcagtgcactgggcaactcaaaaaaagcacaatctagagtctgtttctgaccagtgtcaggtataactttgtgcagctgacacacatgtgttttgtaggtaccaagaactaggttcatgttccaattcagtttctttctagctgtataactttgggtaaatcatataaattatctgaggtttagtggggtcaaaaatgatgcctagagtttctgggaagatgaaataccaattataataatagcaaatgtttattgaacatttactgtatgttgggtattctgctaaatgcattatctcattaagttttagaacactcattttatagataagaatacaggcccaaagtttaaatcaactcttccagtatcatatagcccaaaagtggtagagcaggaattccagcccaagtttgaaaccagaattcatactcgtagtcactatcttaaaaacctattatacttaactggtgcataatagccgcacaaattataggtacaattatttatatatgaagttaagtgtagcatctgtgccatacagactgtctcattgccaacttgtagaagcgcctatgagaaagggaagcagaccttcattctgttgttgcagctgagttcttgcttatctcctgacagggcttctagctgccctttggcctcagccatcataatctgcatcctctaccaggccactgaagctgagttgcagaattctaaaacctagcggcattataatttcattatttttattctgacttttgtattttttaagaacttttatataattcacctaccatacatacagttcacccatttaaagtgtacagttcaaaagtacctagtagtatttacagatatttgcaaccattatcacagtcaattttagagcattttcatcacctcaaaaaaaaaacctctgtactctagctaatcacttccctatcctcccacttgcctgagccctgggcaaccaccagtctactttctctgttctcttttatggacatttcatatgaatggaatcatacaatatgtggtcttttataactgggttctttcacttagtgcaattacttcctatgtatactgcacacaaggttcgttcatgttgtagcatgtatcagtacttcattcctttctatggtcaagtaacattccattttgtttatccatttgttgacagacatttgggttgtttctactttttggctattatgaataatgttgctatacatatttgtgtacatgtttttaggtagacatgttttcatttctcttgggtaatacacctgggagaagacttgtatggtatgctaactctctttgtttgatgaactgccagactgttgtccaaagtggctgccctattttacaatctcactagcagtgtacaagggttctgatttttttcacgtttcctgctgatttttaccaactgccgtattgttggtggagtggaatgtgaatgttcttgctctcttcccggctttctgctgatgtcttctccctcccccacctcaccgactgatttagtagcttaacagtggctgattctgatgtcttattcccactgccaggtcatgtgatgtgaaaatggcaatgaaaggtttcacagactactagttgccacgtgcagacaacacaagctatgtgactctctcgcaaaaagtgattttgtcactccccagcaaattcattatacagtctaaactccttcagcatatgaagtattacagcattcatcccctagtgacatctccagctttcttttatgcccctctcaaaatacattctcttactctggcaatattatggaatttgcaatatgctaagttatccaagtttccagtgaccccgtacctttaaacatattcttctctctggcttagctatctttctgtaacctggctcactcctacttccaagaagccttccctgacataccttagtcttccttaacatgccttagtctaaattaggtggtcctagttattctttttttttttgagatggagtttcactcttgtcacccaggctggagcgcaatgacgcgatcttggctcactgcaacctcctcatccggcttcaagtgattctcctgcctcagcctcctgagtagctgggattacggacccacgaccacacccggctaatttttgtattttttgtagagatggggtttcaccatgttggccaggctggacttgaactcgtgacctcaagtgatcgcctagccttggcctcccaaagtggtgggattacaggtgtgagccaccacgcccagcccatcctagttattcttaaaagcatttatgcttacctctgttagttaccacatggagctataattatttaatatctgtgtctcctcctgggcccgccccctcctccaaagtgtgagctcctttaccattcactatacagtagaaacctaagcccaggtgggactttctcactcaccccttggtaaccagacccagcccagggcctggcgtggcatgttttgttatgtgaatgattgacattcatctgggctgggctgcagccttgacctcctaattagtctttgcctgcagcccagtcattgtcagccatccacaaagtcccctataacctagccatctctatgaacattcccttctcttttttttttttttaaacaacaaattggatccactgaaacttttatttaactttgtaatatgaacatttaccatataaggttataagacaatataaaatctatctcatttcatttatagcatagctataaatcaatctaatctctcttattaatgttttatatatatatatatatttttttttttcctgcatacttaggcaatattttccccaagggatatatcattctcagtaaactaccgcaagaacaaaaaaccaaacatcgcatattctcactcataggtgggaattgaacaatgagatcacatggacacaggaaggggaacatcccttctctttcttaccctaagtgaaacctgaccataacctctgaggacatatttccactgcagactgcaagtggtggctgatgtttctctcacagccttcattactccggtactacaggtagagatgggtctctcctttgcagcttccaatgcgtcctcttccctaaaatcccccctttgaatgcatgtcatcacattgtgccacttctatgcctcttctttgcggttaaacacacacctagtcttttgaagataattcctggctcattggcactctctctaacatttgtcctttcttaagtcttggtgattgccatattcacatagatggttattctagtaacttggcctctcagttttacttcctttcttcccattatcctgttttctatcatgccttaaacatttattttcatagacataccctagtagaccttgcaattaataagaacaaattacctgcaataatttcagttttaagtatcccaccctgaccattgcttcctgttactctcatttatttccttctagttctcttgtcacggcatttcttctgccccagtggcatctgtaacccacttcacttcctccttacctggcttagattccatgacacttctgtagtccagttactctctccctgtcctggaggatctttcatatcttccctgtcctcaaacctgctaggcctcctcccccatctttactctcggttttttgttgttgggaagatagaagccatcataagtctaccatcactactcacctacttccaagtacctatctaaggccttccctcccttgggtctatgggattctatctcttctctcttacttgatgttttcctctctgctggatcattccttctgacatacaaatatactgtaatttctcccaactgaaaaaaaaaaaggttttctttccccttctgcttctcacacagtctcctcatttctctgctctccttttcttcttgtgctatcacctggatctgctcttgtctcctttacttgacctgtcagcagcatttgacatagctaattacccttactttgtaatactttttttttttaactaggcttctcagataccacacacttctaattttcttcttaccttaatgtttgttcctcagtctcctttgtgattcttcatctcccatttttttacatttgaaatgccaccagggcttgttctggaacctcttctctatgatgaagatctctaaatttgtattttcatccttgacctcttctctgaactctaaatatattctggcattctttttgatgttggatcctaataggcatctcaaagtcaacaggtccaaaacctaactcatctctcactcatccaaacctgcccttccctcagtttttcccacttcaataaatggcagtgctgtccttacagagctctggagtcattttgactcctctttctcagtccttctttagtctgtcagcaaatcctgttagctccaccatctaaatgtattgtccaaccatttaccatctccacagctaccatcctctctcacatatgttactgtaatgatgttctttttttgttttgtttttttgagacagagtctcacactttcatctaggctggagtgcagtggcgcgatctcggctcgctgcaagctccgcctcctgggttcacaccattctcctgcctcagcctcccaaatagctgggactacaggcaccagccaccacgtctggctaattttttgtatttttagtagagacggggtttcaccatgttagccaggatggtctggatctcctgacctcgtgatctgcccgccttggcctcccaaagtgctgggattataggtatgagccacggcacccggcccactgtaatgatgttgtaatggacttctgcagccctctctccacccatagtctattcccaggacagcaagcaaagtgatccttttgaaacataagtcagatcaactcagtcttttgctcaaaactctctcagagaaattgccaaaatcctaaggatggcttagaagtccatacatgtctattctctgcactccacacaccgatgcaaacataccctcatctccttggctctcatcctctcccacttcattctgttcacattaggcccctttctgttcttaagacatttcagggatgttcttgcctcagggcctttgcacttgctgttcctttttcctggaacattctttttccagatagcttattctcttacctttcttgtctctgctcagacatctgcttagtgaaggcttttctgcccatctatttaagagaacatcttctttttttatactgtctgttccctcacacacactaaaatgaaagtcccaaaaggcagacatttatattatgttcactgccgtatatccttaccatctaaaactgcctgtcacatataggtaggctcagtaaatatctgaattaatgaacatttctaaaatgtatcaggtcacaactcatcagatcatggactgccaccaaagccatgtaactgccaataaaactgggcacagaagtctaaaaattactgtgatatcaattagcagttggtcagaacttgagaaaatattttgaggtgttgaaaatagttaaaggaacttcactactagctctccaagttgggagttactgcctagaccaacaattattgaggagctgtgaccttttgagcactagttaatgatagacactgttttagtcatgacagtaatcctgaaagcaggtggaagttctcccattttaaacatgcagaaatagagcctcaagaaactgcttcatttaaagataatactagcttgacaatccactgaatatgtcctaataaatggaaacagggtgggggatgtcagcctaccagtaattggtgtcattaaaccctcttgaatgaatggacatagtaatggccttcagggtaccttgaagtatagctaaaggaatctctggagttcatttagtaaagcagttggcatccctggcctgggatcagagtaaaacctggagctagattgattacagagtgcaaggactaggcaccccgggattggagagcatccttgaaagcaagggttcttcatttatttataaaaatttgattgcctactagaagcccagctaagagtatgaagcaattaagacaacaatctttgctcaagaatctcctagacaatcctgattcaagcaccagaaacaaagggaaaagaaacctcccagtctagtgaagaaagtagtacacatcatgtcaacagataggtaattttgttgataccataagagcctattattaggcctggcatatgacaggaggtcagtatttgagttgagtattgattgatggtactgtggaagacagaggaaacacatctgacccagattggtaggctttcccagaaaagtttatgcccaagtatagtgttaacaaataagaacttctcaggtgagataggggagaagagtctgcgaggaaaacctgtctagcatggcaaatacgaagtccagagatgagagaagatggtccacgtggtttaaaagtctacaacaaggtaaaggaggtacacagtaattaaagtaggaaagatatgtcaacacctaagaatcagaactagtatcttgaaaagttaggagccctggggttttgtttttgcttttgcttttaaaggatgtgtttgttccctgtatcaccgtgcccagcttactccttttcttcggaaacacttggtgccgtattgttactggttgaatctctgtgtttggtttttaatttgttatctttgcccccatgcttaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccagg

SEQ ID NO: 643 - DNA, 18794 bp, Homo sapiens
cttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcaggtgagcggggttgggagacaggagagctccccgaggaggactcaactgtggggacaggttgagcaagaccatctgcgtttgggaaatccagccttggattattgagacagagccacctagtcggctaggatctgacctggccagagaattcttggctagtcctatttttattcgttctcacagaagccgaacttaaacctcagaattatcactccagagatgaaagggaactgagactggaaaagccctgcttaccaaaggtctctgggcggcagaaagagccctgagcttcagtttcaacttaggagacctgggtcttggtccagattttactgtggagtggcgttcagtaagctttgtccccatcccgggcccgagttttcccatctataccatgagagggtttagactacagatcttcaaaggtctggcacgtggtaggtgctccttaaatattacttgttaggagtgaataaatgagataggaaggcctcctgggattcactggaggctcattgggttagttggaggctgtggaattacattattatagtctgagaagtaggcggtattatctccattttataagtgaggaaactgaagctcagaagtaaagtgacttgctagtaagtgtcaaagataagtcagacttcagagtccatgctaggctatactctctcccagtaagaaagcgggaaggacttgatgggaaagtgattatatcgagcagcaagtaatcatttgaattctctgcttaaatgaaccccagagcaggcccatatctgattattttctatcccgtttccagcacctgatttgtgtgaaacgttttgggtggcaatgccagaatcaccatctatattacttctgtcatcaacacgatcagcataattacaaaaattaatggctctaattgttatagtgataataaagcataaatgaaattgtgaggacatcaaaatttataattaaagacacctattaaaacagcagtttaaaatttataaaacacttttgagtggttcttcatattgatctgcttaggtaggtattattatccatagtttacaagcaaggaatccaagacctagaggttgagtaaccatcaaaacgtcatgcagcaagaaatggagctgagacttgaatccagcccatgtgacaagttgtgcttctcctttggtgattatttccctatttcctctccatttccttttttttttgagatggagtcttgctgtgtcacccaagctggagtgcagtggtgcagtctcggctcactgcaacctccgtctcctggtttcaagtgattctcctgcctcagcctcccgaatagctgggattacaggtggatgccaccatgcctggccaattttttttgtatttttagtagagatggggtgtcaccatgttggccagggtggtctcgaactcctgacctcaagtgatctgcccacctcagcctcccagagtggtgggaatataggcatgagccaccgcacccagcctcttcctttcctgttctgagccctaacccgctccatgcctatcctgtgctccattcttcttatcacctggagaattcctgtttagatttaactaatagtcacatgttgactgatgatagtagtgttggtttaacttgtaattaaggtgttaagagtttaaagtatgttctctttcagcaataaagggggatttaaatgtttttaagaaagggagttgtaattgttattattgtcattgttatccacaggattcaaggaataaaactagaatatacagtaattggtagtttaaaaataataactgtcatatattgcactcatactatgtcataggccttgtaatagccactgtagttaagcattttatttctatcacctactctgctgaattgtataggggaggatcctgaagcatagagaagttgaataacatgcccaaggtcacatagtcctggcctggtccaaatcctatgttcttaaccattacaccagcctggctcagagacagattgtttgcttagaacaaagcctgaccctcccggggaggagagcctgaattgaggggagagaagtatgctctagtattgagtgagaagatggtctccccttgcttatcttttgattctgctgttgagagcctgggattgaaatgaagggaggcttttcttctggactcagcaaggccactctcccagttcccctcatgatactgagcaatagttcttttcccttcttcaagttaggaacaagtgactaaatattcatatgctattgataaaagtttgtcttggttgacactaggaggctgtagccaaaagcagtgcaactttgccgtatggttcactgtcctgaaagcttcctggaagattggtctaaaatcatcatgccattcctctgtcaaaaattcttgagtggtctcccatctgtggaataaacaccttaataagttatctaagcctcccaggatctggactgtgctgaccccttcagtcccacctctgcccccatcccttgcactccaccttactgtagtcacactaaactactgagaggccccaaaactcactgttttctgttgcctataggcttttcacatccttgtcctctgcgcttctccttttaaccctcagttggctaatccactgttcattctttaagatctggctcactgattcattcaatcattcaacaaaaatttgttgagtgcctattacttaataggcatagttctaggtgtcaaggcggagcaataagaaaacagacatacccttgctgtttctggagcttccattttgtggtatgtattaaacaaatgtaacataggaggcatcaaagtgtgataagtggtgtggagaatagaacaaggaaagaagataggctggggcaaaggagttgacagagaaaccttcctgattggatgatgtttgagcagagctgaagaaggtgagggagcgttatgtggctatctgaaacgagtgttccaggcagagcctgtgactatatgaggcaggagttcttttggctcaatcattctctccaaaaatccttctctggtgccttgatctggatagatgccacttttgtgtttttctacttgctgttgtgtttacctctaaagtagcacttattacatcatgttataattgtccatgtatatgtctgtttccctcacttggattgggtttcttgagagcaggaacctctgatccttctctgtcttctcagcatctattttagggcctgacacagaggaggaacctagaaatatttattgaatcaattgttcttacagcctgataatatttacaaatgatttgtaaaattgggtttggatgacagttggtttgaggaaaaagtaattctaaggctgctttttgtctgtctggcttgattccccttttggacctctgagaagtggaacacctggttttctttaagaagaatacttggagactccattgtgagcattatggcagggtagccaacctgtaaaatggtgggtaaaatataacaaagccggccgggcacggtggctcatgcctgtaataccagcactttgggaggccaaggtgggtggatcacctgaggtcaggagttggagaccagcctggccaacatggtgaaacccgtctctgctaaaaatacaaaaaattagctgggcgtgctggcgggcgcttgcaatcccagctacttgggaggctgaagcaggggagttgcttgaacccaggaggtggaggttgcagtgagccgagctcacaccattgcactcaagcctgggcaacaagagcaaaactccgtctcaaaagaaaaaaaataacaaagccctttatagctgaatttgcaagaaagtaagagaaatctccagggacctagaaaccaagagtgaactgaaaaccagagtggttagctccttaatctgccctcagctgcactggatgtctcacctagaaacttggactttaataggcctgttgttataccaaatgaagctataggtccgcatgggttagactctagtgggttttttgttgtcgttgttggtgtttttttgtttttgtttttgagatggagtcttgctccgtctcccaggctggagtgcagtggggcaatctcagctcactgcaagctctgcctcctgggttcacaccattctcctgcctcagcctcctgagtagctgggaccacaggtgcctgccagcacacccggctaatttttttgtatttttagtagagatggggtttcaccatgttagccaggatggtctcgatctcctgacctcgtgatccgcccaccttggcctcccaaagtgctgggattacaggtgtgagccaccacgcccggcctggttagactctagtttttgacagaggatggcatgtgaaatactcacatgaagctaggtcccttgaaaatctgcaccctgtgtagggtgtataccttctgatagggtggactagtatcttaattcactttctgttgcttataacagaatacgtgaaactgggtaacttataaagaaaagaaatttcttgcagttatggagtccgagaaatccaaggtccagaggccacatctggtgagggctttcttgctggtggggactctgcagagtctggaggtggcatagggcatcacatggcaagggggctgattatgctagctcagatctctagttttcctcttataaagcccctaatgcactcccatgataacccattcatccattcatccattcatgaggacagagcccttataaccctatcatctcttagaggccccacctctcaacactgccatatcagggattaagtttcaacatgagttttagaggggacaaatatcaaaccagatctactaggaaaaaaaaaaattctccctactgacacagatagaagacaaagagattgccttttatcctaggctttcgtacagaaaaaaagttttcccagaaaattcttaaccataggcattcactcatacagatacccaaatggcctagaaactccaagccaagaagttgataataaaaaccacctcaggctggtaatacccctggatgcttggcaaaaacaaatgcaaaaccgctctgctccaagatacatacttgatacaggccacatagaattcccacagggtctggagttaatgaaattctcatttgttaaacaagaatgtatattgcttgctttgtgctattgagagcatatgttattcttgtataaagaaacatttgaatatatctgtgcccccccacctttgctctccagaagtgaaatgatgaagcagaatttatatgcaggccagcatctgggtatggacacacattaagcttccttctatccttgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacaggtgactcttcatcccagatctgagtctgggcctcagtttctcttcacaaagctcagagctcttcaggatctgtgccttttctcatcagtacaggaaagccctgtgtggggagcagaggcagaaaaaacagcaaaaacaatggctctcactgagtgcttattgtgtgccaggggcacattgggtcctcacagccattctgtgtcgtaggtactgttttcagtcatattttacagacaaggaaactgagactcagagaggttgccatttgctcaaggttatacagctataataaagcagtagaagctggtttcaaactcagtcgctgactccagagacctccacagttatttagattcagctaacgtatgatgtgcctttcatttatattccatttaatcctcataaatcacccagggaagtaagcattggtagtccagttttgctgatgagagatcctagtgctccaagaggtaagtaacttgctcaggaccacatttagcaggtgacagggggataccagtaataaccacgcttctactactaaatgctgtatgtgaggtatattttattatccccattttgcaggaggcaaccaggcctgagaattaaggtcatttgctttggtcacgcgtctaataagtgggagaactggagttagagcccttcctcttcagtagaacattttgactgtatttttagtgaggaaagaagggttactgctctttggcctggaagctacagggttatttcagatcccaaataggcatacgtcggagatattgtggatttggttccagaccaccacactaaagtgactatcacaataaaacaagacacataaattttttggtttcccagtgcatataaaagttatgtttacactatactgtagtctgttaagtgtgtagtagcattatgtctaacaaaaagtacacaccttaaaatactgctgaaaagtgctaatgattatttgaacctttggctagtcaatctttttgctggagtgggtcttgccctgatgttggtgactgctgacttatcagggtggtggttgctgaagatttagtgtattattattattattattattattattatttttctagaagcatttcttacttacatagataatttcttaaaataagacaatgggctgggcacagtggctcatgcctgtaatcccagaactttgcgaggccaaagtgggaggattgcttgagctcaggagttcaagactggcctgggcaacatagcaagaccttatctctaataaaaataaaaaacattgggtgggtttagtggcacacatctgtagtggcagctactcgggaggctgagggggaggattgcttgagcccagaagttcaaggctccagtgagctgcgattgtgccactgccctcccgcctgggggacagagcaataccctgtctacccccaacaagaaataagacaacaatgaagtttgctgaaacagttgacacttcctttcacaaaagatttctctgtagcatgcaatgctacagaatttgatagcatttttcccatagtagaacttataaatgaatcctctcaaaccctgctgctgctttatcaactaagttgatgtaatattttaaatcctttgttgccattttgacaatgtttacagcatcttcaccagaagtagatcccatctcaaaaaactactttatttgctcatctataagaagcaactcatttattcaagttttatcatgagattgcagcaatttagtcacatcttcaggctccacttctaattctcttgctatttccaccatatctgcagttacttcctctactgaagttttgaacccctcaaaatcatgagtatgggaatcaacttctcaatgtctcttaatgttaatattatgacctcccatgaatcatgaatgttctgaatggcatctagactagtggaatttttccagaaggttttcagtttactttgaccagattcatcagagtaatcactatctatggcaactatagtcttatgaaatatttcttaaataatgaaacttggaagttgaaatgactccttgatccgtgggctacagaatggatgttgtattagtggccgtgaaaacaacattaatctcctcatacatctccatcagagctcctggatgacaaggtacgttgtcaatgaccagtaatattttgaaaggaatcttttttcctgagcagtaggtctcaacagggggctgtaaacagaagtgcttcatccaggctttgtttttagagcactggcagagtagatttaggataattcttaagagccctaggattttctgagtgataaatgagcattgacctcaacttaaagtcaccagcccgtcctttgaaggtttgaagccagacattgacttctctctagccatgaaagtcctagatggcatctttcagtagaaggctgttttgtctacagggaaaatctgttgtttggtgtagccacctttgtcagttaccttaactagatcttctggataactggctatagcttctcccatcagcacttgctgcttcaccttgcccttttaagttacggagacagcttcttgccttaaacctcatgaaccatcctctgctactttccaacttttcttgtgcagcttccatacctctctcagcctttgtagaactgaagagagttagaactttgccctggtttaggctttgtcttaagggaatgctatggctggtctgatcttttatccagacctctaaagctttctccctatcagcaataaggctgttttgctttcttatcattcctgtattcactggagtagcacttttaatttccttcaagaacttttcagcctggtgtggtggctcacgcctgtaatcccagcactttgggaggccaaggtaggcggatcacgaggtcaggagttcgagaccagcctgaccaacatgctgaaatcccgtctctactaaaaataccaaaaaaaaaaaaaaaaaaaaaaattagccgggcatggtggtgcatgcctgtaatcccagctactcaggaggctgaggcaggagaatcgcttgaacacaggaggcgggggttgcagtgagcagagatcgagccactgcactccagcctgggtgacaaagggagactctgtttcaaaaaaaaaaaagaactttttctttgcatttacagcttggctgtttggcacaagaggcctagctatcggcctgtcttggctttcaacatgccttcctcgtaagtttaatcatttctagctttgatttaaagtgaaagatgggggactcttcctttcacttgaacacttagaggccattgtagggttactaattggcctaatttcaatgttgttgcatttcagggaataggctgaaggaaaggaagagagatgagggaacagttggttggtgaagcagtcaggacacatatagcatttatcaagttcaccatgtaatatgggcacagttgtcatactccaaaacaattacagtaataacatcaaagatcactgatgaaagatcaccataacagatttaataataatgacaatgtttgagatattgtgagaattaaccgaaacatgacaaagacatgaagtgagcacatgctcagttcagggttgccacaaaccttcagttttgtggcaatatctgacaaatgcagtagagcaaagtgcaataaaatcacataggcctatatttcttattgttgctttcctctctcccagggctagcttaagtgagacaaatgagacaatggttttgagagtcttttgtaaaaaaaatatatagttgtgtcatctctctatatctacatagtaggcactttaatactcctaacctaccctgcttttttacctacagatgtctcaaatctgaccattaaatcttcatatccacagcagataaccttcttctgctgttaaagtacacagtgcaaatgctattctgctgaacatgggccttgccatcaatccctgtctttgcttttgataacattggctcacatttctcttggtgaagttttttactttgtgggattttcagttcctgctctttcaccttatcttctcatgagtctttctcatggcctcccaggaccagacttctgcatgtataactagcctccacagaggcccagccctacagcccagtagtacttgggattctagctctttcctttcttctaggacaagcattgcctgtggtcatcgtcatgttgcactgtttttgatcacagacagtaggctgttaagcattttttttaatcctattttttagagacaacttctatgttgcctaggctggtcttgaactcctggctcaagcaattttcctatctcagcctcctgagtagctacgactacaggtgtacaccactgtgcccagccttttaaattttaactgtctgtttgtctgtctgtctgtctagagacgagccctctctgcattgcccaggcgggagtgcagtggctattcacaggcttgatcattgcatactatagcctcaaactcctggcctcaagcaatcttctcacctaagcctcctgagtagccgccactacaggcaggtgccactgagcccagcaagcattttttatcagaccacacctgttgcataacttcactactcagtagtcacacacatccacaaacttgtccactttaactcattctctctttatttcattctctgacttatttaattgtacaatcttgaagttagaagaatcatgagcccaattctttcccaatatagaaatctgtattctattggtagttactgaaatcttagtgattaagagcatggctttggagtcagtcaagacctatcatttattggctttttggccttggatacttgactcttctctgtttcatcagctgcaacatataattaataatagatactacatagtaagaactaaacatttgtcattttccattaagggtctccttgcacaactcttcaggtgagcacctgattgctgtggcagctggtttttatgtgtgaatgagatgatctctacttctctataattacccattggtttgttctgccttctggggcagtcagtctatacaaaatgtagataaaatctctttttcagagaactactctctgaagtacctgaaagctgtattcatgccctctgagtagtctgttttctgggctaaacagcttcagttctttctgtaacttcttagggcacagtcctgatttggtttctggccccttgaaaattgtgattactgtcgttgggatctggtctgagatagcagtgtccttttttaaagtaggatactcagaattgaacttgggactccaagggtagacaggccagctcagcaatgaggtgagctctcctatcttgtattccctttaatgcaattgaaagtaaaatagcactttcttggtagctacatagcacaattgactaatgttgagtagatggtcagccaaaacctccaagtctttttcacatttgttattcttttaaaaaaaaaattaattgtagtaaaatacatctaacataaattttaccatcctaaccatttttaagtgtatagttcagtagtgccaggtatattcaaattgtgcacccaatcttcagaacttttgatttttcaaaactgaaagtctacacccattaaacagctccccatttctccctcctcagtccctggcaaccactaatctactttctgtttctataattttgactactctagatatctcatataagtggaattgtatagtgtttgtctttttgtgatggcttatttcacttatataatgtcctcaagtttcatccatgttgtagcatgtatcagaatttccttcctatttaaggctgaataatatatcattgtatgtatataccatattttgtttatacattttttttttttttgaggcagggtctcactttgttgcccaggctggagtgcagtggcatgatcatggctctgcaacctcgaactcctgggctcaagcaatcctctgcctcctgagtagctgggactacaagtgtgtgccaccatacccagctaatttatttatttatttatttatttatttatttatttatttattgtagaaatggggtttcagtatgttgcccgggctccattcatctcttgatggatactttggttgcttttgcctgttgggtattgtgaataacattgctatgaataagggtgtgaaaatatctctttgggaccttgcttttaattcttttggacataaacacagaagtggaattgctggatcacttggtaattttatatgtaatgagaaactggcatgccattttccatagtggctacaccattttatattcctaccaacagtacacagtggttctagttttccacatccccaccgacatttgtcattttctggtgtgtgtgtgtggtagctgtccaaatagttgtcagggtgatacctcattgtgttttttagttgtatttccccattaattagtgatgctgaacatgttttcatatgcttgttggccattacgtttgttcttgtttttctttttcttttttttttcttttttttttttttgagatggagtcttactctgtcacccaggctggagtacagtggtcaactcggctcactgcaacctctccctcctgggttaaagcaattctcctgccacagcctcccaagtagctgggactacaggtgtgtgccaccatgcctggctaattttttttgcatttttagtagagacagggtttcaccatgttggccaggctggtctcaaactcctgacctcaagtaatccacccgccttgacctcccaaagtactaggattacaggcataagccacagcacctggcctacatttgttctttaatcagtttaccccatgcaaatttttaagccacaacctgttttatctctgtcaagcctcagcttgttttatatgtcccattgctccagctagttgagagcatcttagattccaagactttcatgctatgtttactcttttttccatcttcatgtcaactgtatgttagatatacctggctcaaataattttcttctctcagccactaaggatgactaaacttctgacttctcaaaaactagactgcttaataagtaagctgacttgatcacatatctctggcatgtttagtgtgctcagggcactcaggtatagaatgggctgtcccagagatcttgaattccctgttgaactagcttagttcaaggacggaatggtcttttatccagaagactgcgaggggactcttccgtgggatgggagttagcactagataacccttatggtccataatggcttagatttcttttttgtttttgaaacagggtcttgatctgtcacctagggtggagtgcagtgattgatcatagctcactgctgcctcaaactcctggacttaagtgattctcctgcctcagacttccaagtagataatgtaaaaattatctagacccagatcatgtaaaaaaaaatgttttgtagagataaggacccactatgttgcccaagttgatctcaaactcctggcctcaggcaaatggctctgagagtctatgatctgcgcctgcttaatctgttttgtccatttatacagaaattaattttttaaatttattttttgttttaggtagttaatacatttcatatagctgaaaaataaaaaaagtataaaaagatatatatctcatttccattcccctacctcttataggcaatcactattgtttcttgttatctcttcagtgctgcttcatgcagtagcaaagcaaagaagtatgtactcttaatagcccttttaaaaacttttaaaaatgtgaagtgataacatatacagaaaacataaaacataaatgtcaaatgcacaaaacataaatgtcagctcaatgagcccttatgacaaagccaacacttgtggactcatatatagaactcacaactaatattccaagaaatagaatgtcgtcagcatctgagaagcttctcttatggccccaccctccttcccaaaggagaagttgattatattaagttgatttatagccctagagtttagttttgcttatttttaatctatgtattcttttggtctggcttttgttcagtattcttgagatttatccaaattgttgtgtgtaaccctaatttgtttttcattgttacatagtattctatcgtatgaacataccacaattaagtgatccattttactgttgttggatacttgggttagttattataagtatagattatactgctgtgaatattcttatacatgtttttggtactgcgggcatacattttgttgggtatgtagctaggagtggaattactggctcatgtggtatgtgtatgttctacctcaatagataatgtcaaccagttttctagagtgatggttttaagggttgttctgcctcagttccatccttattccttggatttggccctttaaggttccatctcaaattacatgacagtttaccaggccttcaagttttgtccttctgctccataaggttgtcaaatgacttgctcagcttctcagcctttcagttacttctttgagaattagtaggataccctaagggaaaaagggaccagccaacctctctgaaagaacttagcctgtcattcttcattctcttgtttgctctctggtgctttcagatattttgtttttgtttaaatattttatctatcttttcaagttctcagtggaaggattggtctaattatttagtttgctgtaaccagaagtccctttcctccacatttctgatgcaaaaggtagcatactacatacactattctgtattttgctttctttatttaagaataaattatgaaaatcaggccaggctcggtggctcacgcctgtaatcccagcattttgagaggctgaggcaggcggatcacctgaggtgaggagtttcagaccagcctggccaacatggtgaaaccccatctctactaaaaataaaaaaattagctggacgtggtggtgcaagcctgtaatcccagctactgaggagattgaggcgtgagaaccacttgaactcgggaggcagagattgcagtgagctgagatgacaccactgcactgcagcctggttgacagagagactccatctcaaaaaaaaaaaaattatggaaatctttccatatcactatatatggaaaaaaggtcttcccccatgtattgcatgttcatttcacccattctgtattgacgaatatttgagttgtttgtagtattctgctacttcaagcaatgctacatttgaataatcttatacatacttaatttgatgagcagatatatcttaggatgaattcccagaattgggcatgatgggaaaggataaatgtatttgtaattttgatatatgtcctacatacaggttgaaccatttgcacttcaatccatatatgaaagtccagtttcttcacatttgccaacacagtattgtcaagctttatgattttgctaatttgatagatgtaaagtgttatgtcaatttagttattttgttttatttttatttttagagatggggttttgccatgttgcccagactggtctcaaactcctggactcaagctattctaaagtgctgggattacagcatgagccactgtgcctggccattgtcagtttcgttttaatttgcatttctctcttatgagtgaagctgaacttttttttctctttctgtgagttgtctgatcttgccctttgcccatttctgttggattcctggaaattttcttaccaatttctactattgttttgaaaatatgttagggagattagacctttctttatttgcaatatgtctgattaggcattatctcattgtatccttataataactcctctgtgaggatgttattaaattttccatttaactgataaagaaattgaggtaaagtaagattaagtaacttgcccatagtcacaaaataagtgatgaaagcatggtttgaactaggtgtctctgaatctatgcttgagctttcaacaaaagttatgaattgccttcccagtgtagtacaggagggaaaaaaatttgtcttaaatttccttttatttgcttaaaatttctgtatttgtttgccttgcttttcttttcttccttttcttttttctttctttcctttcctttcttttttttttctttctttctttctttgtaaaaatatttagcacctattatgtaccaggggctggagaatcaatattagtaaccaatagtataagccctgaaaaggctcatagtctagaaaaggaagacagtcataaaaagttacaatgttatacaataaatgtattaggggaggagagtgagtttcatggaaggctttataaaggaggtgacttttgagttgggtatggaggatgatttggaagtctagatgaaatgaggaatagcattccagacagaggagacagcttgtacaacatttagcattgtctctttccagctttgtaagttatcctgtaatatccgagaatttagtgagtagttaggccttcgtgattttatagatttcaatatcatttatttcttatttatgaaaaatactaatacttttaatgagcttcatgttttcctattagtatctcactcctactttctcccttctccttgtctagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaa

SEQ ID NO: 644 - DNA, 91710 bp, Homo sapiens
tcctctgccacaaaagacctttaatggcctcctatttattgttcttttgttcatttgttagagttgaatgaactataataacttgtctgacataataagaatgccacaggtataacagataaacctggcaggtggtccaggaatgagagtgtcacaaaataatcactcaacacaagggccacagacctggagattcttcccagccatccctcactcctgccccaggacacaacccatgcaggcccccattccataggaagaggcaggtcccacagtgtctgtggctagaccttaacactgagcagagatgcccgggaagatggcacttcctatgctcgttcccaagtgctctgctcatctgccatgcaggtcaggaccataccccgagtttgtgaggcacccacctctcatactcaccacctcatatgaccacctatcatacccacctctcctatgacccttgcaattgtcccagtgaggtgggaagagcctggactagccccattttgcacacagggaaactaaggacacactcggaccgaatgtaatacacccgtgtcatgcgcttgctgtgccctgagcttcacattttcacctagaattccctggggggtgggagtgggggacagggcaggcagggttttgtgccaagggctggtccagttctcactaaagtgtccaggattcctgggggaatcctgccctcaaaggagggacttttgtcataaaatcctccctgagtctgtcttttatgtgagccaagatttccatccatccggcgctgtgtaaagatgaatttaaccctagcctctctcctatcacactgcttctcctgctgtgtcccttgggcctaggccaggaaagtggggtgccagataggggtgcagacacaagtcctcagtgggggattgagcctgtttccttgctccagagctccccatgcttcatgggccaatatcagggtcacgacccatccccactgagcaccaggtccctgtccaaatcaaaccttggccagagcttcagggtgggttggctagaaaaaccatcaactatgtacgtgtgtgtgtgtgtgtgtgtgtgtgtgtgtgtgtgtgtgtataaatgcttgtgcctgggtctgtgacccaagttccaacacaaagacactttgtactggaacgctggagccattccaacatgaacagcaagaatagaacctgtgctggctggtctaagatcaaacctcgagatggtggtttgaagttcttcttcaaagaaagcttgaaaatgaaatctcagtaggcaagacagataaaagcagagttattctggtggcggcggaaatgggaggagggctggaaacctatcctttgcctccactcccatcttcccactttagcatcccctgacaaagctctgtggaatatcaggggttccgcagcacctggtttgaaaaccactgtgtcagtgtctacaaaccataggccccacggacctgtgctttgacttcccttttggggtgacgagttggagtgtgatggggggaggatgtttccccttcaacagggcgtgtctttgaagccgctgtgcagtgaccctgtggggaagtggtagaggtggggtcctgccactttcgtccaggaggaatggcagaagagatggagctgcctgggccaggaggaaacaccaagcccagtgcaggccgtatagatgagggttcaggagtgttttggtccttttgagtttaaaaaattatagatatcagaacaggcataggcctatgtccatgagaccctataagagtgtaagactgggacctaaccccttcctcctggatgggtggagagcaaccagtccccagtgacaggcaggagagaagctgccgctctgggatgctgacgccactgcatccgctgtggctcggctctcaggacaaaaggcttgggtttttcctgggcccgaagccctcccaatgtcactgagaagctgtggtggctccagttgctcctggaagaggccttacactttgaagggaaggaacagacaatttctatttctccttgcccttagatttctgcggatgggtggtttcagctccctgagcctgggggctggtggctctctttaacctgggtcagagccaaggccccttggcctctgtggggtctgagagatgggagatgtgacaccaggcctaggagggtccaagatgtccccctccaccaatcactgacaatatccaggtcttccctctgtgtcctggttgctgggaccactatttttgggcatgatattcctgaattgtatctaaatttccctctcagctgggtcatcaaagccaaattggctgtatctcattctggttgacatctgcctaagtgagaagcagggcaagcgatgaagactggtggggagggctcctcctgcagcaaactttctgtgtgaccttgggccatccctgcagtggcagggccacacacatccagccattttcaacttacagagccctgaccgctgactttcatctcatctgggcctcataacaattcctgcgtcaggcagggaagggattacaatcccattttacagttagggaaattgagccccagaggttgagtagcttgcccaagccccccaggtggttggtgacaggcaggactgagaggcggcattggggacttccaggacagagttcctttcactgcaccatgtaggaaccagcttgtcaggaactctcccacagaaccaacagccaggtgaacccactctagcaggtctgagctttgaggctgaggagaggtgcagccaaataactcagtccttatcttcatggggactgaactcttcccctgggtggaatgctgaggaggtcccgctggctctctgctcggtgggttttcaccggggcatgcttttccttcctgcccggaccggtgtccacacgccacccacagggcacactgcaaagtcccagtgacggatggcttggccagtgcaggccccaaacacttggcagagaaaccgccagtactgtgggatggtgcctggggcctagtgaggctcccccacccctagtttcacttcaaggtatcacctgggcaggctgactccagaaaggaaaggggccctgcagagaagcactggctcggccatgtttgggggctgggaggtggtgcctggagttgaccagaagcttggaaacatgacctgcggcttcctctccaggaagaggctgaaggaaacactttggcctgtgtgtccctcgaggctgcagcgtatggccgtgcagcagggcacctctggccaaggggcaaggggtgctaaaatccaacctgtgtgtcactcccaaagctgtgcgttctagtgtaggtctgaatccacctggaaagggcaccgtcttctaattcacatcaaggcaccatagggaccagcagccaccaggagccctgaaggcaactgccctctattacttatccctacaacgtttccctgaccatgggcttcctgaggacaggggctgggactgacccatctctgtggctccagtacttggcatagagctgagtcatcagcaaaggatggtaggctgaattcaactaaatttggccattgccttgtgcagtcctggctccaggagaaaaaaaaaaaaaaaagatagtgctctgatccttccctgcagctggagaaatttgctaaataacactgggctaaacccaaaagggtgagcgtgatgttgaggtgcaggaggctcgggaaaccagcctgacaaacgttttccatgcatgagttagggataggggaagaagtctgcaggaaagaggtcatcccaaacactaaaggatcttgtgtcagccccaaaggtttcagaagacactggagggcatatgtttgccatgcattgctccagcatttcatcagctctgcgcctgcccagatgaggtgcagcctgcccagcaagctctaggaggggctggatgcctgggggacctgcaactaggccctcaagactggacagggtagtacgacagcccccagctgacttggttctggtctggggaggggtcccttgggttgagtggtcatgagactcagaagtcgcgctgccaggcttgtgaaacaggtgatttcaccacaggaaataagtcacactgcctgccccaggaggtgctggactggaaaggattgagatgccacttgtataagattttttgtctcccttttcagacaagtatgggagagagatggaagggagcagaaactgaggagagagcccttgtcctgctaatcaatatatttgcctgggtaaacctcagggtgtctgtgcccacagggggctgtgaggtactgcaagccctatcataagcccctcagccaagcctcagcaaagatatgctctgtccctccttgggcaactcatgctacctatggccacagcctgacatcaatcccttcccagtcttgggcacagggtggggttgagggcagttggtgctccatagggccctgccacctctgaggtccaataaatcccctctggaggcagagagaccagtcagcagctctggctctacccaccagaccaggagctctaatgttcacaaattcttggtggccagagctaggaaggcccattgtgatcatctggtcaaactccttgctttcccaagtgagaaactgaggcccagagtggggaaggaacttgcccaaagtcacacagtaagttattctcaaaggccaggcaaagaggataactcctaacactttctatctcatctcccatctggcttcttgccccaggaactgccccaggtctcaatcaacccaacaccagctaatgcgtactgggtacccatgacactgggagctattggaggtcatcaactcaccaagaaaagaaggggcttatttgctacccagcagcctccttcccttcgggtgaggatatctcagtggatgctgccaccttctgagataggaccccctttgactgtggcatggtggcctcaggcactctctcccagtccatagggtcagtccagccctggagaatggcagggggaagcaggaggatactagtggcctcggcccccgctggacacccatcctcacttcctgcatgaccatgtgaagtccacaaggaagggacataaggcagactctcctctccccgccccctgcccccatctctgagcgccccccttcgggaaccctcctcaggagcttcagctcactctgctgggggctggtgcttgctgaagaccccctccctccctccctctgcttttctctctgtgcatatctctagacagggccatgcacttgaaatacaaggtagctaagatgtcacagcctgacagtactgaaatatacttgggtgagtccacacagcttgcctcagtctaggtaactgctggtaagaaagtcagtccagttgcttttctctactcctggggtctacgaactttcaccaacatcactatcagacacagagggacatcaggtggggaggagggtgaaggcagaaggtctttggtgggtcagaacttcaaaaaggcattgagaatctgtccacagttctgcccctcccagccagaaggaggtggccttcaacgcggtcatcttttagctgccagaactttgttaaccacctgggaccgtggacatcttctctcgtgtcttgagccctcatccccacccctccaagccctcatgcccaccacaccgtgtcccacattccccatcctcccctgtctgctccccatctcaagtccaattccaaggccagagccctggcagcttttctgggagacagcatgaaaaggaggggagtggagatggcagagatggggtggagccagtgcgctgtggtcctgttggcgtggtgatgtggggccaatcctgaggccagaggttcatcaccgtgatctggaagcccacggggccccctggtagaaactggaagaacaaaggggaaaagaaaccagaacaggaagaagacgagtaagcatccgagtgcacgagagtggagccggagccacgtggaggcagggccggcccgtctatctgttgttgagctgtggagagccggtaccatcctcctcttcctccttgtcatccttcatgcctttcagtctctggcgagcaaagtcctcaaatacaatgtcgtcatcactggtgggagagacaaggaaaatgtggtgtgtttgcaggggcagggagagtaggcttatccagaggcccggccagatgtgactcagagtatggctctggggccggggagaaccaccctctctgaggtctctggcctctggggctgaccatgagcagaaaggcctgtctggctggcacatgtggatgccacctgtggcagtggggacagtcacatcaggactcgggccagtcatgaaaggggcagagaggggcatgaatttgactcttgtgcctgagggctagaaaagtaacctggttctttaggaggtggggggagcagtgtggctctgtagccagaggaaggacttattcccactgtgagaggccaggccaccagtagtttcacagcatgttctgaatcccccaagaataggcccggcaaaccccaccccaccacccagaaaactacccttaggaagcattcccgtttctggacagcaaggagtagtttggcttaatgaaagagaagaccatgaagaacctttctcccagaagtgtcagctcagattctaccttgggggatcccagacagaagaaggctggggtaggaggatgtgaatctaaataggggggcagaggacctgttcgtgaggaaaggggaggcttgagtggggtttcaggactagactgcctttaagaacagcgagttcccttctaccatgaaacatgtccatttaggaccatgcaggtgtccacctgggtcccctgcccaacagggttcagccagtgcatggggcatcctcatggggtgacctgagacccccacaccccagatttctcctgggggacaagggaagattggctttggagctggagcaagaaagccacttggacctggaggcggtccgcgcagtcggcccaggtcctccccctctggccactgtccggtgactcgatggcctttgactgcagggaaatccacatcggttggtcctcaggagtcagaagcaacaagatccccagtcccctgcccaccccacagcctgattccactggttggcgtgggcaggacaggagagccgagcccagggccatggaccagccctgtgtgagccgagcaggcgctgtggatggacgaacggactgacggacggacgtgcaaggacgagggaggaagacagaccccaccaaggcaggaggaagaggaacaggcacggagggtccttcaagtcacatgcaggcaagcgggttgctgaagaggcgagcagaggtggctctcagcagacggggttagaccagcggctcctcaggagttaataagcatatatgcaaatgaccccctccaccccgcccacccgcggcccacccccggatgtctgcaggcagggttcagcttactttgtgtcaagttctatgagattggtatctactggcgtctcgttctctggaactaaacacagggtgggtgggcagggtgtccagggattagtgagtggatgagcacggggcgagtaagcacaggcccccaccctgggacaaccagactaacatgagaagggcaaaggataaaggggaatggagatgggggaggactcattcctggtactgaaacaccccaaatcatctgaaaggcagggaggatggcaccaggagggccccggatccccactgcagccccagaagaacagaaaatcctctaaacttctgtttcttttgacaggtctccaacatgaattacattaattccttgcatgcatgccattcaccaattctaagacaatcttttttatattttccttcacattttaacatctccaaatttggagtgtgtcttaccgtcgatggcactgcacagtttaaccatggaagttttttcctaattgtacctactattatgttgtctctctccactgaaagtctcagattcaatgaaatatgaccaatctgctatcacttgaaaaacaggccaggccaggcatggtagctcatgcctgtaatcccagcactttgggaggttgaggcgggaagatcacctgaggtcaggagtttgagaccagcctggccaacatggtgaaaccccgtctctactaaaaatacaaaaatcagccaggtgtggcggcagccgcctgtaatctcagctactcgggaggctgaggcaggagaatctcttgagcctgggaggcggaggttgcagtgagctaagatcacgtcactgcactccagcctgggcaacagagtgagactgtgtctcaaaaccaaaaaaaaaaaaaaaaaaaaaaaaaagaagaagaaaaacatgacaatagcgtgtccaacggtcatcttatccaagcagccccttcccctacttccaaacgggatccagcccatgcctgggtgcaagatagaggctcaaagcatggccaatgagttcccttctccactcctggcctccctctcccatggggaacaggagccacgcctcactgtctcctggtggggtcagaagcaaatcgagttctggaccccacaaaagatctggggacccgagaaaagggtgactgggctgagggcgaacccggggcggggtgggttacagggtcacgtggcagctgctagagaacccctaccccagagacctacagattctgctcaccttcccgatgcgggggttcctctttgggcttggggtgcattagggtgaagggcagttccacggccacgtcgctgaaacagagacccagacccagtgagccttgagcggactcacaggctgtgagacttgatgtcgatgccctgtcagtccgaggactgcagagggttttgccgtcagaggaggtagatccaaaagatgccctccagccccagttctgccactcggagcctcggtctgcctgggagctggacgaggagacttcctctggtcccaaaaagaaatggaagcctcctctttcctgagaaggctctctgggttcccacgggctgggaagaggcccaggggtgggaaaggattgcccggggcagcatgcaccgtggtcactgcggggctccagaggtgccctgggacccccccccacctcaaatcgccacagccaccctcgcctcccctgacactgcccttcccaacttccaggtcggagctcctcccaccctcacgccatcccatctcccaacacctccagggtgctcttgtaaaagtgctcaggtgaccctagcacccctgcaatctggatgaagcactgttgaggtcagtttagtcaggtttaggatggccccagggcccaaggctgattacactgtggggatgcaggggaaagcggccgggaagacccagccaccagccagtgcttctgatggggctttctctgtacttggccctgatggacagaataagagaaggtattcacatggtactgaccctgtgccaaggattactgtaagccccttccatagagtaactcatttaatcctcgcaacaaccatattattatccccaatgtacagactgggacattgaggcatgaggagattaaaatatcttgcccaaggccacacagctattaatggttattattagattctggctccataaccacacccttgatcactgtgtgacagtagcagaattgagactaacaaaagcaaccctgaaggctcctctcggcttggggtgacatcaccctaggagaccacccaactgcgagtgcctacaggcacaagccacatcccactgatcttgttgtccagagcccagttgggaaagaggaagggacagggaatggagtggtcagaggcacaagccgtgcaattagaaaggtctgttccaccagcctcgccacccgctggtgcagcactttctagctttgagtctcactgagctcaacttggaacaaagcctgtcttctagaaccacgggaacttctgggagatgaggcagctaaagagctgagttaaactgtgaagcttgaccaggcgcagtggctcacgcctgtgatcctagcactttgggaggccaaggcgggcagatcccttgagctcaggagttcgagaccagcctgggcaacctggtgagacactgccaccaccacccatctctactaaaaatacaaaaattaggctgggcgcggtggctcacgcctgtaatcccagcactttgggaggccgaggcgggtggatcatgaggtcaggagtttaagaccagcctggccaagatagtgaaatcctgcctctactaaaaatacaaaaattagccgggtgtggtggcgggtgcctataatcccagctacttgggaggctgaggcagagaactgcttgaacctgggaggcagaggttgcagtgagccaagatcgtgccactgcactccagcctacccgacagagtgagattctgtctcaaaaaaaaaaaaaaaaattagctgggcatagtagagcacacctgtagtcccagctactcaggaggctgagttgggaggatggcttccacccaggaggcagagaaggttacagtgaaccaagtttgtgccactgcactccagtctgggcaatagaatcagaccttgtctcagaataaaaaataaaaataaaaatgtgaagcttgtgcctgccagaatcgttacttaagtcccctcattgggaacctgggggttttataaggctgtcagagctatttggcctttttttccttctcttttttttttccttttgctttggggattgcttcagaatggagctggtggaagactgggtttgccaacattttagtggaagaatctggatcttaaccttctaccgggccaggaacgataaggtcagggaccacatctgattcctctctgggactctggcactcagcaccagcctggacgcaagcctgggttgaggaaatctttgctgaatgatatggaactgaattgaattgaatgaatttcacctgtcaaattagtttaagatttcttaggatgagccacactgccatcttgtgacagaaggaggccaaactgctgtgtttggggtacatgcatttttggaatataagtgcatccagctggctgcaaggagaccttgtttacaaaataggatctcctgaggacctctccttagcaacacttggccagcagttccctcctcactagtgtagaagtttgaaagccatgaagtctgcatttctccaaaagctcctataattcaggtgatcagtaattcagacagctctcttgggggccactccctgtatcagtgtaatcaggctttgctctctgtaaagatccctgtcactcaggtgggatggaagagcaaggtgaggtttgttaaggagaaattgtgtctcccagctcacacctgaacctggctatctgaaatgaccactaagattccttccaacccagtgccctgtgattctggtcagtcaagccaatgggctccaggccctccaggaaggtgggtgaaccaggtggaagggaggaatttacctggatgcaagatctcccaacaggctgggtgggtcagaggaggcaggagaagtggtcaggagagagttcagagaggaagaaaacaaaaagcacattcattcaccacttctgctgtcccccggatagagaagacccacgggacacactcccacccacccccctgcacagccctgactgctctttcagggatacaccgaaatggcattagccctgccccgagggactgggatccagacccagctcagcaaacccctgagccccaggatcctcatctgtcaaggcagtgtaaaaattaaccccagtgctgcctgtcccaagggaggccggactatctaaaggcagagggaaggactccggggttgccaagaatgtttgagggactgtgggtcctgaaaggtcaccagacacaggatttgggatttgtaattttgagatgtcctattatataaggtcaggattacatactgccacctgccaagaggcattcttctaataatcaaggagacccaatgtctaatgggatttagcttttcaatcttttcatagaaatttatgaattaagttacaaaaaagaaacacagtagtttgtttgtttgtttttctccctgagcttccaccaaactatgctccagggcagggcagtctggtccaccactatgacctgagttaggagaggagatttcaggcaatgtttggggcactgtctgggcctctgtttcaccatctgtaaaatgggaaagctgactagcaaatccccaatccagctctgggttctgagcccttttagctgtttcctcagaaaatcagcttgggcatgcatgggggtgggtgctatgcccaaagtgtgataaggagatggcacccctggggaccccacagcaaagactctgaggacgccgtcccctgggcatggccaatcctcagtgcgagcccagacctaggatagaggaggaggagagagagaaagagatgggtgggggtaagagaggggctgagggccaaggaaggaagagagggaaagcgggcgggggagaaagaggaacagaagggaggaaaagaagggacaggaggttcctcctccaaggtggatgcagctaaaagggctgcaaacaggcagaatggggcaggggcctgtgggcacctgggacgctcccctctgcactccggggtcttgggcttggctggagcactcacccgccccgagacaccaccagcttcactttcactttgtaggaaacaatgatccccaggatctcacggttggcaccttccctcaacctgcaaagtgacacaggggagccagttcaggggccttgccaggtgggcgagacacctcaggggtgggtatgctggggggcagtggccgtccatcccccatctggctagccactcagctaccatgtccaatagagcccagtggagatgaggaaggcgagcagtgcccttaggtagcagggacccagagccccggttccaagtctgactgtgagactcgctcactgtgtggccctgctgagcccctctccctgcccaggccagcgtccccgccatgagggccaggctcctcctcccctcagatggattctgcttctctcagcaacccatgggcagaaagggccacacggggagttcacagagggcgaggcagctggggtggggtggggtgggggccatcagagaaggacttctccgcagaggtggtgcttcagctgggtcttgaagatgggtagggtgtgagccagggtggagacagggcaaaaagcttcaggtaagtgggaggctgtgcaggggctgctgaagagagctgagtctgtgctgggagtggcggctgctctagacgtaggccaaagccccactgaaggaccacactggcaagagggcaagatggcatccccatagccagggctctgctggagcagagtagcctagaggcgtccacgatgactgtgcagcaggagtgaccagatgccctgggacccctgacttggaggggcaccccatgttgggtctaacccagctcaccaccctggtctctcctcagggacaccccatctgactgaaggcattacgtcagaagctgccacctcttgcaggaagccttcccaggttgccctcccccaggcatggtagcagagcccagcactgcctgagtgagctggcctagtggtccatcttattctctcagtcacccctgggtagggttgggagtaaggaggcagcttccctgacaagtcaagcacctgaggacaggccctgacaaggctatggagagggtagcctgagccttgtctttgaactggggggaccaaggagggtgtggccccatcaggcaagatgcactaggagcccagggctaggagggcaggtcctcacagggtgctagaggccaagttcgtgtcttcgtgcttgagcttcccgtccaaggcgaggccccgcttctctcggttattggctaggaagggggtcagtgtgtagaccttgcagaacgtcgagctgggtgccacagtgtcactgggaagaaaggaagcagctgtggagatggccctccccagagccaaccccagccctgatctccagcccagcagaatatctagtctgagcctgctccaagtctccctctcccaacctctgtcccccagacacacggaccacttgggccagcccagctcgggcaaggagaccactgccactcaaaagaggcacatctacattctacgcacaaacaggactgaatctcggatattctaaaagattatcctagtcaagcagcacagtgctaaaaagcacatttatttaaagaattacagccagccgggtgcagtggctcacgcctgtaatcccagcattttgggaggccgaggcgggtagatcacgaggtcaggagttggagaccatcctggctaacaaggtgaaaccccgtctctactaaaaatacaaaaaaattagccgggcatggtggtggacgcctgtagttccagctactcaggaggctgagccaggagaatggcatgaacctgggaggtggagcttacagtgagccgagattgctccactgcactccagcctgggtgacagagcaagactccatctcaaaaaaaaaaaaaaaaaaagtacagccacagcaggcacagttgctcatgcctgtaatcccagcaacttgagaggctgacaggaggattgcttgaggctaggagtttgagaccagcctgggcaacatagcaagaccccatcgctacaaaaaattttaaacattagcctgatatggtggtgcacacctgtagtcctagctacttgggaggctgaggcaggaggatcacttgagcccaggagttcgaggctggctgtagtgagccatgatcataccactgcactccagcctgggcaacagagtgaaactctgtctctaaacaaatttaatttaaatttattttattttattttattttattttattttatttttttgagacagagtcttgctctgtcgcccaggctagagtacagtagtgcgatcctggctcactggaacctccacctcccaggttgaagcagttctcctacctcagcctcccaagtagctgggatcacaggggcgcgccaccatgcccgactaatttttgtatttttagtagagatgaggttttgccatgttggccaggatggtctcaaactcctgacctcaagtgatctgcctgcctcagcctccccaagtgctgggattataggcgtgagcaccagccctgtctctaaacacattttaaaaagaaaaaattatagctacacataaaccataaatgaagctatttgggcacccatatacccaccatctaggctcaacaattaaaactttacttgcttgatcacatccatcatatatagggtgttttgattgtccaatttttacttgcttttgctctatcccccatcctttccaatgagagagctgtcatgcagcagatagtgaacaagccttggagtcggacgaccgtgttccagccccagctttgctgcttgctaacttgcaagtcacatctctctgagccacttcctcctctacatactggggcagcagcaaccccagccccacagcgcttcctgagaagtaaacaagtctgtgagtgcaaatgcctccccagccatccctgctggtattcgttatgcagacgctggcaccatctgcagtggttgggattttctactctttagggattatatgttactctggttctagatcacttcactttaccatcaggaatctatgcctcatagctctgatttttttgaaaaaatcaacagtggatatgaaaaatatccagtaaccagagaaagcttgatctaatcatagcatgttcacctataggacattaaaaactatttcaaaggccatgtagtaacattttaaaaatattttcagttgcaagaaatactgattggaattatacataaacaaatacacatatacatgtaaaattatatcaggtataattgccccaagaaattacttgcagggccaggaaaaaaaaatgtgtatgtctttgaatgggagcatttacttcctttaggtaagtaaagatgtttcacttcagatctctccacttgccttagctgccaacaagcctgggacaaagttcgatccatgctcaaccatagcagttctcctcaaacctagatgatttttttgtgtgtaattattctctgcactcccacacacaacccctttttcccaatgagttggattacccctttatcagacaagagctgtgtacctagtgccttacccactttgccctggctaccaggaagccaagaacaaagtatttcccttcaacctaggtttcttgtacaacgtaattatttcttctcacaaccccaatccccttacattcattagctattgttttgtcactctagttttagtgggtctcttccttgactgtagcatgcattttcttgaagctaaatcaggtggatggtttctaaaaggctcttcgggatcatctactctgagtggcaaggaagtctgaggcccagccctctgccaggtggagaagagccacctggacctgtaacaggacacctagagcttctctttttcccacccaatcccatacgcccaaggccagacttgtgcccacttactcagcctcttccatggcaacagggcacttgtactgagctgtgttgaaaaggcagatgtctgcatactggcgcactagggagggagaggaatcaaggtggagtgagtcgggaatgtagctcccatggagtctcacaggcgtccccgggttggggatattcagccccaggcaatggccagaggccaccagtggggacttctgcataagaccacccctgtcttacatccaaagggtagccccaaacacacccatttccttccataaccaaagccttcccctcaaggacagctttgtccagaacccaagaaactgaagaggtggcttaaagagcaaactcattacctagccaataagcagcctgccttacccaactcaaaagctttgccctgtggctcagagcaggccctgggcttcagtggctattttttatacaaggctgttaacaaggggagatacttcagccacccccagcccttgggaagattgcctctcgctgtcccctaagctgaccctctgtctgggatacctgagatcttgatcttcttcaccgtcttgttggtgttgttggtgacgtggacgttgacgctgatgggttctccatggtaatagatctggggggcataagaagggacggggttggctgggaggacagcaaggttctagggaaaggggagggagaaaagcccccacgcgatcttctggggttccccagaccttgcgcagaccttcagaagggtctgctgctcccatctgaagtccatcacatccctcaggttcatgccccctctgccactcctttaggcccaagaggcttctccgaatcccccaaggcattgtgacatttgccccaagttcatcagccacttcccactgctgctaaggtggcatgaaagccaccaagcacattagccttcagttccctggtgggacccttgaaagataacggaattggaaggtgatagtcctgggctccagccctggcttggccagcagtaattgtgacaacaataacaacaataacattgacgatgatgaaagcagtgtgaccgtgggtaggttatctaagcctcagggtctccctctgtgcaacgaaggggttggactaggtgatgtctgaagtccctgccagctctaaattctgtccacagaaggatctggaagaagcagggaaaggtgaggatgggctcaccagctcactgagggagccagctctgaatccctacaaaaagacctcaacttgcatcttgccccaaggcacttcccttcagccatgccccgagagagagggggtgcccacaccttgaggaggggccagcctaagctcacagcagtcagctgggtttgattcagagtttgaggggaggcccttccttctgcagggcttgtcgccctgacgctcagtgtttggcaggaaggtcacggccccccaccgtgccccctctgcaatgctggttgaccttcagcactcggcctgaggcaggcagctggtggaggtgtgggggagatgtccaggaccttcaggaaggtctgctcctcacttcggaagtccatcacatctctcaagttcatgccccctttgccactcctttaggcccaagaggcttctccaaatcccccatgagaggtctcagattccctgacccctgtggtccttgggctggggatagaagctcctacctgaggcatccttgcaggccaggagagagctgggatctgaggcccaggccctggtggagcagcccccaccccctgccaagtccgagcctcctacctccttatccagagaggcttctaggtgcaagggcttgtccgacatgaggaactgcctggtggtctcggctgtgggctgggggccaggcctctctggggcatactgaaccttccggatgaccagacgcacagaattcctaatggagatgggcggagtgaaagaggaccagggtcacctgccttcatcccctctccttgcgagcctcacatcattctcctgctcaagagactggcatggctctccatcaccttagaatccagccaaactgcagagatcagcataggggtctgtcaccatctggctccattccatcctcccctgttctgtcccagaagtgccctgtggctgcacttcatttggtcctggtacccagcaggatgctgaaacagggactacatttttcacctcctgcttccctatgtcaccaaataggtaacattgtcacttcctgactccctatgtcaccatacacaaatagtgtccctctgtcatctattttggtgacataggacactatttgtgtaagttctttaaggacagaaatttgtgtctaaggtgttcacagctgtactctcagcacctatgactgtgcctgccatataataaacaactgccagatatctattatgtaaaactatgcagaggggacagcggtctcaagaagaaatggggcttggggaggcgttggggttcagggaggaggcgtggattcagtcagggggatgcaagccagtgaaggggacaagcccagggaggggagaaggcccatggatgagactggctccatgaagattacaggggatcagggagcaaatgaggatctggtgagggagggggacttggtgaggccgtctctgtggcatgctgggaatgccggcatctccgttgctcagataagctgcctccattgcctgtaaccagggagccagggtcaaactcccagctctcctcttactaactatgtggccctgggtacattaacctctctctgcctctgttccctaatctgtaaagggtgatgacagaaggacctacctctttttctcctttttaaatttttattaatttatttattttgagatggagtctcactctgttgcccaggctggagtgcagtggcgcaatctcagctcactacaacctctgcctcccagcttcaagcaattctcctgcctcggccttctgagtagctggggttacaggcatatgccaccacacctgcctaatttttgtattttcaatagagatggggtttcaccatgttggccaggctggtctggaactcctggcctcaagtaatatgcctgccttcggccttccagagctctgggattacaggtgtgagccaccacgcccagcaaggacgtacttcttagagctgctgtgaggattaaattagttcatacagcccagcactgtaaatggtgtctggcacctaatcagcccttgataaatgatagcttctatatcattattattagtaactccttggtgtggattttaaatgtcccattggtggtagggtgagaggggtggctctcgatgtcacctcctctttcttgtgcttaccaagcctcctcccacatcccacagcacccttcctcttccctggtctcaggtcttaagaggaaaagggagacagagaagcaagggagaaaagtcccatctcctcacacacagctgccagggctgcagatgcaaatgcatgcaatacaccctatagccaccaggtggcaaactcagcccacgccctaaaaaggctgctgtgccctcagccaacctcctctgggaccagtgcctctggatgcaggcacatcagcgtcgagggcccaccagctattccaggaggcagacagagcacagcccgacccaggaggggcaggcatgagacatccgggccagctgtttctggctgccagcctgggctctctgtctgcccgggctgttcttctccagagaacgcttcccatctcttagatgtgggccgacctccctgtcactctcccctggatgggttcactatctccacttcctcctcacttagaagctgccattgacacacactccactcctgctgaacgcctcccaggaggaaaactggaaaatgagaatggtcaggaaacagcctgctcactgtttaacacaatctgaatttagggtttttccaaaacaaattaaaaagacatgcagtctggaggggatgaaatgagaggcagggagatgagggaggaagctgccacaatggtgcaaaggagaagatgctgcagcctgaacccaggcagtcgaagccacctccccaaggaagccctccgtgacctcccagcttccagagtgcccttccaaggctggaatgtgcgcccctcctcacacacttccaggtattgttacttatctcctcttggactttgcccatcctgtctccctccctcacccagcaggcggcccacaccctggcatcctactcaccgcttgtggatcttctcctccaaattctccgcgcagaaggctttgacttcatagtccacaccgcaagcctgtggggaaggggtcactgaccacagggccttggagaagcagggtccccagtacacagccagcccacctctcattttacaaacgaggacactggacaggaacaccaagctcccacagcccagccttccttggtctggaagaagcgggggaacgcccttgtgctcagccccaatgctgtgctgcctcctccatctgacatgggacatctcgaaccacccaaacggggctctgctctttggattcctgcctcagtctgggtggccgtcctcatccaggcagctgcccagaaatagcaacaggcacctgagcagactgggggcgcctactactgtgtgcacacccggccctgggtggcttatccggtattcctctaacaagacaaggaggcacgtgctgttatctccatcttgcagatgaggaagctgggctcaaagctctggagctagtggtgtcacttctctccaaccctcagtttccccatctgtgaaatggggatgatcgcactttgattccaggttgccaggggttacatgaggccaggtgtaggtcctcagaacactttggtcctgttgcagccaacgccacccaggagagcctccagacccatcactgaatgggagagtgaggctgaccccgtacctgctgccctgtctgaagagagactggttgtccaaggtgggaccagcttagcctagacacaaagactgttcaacagggagagtggtcctgtgtgtccagcacctcccagggagaaagccagggacctggggacatgagactcctggagccagagagatggtccccttggggtgacctaccttccccgtgtcttcgggccccggctgcagtgtcacagaacatggaaggtttggagggatctgtcaagaagaggacagaacgagccacctgtcacatccaccactgtcctgtctcatgtattgcagcccagacactcccatacacccatcagaccaagggccccaggggacaggccatgtctatcccatcagaccatgccaagccatgccccatctaaaactctttagataaagagctttctttatctaaagggtttggcccagcccagtcctcgcagcaatggtttaaatagatctttctatgatgtctactgtggttggcagaataatgttccccaaagatgtccacaccctaatcgcccaaacctgggaccttaatgacaaaagtgactttgcagatccaattaaggccttgagatggggaccgtatcctggatgattttggtgggcctagtataatcacaagagtccttagaagtggaagcagggggcagaaatgtctgagccacagtgatgggatgtacaaaagactcaacggccactgctggctttgacaatggaggaaggcactgtgagccaaggaaagcaatgctggaaaaggtggacgctccccgagggcctccagaggagccagccctgccacgcctccatggtagcccactgagacctgttttgggacttctgacctccagagctgtaagctcatacatctgtgttgttttaattgctgccgagtttgtggcaatctgtttcagcagccatagggagctaacatgtctacgtagaaaaggtgactccatgaccctctccactctctcagcctccaagaaagggagagaccacactgaatctcagaatcagagagcctaagaaacttgagattttgaaatccagcatcttaaagtctctgatttgaaaggtggtggggcagacagatcacctacttgccatccctctcttgcgagctgggttgctgccgggcaagtggggagctgatctgagcgggaaaccccttgcagtgatgcagggtccagaaagggctctttctttctctgaagccccttagcaccccctttctcccaccaatgacctggcctcagaagggtctgaggagtagcccaaaggtacaggtgacaaaccccagcaggggctggagaagagacacttaccaggtaacacaggtgacagtgccccaggtcccagcatacactgggaaactgggtggcagggagcagctgaccctcaccgccctcttatgcccaccccagagggcttcctagaggtggcatttctggaatggggccccagggatggcagttcctgacctcaaaggtgaaagggtaagcgtgctcgcccagcttcttgatgaggcgttcctgcagccgcgtcaggggcttcttgtcctcgggggccggtgggaacgactgtacgttggccacaaacaggtccttgcgaaaggtcaggcccaggacatccaggtcctcccggccatagcggaaggcgcaggtcagcgtcacatagactgtggggagcgaggagcactgaggaggggcctgggagagcagcaagcgagccccccagagtgccggcagcagccctgggacgggccccactggaggccccaagcctgtcccaagctctgtggggatggctgcactgtctccaccaggagggctggtagtgagtaccggaaggatgccatggcctggcccctgggaggaggagggggctgcctgctgagccagctctgtccttccccctcccacctctccccagggcatatgtggaggggtatggaaacggtctgacaggcttggcgggggctggagtagtctggcaggcctggggtgggggtaggggacctggggaaggagcagggagttgtgggggcagggcaagtgctgggtggtatctggacggcaagcgtcttgtcacagctcagtctgcactcttgtcttcctgcgcattgatactgccccggtatcaatgttctgttctgttaaagaagaacctactcctaccctgctggcatccccagccttgccacagtcatgacatattgatgtgaaagtgctcagggcatggggaaaccttctcccaaagtaagcttggggcagggccgtcccaggctggaggaggcaacggcatctgtagaggtatttgttggggctttcaggggaaccagtggggatgggcagggagttcctatgctagaggtccggggggaagaggaggcggcccttgacaggctggggatgggggccacagcctacctctccgctctttgagatactcaggatccaccaggaccacaccatctggggaaaggacagagagtaagcggcctctcccaacctggtctcccaaacctctgtgccccaaacaccagcccaagcccagatccaaccatctgttcatctaaaatcatcctgagaaaaatggaaaggcgggcacctagagggtggcactgcccacctccaccacgctccacccttcccccatcccaggccagtataacagacccagctggtgactttaggcaggttagagaccatttctgtttcttcatctgctagtaagaataataacctaggtccgaaactcctagaaccaggtattctttggaatttagaaattgcgaagtatagagaggcaaaatgggccgggcgtggtgggtcatgcacataatcccaacactttgggaggctgaggtgggcggatcacttgaggccaagagttcaagaccagcctggccaacatggtgaaacatcaactctactataaatacaaaaatagctgggcatggtggcgggcccctgtagttccagctactcgggagactgaagcaagagaatcacctgaacctgggaggcagaggctgcagtgagctgagatcatcccactgcactccagcctgggcaacagagcgagactctgtctcaaaataaaataaaataaaataaaataggcaaaatggtacatgttccatatattctgtaatgacctctgcaagatctgtaccttattattaaagccattaatacctctgtaggaaaacacaaatattctcaccaagaggctaaataaggcataaatagcctcgcatcagtttgggtcaggtttgccaataaatgaattctgcattaaacttggaagcaatgttaggttttcagagcttgggcttggcacatgtggattgggggttgtgatctgcagtgcctccctcatggggctcccgtgacgactgaatgggtacatgtgtgaatgtgcatatgtgtacagcgcttagacagtgccaagcactcgagagcactctgcagattgtggaaggcgcctcagtgccctgaggcctgcccttgggggcagagtccagctggacacaaaggacatctctgctcagcaccccaggaggccagaaacactggctcagggtcacccccttggctgacatcccctgtctatctttggccaaacctttctttcctctctctctccccctaccctctaacccattgtcacttcactgctggtggaagaggagggccaggatggatcatcaatgtcctgttgggcaggccagtgggcttggacttgtgtgcaggtttggtggggaaccggtaagcatagggagggtgtgatcagatcaagccaaatggcagcgtcactatgggagaagaatctctcacagtgagtccctgatcagctctgcacagtgccccagagttctcggggataccagggctcacaaggggcctggcacaaagggggtgctctgtgaacacctgctgaacagctctcagggtgcctgcgtgtgttgggggctggtttcctgcccctgtcctctcccagtctctgggccacctctgctgctgtccttagtaggccaatggacatggacaaccctggcctcagagggcccactggaaatgacaacatgaagcagccacagatgaacaccaggatgcctgctcccggcctctgagaggccacctcagggagaagatgccaatggcaaagggacactgagcttcagaagacaccaaacagcatcccaggcagggctggaggggagaattgggggtgttctgctctaggccatgaagggctctgctgacagccccctggccctgggagcccagggtccccaggtcttcctcctggtgagctgaagcctgcagccgggctcgcttccttggctcaggaaccacacaaatcactcctgccctggacccaggacagcccacagggacatgatgggaaaggccatactaggcctcactttgatttgctcatcttttttttttttttttttttttttttttttctgagccagagtcttgctctgtcacccaggctggagtgcggtggcatgatctcgctaactgcaactctgcctcctgggttcaagcgattctcatgcctcacccaccccagtagcagggaatacaggtgcatgccaccatgctcggctattttttttttctgtattttttagtagagatgatatttcaccatgtgggccaggctggtctcaaactcctgaccttgggtgatccacctcccaaagtgctgggattacaggcgtgagccaccgcacttggcctaaagacatttttagttggcctaactggagcgtgaggtactctgggcatcgaatgagtagagaccagggatgtggctatccagcctataacacacaggacaggccacactaacaaagaactatccaatccaaaatgtcaagcatgcagaaattgcaaaaccctgaacttgaacaagaacttggaaggtgccttcagccacagcccagcttctagcaggaaccccatgtacatgaggacagcccccatttcacaagtcctaagaagggttctccctctgtctcccactctttgccatcacaaggaagcagaacaaagagttttgcagactctgccaggtttgaaccgggctcctctatctactcactctatgacctggagtaagtcactgagccactctgtgcctcattctccttgtctggaaagcagggatagtcatcatagccacccccactgtctgctacatgacacgccttatagtaagtggcggtgtctgtcgtcatcaccctcacccttcttaccatcatcaggacgccttccctgattgtcacctcagtccttcccacagtctcttcttgcagtcctcacttgagtgggaaagtagctgctcagtaaatgcttgctgcctgaagcaggaagccattcacccccgttcttggcaccgggcccctctggagagctgagagctatttctgggaggcttggccagccacatcttcccccagccctcctctcgccctccagggactcacccacagggtccacgaggtcgatgtggtccacaaagtcccgctttcccaggtagacggtgagctgaggaggagaggcatagggggcgttagcagctgcaggcccagaggacacaggaccctgtcttggaggaaaccctgcgggcagcctctgaaactccagacccatccctaacccttatcaaaatcctaagtggacttgggccttcaccccagccctaataccaagattcgcaaacccctgtaaaatcttaaaagcaccacttcctcccaaaacccttgaaggagtcattattgttcctgttttacagatgaggacactgaggcccggagagatcttcatgccaagcaccactgccagtggagcagcagcggcagagaagctgggtgagtgggagtgtgggcatctcagagggtgagagcccccaggcaggcgggagcgctgagccctcagaggctctgaacgcgggccgcgctgtgttcttcagttgctccttctcccatgcagccaggcggggatccactgatacgaggactcgtttcctttttcttaaataatttttttttcgagatggaattttgctcttgttgcccggcctggagtgcaatggcgcgatctcagatccctgcaacctccgcctcccaggttcaggcgattctcctgcctcagcctcctaagtagctgggattacaggcatgcaccaccacacgcagctaatttttgcatttatagtagagatggggtttcaccatgttggtcaggctggtctcaaattcctgacctcaggtgatcagcctgcctcagcctcccaaagtgctgggattacaggcgtgagccaccgtgcccggcctaattaattttttaaattgagttaaaagtatatgttatttatcatgtacaacacaatgttttaaaatagatatacattgtggaaaggtgacatccagctaatgaacaaatgcaccacctcacacagttagcagttctgtgtgtgaggacttgccttctgaggcactgagggtttgggggctcacgccccactccatagccagccgggagggaaaaacccccgagacagaattccagcggctaaaccagatccagagcgtcatcctgatgtgtgctgttcctcaacaacccttcaatccttgtgactcgatcgccatcattatttctcaagtccgtacctctccatccccacagccactcctgcctagaccaccacaccagccccttgctgctcactcgctgagagcctgctctcctccttagctagactagtcaccctaaaatgcaaatctttctttttttttttttttttgagatggagtctccctctgtcgcccaggctggagtgcagtggtgcaatttcagctcactgcaacctctacctcccgggttaaagtgatcctcacacctcagcctcccaaatagctggaactacaggcatgcaccaccacgcctagctaatttttgtatttttagtagagacagggtttcaaactcctgacctcaagtgatccacccaccttggcctcccaaagtgctgggattataggcgtgagccactgtgaccagccctaaaattcaaatctaaccatgctactgccgcctgaaacccattaatggttcctcagtgtccaaaaataaggatgacaaatgggtttcattccaagtgccaagtctgatctaccggcggggagaggggacggggagctgtctcggactctgggctgagaaggaatctaagatgaaaccctggtgcagcagggaagggcaatggtgactgatgttatctactgtggacacagaagagagatgtggaagcacacgtggtgctatttgccaacccaggccagctcataagccaagccacagtgttcccgtgaccagccctgcagcctctcagcctcagcctctctcttggcactctgaactcagctgcttaagattcccacagttcctatgcttttatgtcctgcctacaatgctgttttcaccttgccttgctggaaatgcatccctcctagaagctgccgctgcccaccaggctgggtcctgcagccccaatggccccgtatctcccctctgccacttcatgttgaaatgatggatttctgtgtctgcctctgccatctggctgtgagaggcacagactgtgcctcattcatctgagtacaccctgcccctgtccccgccggctcagcccagacctggtgtggaatggtgtcagtaatgtctacctgctaaactgagggggaagcaggatggcatctggacctgcaaggagaaagcaaggaagccaggccctgggagctgccctggctaaggaggtgacgctagggtcctctcacagcaggggactcactcccccacggccctcggcgcttactggttggcttgtcctccactgtcacatacttactgaagtctctctatgacaggccgtctctccctacaccagagctcaggggagctgtgcttccccactctgaaagtttcctgagtgtgtccctcccccttcaactgacagctccaagagagagagctgtgtcacccctaagacggggagcagcacctgccccctcccacagaggtgtgcatttcaggggacatgccgtttcctctgcttcccaagagaaaatgaccagagtgtgaggtcagggaggcgctgggcgcagctgttacagactcacctttccatttggactggccttcttgaacactctgtggagagaaagagaggtcaggccagggttcgcgtatcctgcccaggggcaagctcctgcgggccaccttgaggcaggactggggaccagggctggagtgactgacaggcaccatgcaggcttgagatccgaacagtgcccatgtaatccgctcttaccatctccactggtaagcctccacgatagccattagagctctcctgggctacgcaacagccgccttgcagtcaggtctttgcagggcaggctgcgggagtctccaagtgcaagttttctgagctcaagtgaggaaaagcctggcatgctgtaaggtctgtgtgatctaccctcacctcccggtgtcacctcctactactctccctcacccatctccagccacatctacccccggctggtcctcaagcacaccagggcgattcccacctcggggacagttctcttctgggaggctctccccgagacatctgcatgctcagccccactgtgcctccggggcctgaagtccctctcttgctctacttcttctttttccatagcactcatcactctcttttttgagacaaggtttcactctgtcactcaggctggagtgcagtggcgtgatctcagctcactgcttcaatctctgcctcctgggctcaaacgatcctcctgctcagcctctcaagtcactgggaccacaggcacacgccaccaccctgggctaatttttattttttgttttcttgttttgttttgttttttgttagaaatggggtttcaccaaattgctcagctgctctcagactcctggactcaagcgatctgcccacctcgacttcccaaagtgctgagattacaggcgtgagccaccacgcccaaccaacacttaccactttcgaatgtacacatattttgcttgtttattatgtgtctactctgctaatatgtcactccacgagggcagggatctttgtctctcttatccacagatgcatctatcccaagcacccagaacagcactgcaatcattgtttaataaatgatgggaccaggaacggtggctcatgcctgtaatcccagcattttgggaggccgaggaggtcaggagttcaagaccagcctaactaatgtggtgaaaccccatctctactaaaaatgcaaaaattagctgggcatggtggtgggtgcttgtaatcccagctacttgggaggctgaggtagaattgcctgaacccagaagacggagcttgcagtgagccaagatcacgccactgcactccagcctgggcgacagagcaagactcagtctcaaaaacaaacaaacaaaaaatgatgaatggcaggtagcaaacactcaataaacattagttgaacaggtgaatgaatgaatgaatgagtgaaggaatcaactgccttacttcacagaaactgaagcccaggaaaggcagagaataagccatggtcacccagctggataaggaatcaggttgagatgtagtccatgactcccaaaaagtggaactcacttgccttccgtatctcctcctgccctctcccccgagctgggtcttggagcctgagacccccttccctagctgccaacaggtagctccaggatctctcaaagtaattgttgggagggagagaagaaaattgaaagatagagacagagaccgcgagataagagagggggttggggaagagaggggaggatagggacacaggccctggacgggcgaaaataaaagatggaataagagaggctaaaacagccatggacagaggagtagggcaggaacacatgaggctgagagggcttcctgccacccagtcctcccccaggagcacagggtccagtaggcaccagggtgggcaggacagtgaggcccgccatggcacatggacagccactcctgcctccttccagaagagaaggcgagtgggtggtggctctgcgctgcattgatggccctggccctgcccaccctcacctctcacttctgggctggcaggaaccactgatgagtgtgagcatggcttactaagaagcctggcacatcccgccccacctcccctgggagccctgggcttttctcctgctcataaatatttatttatttatttatatttttttgagatggagtctcgctctgttgcccaggctggagtgcagtggcgtgatctcagctcactgcaacctccatcccccaggttcaagcgattcttgtgcctcagcctcccctgtagctaggattacaggcatgcaccaccaggccaggctaatttttgtatttttagtagagatggggtttctccatgttggccaggctggtctcaaactcctgacctcaagtgatcctcccacctccagcctcccaaagtgctgggattacaggcgtgagccaccgcgtccagcttccttctcataaatatttattagtgttcagagtgtgaagatgccacagtcagctggggtgtgataattgctaaagtgaggaaaaatacagatcacaaggtttgaagcagcagctcccaagctggggctggacgtgcagagaagaccagagaagtggcaccggccacaagggactccacctgcttccagaagcctcgggagcccatggtctgaaggaaaggagaggccacaggtgcctgaggccacaaacaactgagtcagggaaaaccattccagggactgctggaaggagcgagacaccctggtcaggctggaagaggcaacttaagaagggagggagggaagacagaactttgttgagtggctaattatttctcataatagctctgtgaaatggggattatcatcctcattttacaggtaattagctcaaggctcagagagacgcagtaatttccccaagaacacacagcaagccaggggctcggtcaggattcagacccaattctatctgcttgcctccagaagctgggtgcttcatatccaacccggctgttttcctaaaccgggtgttttcatcaacatcgggaataacaataaagaggagaaatgaggagaggagaggggcaaggggcacagtgagggtggccagggtaggaagtgtggccagcagtggggaatgacctgctgctaaccttgtcagcaccaggaccacctccttcaggaagcaggactctgatggcttcctcaaacaacagcagcagccaccacattccccaagagcatgccatgctctagacatgactttaggtatttttcctagaacactgctgatccttacaataccatttcagagatgaggaaattgagtctcaccaaggtgaagcatggtctgcctgtctcccgagcccatgtcctttccactctgtgacactgccaagccctctgtgataaaactcctctgacttcctgaccctaacactatcagaaaagaggcccctgtgaggatgcttcgtttcctgggacctccacctatgcagcgtcacacagatggctctgcctgtcaactttgaagagcaagcacacacgtccaagactggtcaaagccaaatttccaggatgccagaggcagggtctgcctcatccccagccccatctatgccccacagcctgattcacagagctgggtgcctataagagaaataccagcagtgttccagctgattaaggctcagtggagacaaggaacagaaccagcccccaccacacccaaccccaccgcccagggtagctcaagaaaagggggagggcatgttataagaaggcaaaattctcacgggatgcaggcaggatgcatgggggctggcgcaggatctgggaagccatctgaatctcaggcagtctcactctctctgcacctctcctcccggggcttcattttcccccggttgcactgctttctgggcggctgccccattgcctctgtggaccagctatctctacttactcaaggcttttctcctcctccatccttttggcttggatgtgactcccactctgacactgtttccactctgattctcactcagcttcccactgctaactggttgaatggcccacttccaaattcccagtagaggaatttgattggtcagcactggtcatgtgttctacacctgggccaatcagctatacctaggtgtgtcacacatctaggtctgtcatgtagtcaaggaggcccgggcagaagagggtctgtagagtaatgttttccaaacagggggtcacaacatactagttgataataaaaccaacttatggctgggcatggtggttcatgcctgtaatcccagcactttgggatcatgcctgtaatcccagccgaggtgggaggatcacttgaggtcaggagttcaagaccagcctggtcaacatggtgaaacccagtctctactaaaaatacaaaaattagccggacatggtggcatgcacctgtaatcccagctattcgggaggctgaggcagaagaatcgcttcaaccagggaggcggaagttgcagtgagctgagatcatgtgacttcactccagcctgggcaacagagcaagactccgtctcaaaaataaataaataaataaataaataaataaataaataaataaataaataacttaaaatatttttttaatgaaatggaatggaatagactagaaaatataagcatgcactgcaggtagcaaggtataatagacattactatattcaccaaaattcagtttccttctaagcctgggggtatgggagtatcagatttctctggtcctatgaagttaggcatgtccatgtggcttgctctggccagtgaaatatgagtagaagtgccagatgtcagtgccaggtagatttaagtgctggtgcttgattccccatgccctctgtattcattttctatggctgctgtaacaaattaccacacacttagtggcctaaaccaacacaaacaggccaggtgtggtggctcatgcctgtaatcccagcactttgggaggccgacatgggaggatcacttgagttcaggaattcaagaccaatgtgggcaacatggtgaaaccccatctctacaaaaatacaaaaattagccaggcacagtggtgtgtgcctgtagtaccagctactcgaacgctgagatgggaggatcacttgaacctaggaggtggaggttgcagtgagtcaagattgtgccactgcacttgagcctgggtgacagagtgaaaccctgtctcaaaaaaaaaaaaaaaaaaaaaaaaacacacacacccaacatattatcttatagtttggtagttcagaaacactaaatgggcctcactggactaaaatcaaggtacccacagggctgcattcatttctggaggctcaagggatgaatctgtttcccagcccttcccagcttctaggggctgcccacattccttggctcatggcccctgcttctatcttcaaaggcagcaagagcaggttcagttcttatcacattgcctcactttgacctcctcttctgcctctctcttccatttataaagacccctgggactatgttgaacccatctggataatccagaacaatctccctattttaaggtcagttaattagcaaccttaactccatctgcaaccgtcattaccctctgccatgtgacatatcctattcacaggttccaaggattatgatgtagacatctttgggaagagcattctttggcctgccatgctctctttcctttgccactgaaaccagcaatgatctggatgagaaagcctccatcaacctaaatcccagggctgtcccactacatgacagatgtgtagcataagggagaatgaaagctcttgagccactaagatttgggggttcttaccggccacaggctagcttctcctggctgatacaaaaagtgagtattggctgggcacagtggctcatgcctgtaatcccaacactttgggaggctgaggcgggcggatcacttgaggccaggagtttgagaccagcccggtgaacacagtgaaaccttgtctctactaaaaatacaaaaaattagccaggtgtggtggcacatgcctgtaatcccagctactcaggaggctgaggcatgagaattacttgaacccgggaggcagaggttacagtaagctgagatcgcaccactgcactctagcctgggcgacagagtaagactttgtctcaaaaaaaaaaaaaaaaaaaaaagagtattatttagcaaaatgtttgtttcaggtgaatgtgtgtgtactgaattacaatgtaaaatgaatttcatgctgcaaatttaaaaatgtttcagatccgctgttctagaaaaacatgcctaaaccaaacatgccctatccgtgtctgtgcagactgctggatgctgtcttctgattccattccatcaaggtggtgccgccaggaagacaggtaggtcaactctccatgaaccagaatgtcagtttctccagtgagcctcattccccacctgcagcatagggtacctgtggaccaactttgacactaatatttcactgctcttctgtgagccatcagtcctcccagtgtccctttgtgcctgtcagggagagggctacacaacaaggaacccaaatgaagtaccttccaagactgattacaccaaaacaagattttctaattctatatgatcagctaaacaaggaattttttttccttttttttttgagatggagtctcactctgtcacccaggctggagtacagcggcaccagcgaggctcactgcaacctccatctcccaggctcaagcgattctcctgcctcagcctcccaagtagctgggattactggtgcatgccaccatgcccagctaattttttgtattttagtagagatggggtttcaccatgttgtccagggtggtctcgaacttctaagctctgcctcccagagtgctgggattacaggtgtgagccactgtgcccagccaacaatggaatattatacagcactgaaattaggtttccatctttgataacacaaggaaatgcctatcatagaatattaagcagagtaagtcaggaatcagaatagtacgtttggcatgagctgaactttacactcaataaatacccaaaagaaataaatgagaagacttgatgttaagatgcctacgctcccctaattgattcaatgtaatctttatcaaatcgtagctagcttttttgcagaaactgagaagctcatcctaaaattcataaggaaatgccagggatccagaatagccaaactatcttgaaaaaaaaaaaaaatagaaccaagttagaagactcacacttcccattttcaaaacttaccacaaagctacagtaatcaagactatattgtgctggcataaaaacagacatatagatcaatgggatataattgagagtctagaaatgaactcatatatttatggtcaatagatttttttacaaaggagccaaggcaagtcaatggggaaagaacattgttttcaacaaatgatgctaggacaactggatagtcgcacaaaaaaaaacaaagttagatcccgacctcacatcacgtacaaaaattaactcaaatggggccgggcgctgtgtctcacatctgtaatcccagcactttgggaggctgaggcgggcagatcacctgaggtcaggagtccgagaccagcctggccaacatggtgaaaccctgcctctactaaaaatacaaacattagccaggtgtggtggcaggcacctgtaatcccagctacttgggaggctgaggcaggagaatcgcttgaacccaggaggcggaggttgcagtgagctgagatcatgccactgcactccagcctgggtaagagagcaagactttgtctcaaaaaaaaaaaaaaaaaaaaaaaaaaaattaaatggaccaaagacctaaatgtaaaagctgcagctataaaactcttagcagaaaacgttaagtgtaagtcttcatgaccttgggttaagcaatggtttcttagatatgacaccaaaagcacaagcaactgaagaaaaaatagacaaaattttaaaacttttgtgcttcaaaagtcactgtcaagaaagagaatattggggggtgggggctgggggagggatagcattaggagaaatatctaatgtaaatgacgagttgatgggtgcagcaaaccaacatggcacatgtatacatatgtaacaaacctgcacgttgtgcacatgtaccctagaacttaaagtataattaaaaaaaaaaaaaaaagaaacccactgaatggagcaaatattttcaaatcatttatctgatcaggtcctaatagccaggatatataaagaactattacaactcaacaacaaacaggtgaatcacccatttttaaatgggcaatggatttgtttgaataggcatttgtccaaagaagatattcaagtggccactaaacacatgaaaagatgttcagcatcatcagtcatcagtcaaaactacaatgatacacttcacacccattaagatggctatactcaaaaggaaggataataagtgtggacaggagtgtggagaaactggaaacttcatacatcgctggtgggaatggaaagtggggccgtcactttgaaaaacagtttggcagttcctttaaaagttaaaccgagagttaacatatgacccagtaagtcccctcctgggtatacacccaaagtaactgaaaatgtccacacaaaaaacttatgcataaatgtttgtagcagcattattcaaaatagccaaaaagagtgaaaaaaaaaatctatcaatgaatacatgtatttttttaaaattcagtctatacatacaatggaatagtacataggcataaaatgggatgaagtactgattcatgctacaacataatgaaccttgaaaacattatgttaagtaaattaacataatgttaattatgttaatttaacataattaacataattctgttaacagaaggctgcatattatatgattccacttgcattaaatgttcagagtaggcaaattgatagagacagaaggtaaattagtggttgccaagggttgatgggagtgggaaatggggagtgactgctaattggtacagagttctttgggaggtgatgaaaatgttctggaattggatagtggtgatggttatacaaacttgtgaatatatacaaaaaccactgaattttaccctaaaagtgtgaatattatggtatattacatctcaattaaaaaaaaaaacaactaaaaaaagacagagagaatgaaaaaaaggaaatgtgcctaaatactgacaggagttgaagaagactccgcccacccacacgcttctttatacctataatttttctgttatacaatgagcataaagtactttataaagatgcttggatttccctaacaagatatgtctcaagtcttggagaaaggagaatctaggaaaaaaaaaaaaaagtaagtgaagtagggaaaatctggaccctaaactctgaatgctttgatgtaagagtctctggttctgtgattttacaatccaggatccatgtttctgtgaatcctgagatccctccccaggcctaatgtatcgtatactcagctatcctttttccaggaagccttccctgactaccctctaagtctgggttaggagcccctcagctccacatccagtgtgtccccattcatagcacttaccatactttgtaatggtctgataacaccctctgcttcacttttatagcaacaatgaaagtagagatattatttgtgttatattcactgtatttctggggcatagcatggtacctaggatatagtaggtgctcaataaataaatataggatgactatggttaaatgaatgccctaagagaattattcaagtatgaggatggatgaagtttaaaaagatggtggtaggacaggcgcagtggctgacgcctgtaatcccagcactttaggaggccgaggggggcagatcacgaggtcaggagtttgagaccagcctggccaacatggtgaaaccctgtctctactaaaaatacaaaaattagccgggtgtggtggcacgtgcctgtaatcccaactactcaggaggctgaggcaggagaaacactgaacccaggaggcgaggttgcagtgagctgagattgcaccactgcactccagcctgggcaacacagtgagactctgtctcaaaaaaaaaaaaaaaaaaaagaaagaaagaaagaaaagaaagcttatccaggttatccaggagagaaaccaggtccagttactgctgtaagtgagttacaaatattaactcacttatttctccaacaactctataataagtgttactatcatcccatttcacagatgagaaaactgaggcacagggaggttaagtaatttgcctagggtcacacagcaagtaagcaacagagctagatatcagagcccagatactccagctccagagaccacacttttaatcactcacaatactgcctgagaggtgggattatgtggttctgtctggggagtcaaaaaagccttcagggctggccgctgtggttcacacctttaatcccagcactttgggaggccgaggtgggcggatcatgtggtcaagagattgagaccatcctggccaatatggtgaaaccccatctcgactaaaaatacaaaaattagggccgggcgcggtggctcacgcctgtaatcccagcactttgggaggccgaggcgggcggatcacgaggtcaggagatcgagaccatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaatacaaaaattagctaggcatggtcgtgggcgcctgtagtcccagctactctggaggctgagacaggagaatcgcttgaacccaggaggaggaagtggcagtgagccaatatcatgccactgcactccagcctggcaacagagcgagactccatctcaaaaaaaaaaaaaaagccttcaagggaggaggtagcaatgaggaagatcttgaaggacacacaaggtgcagaaggtgaccacactgcaggcagaggcctggagagggcaactgaatccaccaggtgctcaggagacagcgagcctctggtgtggctggagtgtgccccaagtgcctgggaggagccccaggggaagaggctgggctggagaatggtccgtttgctccacagagaatcacggagcacctctatgtgagggccttcggctaggagggtagggctgtgaagggccttgagtgccgggctaaggaacttggaccttatccagaaggcaatagggagccatgcacatttgaggggagggagaatgactggccagggccatattttggacccagagatgccctcaatcccatacgttcccccatccctgtccaatagcagccatggctcagctgggtagggtggggagacgcaagggggcattcactcagacgcagccaccctacattctgacccactttcctcagtgtgagagcagccatcagggagcagggaggtgcggggagcaggtggcagcggctgcagagaggttcctaggcccttatcgcattctccctggtagcagagttatttgtgtaccggctcgtctgctctgccagaatttcccagccctccctgtgtcagagtgtggcccttctgtttacccaccatcagtgcacctgcttctcaggacagcccaggagggggaaggaggcaggaaggcaagaaatgtcaccccatttcagagatttccggagcctgagggagcacagtcccacctgcttcatttcccagagggagaaatcaaagcccgagtgagagaagagtctcacaccagggccaggaagcttgggctcagggagactcgctagtgtgcccagagtcagactgggatggggaccgccggcttctgtggttcccgtctcctgtcacatccctgctcaaatctgccatagctcccagggcacagggcagtgcctggcaggccagaggggtcaggggtggtggctggggagtgaggggttctggccaagtcagactcctgggctgcagacttcccacagacttctaggccgacagcaattccccaagcctcctgccgcattcacgggttcacttctttggccatgaagcatatttttgaaaattctcaggtggtgcagagtgaggaaagagggggccatggacagaggggagagtttcttaaaagagcttggcttattttctgttaacccatgaagctggagatctgaaaatcaagggctaatcaaaatttccccaggcgggctggcagctggataccaaagagcccacagactgcgcctgagcgctgcccagccttcctggggctgagatgcaggaagagaaggttgctggcagccaaaagggcccagaggctgaagcagacagtccctgcctgagtctctgcttgagcccagtgtgacctcaggcccatttcctatcctctggaaggctcagcttccttcgcctagagaatggggataatatccaccccataggctggggataggtgtaaaaacttgatccccagtagtgactcaacacagggaagctgacattgtgctatgatactatgaaattgtcatcatcattatcctggccagtgtcctgcccccaccccctgctcagggagagttctcccccaagtgtccctcaggtgagaaagccttgcgggtgggaggagatggtcatgttactcctgctgggacagggaaatgtttaaactgtctgtctccctacagtcttgggtagaaaacacaatttatgatgtttttcccccagattattattatcattattattattattatttggagatggagtctcgctctgtcacccaggctggagtggagtggcatgatcttggctcactgcaacctccgcctcctgggctcaagcaattctcctgcctcagcctccagagtagctgggattacaggtgcacaccaccacacccggctaattattgtgtttttagtagagacagggtttcaccatgttggccaggctggtctcaaactcctgacctcaagtgatccgcccatctcagcctcccaaagtgttgggattacaggtgtgagccactgtgccccactttttcccagtgtagacatccacattccagaaatttccaggtgcgtgccctgctcttccctcttcctgtactatcctttgcatcagttctaccaactgcagccccttcccatccttcacacagtcccagcgtcacctcacccaagaagccctccttgactgccttggcttaaagtgctcttgccctgactcctctgcccttgctccctcctttgcttccttccattcgtctttcttatttccctcctttcttttcttccctttatttttcaaatctctgggcctggggctgtttttacctgcagaaggtacaggccccggtgtcggtgttgtttccccagagcacctacagggcagcggaaggcagacactcagtgaacaagcaagccctccctcaaaagcacagtgggagggtgggaggaggtgcatgtgtgatgtgcccagttccgttccaggcaccaccaggcacccagcacacatgtgcatctttccctccctctcctgctggcccctgagcatccaaacagggcctgcacatggctgctcctgagtggatgccacggaactgaaatgatggcaaaccccagggaacagaaactgcgacttcagtcacttatgttccttggtacatagtaggtgcttaataaagattttgaatgaataaacaagagccaagccctgagcttgaggctgggaaaaaataggacctgggccaagaagcggcagccttgccatctggatgagcaccatggatgcgcagtcttggcgggaacccattagctatagggcactcctgacacaagacaggccattattttcccagcggaaagattttatttaaagggggtttttgtttggtttgtttgttttgccaatttcaacatgcaaacttttaaggatatagaataacatatgttaaaataagatattaattcaaaaacatcattaatttcttcctattctcacatttcataaaatgtcacaacagatccactatggcagcatatctctgactctgtgtccactgctctgtggatcagtcagtaagccgagagggttctctgtggtcagggactccatacagactgaaatctaaggcctaaggtgccagctttttccagggaaatagttgtgggggaaaaaaactgccttatatttatctggatggggtgcccacggtgtgctgagctggcttgtacaggctcataagagccaagtgtcacatttttaagaattttgtgaggtagttgttaaacacagccagtaccgttggttctcagccgggggcgaatttgcaccccaggggacacctggcaatgtctggagacattgtgggctgtcatgatttggggaagaggtgctactaacatctagtaggtagaggccaaggatgctgcctgcataatgcacatgtcagtccccccaaaccccccgcaaaggatctccagaccaaaatgttatggtgctgatgctgagaaaccctgcttggagcagtggctcatgcctgcaatcccagcactctgggaggctgaagtgggaggatcgcttgaacccaggagtttgagaccaggctgggcaacaacctgtctttaaaaagagagaggaaaaaaaaaagtttaaaaaaaagaaaaatagaaatcctaatgtgaacttacaattaaataaactctattaaaagcaaagggaatgcattttcttttcttttcttttctttctttcttttttttttttttttttttttgagacaagagtcttgctctgttgcccaggctagaatgtggaatgcagtgacatgatctcggctcactgcaacctccacctcctgggttcatgcaattctcgtgactcagcctcccaagtagctgggattacaggtaatgtgccaccacgcccacccagctaatttttgtattttttttttttttggtagagacggagtttcaccatgttggccaggctggtcttgaactcctgacctcaagtgatcctccagcttctgcctcccagagtgctggaattacaggcataagaaaccatgcctggcccaggaatgcattttcaaaactgattacatactaattattttactgttgttactatcataccctcaagggtatttatgcctactatacctgtatggtggaaatgctatacaatggtgtctactgttcatctcttcccaactgcacattcagtgacttcacactggtagagtgaaatctgaagtcagagtatttacatcacagaaattggcagatgctaaaatcccccacccttctttttttctggagggccagttgttaccagcacactgttgggtgtaaccctaagtagagaagataaattcacaagcttgatgaatccttcccagtttccagcctaggcagacgactcagcaccagcctgctgtatggatcaaggatctgaatgtggtcgtgtgcacgcactctacacaccatgcacagaaagacatacacaaatactaaacagtaacacacctgcatcacactccacacacacatcttgtctacaaacccccacatatacaacatgcacacagcatataaccgactaaacatgcaccccacagtagcccttcagtcagcaggggaataatttgaataatgacaaacacaagcaaaagaatgacaacctgactgaccaaattccttgatatctgagcaccttcacctttactccctcctcatcctctgtgatccacccttccccgcacaccccgacaccacactgcaaaggcaaaggtctcaaccctcacaagaagcaccaaacccactgaccccatttcagtcccgctggaggccctggccacctgactccccatccctgctctgtgcccagctctcaggagactccagagctgagtctgaccttggccccttcccagagcccatgaaaaggagttccctgggcaactccacccacctgaccacttcagctgccaccgatgccagtaagtccaaacctcgtctccagccagaccctctctgacccccacccatcagccttcagacatttctactcgatgtcccccaactccttagacaagtcccaaacagccttcccccatctccaccccgcactgttcctccctgtgttctccatccccacctatgccagaggctggtgcgcaggaagcactcaatgcacatctcatggagagaggaagaaatcatgtaaatcccagaaagagaggaaaagcaaacttcctggtgagtcagatagaaagtcttaccccattttacagatgagagcccaaagattcagtggagtgaagaggccagcccagaagcagcgccaaagcagtggactgtgaggtggagggagcctgagctgggggctgcaggcagcagcagccaggccagggccagccccgcaggctcagctctccccagccccaagtgaggggttagttacaaagaaaaggaaaaggcgttcctgatacgcgtcctgtttcctctcctcctccgggcttctcgggccatggagggcggatgtccctgggctggcagcactctgcctgtacacagacgggcagggggtgagggtctccccaaggatggtgacggtctccctagaccactttccattccagcagtccagcctgcatggagacaggggctcaccagagtgacccctcaagtttcccttccagcctgggggagcccttaccccttatccccagtgggtacttgtcacagccaggcacctcctgtccatcagaggatcccatacagacaccttcaccaggaaggcttctatgtcaccctcacttgctgcagagggccttcttgcagtctcctgtaaggagtctcctgtcttcccttcctccctgccccacagcagccaagtttataagtgcccatctccgtccgtagctgctgcctgtgggacctgagctccccatgaatcagggagcggaaggggtcaaagtgaaggggtcaaaggtgaaggccataaatggggtttcttgagtgagaggacaagatgagcctccatcagacaggggtccttcctgaggacagaggtcagggctcctctctcaaatagggaatctctctgagggaagtggccatggatcccccatcagattggaggctcctgcaggatggaggccatgcttcattcctcaggcacacagctcctacagaacaagaggactgtgtcccctctgttacacagagagtcccaggaaacagaagtcatggtgccccatcagacaggagtgtcctggaggacagggccatgcctcctccatcacaccaggagctcccagagggcacgatccccatctgctccctctccccagaagctcccaggacagacttcagctcagtctaacacacggggaaggtcttccctctggagcagaactgacagggagtcttgctcacaccctcccctgcccagggtcccactccaactccccatttatgctctccattgaactgaagccaccatgccatatttatgtcagctgtgtgtctgggcagaggccagcaacctctggagagatggcagggggcaacagggggatccctgacaagaggatcccaggacaggccatggctccagctctggctggatgtgacccagatgggtatccacacctggctctgccagtaactgagcaagcctcttcccccgtggccatggatagcaccatccccatcatcaaactttatcagcacccactcctggctaaagtggaataaagcatcagggacaggggatagcaggcccttccttagtcccactgtgaggacaacactggccctccctgggtgccagccctgagcccggcccaagcaacttccacagtcatctttcctactcacggcagctccagggaactgctattagttagcatcgatccacaaagtactttgccgacactttatgagctcagtctcaccagaggccccaggggccataagcaagaggcagaaaccaaggcccaggagctcaggccactgagtagagccagggagtcgctgagccagcatttgaaaccaggccccatgaccaaggcccaagcgagcccagagacagcactaagtaaatgtttactgaatgcctgttcactgaaaagcaatctgactggattttggtaacaatctgggcatattttcttattaagaaatttggcctggcacagtagctcacgcctataatcccagcactttgggaagccaaggcgggtggatcacgaggtcaggaattcaagaccagcctggccaacatggtgaaaccctgtctctactaaaaataaaaaaaattagctgggtgtgatggcacacacctataatgccagctattcgggaggctgaggcaggagaattgcttgaacctgggagacggaggttgcagtgagccaagatagcaccactgcactccagccttggcgacagagtgagaatccatctcaaaaaaaaaaaaatagccctacagtaatatttttttctggagaaagggtctcactatattgccctagctggtcttgatctcctgggcgcaagtgagcctcccacctcggcgtcctgagtagctgcaattacaggtacatgccatcatgcccagtgattattttaagacataccatttgttaatttgtcatgtgctaggtactttaaatatttatgtttaatctcaaggataactcaaggagaaaaagccagtatcctcattttacagaattggaaactggaggctagggaggggaagagaaaagttacccagttcaggggaggcaacgcccgcctggcggccccaaagcccctgctccttttctggcccacacagctccctgtgctctcagaaggtggcctggggaggccagaggcccacaaatgggcgcagccagcatcaaagtgctcaggcagcctgcctggtgggcctgaccccacattgcagggatccctggaggagagggcccaagccctgctccctcagggagctttgccaggcctctctgagggcacctatttcacacccctgccttggtgggaatcattcatttgagaacttgccccccaggatgggagctcctccagggcaaggcctgtgcttggcacagagaaggtgcatcataaaggagttaagggcacaggcttagggtcaggcaggcctgtagcctcatcaccctgcaacgcagccgtcttgagtgaaatgaggccctggcacagagttggagctctgtgaatggtgagaatactaacccctaccacagcaagcggacccactggtggccttgggcaggtccttgtccatcttggcttcagctggcttacgtgctgtcactgggggtcacattacctcacaggaggctaggtaggtgggaggaaataatgggtatatgaggagtcctggggagaccagagtgctgagcagagacaaaggcctgatattaggacaaggctgaattattgagcattttaaataaatgcatttccattacttccaagaatacacaggccttgcagataaggtgggcacagcaaagccaaccaagagcagctgtgcctcagtgaggcagggagcaggggaggagcattctagagcatctccagaccattccccagacatacactgggacttggtaatatgcaacccccaaaccttccacttgctcctcaaaacagttcccttttatggcttcaggaggggtagtaagaagcccgcaggaggaacggtgctggccctcttagccaccaacctatctggagtgaccttcccagaaccagctctgcctgccacaacctagaagctcaagccatctgatcccaaacctcggggagaactgcgcaaatggaaatcgatgtggggagcaatggggaatggggtctcgctctctcccctggtatttaatggctatgtttggacatggcatcttacctttcctgtcctcacctggataatagggcaacacagcctgctccagggtgttgagggggatgaaaggccaacgtctgtatgcgcctggcatgtaacctgggttcaacataggtaggtgagtgcactgagaggcactgggaacaccaaggggaacaaggccatccagggccctgcctctgtggggcttaaagtctagcaggggggaaaaggtataaggaatcgcatgtaagaacacctgcaggaagcggaggagcctttggtcaccatgctacattgtttccaacatttattttatactctctgtgtatccaaccggcaccaggcagtgggacacaggcttcccacggggtttggagtgtggtggatgagcttacggaatgtgcttccttaagacctagatggcctttccttcagcaccttcctttggctcacatttcaccctcatgaggaaacctcatgagcaactcagcccctgtgctgtctgattatcagcaggaggcagtgggcatgggcattcatgccacagagagagaaggacctgaatgatttggttgcctgcttttagctcaggttcatgtgaatctgattgagtcagtcatgtggtctgctcaattctaagggctggactgacatgtggcaactttgtacaggccagaccccaggaggccggctccccaattgcctttgccacactgcctctgtcccaccacaaccacagtgaccttaaggagcagaagggtctgttacaaatgtactgcccacatagggtaggggagacagatgtccaaaccaatacccagcctaccaaaggcaccctatgagagggttataaagagaccacagggccaggcgcggtggctcatgcctgtaatcccagcactttgaaagatcaaggcaggcagatcatctgaggtcaggaattcgagaccagcctgaccaacatggtgaaaccccgtctctactaaaaatacaaaattagcctggcgtggtggcacatgcctgtaatcccagctacttgggaagctggggcaggagaatcacttgaacccgggaggcacaggttgcagtgagctgagatggtgccgttgcactccagcctgggcaacaagagtgaaactctgtctcaagaaaatataaaaattaaaaaaattaagaggccacagcaattccgagaaaggagcagctccattctttctgggatgggcagggggctgttgagaaagttgcagagagcaggtgacatctgagctggacttgaagcacaatgaagagtttgtcagattgtcaaattgcagaagagaacgttaaaggaacaggctatgcatggaatgcacatccttacatagcagactgcacatttcaaaaatcagttcaaaatcacaatctcgtttcaccctctcaaatcccataatggtgttattaactgcctctcccacggccctccacctgccacacacaggcaaacaaaaaaagtaaggtccagtgaaggcagatggtgagccccagggcaaacaaacggtgactgatttctgagtagagggaagtgaggggtggactctggctgaaatggtcctcttctcactgaagtgggggattcctgaattcctgtccggcggcagcaccccacttcggcccctgctggcctgtgacaccctcctctcatccccagcatacacacacactcctccggccaccagggcctgtcagaaggggctggctgagaggggacggccggcagaggaaccaagcagcagggcctgggccgaggggctgggaaaaagctgaccgttctcgaaggcccagatcggaggccctgcccagcctcttcccctcctctaagtgctgatcacctcagcctctcccgctgcaagtctccttccatggcctctcctctcccatctcttgcagtggctgctgctggcctctcccttctccttcctccaccctcgccctccccggggagtggtgagctcagcctttcccagcagccgtccctaggaatgatgggaaatgcaccgccaggaactgagaacaggcctgcccctgggaaggagtgggagaagaggcgtcagggacagggctcaagtctgccacttcctaggacccctgaccgccgaagggacagtctgcctgtgtgtactgcacgctggaaggacatgggctcagactgtgtggactgccagggaccttgtcttacagatggggagacaaaggccccaggagaggagaaaggggactgactgcctgtcccaggcattgggagcctttcattgtctcatgtcatcctcacaactgctctgcaaggtgtgtgtggtaggctgagtaacagccccccgagatgcccacatcctaatcaccagagctgtggctgtgttgggtcatgtggtagaagagattctgcagatgtgattttgttcagggccttgagatggagagattatcctgcatgacctgggtgggcccaatgtcatcacaagggtcctgacaagagggaggcaggagggtcagagagagtaaaggcaatggggtgatggaagcattgaaagacagacgaaaatctacactgctggcttcaaagctggaggatggggctgggagccaaggcatgcagacagcttctggaagccagcagaggcaagggaatggatccccgctagagtttccagaggacacagccctgacaacccatttcaggactttggacctccagaagtgtaaagaatatatttgtgttgttttaagccactaaatatatggtaatttgtaacaggagtaataggagactaatacgacagacattcttattcccattctgcggaccaggaaactgaggctcacagaaggctcataactccctcaggccaggtgtggtggctcacacctgtaatcccagcactttgggaggccaaggcgggcagatcacttgaggtcaggagttcgaaaccaacctggccaacatggtgaaaccctgtttctgctaaaaatacaaaaattacgggcgtggtggctcttgcctgtaatcccaggtacttgggaggctgaggcaggagaattgcttaaagctggcaggtggaggttgcagtgagctgagattgagccacttcactccagcctgcgtgacagagtgagactccatctcaaaaaataataacaattataataataactccctcaggtccttcgggaatctctatgggctcttaaggttgggggcccctcagccaaggcttcaggctagggggagagtctgaggaggaggcagcggtctgccactgtaggctaaggctgaggacaagagagagaactggagaaggttaagctttgtgccttattacagctgggcccttccagatcccgtgactaagaactgccatgtcctgactgagaagcagggaggcgtgtgacacacaggaagggccctggctgtgcagctgggattggctggctgagtgtttgccggattaactgagatgaaatgaaatcccctacttagctcttggatcctgataaaacccctgtgaggaaattccttatccctctgcattactggtaaggaaaattggtcccccgggttagtgactggcccaagttctcccagctagtaagcagtggagtctgggtattcataatgagcaacagaaaaagcatcacagccaggcctgatggctattgagtgcttcttacgtgcctaacactgccttaacagttgcaggcattttctcagtcattccagatgcaaacctgatcacgtgcctcctctgcctaaaaactcttaaccgctcccaagagctcttcacaatctggcctctgtccagcctccagcctccctcccaccatgctccctgcccccacacaccctccagccacactgaccttggtcagttccctggagccaccaacttccttctcacttcggggtctcccacaggactccagtcccaccagcctggggccccactaacacagggtggagaaaccatgggtcctggccacctctgctccccattgtgtgtaaggaagggatagggccaggggtcagcccacaatggcaaggggcctgggaggctggagtcaagagggcccaagtcagccagtcatcttcttagtaaagataacagcagactggatgccgcagggcatggtggcacagctcccagggatgccccccctccagcagaaatgcagaccccaggacactggagcagagggggtttgtggaacacaaggtgtccccttaagagcatgcatggcaacatgaggcccacagaagggcaggacttgctgcaggccccagagtgtcactctgggagtcaggtcagagcaatggttaaggctttgggatctgccactcactagctgggtaactgaacctctgactctcgtctctaacaacagcacgtttttttttctttgaaaaaaaactttgttgcccaggctggagtgcagtggcaccatcacagctcactgcagccttgacctccccaggctcaggtgatcctcccacctcagcctcccaagtatctgggactacaggcatgtgccacaccaccacacccagctcatttttgtattttttgtagcgatggggtttcaccatgttgcccaggctggtctcaaactcctgacctcaggtgatccacccgcctcggcctcccaaagtgctaggattacaggcgtgagccaccacgcccagccaacagtgcctttcttcactgatgcatgtggagcacctggttcagtgcccggtgaacagagaggcccgtggtagatgacagctgctctttccattgagagagcagggcctgcactcgggacgcctgggtcccagttagtgctgcttccaccaccaccaccaccaccccacgctgcgggatgggggagatcacccgctgtagtgaattttaacaatttcatgttgcttgggcacccactctgagtatgtcagactttctcgtaccagaagcagggctcagtcacccttgacacagcttccagtgctcggcctcctcccagttcctcaatgtgatccatccaggtatctgccttatgcaacctcctcctggtgaccacctcgctatgggacagccagacagaagccacctaacttgcccattgacccccacacccacatgggctacatggatttgccgcagtgacccccctcagtcaccatgccttatgcctgcttgctctaatcccagcaattatatttacccacagaaactgcgtgggtaacatcttgcaccccaacaaagcctccagtccacaggtcctcccatctctctcttgctccaactcactggctaagcacggggtcccaggcagcttcccgctgccctcccctctgtgagtaatactctgcttctgttatttcctgggttttgctggctacttcctcagtgtctcacctgaccacgtactctcctagagagtggttttcttggtaggaataaacggacacaggtcagaaaagagccacaaggcgccttccactataagccagtttcctgtgagagagacacctggtcacggctggatacttaggcatcagaccatccaccaggataaagaagcatctcatgaaaggcacactgtggacccccacaaacacctgccctggaactccgtcagcagggctagaatttatagccattctcagagagagacctcaagaccaaattagaggaaaatacactcacgccacccctactctatgatatagctgggtgggtttaattaacccctcaggtgggacccaaacagggaggacacctggagaggtggcactcagctgtttctggagcctctgcttctgggcctcaaagctggttacaggtggggtgccgtggctcatgcctgtaatcccagcactttaggaggccgaggcagacagatcacctgagatcaggagttcaagaccaggctggccaacatggtgaaaccccgtctctacaaaaatacaaaaattagccaggcatgatggcgggtgcctgtaatcccagctacttgggaggctgaggcgggagaattgcttgaacccgggaggcagaggttgcagtgagccaagattgcaccattgcactccagcctgggtgacagagtgagactctgtcaaaaaaaaaaaaaaagtgctggttatgtccttatctcctctggtcatctatagaaaagaggtgatcggcttcgttttccttacaattaaaggaaggggccagcactgccccagcagagtgagcctaggctagaggaactcctaattcaaaactgagctccctacttgcaaaccgacagaagggaaagaggaatggactattcactgagcacttccagcgggtgggtgtcatgggaacctgccatgaaacatctcgcttaaaccccacaacagcacaacgagaggggctaggcagtagtccagtcccattttgccaggcacgatggctcacccctgtaatcccagcaactcagaagacacaggcaggagaatcatttaaggacaggaggtcaagaccagcctaggcaagacagtgagacttatctctttaaaaaaatttttttttaattaaaaaaaataataggccaggtgcagtggctcacgcctgtaatcccagcactttgggaggctgaggtgggcagatcatgaggtcaggagtttgagaccagcctgggcaatatggtgaaaccccatctctactaataatacaaaaattagccatgtgtagtggcgcgtacctgtagtcccagctactcgggagactgaggcagaagaatcgtttgaacccggtaggtggaggttgcagtcagccgagatcgagctactactgccctccagcctgggcaacagagcgagactccgtctcaaaataataataataataatcccattttgcttacatgaagctaaggttcccagaggtaaaacaacttaacttgtggcactggctggcaaagtcattctcctccactgtgtcaggtggcctctgggtaacggccccatttccattctaaatggctacagtctagggtctttttgaaggaaaggaacccagatcaggaagatgaggcccccaaagcagcctctcacccacccttagcccctatggcccatctcctccctccaggtgctctcccctcccatcagcctaccccagaggctggttattaacttctgtgaaaataacacatagcagtgctgctgcctcccccaacccccgacggcatcctcacccccacacccggttcacagccactccttctctgagttttgctcctttggcacttccaaagcctttagtgagctgcaactaggtcagatccccccatcagacaatctcctgtgcctgcacttttccctcggagcacatttcacagtgtgcatctcttgccgtctgtctacctgctccagaccataagccccattaagccaaggacatgtctgttttgctgccatggtatccccaggggtgtgcaccgcactggcacccagcctcagagtcactccacactcgcctgtgccaggccctgtgctaagagctgtgcttaggcatcacacttaacccccatcagtgctccagcagagtgagaatgatcatccggctgcacagatgaggacagcgagactctgaaaggtgaagtgacttcctagaggttaccccctagcctgggtcacggcagggaccagcaccgaggactagctacataatttgtgggccccggtgcaaactgaaaatgtgctcagatgtcaagacaaagtcctgactcgaagtcaaagccaggctccacccaccgagacgcttaggtcccctaaggcagtgggtctcacacttgagctggggtcacaatcactggaagggcttgttaaaaaacaggttgctggggcccagtcctagagttctgattcagtggatgtgatgtcggcctgggaataagcatttctaactttttttttttttttttttttttttttgagagagagagagattggatctcactctgttgcctcagctggagtacagcacaatcatagctcactgcagcctcaaactcctggactcaaacaatcctccagcttcagcctcctgagtaactgagactacaggaacatgcctggctaatttttttattattatttgtggagacaaggtctcactatgttgcccaggctagtcctgaactcctgggctcaaaagatctccccatggctgggcacggtggctcatgccgataatcccagaactttgggaggccgaggtgggcggggcacctgaggtcaggagttcgagaccagcctggccaacatggtgaaaccccatctctactaaaaatacaaaaattagctgggcatggtggcatgcacctttaatcccagctactcaggaggctgaggcaggagaattgcttgaacctggtaggcggaggtggcagtgagctgagatcacgccactgcaccctagcctgggcaacagagtgagactctgtctcaaaaaaaaaaagcaagagagatcctcccgcctcagcctcccaaagcactggcactgggattataggagtgagccactgcgcccaacataactgttgcatttctaaaggggatgctgatcctgtggcccacagacactgagaactgggctgtcagggctgaggatgtccaggatccttcaaacaatagtcaggccctcagtccaaatggccagccctactaagaaggagaggagcacatgggagtaggggcagaaggaaaggaggaaaaagaaaaactttacacaagtttccttgtttgattttcataacaatcttgccaggtaggttctattatctttattatagaaacaactgtagcacacagaagtcaataatttaccccgggtcccagccaggaaattacggagaccagaactgaacctggttctatctatgttaggtagctagaacctgcttgaaccacagctggctccaacaggttcaaaccccataacctgctcgcccaggggagcagagcccaagcctcaggagggaaggattagcacagcctcaagccctggggagccctggcaagcccccaggatcctccccttccactgcctgcgtgctctccaagcccaggcccgcagcacagagacccgggaccaggtgagggggccaatcactggtgccactccaggaggccagggtgcccatgcccagatgaaaggttcctcacacatgtcctaagtgccagatctgaccacactgtttcagactttgcacaggctgctcctgcctggaatgcccttcccaccctgcctctctgtccaactcttactcatccttcaaaatgcagttgggctctgggaagtgttccctcagcaccttgtccgtcctcactgctccatcaggtcaccctgcgatttcctggctgctcctccagccattcactgcacaaaaatttaataagcatctgccctgccccaggcacagtgcaaggtgctaaggctacaaggccgaggttgggctctgtcaggccaggatgtacgctggtttcatccctgtgaagctctgtaagccaggaggagcagacagggaaagggaccgtaagggtccccagggggaccccttggggtttgaaaaattagaagtactcaaattctacattccaggccacttgcctaggtggtggggtggagggtagcccccacccagtgcttccaggcctggagtaaagatgcttggcaaagcagcacaaaactcctaccaaacaaatacgaagcatgctatgtacctctgtgtcaagaggcccagttggctgtgaactccccaggaaaccgaagccccatcggggacagggatgagaccaaagtcccccccagagcaggaggcagccctggagtggtcctgcagcctcttctcccaggagatttgggcttcaacagaggaggaagagaagaggtgaggtgcccccatcctgaaggatttgcctacagaccctccactggtgaagagggcattaagggtgcaccctgggaagccacagcccacagaagccccaggccggagaggatggctgctgcctgcccaaggtggggagggggctggagtggagccaggctggcggaggaaacatcttgatcagcaagcaggaggaaaggaggaggaatgagaaaggaggaaagagccagacatgcaaactcctccgcctcctccttccaaccaaaacagaatccccagcagactgagacctgtggagaaggaggcgggaaagaagctgaggcctccaagggcgggtggctggatggtggccctgaggctggagcctctgaaagcttggggggctggatagccccaccagagatggggagggatcagtcatcagggcctgctcagctctgttcccgcaagggctgaaggctccaggaggaagaggccatgggctccacatggtaactccgattcctccttcgagaccccactcaagtacccaactcttcccaaagccctcagacctgacctcagctgggctggctccagcaccgcacaaactcaaaaacattgtagagtaaaattcatcctagtctctggaaagcctggaatctgctaggaaacccaaggaacccagaagaggaagtgccagcacagagatggccctggactcccagaccactgggcgctgggacacacttcatttccattcgcaaagccttcatgggggccttttcctctggtgggacaggaggctgggatgaggagacaggaggggccatgggagctgagcaatagggagacatcatctttgcccctctgccctcaacacaacacacgtgcacagacacacacatacactcactagtgggggctaagaggctcccagggacctatgtgtcttggacaaatcctttgacttctcttgttctctgttttccctcacctgcacacctgctttcctgccctccttcctttcaggagaggcacaaggtaaagtttaggcctccaggtaggtaagaacaaaggcctctggtatgacctcagcacgtggaagaaaatcccaccccacgtggaagaaaatcccaccccattcctgctcacccccccccaccaccatccccccacctcttcctcaggactctattatggcagagtgagcctgggaggcagaagctgtggtcaggaaagtaggcagccaggcttggagcccaaggggagagtgaccaccaaagtaacccatctcctgtccagggccttttctctccttcttctctccctgctggcggaaaccaccttccttacacacatgctcaccaccatttgagagaggctttatgggatgactttagtctgtgttttccttacagccctcatctgagttacttgaagctgctggaatttaggggtccttctttcattcacttttttatcctagtgaactggtctgccttggttggaaccggctagagggcatcagtcaagtgacctcccctcactcaacttgtttcttcatctgtaaaatgggatgatagcagtgcccaccccatcaggttgttctgaggattaagtgagtgtagtgtctggcacctagtaatacacattagatcttcttatgaatattcaacagaatttattgagcacctattgtgtgtcagatgctgttggccatcagacatatggtgaatagggcagatttgggcaaagggccctgtctacataaagcttcccgtctggccagggaaactgcagggctctgcactacacaactcctttggttaccatgacacagatcacagtgcaaacagaacacagagcgttcctacaagcaggtaacacagcagccctgcaagacaggcatcatacaaacaagtatatggtgactctcacaataaatgctataaagtggagggctccaagagcccaggatgggcacagaccagcctaaggagtcagggaagtcttccccaagaaagtgacatccgggctaagagttgaagaagcagcagtactaactccaaaagggacaagggctggggtgctgaactggggcaaaacaaaaccaaacctaccagccagacgcctgttatcccagcactttgggaggttgaggcagatggatcacctgaggtcaggagttcgagaccagtctggccaacatggcaaaaccctgtctttactaaaaatacaaaaactagccaggcatggtggcacatgcctgtaatcccagctacttgggattctgaggcaggagaatcgcttgtacccaggaggcagaggttgcaatgagccaagatcatgccactgcactccagcctgggcaacagagcaagactccatctcaaaaaacaaaacaacaacaacaaaaaacaccaaacctactatgggagggttctaggggaagacaggggaatcactgaaggtacaaggccagcagggacatgggggcagggcctggtcaccagaaggccagatcagaagtgtggatattactctgtcaccgtgataagatgttggtggggtttcagcagataattgacacaatgcagtcatgctttagtacgttcactttggctgctgggaggcgaatggaagggcagagagactggagtggaagcagagagaccagttaggaggcagattcaactagactgctctgggttcaaatcctagatctgccgtttattagatgggaaacctctcagggtctcagttttcccttctgtaaaatggagattacaacagtgtctacttcctgggttgttgtgaggattaaatgagcaactttacgcatgtaaagaacttggaacaatacctggaccacaggaagtgctgtatgttttgctgatattattcatctgggtcagaaatgagggtggcccagattagggaggtagcaatgagagagaaagagaaaactggacagattcagagataaaatcaataggtcttgctccaagcaaccagctgctccagcccaccttgtgccacctgcagccatcagagagaccctaagccagaactgcccagcggagctcttcccaaactcctgacctacagaaaccacagtccataacaaaatgaatgttgttgttttgagccactaagtttttgggtgatttgttatgtagcaaaagataaatggaacaaccctcattgaaatgtacctagaggggccgggcgtggtggctcacgcctgtaatcccagcactttgggaggccgaggcgggtggatcacttgcggtcaggagctggagaccaacctgtccaacatggtaaaatcctcatctctactaaaaatacaaaaattagccaggcgtggtggtgcatgcctgtagtcccagctactcgggaggctgaggcatgagaattgcttgaacccaggagacgaagattgcagtgagcccagatcacgccactgcactccagcctgggcaacaagagcaagactccgtctcaaaacaaaaaagaaaaaaataagtgtacctggagaggaaaccttctctccccccatgagcaagaagggaagcagctgagcaggaaggaagcggaaaggtgtgcagggaagatgggaggggctgagagccaagcctgggacctctgagccacccagggtccaggctctgccttcaggaagtgacgggatagctccaaagctaatcatttcagcactatttacaaaaccaaacacctggaaataatgtaaataccaaagaaggggctggttaaactgtagggcacccacatgaggaacaatcattaacgaatcgagatactacgagttaatagcataggagatactgaagaaaaaaaaacgtattcaaaattttacatacagtttaatcacaatggagcttgaatacacaaacacatgcatgcacacacacacagcaagaagcacaaacaccaaaaagtgttagaaatgttgtttctaaatgatgaaattctggatgattgctctcttctccttgtctaatgtggagggttttgttgttgcttaaataattactgaaagataactgttagttctttcaagccctcagaactcaggctgtgtgcccgcgccctccccccaggtctaggggaacatagcaccagcatcagttgctccatgagggcagggattcttgcctgcttcctttactgctgggacagcgcctagcacacagcaggctggctgagcacttcctggtgaatgaatgaatgaatggtctttatctgcccgtgcgaagctcctctgagtccacagcagccgccctcgtcagcctcaggtagggatgaggtctggccccactccatgtcctcagggttcagaacagggcctggcaccgaggaggcactagcaagggccgtgaatgaacgaagggctgaataaatgaacatcctacccaaagaagccctccctgatcaccgttgccgagccctggaggcctggggagtgtgcgtgtgggtgtgggtgtggaatagggggcagcaagaatggaaacatacctgggtcttctgagaacccagagagcctgtgcacctgactccaactccacctgcctcctcgggccccttccctttctgctgcgactttgcctgtttggtccccttctgagaccacagaaaagttctggaaggttctaactgctacgtctacactcaaagtgtagctgtttttaaaaggagaagagagcaaggcccttcctagacttttctgcctctctaaccacccccacccctgtccctgggagaaacctctgggagggaagccagcacatggggacccagggctggtggctggcgtgaggtgaggcagggagggatgcaggtgtcagagactcaggcagggctgggcgggagggccttggggtagagacctgaagaaaaccctgtggaaggaaatggcagagaacgtatgctggttgtcagggttggagaaaggactacatggtgcaggggtgacaactgaggctggcagtgggggaggtgccaacatggagagattgaccgtaaggaggaccagcagtggaatcagattgtttttgtccaggagaagtgaggtcagactgagcctgaatggctaccagaggggtggggcaggaatcccccgaccctcaccccagcccctactctggctgcccagaatgccagcccaaaaaaggcagtttactttgtttttgtttttgtttttcaacagggtctctcgttctgtcacccaggctggagtgcagtggcacaatctcagctcactgcaacctccgcctcctgggttcaagcgattctcgtgcctcagcctcctgagtagctgggattacaggcatgtaccaccacatccagctaacttttgtatttttagtagagacaggagtttcaccatgttggccaggctggtctcaaactcctgacctcaagtgatctacctgcctcagcctcccaaagtgttgggattataggcgtgagccaccatgcctggcccagtttactttttataaaataaatctcaacaggcatgacactttaagcccatccaaaatatagactagtgaactctgcggctcatgctaagaacaggtaggggctgaggccaccaaagccgctccccaaaccaggcttggccattaccttccaggcacccccaggcatgccccagcctctctctggacctcactaaccttgtgcgtaaagggacctctgagatcccttctggacctcacgcccagggctctctggtctgaccctgccagtgctcaaagcaaaagccccaggcccaactcgggccggctgactcagaggcttggaggttagaaaacagaagaatctcagagctcagccaggctgacctctcccatgacaggtagggaaactaaggcctaggatctttcctaaggtcccctcaaacctagggcaccagctcccaagcctagggcattttctaatgccttgaaggagctctgcagggtcccaggggaggtggtgcctgctcaggcagctctggagaagcaggaggtgatgaagaattttcattaacagccaaggctccaggctgggaggaggagggtgctgccggaggatgtgcgagagctcctgagagaggcactgagtcatgcttgcagctgcgtccccagaaagcagcccagggcctggcacagcgtgggtgtgcagtaaatgaacaaataaataaaaatgtgaatgagtgataacaacagcagctaacacgtagtacttactttgtgccaagcactttacaaatattaactcatttaatcctaatggaaacattaagattcccataacaaaagatgaagattctcataataaaaattttgttattcctcttttatagacagggaaactgaaacagagagaggttaaataacctgcccaaggccacacagcttgggcagtgtgggaagtctggcagtcaaccttggtcttaaccactctgcctcccactcagcacccttacctgccacagcctctctcccacacaccgtctccagcagtctcaccctaacgcccatgtctcatcgcaaccccatcccctcttactacacactgcctttttaaaattactgtctttttttttttttttttttgagacagggtgtcactccagcccaggctagagtgcagggctgcaatcatggctcactacagcttcaacctcctacctcagcctctcgagtagctgggactacaggcatgccccaccacacccatgcctaatttttgtatttttagtagagatagagttttgccatgttgcccaggctcatctcaaaggcctgagctcaagtgatctgcccatcttggcctcacaaaatgctgggattacaggcatgagccaccatgcccagactcttgttatttttaagaataattttgtgctgggcgtggtggctcacgcctgtaatcccaacactttgggaggccgaggcgggcgggtcacgaggtcaggagatcaagaccacggtgaaaccctgtctctactaaaaatacaaaaaattagctgggcgcagtggcgggtgcctgtagtcccagctactcgggaggctgaggcaggagaatggcgtgaacccaaaaggcggagcttgcagtgagccgagatggcgccactgcactccagcctgggtgacagagcgaaactccatctcaaaaaaaaaaaaaaaaaaaaaagaataattgtataaaatgtatttttttgaaacagagtctcactaggttgccgaggatgatctctaactcctggactcaagcaatcctcctgtctcagccttccaaagtgctgggattacaggtgcgaaccacatcaaccagcagaaaaaataatttattgaggtgggtgcagtggttcatgcctgtaatcccagcattttaggaggccaagacaggaggatcacttgagctcaggagtttgtttatttttttgttttgttttgttttttgtttttgttttttttttttgagtcttgctcttgtcgcccaggctagagtgcagtggcgtgatctcggcttactgcaacctctgcctcctgggttcaagcgattctcctgcctcagcctcctaagtagctgggattacaggcgttcaccaccacaccatactaattgttgtaattttagtagagacggggtttcgccatgttggccaggctggtctcgaactcctgacctcaggtgatctgcccaccttggcctcccagtgctgggattacaagcatgagccattgcgcctgggtgagctcaggagtttgacagcagcctgggcaatgcagcaagaccctgtctctacaaataaataaataaaaataaaataaatacataaagtgaacaattcagtggcatttagtccattcacaacgttgtgcaaaaccgccacttctatctagatccaacgcatttccatcactccaaagtaaaaccccttactcactatgtagtctctccccattctttcctctctccaacccctggcaactaccagtgtctgctttctgtctctatggatttctctattctggatatttcatacaagttgactcatactataggtgacctcttgtgtctggcttttttcatttcacgtaaggtttgcaaggttcgtccactttatagcatggatcagtatttcattccttctcatgggtgaataatgttgtacagcatggatataccaccatttgtttatccattcatctgcagatgggcatttaggctgtctgttcccactttttggctattgtgaatagtcagttgctgcctgttcctcctccctaaaaccctgtgaatgaggacagttgttcatccccattccccagaagacaacattgaggttcatttgtgatacagatggtgacttgaactgaagcccctgccgcccaaatgaaagtgcccttcttacatccttgtctcccaccagccattcacccatcccaagtgtcatgccttccctgggcatctgttaccacattctgggctctgtgccaactgctggccacctggtgtggacagctcaggccaagtcccagactctactatagtctgaagctgcagaggcctggaggctgcagtctcaccctctgggatgggctcctgtccagccaaggagtcccaggatccagggccaggggccaggcataccacatccaagatgcgtatagacaggagtgccctgctcctgccctccctggatcccagtattcctcaatgcacagaggaagatggcccccagcagatggctccagagatctgcacagcaaaaccattgagtggaacgggaacggctgggctgagagggccgtcagaaaacactgaactcagagccctgaagagagtggggcagccagtaagggtttcccatgcaaattggtcactgcacctctcaaatgtaaacacactagaaacagcacttcgctgggaccattccttcctgctgtgtaactttttttttttttttttttttttgagacaagttcttgctctgtcacccaggctgacatgcagtaacaattacggctcacagggctcactgcagcctcaacatcctgtgttcaactgatcctcccacctcagccgcctgagtagctggaactataggcacgcaccaccatgtctagctaattttttgtattttttatagagatggagggtctcaccatgttgctcaggctggcctggaactcctgggctcaagtgatcctcctgccttggcctcccaaagtgctggaattacaggtgtgagccactgaaccttgctgctgtgtaaccttgagccaaaccttctctgagccatctctgcctaaaagcagggttcagggatctagaattccagattctagggtgggaggagtgggttgtccttgcagagcccctcctgttaaagactacatccactcaagctgtctctttgtgtaagatggtgtgactatgaccactacgcggaccactgccttcctggcctttcacgaaaccaccttctgccacacattagcctgttaatgggaccatcctcagagggtttctgacattccatgtggggacgaacagtcacaataatcactactggctgggcactgtggtgcatgcctgtaatcccagtgctttgggagatcaaggtgggaggattgcttgagcccaagagtttgagaccagcctgggcaacatagtaagactccatctctacaaaaaattttaaaatctacccaggcatggtagcacatacctgtgctacaagtctcagctacttgaaaagctgatgcaggaggatcacttgaccccaggagttcgaggctgcagtgagatgtgattgcaccactgcactctagcctgaatgacaagactgagaccctgtctctaaaaaaaaaaaaagtcactactgcctctcagactccctttcacacatgacagaggcctgacaaatttgcactgaatgaataaatgaacgaacgaacaatctgtcactcatttcccaacttctagcctctctcttctagtctatttacctacacagctgccacgtgaaccttcagatcctgctgctcctgcaagctgtgtgttcagacaaattgctgaacttagctgagccttcaattcctcaactacaaacagggactctacttgggtaattaggaagattgaaagaaagcataagcacagcatctcaagggctaaggaggagtccaggaaaagctgttgaaggaaagctgtttctccccaccccaccccataacaccccacaccaccctgatcctctaatctctctgttccaaaggctgcaggaaagagcccagcccctgggctggcccctggctatatgtaaatgtttatgccaagcccagcctcctaaggacaagttatttgctttgcttgtaattaattgcagaaggcctgcctgggtaataaactctgccgaagaaatataaacagtttgcacagagcttcaaatccattgtgaggccaagagaaagggtctgctaggaatggaatgttctccccagtcttcctctaagctggaggcagagagatcactgaaggtcagaactgagaggacccttggaaatcatttgaaaaatagcacctggcatcatgaccttgttccaggcccggctgagcacttgctttatatggtacagctattttcccattctaaagatgaagaaactgaagctgaatgaaagtggcagggaactttccccaactagaaggcagctgggctgaaagttgaatctggctggactttagagaaaaagaaagacagccattcattcaacaaaaatatcccgtgtcccccgtgccagacactggtacctggtgacacagctcctgcagcacttgcattccagcagggagaggcatatttcagatgttgaggactaaaatctgatttttattttttgaggcggagtctcgctctgtcgcccagtggcgcgatctcggcttaccgcaacctccgcctcccaggttcaagcaattctgcctcagcctcccaagtagctgggattacaagcgcctgccaccacgcctggctaattttttggtatttttagtagagacagggtttcaccatgttggccaggctggttttgaactcttgacctcaagtgatccgtccgcctaggcctcccaaagtgctgggattacaggggtgacccaccatgcctggccatgtctgatttttttttttaccttgcccaaattcctgtctaaggggtctggggagtcatcttctacaaaccatgaattctcattgtcaggcctctgagcccaagctaagacatcacagcccccgtgacctgcacgtatacatccagatggcctgaagtaactgaagaatgacaaaagaagtgaaaatggcctgttcctgccttaactgatgcctttatcttgtgaaattccttctcctggctcatcctggctcaaaagctcccccgctgaacaccttgtgacccccacccctgcccgccagagaacaacccccttttgactgtaattttcctttacctacgcaaatcttataaaacggccccacccctatccccctccactgactctcttttcggactcagcccgcctgcacccaggtgaaataaacagccttgttgctcacacaaagcctgtttggtggtctcttcacacggactcgagtgaaactcatcagttgggttttatgtaaccctacatgtcgtgacttactttccagtctgactctggcataacattactgtaaggcttctgagctcaagcccgcaggtatacatccggatggcctgaggcaactgaagaaccacaaaagaagtgaaaatggccggttcctgccttaactgatgacattaccttgtgacattccttctcctggacaataagtctccggagctccccactgagcaccttttgacccccgcccctacccgcaagagaacaaccccctttaactgtaattttccactacctacccaaaatcctgtaaaactgccccacccctatctctctctctttgctgattcctttttcagactcagtctacctgcacccaggtgattaaaaagctttattgttcacacaaagcctgtttggtggtctcttcacagggatgtgtgtgacaattgcgagataaggaagaaaatcagaatattttatcccaaaacgtgtttctctgccatatcttgaaatggccctgcaaagccatccttagtgggggaaaatctgcgtctgtaaacatagctagatctttttcttcgaggccctcccaatcctgatgagaatgactaaaagtctagcaccttttaaaggtctgaataggaaacatttgtcatctattttctctaagggcagccaccattagacttcaaaagaactttcgtctccacaatcttttatcttaacctgaacatttcctttctaaggatcccaagtctttagacaaactcaaccacctgtcaaccagaaaatgtttaagtttacctatagctggccaggcgcggtggctcacgcctgtaatcccagcactttgggaggccgaggcaggctgatcatgaggtcaggagttcgagaccagcctggccaatatggtgaaaccccgtctcaactaaaaatacaaaaattagccaggtgtggtcaggcgcacctgtagtcccagctactcaggaggctgaggcaggagaatcacttgaacccgggaggcggaggttgcagtaagctgagatcgcgccactgcactctggcctgggcgacagagtgagactccatctcaaaaaaaaaaatgtacctatagcctggaagctccccccaacccctgcccaccgctttgagttgtcccacctttctgaaccaaaccaatgtattccttaaatgtatttgattgatgtctcatgcctcctaaaatatataaaaccaagttgtaccccgaccaccttgggcacatgttctcaagacctcctgagggctgtgtcacaggccacggtcactcatatttggctcagaataaatatcttcaaatattttacagagtttgactcaacaacgctcaccaaattgattacagcaggtgctaagtgctctgaagaaaaaaacaaagccacttgtcaagaagggcagagccacagttgtgggtggccattcaagctctgcagggcagaaaccatacagtaagtgctctggcaggagcacacagtaggtgtgttgtaagcaggtttccagctaaaacttaacactgttttctttgggcccagtgcagcttcttgccaaccagttcagggtgtattgaaggcattgtgccagggctggggaatagaatgattggtgaacaaaaatcagtccttgccaccacggagcccacacccaactgggggcacagacaaacggggaagtgtaaaagagaagttgatgagggtcatggggcaggagagggacaatcagcatgtattgagcacctactgtgtaccaggcactgtgttaagccatgcattatctcatttaagccttaccacaaccctatgggggtgaggagaggattttattacccccattttaaagatgacaaaaccaaggttcagaaagattatgtaaccgtctctaggtcacaggcataacaagcagtaggggtgggatctgaaacctagccggacatcatgtttgttcttcgaagccctccccacagccacctgtcttagggaagcacagaaggcaagacattgctgccaacaaactccgcttccctgactctgcagagggatgcaccgcaccctgccagcctggcttcctttctgagcaggaaaggtcagctcggcctgccctggcagctcccctcaggcaccagaccagccagactcctgacccagtcccaggagcaggaaaggcctgtccagacttctactctgccccactcccacagaaggtcccatcccaggccgggcgcggtggctcacgcttgtaatcccagcactttgggaggcccaggtgggcagaccacaaggtcagaagttcaagaccagcctgaccaacatggtgaaacctcatctatactaaaaatacaaaaattagctgggcgtggtggcatgtgcctattatcccagctactcaaggcaggagagttgcttgaacccgggctgagatagcaccactgcactccagcctgggtgacagggcaagactccgtctcaaacaaaaaaaaaaaaaaaaaaaaggccccatcccggttacaacagccccttcccaggcaagccgtgctccacagtttataaccactttcaccctcttgattcgtctgaccacctcaccccagcagcttgtatcccagagcctaataccaggcctggcacacagcaggttaatttgacagacagcaggacagactatcccaatgaaaggcatgggctcccctgagccatctccatccagctttcatcagcatttcctgagctcccaggacaagcctggggctagaccaggcagtttcacctatggttcattattttaacctttccaggaaggtcttatctccattttgcagaagaggaagattgaagtcagagaagcctttccagtctctaatttacatggcaagtgaagctgcaggttcagcctgccccagaactggctcccctggatgcctttcaggtgttgcttctgtagggagggctctaacctatgacagatctctgctgtgggatgagagccccctgaggacatgcagcagatgtggcaccaacatcctagcccaaacgaaaacttgccacagcagggcagagctgggcttgggcgcctaaagcttacagagcttggaaggttttttttttgtttgtttgtttgttttaaaaaaaaaagagtacaaaaataatttccttttgcaaatttcacaaaacccctgagcacatggacacattgctaggccttggaaagggccctggagcgtgaagggctggaagctgaagctgcatcagcctcatggtgaatccgcctcggggctggaggaagggcccagaggcgatctgagcaccacccgccttcacaaaggccctgcctccagcccaacagacagatgaggctccggaagacattccttcttcttgatgggagtcccgctgctacttaaccctccctgcagtaggtccaagtctgtctgtctttctcttgccatggtttcagaagaagcagatcttggccggacgtggtagctcacacctgtaatcccagcactttgggaggctgagacgggaggattgctcgagcccaggagttcaagaccagcctgggcaatgtagcaaaaccacatctgtacaaaaaatttaaaaattagcctgggatggtggcgaacacctgtggtcccagctactcaggaggctgaggaggaaagattgtgtgagcccaggaagtcaaggctatagtgagctatgatcacactactgcactccaggctgggcaacagagccaggccctgtccctgtctcaaaaaaaaaagaagcagagctcagctgagtctcggacctgcctgcggaggtctgctgctcacaagggcagcactgccagatttctttgtgatcctggggcacaaccccaagaggagccttccatgcctgggctggaatcctgggcctggaatcctgggctggcaagggctgccctattaagaaccccatcctcaaacatttgtagggtatgatacagtttaccaaatgttcccacatcccacatccacatcccgtttggcccacacgacagtcctggaggtgagcagggcaagctttattgtcccccttttatagacggggacaaaacatgagacttgctgtgcacctattgcatactaaagatgccaaggggctttccacacgtgacaactcacagataccctgtgagaaaccaaggctcactcagtgtctggggctgggcctgagaatgagcctgcagccctgctctcccatctcgcagcccgtgcctctgccctgtctcatctcagtctggcatggacagctcagaaggcagtgggcaggcacgctgagactcagtaggttgaggaagaagaggcctccagctaccaaggcggaagagtagctgagggctcaatatatttaatagaaatcaaaaaagtgagaatcaaccgtgccctctctggatgtgtctgaggaagagcacatggcccttgggagcctgaaacctgtttgaaagcagtcaccttacagactcagggcctgatgtcctccccacaccctgccaagctgcagatggccccacccctacctcccactgtccacatgctaggccttccagacccttctgctgactcctctcagcgcccaaggcagccacccagtgcttgccctggcctgttcaagtcctactcctgtccttcactaatgcttgcttaattcgtggatatacctactctacgaatctttatgagaagatactgtagggtgacccacagtcctgatttgcccaggagtgagctgaggggtttcctgagatgcgagactgagactgtcccaggaaaattgggatggctgacgaccctcatgtactgcatgcctggtccctgggctgggtgccaaggacacatttatctaccaaacatagtcactgccctcaagaaacttccagtcggagagtggctgccactcaatgagaaaccactgtcaaaggcacctgttcagcccctcacacacatgatccatcaccaccctatgaggggaatattatcacctccgtggtatgcataagaaaactagggctcagaaaggtggcacaatgtgcccagagtcagagttacaagtgacctgctaagatttgaacttgatccaatgaaacagaaaaagggcagtttccagcatgaacattatggagatagaaaaagatagacatgttttatttaattcattttgtagctccagtgtctggcatgttctaggtattcaggaaatgcgtgaagggagagagggagatctaagccttatttaattatctccaggctaggagattccatccctcaattcaaaagccatacatttcccttttcaaagtcagtttcagaccaggcacagtggctcacacctataatcccaacactatgggaggctgaggcagaaggatctcttgagcccaggagtttgagaccagcctgagcaacacagtgagaccccatctccacaaaaaatcttcgaggctgcagtgagctatgatcgtgccactgcactccagtctggatgacacagcaagatcctatctcaaaggaaaaacagaaaaggaaaaaaaaagttttgactgttttccttcagcacgaggaccaggaaggaagtaagaagagggaaagggtgctttttctttaagtcagcagctcggggctcacttcctccagggaatcttccctgactcactccctaacccaagtctggccccacactgtgccaggccccagtcaggagctgggagtccaagagacaagagatacacatttgccctcgagcagagagggaactgacttgttagcagtcaactacaatgtaaagtgccatccgggaagcctgcacagtgctaagggagcctggaagaggccattcactctacctgggcagggagcagtcaagggagggcttcatgtctacagcaggtgccctgtgcagttgttcaatgaatttcattgaaatgtctttttttttttttttttttttttttttttttgagacggagattcactcctgttgcccaggctggagtgcaatggtgctcaagtgatccgcctgcctcggcctcccaaagtgctgggattaagggtgtgagccaccgcacccaggctaaaatgtttttaagttcaacctgaaaatataaggaatatttcaccagaggaagaagggcattccagctaaagagatcggcttgagcaaaggcacagaggcgtgaaaagtacaaagactgttgaggaagatccaaaaaagtcaatgcagccaggttgttagcagtgtggtggggacagctgggaaaggagtgtggaagggacattagagacagatcctgaagggcctccagtgccacctagagaatggggactttcccataggacatggggagcagtggatcaggccttaggctgggaagaatgaccagatgtgaatttcagaataacaggatggcttggagggttgggactgagcagaaagacagcaactagaagacaattgtaatgatccaggccaggagtggggcttgacctgagccagtggcggtagaatgaggagaacagtactttgggagccatgtctctatcaccattcagtttggatcccctgaactggggctgcccacaggaaggcatggttttctcttctccagggagctcagcacacccccatccaggtctacactcaaatggaagttgaggccagagcctcagtgtacagaaactcaggtctttctgtacactgggtcagggctcagtgtggggccaggtcatggttctttgaaagttctccctactacaaagtttactctgcaaatggtgaacatcagaggtggctgaattgtttcaagtatgcacagtgaatcactgctgtactgaatcgctgctgtggaacagtcagcgcagggagaaacgacaacgcatattaatcacttgattatgatgtgtaatcatttttgtcatttttagaatgtcaaaaaaatctgttgcaaaaaaaaatctccttattgagttttaaaacgtctgtaggtttctcccagtaccctggggcaatagagacccatcataacatcaaccagtgatgagccctgctaatgtgctgggtgctttaattagcacagctgtaaccgagaaaggatgaacacattatctccagaggctggaaaacttgcctacagacatgcaattactggtaaaggggaggggagaaccccagcctgctgcctcctctccaccactccacgtggcctcagtgtgcccaaagatagccctccaatctgtagagaccagcgcacatggcccctggctgccagccccaaagcctggagctgtttctcctaagacatagtttctcaactgtctcatgcccatgggctcctctgggaagagccatcagatctctgcagtgtctcctgggctagagggaagctttcctctccataccctcaggacagtagaccctggtttccaatggcaggtttgctgagcccagtgtctcctgatatacccaccccattttctttctccaggcagaaacacttactgtgatgccctgtggcagaactttcacttttcaccctagtttttttgtcctcaagcagtctgcattcccaagacactccttactgacagcagatgaaaccagtgcctgacactatgccggcacatagtaggtttctcaagtctgctgaaggaagtcagtcctggatgaaaacacatgtcacagagatactgccaggaagagtactacctctggctcacacaaacgcactttccaaccaggtcgtgagtccctacttctggggagctgcctctgatccttaacctctggccctgttttgtccctgctataaacagatgcccactacccctcttctggcagctgttgagatcatctatttcctctctcccaatacatctgagcagcatgagggcagagacttgtctgggtcctcttcatatttcaggtgcccagcacagggcccggggtgtggcacagagagaaagctttgttccttggaacctcctcaggagggcagcgatggcctaacagaaacgatataagctaaccctgaaaactcctagcccgaggcccggggagatagtgttccatgtcatgaggtttcttgccacccagaacctgggaaggccaggccctcaacttcggagaaagggcagcctcaggcgggaggcagagcagagctgctccataaatccccttcccactcggagagagacacaccactgggacaggcccggccacttcgggacatgccttgagtggagggagaaatgtttgtggaattgaatggaacaaactgtaaaatgctagctatttgttcctctggctgcagaggccagttgccctctgggggcagtttgcaggcaaattatctcaggacgaggcctgtttcctctaatgaggcttccccgctttgcagctctgctcccaagagagttggaggggacaatgctcagagccaaccccagaggcctgcactgaggaagcatacatggctcaccattctacacagtgtgggcggcactaccactatccaaggcagggggatgctccccacgaccttctgggtgcaggaattctgagcaatgcagcacctcctccaaggcccctctggggaaacagggaggaaaggagcagggaggcatgctcagttatgtaaccagctgccttggagtcagagtccctggcatatctcagcccagcactacgaggagaggctgtgggggctgggggtctttcttctcttttgctgcctcctccagacctggcagaccctgtagcaggcgctgctttccaagtgcctgagctccaagcaggcacctcctacttggggttgggaaccaggaaagctgttgttttctgagtgtgtgaaacagtggcctgctggctcccttggcagaaagccaggctcggggctctgcacaggggtgagggttaagaaagaggagcctggggccaggatgccaagggacttccctccacaaccgcccccagcttcctgctccccaatctctccccacttcctcctagagaatctgccgtgggtgaggggccagaggggagtggcgccagcagccccagcaccacactgctgctgctggccctgggcaatctcacttcccttcctgccttccttggagcttctccgctggccggcacagcccccactccctgtgcccccacccccgcgcactcagctgtgtacactaccctggaccatggaaaagagggatgaaagaggaggaaggggacatgggagagggaaggagctgagatccaccctcagtcttgaatgatgatggcttttttgttgttgttgttgagacagagtctcactctgtcactcaggctggagtacaatagtaagatctcagctcactgcaaccttcacctcccgggtccaagcaatcctcccacctcagcctccctggtagctgggattacaggtgtgtgccaccacacctggctaatttttgtatttttagtagagacgaggtttcaccatgttggccaggctggtttcgaactcgtgacctcaggtcatctgcccacctcagcctcccaagaggctgggattacaggcgtcagccaccatgcctggccgacaatggctttttatgaagcccttaccctctctgcccacagaaaccccattaatattattatacctatttcccaaaggagaaaactgaggccggagagtttaagacccaagctgaaggtcatggagctagcaagtgagcagtagagcagagtctgcctaactctgaattccaaactccaaacctcctgcctctagctctgggagcccctcctccacactctctgagggtgctacttgggcaattcctacacagatggaaatgacactgcccagccctggggagggagccctcggccttaaagagtccctcgctgaggactagtttgggaaccacaggacagtcccaaagacaggaccaaggctcaagggcaggacatgcttggggagccaggtgggcagactgctgctcccaactgtcttcccttcccacccagtctaggctggctcagactcctacactgtctgccacttccagaaggcagggctgccagaggccaagctgtcccgccagaatcacactgctgctcacgccctctcccctcctaacgagagaaggaaagggtcctagggaggagcctctaggccaaagcctctcctacttcctgcttgacacatagagaaactgaggcccaatgaggaaaagcagcttgcctatggcagcacagggacagtgaagaagtgagatccctgtctcccaggccagagccccttccctccattcaccccacttgggtgctctcctcagatggcacctttgggcatctgcccacttctctccctctttctcaccttccctctgcacttcctgcttccctctccgagccctgctctgcagacccatttctgagcctcccctgttacatctcctcccagcctcaccacctcaccccccttccctctgctctgggccaaggagcaatgcttgggtggtttaattagctgattatgaccgcagcctgctggatgcagtgcccagaattctgtccccagtaattaggtgggttctgagtacttgcccagtggggagccgatggggagctctgtgctctgccagccaagggaggctgtccagctgaataaagagctccttgatcaccggtgggtcatcggaaaccatggtcccctcctcaggccgggtcaaaccacactggagggactgcagccagacccagatgtccatcctaaggagggactccctactctcccatgccactgcccacacccgggaaaggctcagtacatgactgaggatgaggatgaagaatggagcgcgccctccagaggccgggagagaatggctccgtggccggggcacctatttaggaagtaggattggaccaagtagacagagaggcgcagcaggaacaaaggccctgaggcgggaatgagccgccaatccccttcccagagagctctggttgtcagaaaatacagtcttcaagcaaggtaaagctgaacatccagtgacctctgccctttaggtcacaaagaataatctaattcctatggctctgggctactttgagatattttgaaatcagcaatgatgtcctatggtcctcaccaaccacactgcccaccccctagagtatctcctcccagcgaaatgccttggctgaacaaatatttatggagctcagcggcatgccaggtctgcgcaggtgctggggacaagcagatccagggtgctcttgaaaagttcttgacctcacaagatgacatcatcacgagtgtgcaaataaccaggacctatgcagggagggagggatgagtgctgagagagagagattacaagaaggtcacaaagcgctgggaatccagtgagggcttcccagaggaagaggtgtatgtgatccaggccttgaaggatgggacagctgttgtatgtggtcaagtcagcaatcaggtactgaaagccagcaataatacaggcttgtaatgaggccttgggaggctcaaaaaaatgaatcaaacagggtccttccctgggggagctcacagctgggttagggaggcagggccggtgagacgtcatataagcgataagaaccgcataaaactgaccttgcacagggactttctttgctttatcttacttaattttaactcagtcctcatgacaacctactaccctattttacagataagggagccacagcagagaaagggttaagtaatcagggaagccacccagctggtaagtgtcagagctgggactggaaaccaggaaatctggttcttccaagagcctaaccgctatgctaatctgctaataatccatgctaatcagatcaccgaagggcctgcaggtgcccagaggaggccccagagcagcagagaaggcttcctggaggaagtgttcctgacctgagtatttttttttttttaagacagagtcttgctctgtccctctgtcgcccaggctggagtgcagtggcgtgatctcggctcactgcaagctccgcctcccgggttcatgctattctcctgcctcagcctccggagtagctgggactacaggcgcccgccaccacgcccagctaatttttcatatttttagtagagacaaggtttcaccgtgttagccaggatggtctcgaactcctgacctcaagtgatccacccgcctcggcctcccaaagtgctgtgattacaggcatgagccactgccctggacctgctacagatgctttatgtccctggaggtgaacatgactgctgttcaaggacctgataccatgggagacagcactaccctttcgagcagtagccaattccttcctggccgccagcacccaacacccatccccacccaggacacactccctggtggtctcagtcccactggcctgtagcagaggcctgagactttggccgcccagaagaaaggtcactcctggacctgctagcaaaagggcctctcacctgatttgacttcacagggaaactaggacccagagagggtgcatgtcatgcccaaggtcacacagcaataagtaagcagtagagcatgcctctgggaccattctgagatggtgagccacagcagtctactccccacccctcccctggccctatgccaaaacctgtccatgccctttgcacaaggcaggggcaagggtgaagagggaacaaacctagcagaggtttgctcaccctctgtccaaccctctgttctccaaccccctactaggactcaaaccacccctaggatggacgcatcctgcacacgggaaggcagaagagaaggtgcccaggaaccatctgagatgatacctattctaatcccagggctcatgtgggagacaaggccccaacttcaggagcccccagtgtgatgggggaagaaaggaagaaagagttcagtccagttcgacaagcctccctgcaaggctgagggaagggtgtggccgcacaaggaccaagtgagttggttgtgggctacaggcccagggccagcatgaaagggacctcctgcctcatccaggcccatacacgggctgttgaaccactgaatggttcagacattgcatcctgcctcccgctgactcgacatcagtcacagtgcttccagtgctgaaggccctttagaccagcagatccctctccaggtgcagggaggcagaagctcaactgtggcctcagccaggtgccgcccagccccaggcagaggaaaagctgttcagttcctgcggtgaccttagtcacacacaattctggggacctgtcttgtccaactcccaggggcttcatctggcaccaggtctcctgggaaggaacaagcagttcttctgaagtggggctaaagatggggccagtcccaggaaggaggaggcgcgtctcccgagagatgaccctgccagggccccttagggaaggcgggagggggctgggacaacagagtcctttgttaccctctcaaaagcagccaccctgtcctgccaaccccctctgttctccaaccccctactaggactcaagccacccctgggacaggaaccatcctgtccacataggagggaagaacacagggtgcccagggaccatctgagacgatacctgttctaatcccagggctcacatgggagacaaggccccaacctcaggagcccccggtgtgatggaggagacatccttccttcagaagcctccagtctgaggagggagacatggctcccacctgcaaaagccaatcagatgagggagccccaggcctcccgctcaggcgccccatgctaataggagtggtataaccctgtccctcaggacttcccagtctgatggaggagtcaggaccccacccctctcttttgagaacttgcctaatgtgggaaatatcgctttcagtcttacgattcactaatgggaaaggcctaatttcagcacttagggagtccctggaccgatagcagaggcaagaagggaaaaaaattttcagtccagttcagcaaacctctgccaggcatctcctggggaagcagacccagcgtgggtaaggaagcatcaactgagaaacagaaatagccctgaaccacaagctgcttaccaaatggggagctcactcagcctgaggtatgaatgaataagaaagtaccttgaaaccaccccctccagcatccaagacctgctggccaaggctgtcccttcctccacagcctcacccctcacactcccacacctgcagccagtatctgcaccttggcctaggctctttcttctgtctagaacaccttactcctgcctaagtctttctcatactccagcacccagctccggggtcacctcttcaaagaagccttcctccaagtcccccacctgagtcagaagcccctcctttctggagccagcacattacatgtcttccccaggaccagctcacacttcacaacccctcagcctgagcctgaaaggagagcacagggcagtggtcttctgcctctggacataaggcagagggagggggtggatgagataaaacccctaggttcccatacccagtcttcactgcctgccgccatactgcttgctcccagcccagggcctcacgcccttcctccaagaggctcaagccttgctccaggcatgtagaaaagcagggtcccctcccactcctctctgcccgctgtagcctagttttgccctcaccactccaccaaaacccatgccaccagctaatgccttctggctgaatctgaggggtctcgctccagctcatcctctgtgggtctgtccctgcttctttggctccaagaatatggccttccgtcagtttcctccctcttctctccatacccaggcactggtgctctccaaggccctggctgtccctaatcatcctctcttcatactctatacctcctccctatgcgatgtcattcatccacatttccaaagccctgcctcgcaccttgattcttaccccaggatccagacccttctatgcagaagccccactacgtccagcctataacagactgccctggctccctcaccaagctgctcccagccatgcaggcctcagccagatggtaggcgcgggcactctggcagtagcggagcatggctgtgtagaggccaggacctcacttggggtgtgctgactcccagcctgctgttctactgccaccaacccaaagtgtcagaagccctggaagtggcaagcccacaactcaggacctctggacccatgccaacgggaggcgtcagcctcaggcaaggaggcccaaacttggaaggaagagagcagtggagaagtctgaagcccagaggccggcctggaatcagggatcagagacagtgggccagacttgatgctaccactcccagcggccccatgagcagccctggccaaagccacaggacttccccatgttccagccaagatgggtcacacagggcttaaccaccaagagaaatgacagccaaagttcacagagagctggtgattacatgtcctcatcaccctcctttctctgaaaaaagaggagttcatctgcaggaaaggaaattccattccctaccactgcctctcaggaagtccctcctgttgtctaaatctgatccttcatgttgtctgttgagtaagtggaaacggcaaggcccagaaaggacgcacaacttgaggctgggagctgctggggaggccaactgtgagccagacaaggccccctctcttgggcaaaagcgtcgagtagcagagagggctttgtgggtcaataggcctgggttcttatgcttgctggctgaatggcagtgaacaaatacttaatctcttctagtctgtttcctcatctgcaaaatggggacaacaatgactacactactagattacagttgaattcattgagattatgcgtgtaattctaacacacaccagatacctggcaaaggtccaatcgaccagcaaggttgatggactccacctcctattcacattcatatttctcaactctatcctctctgcagcctaagttcagagctcacagccttagttctcaggtttctccccagcctcctcactggtcttcctgcttctaggcctgctcttcccatccaccctacttggcgctgccaaagacatctctctgaaatgaaaacatctgcttccagccctctgctgcctcacactcttctctgaatcaccatccacttcaggagaaaatgctctctccttagcctgacattcccagactgctggtgaccggtctgtgtttacctcttaaggctcactatcatccccagcccaggccccaggctgcacgccttgcttcctgcctccaagccactgcacattctgcacccttggccagaaatatcattcccaatcccgcccccttggcctattcatccttccagatgaagctcagtagttccaacgccacctcctttccaggagagcttcctgtaccatgctccctgcctgggcctgggttggggacttctccttaagcctcccacaacacatgtcatcctgcgttatgaccacctgctctgctctaaatccctggaggacagagtagactccttccttgctgaatccccaggccctgggcactcagaaggcactcatcaacatttgttgaatgaatatatgattgttcccagagcaccttgcagcaaccatcatactcctgccctgtgattagtcctgtccaggtattttttttttttattttttcagacagggtctcactctctcatccaggctggagtgcagtggcatgatcatggctcactgcagccttaacctccagggctcaagtgatcctcccacttcagcctccagagtagttaggactataggcatgtgccaccacactcagctaatttttgtgttttttgtagagatggtatgttgcccagactggtctcgaactcctgagctcaagcaatctgcccatctcagccttccaaagttctaggattacaggcgtgaaccaccgcgcacagccctgtccaggtatttaacacctctttcccccttgaccctgggagttcctagagggcaatgacagtttgtgataaattttcattgtcactttcacatgggggtgcaattccagatggagggatggttgcgatgattcctgatgttcagtttttgatatctgcagattcctcttctaagtcataggtactcatgccttacggaaaaagacaaggtacagcccattactgattttgcccttcttttccaaattacttagccaactgtccggaaagggacagaaaggcctcatggggctgcaggagagtctgaaggggaggtctgggccaccatcaggtggatttagccgggccttggctccaggcttcaggcagtgcctcttcccctgcccagtgaagtcagtaagtacaagggaagccctaaaatgtaagtattgatagctccagtttacagatgggaaactaacgtccggaaaagtaaaggcaattgcccaatgtcccaaaggtccaccagtgagtttgaggcagggcagggggagccatggaaaataccttggcctcagagacagggtctccaacaggtgcctggaagcccatggtgtccacatcttcctgacaatcatgtcagcaggacaacaatgacacttatcccccaagtcacagagaggtacagagagacccaagagaggctgagtcactccgatcacaaggcagcctaggaaggacaatggagtggagaatggctccgactccctgctatgccctgcaggaagaaaagcctgacctcatgggtcaagagggtcttaatttcagggcagatggatgtggctggggaaggagtcacataccttcctactgaggacagaggcctaggtcacagtgctggccagccagctgcaatggggactagccatcaaggttcatgcagacacagcatgatcttctgccgtcccccccaaagcctgggcctccagcacagagcagggctcccctccctggcccatgaggggcctggcagtgccctagggccatccacagagacatgaccaagtggactccagcctccgccctgcctctggccccttttgaccttaggcaaatcacatggcctctagccctctggttcctctgctagaaaacaggaagaggaaaattaacctcctggaagagctgtcaggaggatggctggaaagtagtttctaaacattaagagcctgagttgcctctgagcctgtttcctcctctagaaaatggaaataatctctgcaagccctttctcacactgtggagagagagtcttagatggcagtgggtgagaaatagctttgtcagtggccctgaaaggtggtgcccaccggggtggtgtctctctagtctgttagctccttcaggggaggagtgggccttgcgcatctttgatcccccacactacgcctagtatacagcaagagcttaataataaatggaaacgaggagaggggaggggaggaaaggaaggaggcagaagtcggacacaagaatagaagagaaagacagaaaacaatgagaaagagggggagcccagggagaggctgctgtgcccacttagggggtggggagggcaacggggaaaatagggtggcaacgctgagcccctgaccagcgctggtcctgtctgaagggctgcccccaggggctgtcctgctccagccccctcctccttttgtcccagtttcccctttcagaggcagagactgtttctgagtatttcaggacaggttctaggagaacgggaggggttctcccagccctaggttcaaaacagcccctggccagccactcctcaggaggtcagagggaaagggaacagagtagatggatgggatctatttggatgaaatgcgatctgttttccccaggctgggggtggcggggggcgctctaccctgtgtgatgtgtgtgtttccacttctggccatgtggggcctgaagcgtgtgtgtcagcgggccttgggctagcagctcgtgcctgtggggtgccagtctttgagggcatcagtctgattgtgtctgtgggggtcagtgttggtgtggccttgcgctccgctgtgttggtgagacatgccagcacaagtgtgtgtgccagtgagggtgatgtgtgtgccagcaagagtgtttgctacagcgagtgcaggtgacagtgtgcgtatcagtgtatgcccacacgtgtgtgccagcacgagggtgtgctagaattggtgtgtgttggattgtgagctgtgcatgccaacaaggctgtcagcaagaatgtgttgaccgaggcgtgtatgacggcgtgccactgcgtgtgatgagcgtgtgctagcggttgccagtgtgtgcgccagcatgcctgtgccacgggttagtgtgcccgtgcgtgtattgtgtgtcaacctgcccccgtgcgtctctgcggctgccggccaatgctgggtgtcagcgagctgtgtgtccgggccaggagctgcggcccacatggggcggcccggccctcgccctttgggtccccccgcccacggccctgccggggagaccacacaggagacctcgggtggaggagagctggtactagatcccgcggtggccgcgaacgcagaaccaggacgcaatcggagcccccgcccgtgtcctcgccgaggtcgcccccacgcgccccccgccgggcggccgccctgcactcaccgggtccctttgtcgcccatggtccgcgacggtcgcagggaggtccgcggcgtcagcgcccaggctggaaaatccccagccagcaggaggagcgcgggccagcccgctcccggctccctgctccgcctcctccgctctcccggccgccgccgccgcccccgcccccggtccccgcccgccgcccgccgcgtcgagcagcgcagcgcccgggccgcggccaggggcgtggaaccgcgcggggtgt

SEQ ID NO: 645 - DNA, 91710 bp, Homo sapiens; identical to SEQ ID NO: 644

SEQ ID NO: 646 - DNA, 95 bp, Homo sapiens
tgaatccgcctcggggctggaggaagggcccagaggcgatctgagcaccacccgccttcacaaaggccctgcctccagcccaacagacagatgag

SEQ ID NO: 647 - DNA, 60128 bp, Homo sapiens
aggggcgtggccacgtcgaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgaggtaggtacgggagaaagctgctgggggctgggcctgagaggacacggcctggtaggtaatagaaggctccgctcggagcagtcgagggggagatcggcaccgtcagaacagaccccaccggagcctccttccttttggagtagaatgccggaggtggaggtgaaaacgcagtggactgagggcacgtgcgaatcctgccgcatccagcttcaaagcgaagaaggctgcgggaccccagcggaacaaagagtttggaagttgcaatgttgtctgtttgtaactcagctcagccacctgctagttgtttgaccttgggcaaatcgtttgtatggaaaatgctgatgttaatgctgccttacgtggttctgggggaattcaaagtatttgttaagtaactgcttccaaataagcgctcaacaaatggcaggtgctatgccaatagcacagagatctgaaagcctttagccaatatcatagagatctaaattatgccaataacatagagatctaaaagcctttttctgcatgtttgcggcttttccttgtattaaaaaaactatattgcagttctaggttggaaatctgtatgtgttttcactgtggtgcccgcaatacctagataagtgctatgtcatgggctctttcattcatgtaacaagtatttttttggctaagctctgagtgcagcaaatatacagacacaaaaatctcaaccctcatgaagcttaagttctggcatgggatgaaggtgggggagtcagacaataaagacaaactgttaggtggagatgtggtcagtactaaaaaaaataataaagcaactgggtgtagtgaatattgggggtggggattggtgcaatttaacttgaacactggagtctcactgaggagatgtcactttggtcaagacttgaaggaatctcaaaagctagaggttctatatctgaggagagtacaaaggctgagggtgagagctaggggaggaagttgcacctggcatgtccaaggccattgtcactggagcagaattaactagaagagtaaaaggatattatgtaaaaatggtgaagatgcagattgtaaggacttagcttttactctagttgtaatcaaaagtcattggaaggttttgagcaaaggaaagacataatctgacttgggtttaaatggggtcactttggctgtagtgttgaatacactaaaggcagcaaaggatggaagcaagggacaccagttaagaggttattgaaataattcagctcaaaagtgagttgagccaggtggaaaacagtggagatgatgataagtggttgatttctgtatatattttgaaggtagaaccagtaggacttgctgactgactgaggggtatgagaagggcatcaaagttggcactaagatttttggcttgggtaactgaagaatgggattgccatttatttgagaaagaggaagactgtgggaggagcaggtctgggaggaagtgggggcagtcttagctcaatttgggatatttaactgagatagtgtaattcactatttttaagagcaagagaagaaagttcagatgaattcaacaaacagggcataatagtgttatatctcgtattagatcatgggcatacaaaaataaatggcatagcccttacctttacagagttcacacaatatagagcaggtcctggtataacatcgtttcgttataatgttgatgagaaaaaaaatcaattcattgcggggctgctgtgtatgtggagttttcatgttttccgcatgtctgcatgggtttccttaggtactccagtttccttctacatcccaaagatgtgcctgttaattggcgtgtctaaatgatcccagtctgaatgggtgtgaatgtgatgctccctgtgatggagtggtgtcctgtccagggttggttcctctctgagttgctgagatgggctctggccaccctcaaccccgaactagaataagtgagttggaaaatgaatgaaggaatgaatacaaattactgtaaaataaaaatctgtaaaggctgggagcggtggctcacacctgtaatcccagcacttcgggaggctgaggcaacaggattgcttaagctcagcggttcaagaccagcctgggcaacatagtaaggcctgtctctatttaaaaagtttatataaagtgtgtatgataatcatataaatgcatgacaataaacaatgccttatgaaagtgcccagcatgcccactatagtgttactatttgttttttgaactttgtggtggtaggaggtacttcttgaaattttcactctcaaacatttattccttgagttaacccaccaacactatgactgcagtcattcactgattcgccaaaaattgggtaaatgattattttttgttttcattaaatgttcttaagtgtacggatagctcacatttatttcaatatttagtattaaaaatgtttgtttcgagtctttattcagaagtttggtgacgtttttgtgaccagaaatatgccataggaacttaacttttgtttatgtcgatcagcctgtggtaaaattggttttgttacatgtcattttgattaaagtcatagtttccaagaagctgtctccaacgagttttcagtgctcatctagactgaagtcacatataactttcactctatttcaaagattagtgccaatgtgtctctctttttgttttaagtccagaggtaatgtctcttagaaatagtcttctatctaaccattgcagggctctgaattgcagaatacgtaatgggaattacctccaaaacgtttcgggggttttctcagtaggcttgctagaattgggtgtgaggatgcagggaattgtgactagtaaactgtgtttgtttgcttctgcttttagctacttatatgtacaaacttcagttttgaatcatcattgaaacatgggacattagtctcacccacactttgctaattttaatgttttttttttgagacagggtcttgctctgttgcccaggctgcagtgcagtggtgtgatcatggctcactgcagcttcgacccctgaacccaagcaatgctcccacctcagtcttctaagtagccacgaccatgggcgtgtaccaccacgcctggctaatttttcactttttgtagagatgggggtcttcctatgttgcccagggtggtgttgaactcctgggctcaagcacttctcctgactcagcctcccaaagtggtaggattacaggcatgagctaccacatccggcactaattttaaattaaactagatgatgcattcaatggtaggcatagaattacttgttgcctttttgtctactttgccaaatttataacacttttgttcccttcttttctttctgccttaagccctattcatttttctttttttttttttttttaaagaaagaggcagggtcttgctatgttgcccaggctggtatcaaactcctggctcaagaaatcctcccacttcggcctcacaaagtggtgggattacaggtgtgagccaccgcacatagccatgccctattcttatagtactgtctacgatatccttgccaagttgtcttctatcaggcaatactgtagccataaacttgaaaaacagctaacaaagaagcttaggcatataataataataataattatgtgtcagtccactatattcaacccaagaccatgaataatcacctttcggaagacatttacaataatctagtgctataatagtcaatgttggtatgagatttacatttgtttccttcttcacagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacggtgtgtagaatggctgagtctcaacctgtcgtcattcatcctaaatgttgtagataacgtgggtgtggatccatgagagatggcataatgagtacttttcaaaaattggtagtatgagaatctgttctctacctgctttcgtatcacatgacagctatctgaagatgtcctcaggtataattaagaacaagggctataggatttcatttcactgtggtgcagcgaaactctttttatcaatagaaatacattttatacagggggcagtgataagcatagtaaagcaagtattatattgcaatgcttcccaaaagtattatgttaggaacttatttttgagagtatgacaaaaaaagaagtggtctccaaagacatgtaaacctcagaacaattgaatttataccagaaagttctcaataattttaacaaactctggataaataaaagctgaaaaatactcttatgttattcaaatggacctgtggatctcctttaactaatacatgttttgataaatatgctttttaaaaaaaaaggtaaatcagagtatcagtttctaccttcaatctctgacaaaaagaaatactgccattactggcaaaatatcataatttgggattataatgcaatgactattcttattcatctctttggattttttttttttttttaatatgacagggtctccctctatcacccaggttggagtacagtggcctgatttcagctcactgcaacctctgcctcccggttttaagtgattctcccacctcagcctcccaaatagctgggattacaggcgtgcgccgccacgcctgggtaatttttgtatttttagtagagatgggtccttgccatgttggctgtgctggtcttgaactcctgagctcaagtgatccgcccaccttggcatcccaaagtgctgggattacaggcgtaagctaccgcactcagcctcattcatcatattttttcatgttacatgcatcagtagattgctctttttattgctgaataggatttcatttatttattcaccaattgatgaatatttagattcttccagttttgtgctttataaataatgttgctatggacattcttgaacaaggctttttgtagacataattttctctctctctcttttttttttttcttttagagacggagtctcgctctttcggccaggctggagtgcagtggcacgatcttggctcactggaagctctgcctcctgggttcacgccaatctcctgcctcagcctcctgagtagctgggactacaggtgcctgccaccacgcccagctaattttttctattttttagtagagacggggtttcaccgtgttagccaggatggtctcgatctcctgaccttgtgatccacccgcctcagcctcccaaagtgctgggattacaggcgtgagccaccgcgcccagcagtagacataattttcatttcccttggagtggaattgttggaccatagaatagatgtatgtttaactgttgaagaaactggtttaccaaggaggttgtgacattttacatttctaccagcaactcatgagagttcatttgtaccaaatccactccagtatttggtgttgtcgatctttttcgttttagccattctagttttgtggagttgtgtctcattactttgcatttccctggtgactaataatggtgaacgttttttcacatgctttttggccttttgtatatcttcttttgtggtgtatctgtttagatattttgcccagttttcaaattgtgttgtaggggttctttatttacttttcccaggagtatagattcaagtttccctgattcaagtttcaggagcatagattcaagattccctgaatctatgctcctcagtaggggttctttataaagtctctatactagtcttttatcaaatatatgtgttgcaaattttttttccctcacccatggctgtttattttctgggtgtttttttttttttaaactgcttagttttaaattttgatgaagttcaattaattagtatttttcttttatggttagcattttttgtgtcctcttcaggagacttttgcctaccccaaagtgacaaagttactctcttatgttttcttttactagcttcattttagctttttttttttttttttttttttttgagacggagtgttgctcttgttgcccaggctggagcgcaatctcagctcactgcaacctccgcctcccgggttcaagtgattctcctgcctcagcctcctgagtagctgggattacaggcacgcaccaccacgcctggctaattttttgtatttttagtagagatggggtttccccatggccaggctggtcttgaacttctgacctcaggtgatccgcccgcctcggcctcccagagtgctgggattacgggcatgagccactgcgtccagccaagcattattttagcttttatgtttaggtgtatgatttttcttaaatttttccttgtatatggtgtggggttggagtaaacaagtttttttcctctcatatgggttatctttctagttgttctgcctcatttgttagatttttttttttcctttcctcactgaattgcgttggggcccttttcaaaaatcatttgaccacatatgtgtgggttatttctggactctatattctgttccattgatcaaattgtctgtcctttcaccaataaaatacactgttttgattagttttacatagcaagtccagcagagtgagttctacagcttttgttcttttcaaaattgctttagttattcttggtcctttgcctttgcaaacaaagtttgaaatcatcttgtcaatttctagaaaagagcctactgaaaaagaaaaaaaaaaaaaaaggctgggcacggtggctcaagcctgtaatcccagcactttaggaggccgaggcaggcggatcacctgaggtgaggagtttaagaccagcctgaccaacatggagaaaccctgtctcaactaaaaatacaaaattagccgggcgtggtggcgcatgcctgtaatcccagctactcgggaggctgaggtaggagaatcacttgaacctaggaggtggaggttgcagtgagccgagattgtgccattgcactctagcctgggtagcaacagcgaaattccgtctcaaaaaaaaaagaaaaggaaaaagagaaaagaaaagagcctactgggattttgattacattggtttgaatctatagatcaattggtaggattgctgatttttatcagtagtgccttagattttattgttttaccatttctgcagataatctcattatttcacactttaattgccatattagcctcataactgtggtcccttcttctaatgcctggctatccttataaagttgcttgattaatctttctgaaatcttatatttaagatgccctccaattaaagaaccaatagtggctggagtagatggaatccaaagtctttaaatttacatttaaagcatgtgcttcttacttctccaggggtctccatttgctctcggtactgactttatgttatagcttagggttcactcaccttcctttggatgagctcttccaccttcgtaattttattcaatattagtttccctctgtcttgaaaaaactgtttttctttcaaattccatggttctttcagagtctcaccttctgaggctgcttctgtgatacctccttttgacttaaagcctttactatccattcttggcaactgtaatttagtatcctgctttgtattactagttcatttttcatttgtgtactttgtttttcttattagagtataaattcccatgtgtcagggactaattatttttagatcaaacataactgcttatccaatttttattaatcattatccaaattctggcttattacctaattcttcccctctattctaactggtcagtcttaatttggtcttagccctctgcctttcccagctttttatagtcatattttaccctttttttgaggtattctccaaattatttatagtattattcttctctgaccaatgttacccatggaagttttttttgaactttaaaattcttatttatatatttgttcatgtgtgtaaaccctttacatttaagactagtcaacctaataagaaagtactattattatccccattttacaaatgaggaaactgaaaacagagttttaagtagcttgtccgtgttactcagcttgtgattggtggagctgaatttgaatctaggttgtcttgttccagagttcttaactgctgtgtagtattaatactacttttctgtatgttgtcttgaaatttgtttctctaatttctatatattttctctctcttcttatgttaagtagaatcttaattatttctattcttttttttttttttttttttttgagacagagtcttgctttgttgcccaggctggagtgcagtgctgcaatctctgctcactgcagcctctacttccaggttcaagtgctcttcccacctcagcctcccgagtagctgggattacaggtgcttggcaccacacccagctaatttttgtgtttttagtagagatgaggtttcaccatgttgcccaggctggtctcaaacttctaacctcaagtgatccaccccacttggcctcccaaagtgtcgggattacaggcatcagccaccatgcctggcctttttctattctataacaaacccataaactctagtgcaataatttagatcaatattacctacttattacatgaataaaaatggaagtgatacttgttcattggctgttgtcactattgcatatgctaactttttctgtttacatttcagggcatttgaatatgaaattcgattttacactggaaatgaccctctggatgtttgggataggtgggtctttttatttcacaaggacaatagaaacattaacagataagtccttatggccatgtttctcaaattggggtatatggagtgtgtgtcagagtagacagtggtgtcctgggggcacagagatccagaataatcataatatatcttcctgaggtgtttaagattcaagaaatttcaagtttatgatgtacaactttgaactacacccttctatccctatcctcagttttccccagaagcatgtactagagatactttggagaagtttgagggatacaggcttagggtatgtcattgaggacctcaaaagaaacatactttacttctgctaaaatccagaatgggtcttggagcaagaacaaaagtacatgttcaatttaaaatgtgttcttatctttttcctcccatttaggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagtaagtctttctcaagtgccatctgagttttaaatattaaactaagagattttctctagaggtatctggtataccaaaaaaaaagtaaaacagccattttgaaccatttagtagattggaaacatttaataaatatgcaatacttcttaaattggttctacttaaaggtggacttaaatatagtataataaggtattttcgcccttttaagattgatcgcaaagtctgtagatctctcagtgagtatggattaataatttattttatattttgaaacaaggtctcactctgtcacccaggctggagtgcagtggctccatcatggctcactgcagtctaaacctcctgggctcaagcaatcctctcgcctcagcctcgtgagtagctgggactacaggtgctgtgccattacgtccagctaattttttaatttttaatagagatgacttctctctctgttacccaggctggtcttgaactcctgagctcaagccatcctcccaccttggcctcccaaagtgctgggattataggcgtgagccaacacccctagtccggattacttatttatttattctaaacataactgggtgcagtgtttcatgtctgtagtcccaacactttgagaggctgaggtgggctgatcgcttcagcccaggagttcaagactagtcagggcaaaattggtgagaccccatctcataaagtacagaaattaaccaggtgtggtggcacagcacctgtagtcccagctactcaggaggctgaggtgggagggtcgcttgagcccgggacgtccagactacagtgagctgagattgcaccactgtccgccagcccaagtgacagagcaagatcctgtctcaaaaaaacaaccaaaacagaaaaacataattgggccattcaactgtactggaggaggaggtgcaggagctaacatttggcagcagtgtggttgtttggggaaaaacttccctctgtgattctggtatccctttcactcctttatgaaagtcatcaacacaaagaagtgatattttagttttttattggtctttggacttttttcacctagtatattgctacagccaaaaatgtctgcctcagctgggcatggtggctcatgcctgtaatcccagcactactttgtactgtcttacttgacatgtaggaaaaacatattttttattaaaaaaatgaccaccgtttgttagacattaatattactgcttttattctaaaataaatttaaaaaaataaacaataaatatttggaattatttacaaccaccacaatatgatgaaatattgacattaaaactgataagatttcttactaaaataaatctcttggcattaaaactgataagatttcttaataaaataaagtaagaaataaatttcttactaaaataaagaaataaatttcttactaaaataaagtaataaagtaagaaataaatttcttactaaaagtaataaagtaagaaataaatttcttactaaaataaagtaataaagtaagaaataaatttcttactaaaataaagtaataaagtaagaaataaatttcttactaaagtcttaaggaggactgattttaaacttccaatacagttgacccttgaacaacacagggcttaggtgtgcccacccctcacccagttgaaagtctgcatataacttttggcccccaaaattattaatagcctactgttgaccagacgccttaccaataacataaagttgatgaacacatagtttgtatgccatatgtattatatctttttttttacaacaatcttagctagagaaaagaaaatgttattaagaaaattataaggaagagaatgtatatttaatagtcattaagtggatgattgtaaagatcttcatcctcgtcttcacattgagtaggctgcggaggaagaaaacgggttcgtcttgctgtctcacgggtggcagagatggaagaaaatctgtatatgtgaacctatgcagttcagacctgtgttgttcaagggtcaactgtagttacaagtatagaaaattaggtaaatcctgaagccatgaggtatcttgatttcctcaggacattcgacaaatatttttacatccttagtgaaaggttggagaaattaccctatggatattagttacagaaacttataatgaagaatggcacccaaagaatgctaaacagatttgttagcctggagtctgtggaccctggtggtgtaacaatggattttgtccttcatttgtcactagcctaaataatatctttacatgtaatttattataagattggagactgggtgtggtggctcccacctgtaatcccagcactttgggaggccaaggtaagtgtatcatctgaggttaggagttcgagaccaacctggccaacatggtgaaacctcatctctactaaaaatacaaaaaatgcaaaaattagccgcacgtggtggtgcgcacatgtaatcccagttactcgggaggctgaggcaggagaatcgcttgaacccaggagacagaggttgcatgaactgagatcatgccactgtactccagcctgggcgacagagcgagactcagtctcagaaaaaaagataaaaaaaaaaaaaaaaaaaaaagattggactagctgcacctctaaagtgacttttaatcccaggattctatgattatatttaattggagttgttaaaagtaacaattaattagaataatttatctgtttatttttgataacctggtgcttgtactgaagaagaataatatcatgaagtaaaaagcataatctagatcagtgctactgaaagaagggtttgcatactgtttgagataagttcaaaaattgaaagtgagcttttggaaactttggtaacaatttgatattgccgggacatccaagcacatcatcattctttgagtaacttctgtttttattgtactttatatcagtccataatggaacacacacatacacacaataaaactggccccttcgccacagattttttgagaagcacgggtatagacaaccatcaaattcaaatgatcagcactagaatgatcagcaataatctgaactttgtatgtggctaacgaggtacatattaaactattgctttttctttgtgggtctggtcaagaggagtaacagatgaattcttcacactactttctttcgctttgcagaaggatttctccagtcagttattttatgtgactcctacagtctagctaaggaaaaaattgtttctggaaaacttctggtatttttatttaaaggtataaaattattttagtttggcaatttaagggttaccaaaaaaaaggtttatttaacttttagatctattaatctaaccatatagtccttttatttatgttatttcttaagtgatcttattcagcactctgaataacctgatctttactggctgtcccacgcacaagaacaccagaaccattcagaaagctctcaaaatagtgaaatcaatgttaagctatatttatgtagtgacagatatcaaagactggatcttatgctggtagcacattcagagttataacttttcttgaaacaccaccacatatgagaaaacatcactaatttaaataagcaagaaaaatccatttactgaattactgcaaaattaaactataaaatactaattatttttgttaaagatataaataaaacattccatttatttagcatttgttgtactagaccatgattaagggctggcatatcatagcaatgtcttctgagtttgtagagcttagtttatctgaaagacaaatatgaagccattaattgtaactgtaacagagagaaaattacgagttctataggaacaaatacaagacggacttaacctgggctagacaattaggaacagataaataggagatatttggtaaagtaacaaatggtagcttctctagtagtaacagaactcctaactagaacattgaaatgctatttttgaccaggcatggtggctcacacctgtaatcccagcactttgggaggccgaggtgggtggatcaccaggtcaagagatggagaccatcctggccaatatggtgaaaccccatctctactaaaaatacaaaaattagccagccgtggtggcgggcgcctatagtcccagctactcgggaggctgaggcaggaggatcacttgaacctgggaggcggaagttgcagtgaggcgagatcgcgccgctgcactccagcctgggcgacagagtgagactctgtctcaaaaaaaaggaaaaaaaatgctatttttatgtgaatttagggattgtttttaatagcttctaatgctgattagagtctggtggaatgagtatttttgcgaattattaaattttagcattaacaatttttacaaccttctcagaaagcaatttgttaccttttaacatagttctaggaatttctcttaagggaataatgtaaaatgtgaaaggttgtatgcatgaagttattttttatagaattatttataattgggcaaaattagaagttgtttaaatatccagaagtagatgaacaattaaattatggaagctctattagatgaaacatgatgcattcatttaaaaataatagtgaaaagaattcgaggttgcagtgagctatgattgcgtcactgcagtccagcctgggcaacagagcaagaccttgtctgtagaaataaaaaaaaattaaaaataatggttaagtgtaagcagcagcgtggaaaagtgaatgatgcagtattatagtggaataaaagcaaattttattatgatcaaaactttataagataatacatatcctttcatccttaagggaaaaaagactgaaaaaatttatcaaaatgtttgtgatgtgaggtttttagtgatattttcctccctcttgctaatagaattatctacattgtatatggtctcataatgtcccttctaaaacacagatttgactatgtcattcctttgcttatcgctcacccaccctaacacatacaacaattactattaggcagattcaaaattgattagcttgatattcaagacctatcacagcctttttctccagacaactatctagcctggacccctacataacttttaattttctgtatctttgcttatgctattttctctggctgaaatacccttcccttcccattttccacctgataaaagtccatttctccttcagggctaagctcaaatgttaaccccttcctcccccctttttttaattttctttagagacagggtctcactctgtcacccaggctagaatgcagtggcaccatcatagttcactgcagcctcaaactcttgggctcaagtgattctcctgccccagcctcctgggtagctaggactacaggcgccttccaccatgcccagctaaagttttaaattttgttgtagagacagggtcttgttatgttgcccaggcttgtctcaaactcctaacctcaagcgatcctcctactcctacctcggcctcacaaagtgctgtaattacaggcagaagcgactgcacctggcttattactccttcttgaagcctttactctccaactcttcttacaaatcgctcagttttgcctcttttttaggtcctcccagtatggtccttatcacattgtaataatagatttttttttcaatacaggaattgcatgtagtatctccagtgattgtttggcaactaataggcattcaatacgtgagtagaaattggttaactgttaacacttctgttacaggggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccggtaaactttctttggagcttgtcttaactctaaaaataatagaaataaattatctcttttttgcatctgaataaagtgctttctggtggattggcatgttaagtttacttagttactattcaatttttttaaagatatattttaaaaattttatttatcatagagtaaaatccactctttggtatatggtactaggagtaaaaagacttgtgatcatcatcattaacaagatacagaataatttcacaccccccaaaagaattccctttgtaattagtacctatgctgaacccaaacccctggcaaacactgatttattctccagcctgtggttttgccttttccagactgccatataaatggaatcgtataatatatagccttttgagtttggcctgtttgatttagcataatgcatttgagttgtaaaagttctttatagattgtaagtataagcctttgtcagatatgtgatttgaaaatattttctctcagcttaagcctggtctgttcattttcttaactgtcttttttagaacagaagtttttaattttaaagaagtctaatttacaagtttttcttgtatggatcgtgcttttgatgttgtgtctgagaattttttgtctagccaaagattgttacagagattttcatcttcaagttttcatcttcaagttttataatttcactttttacatttagatccctgatccattttgagttaatttttgtagaggatagaggttaaggttcttttttagcatattaatgttcatttgttccaatgccaattgttgaaaagactaacctttctccattgaattgcctttataccttgatttttaaaaaatcagttgatcatattcatgtaggtttatttctattattctattttttctaccgatgtacgtgtctatccattagtgtttaccatgctatctagattactataccttttatagtaagtctagaaatcagataaaatgagtcctctaactttattcttatatttaactctggtagttcatttgactttctatataagttttagaatcagctttctgggattttgattaggattatacaggaatatggtataattctccatttatttaggcttttttttttttaagtaaactttggtagatttttgtctttcaaggaattgatccattcatccaagttaatgagtttgtgggcatagagttgttcataatattcccttattatgcttttaatgtctgtaggttatatagtgattctccctttctcctgatactggtaatttatgtcttctcagtctggcttggatatcaattttactgattgttttagaaaaccagcttttgggttcatttcattgattttttttttttttctcttaatgattttctgttcttaattttatttctgcactttatttcttcccgcttgctttggatataacttgctcttctttttgtagtttaaggtgaaagcctagatcactgattctagacctttctctttttctaatataagcatttaatgctctaaattcccttctaagcactgctttagttgtatcccacaagttgtgatatactgtattttcattttaatttagttcaaaatattttctagcttaccccgtgtcttccttttgacccatgagttacttagaagtgtattacttcagttaggaagtgtttttggatttttcagatatctctgttattgatatctagtttaattccatagtggtcagagaacataaggtatatggtttcaagtcttaaatttgttaaggtttgttttatcacccagattatggtttatcttggtgaatgcttcatgtacacttgaaaaatatgtgtattctgttttttagagtgtaatattctgtaaatataatttagggcaagttgactggtagtctgttctggtcttctgtatcattgatgactttctgtctacttgttatatcaattactaagaagggttttgaagcctctttgtgattttgtctatttcttttagtcccatcagttttgcctaatatattttgaagttcttttagatgcataaacatttagaattgacccctgtatcattatataatgtctccctttatccctgataatactccttattcagaagtctacctggtctgatattagtacagctattccagcttcctttttgtttgcatgatacatcttttccctttctttactttttaaaaaccacattaaaaaaaaaccactcttagagttgtataatcatcattacaatctaattttagaacatttttaacaccctaaaatgaaccccatgcccattagcagtcactctccattcctacttacctcgctcctaggcaaccactactctgctttttgtctctatggatttgcttattctggacattttagttaaatggaatcctacaatacatggtcttttgtgattggcttcttttacttagcatactatttcctttttttttttccagggagggaagggtggaacagggattttcagcatactgttttcaaggttcatcataaatgaacatagttgtgacatgtatcagtactttattcctgtttattgccgaatgatattccatcatatgaatattatttatccattcatcagttagtgaacatttaggttgtttgcaccttctggctattacaaaataatactgttatatttgcgtaacaggtttttgtgtcattttctttttacccttttgttaagctagttgaatttagcagtggagggttatataccaactttagtgacacttatgttaattagcttctttaacttttaacctatgtctttatattttttaagtgggtttcttatacacagcaaatagttgggtcttgttttttctgtgaactctaacaatatcttttttgttatgttgagaccatttaatagaatttttaatattgttgggtttaggtctactattttattatttgttccatgccttttgttcctcttcagcctctttcctaccttcttttggattatctgagtgttttttagtatttcattttaatttgtgttattggctttttgcctcttacaactttaagtggttgctataaggtatataatatacctaaactttcacattctacttaatgttttaccatttaaagtaaaatacagaagctttataaccataaaagttcctttatattccctacccttttggtatacttgtcataggtattacatctatatgcattgaaaaccccaccagacaatattttgttttgctttcaaaagccatatatatatatatatatatatctcttaaataacttaggaaaatagtctgttgtgtttacccttttttttgttgttgttttttcttcattcctgaagctccaagttcccttctagtatcatttcccttcagtctgaagaacttcttttagccactttcttttagagcaggtccgttgtcaattaattctcctagtttttcttcatctgagaatgtcttcatttcatcttctttcctgaaaaatatttttactggatatagaattctgggtcaacgtttcgtttcttttttttttttttttttttgagatggagtcttgctctgtcacccaggctggagtgcaatggatggcacgatttcagctcactgcaacccccacctcccaggctcaagtgattctcttgcctcagcctcccgagtagctgagtagctgggactataggcatgcgccaccacacccggctaatttttgtagttttagaagagatggggtttcatcacattggccaggctggtctcaaactcctgacctcaaatggtctgcccaccttggcctcccaaagtgctgggattacaggcatgagccactgtacccagccaacatttcttttctttcaccactttaatgatgttatcccactgtcttctggcctccttggtttcttttttctttttctttttttttttttttttttttttttgagacggagtctcgctctgtcgtccgggctacagtgcagtggcgcaatctcggctcactgcaagctccgcctcctgggattacgccattctcctgcctcagcctcccgagtagctgggactacaggtgcctgccaccacggctggctaatttttgtatttttagtagagatggggtttcaccatgttagccaggatggtctcaatctcctgatctcgtgatgagcctgcttcggcctcccaaagtgctgggattgcaggcatgagccactgcgcccggccctctctggtttctaataagaaatctgtagtcatttagtagttcctgacctatacataatgtgttgattttcctctggccttgtccaagattttttcttgtttagttttggttttcagaagtttgattgtgatgtgtctagatgtgatttttttttttttttttagacagagtctagctctgttgcctaggctggagtgcagtggcacgatctcagctcacagcaacctccacctcccgggttcaagtgatcctcctgcctcagcctcctgagtagctgggattacaggcatgcgccaccatacccagctaattttctatttttagtagagatggggtttctccatgttggtcaggctggtctccaactcccaatctcaggtgatccacccgcctcggcctcccaaagtgctgggattacaggcgtgaaccaccacgcctggcctagatgtggttttctttacatttaatctgggcttcactgggccttttgaatttgtaaatgtatgcctttcacaaaatttgacaagttttcagccgttatttttaaaatgattttttatacctattatctctttcttctttctctctctgagacttcagttgcacaaattttagaccatttcccccgactctgctaccaataatctgtccaaattaaaccttttgatatcattccataggtccctgaagctctgtttaaccatttttctttttgtttttcagattggcccatttttattgctctgtcttcaggttcacttattcttttctcttccatctccatcctgctattgaaaccattcaacataaattttttatttcagatactgtatttttcaattctaaaatttctgtttcattcttttttataatttctgtttctctgttgagaatttctgtctctccattcatttcaaatgtttttaccttcatctcatggaacatagttatattaggtactttaaaatctccaggctgggcacagtggctcacgcctgtaatcccaacacgctgggaggccaaggcgggggaatcacttgaggtcagcagtttgagaccagcctggccaatatggtgaaactctgtctctactaaaaatgcaaaaattagctgtgcatggttgtgggtgcctgcaatctcagctactcgggaggctgaagcaggagaatcgcttgaacccaggaggcagaggttgtagtgagccgagattgtgccactgtactccagcttgggtgacagaatgagactccatctcaaaaaacaaaataaaatctccatctgaaaactataccatctgggtcattttatgtttgcatttgcttattgttttttcctttgaaagttggtcacatttttctagttctttgtgtgtcaagtaattcttgtaccctggacatttatcctgaccatatgttataagactctgatcctgttggccaatattccctggagaatatctatgtttttgtcttagtagacaaccacacttcagatattacaagttctttgtcatcttgtgtggctgttggttccactgtcagttcagttttcaagacctttgctgtgttgctttgggtctgtcccatgcatgtcctgcttaagggttaatctggggcttgggcagtggtttatatcattgttcagttctcaaagccttttctgtgctgctttgaatctaccctgtgcatgcatagctcaagagggaacctaagatgtatgccaattcacatacagaattaggagatcctcttgttcagctcattcctttgcagttctcctcccatattctttggccttcagagtcctcttttcccagtcctcaggccagaaagatggggtttctctgagttttacattcacataccaccactgcaacagttcaaaaccacaagagaaaatagaagaataaaaaaacaggaaacaatcctgcgtgggttgtttcttcaagttttgacccctctccacagtctgcttgcttttgttgacttttcagagccctcagttagttgctttttttgtatatggtctatagtttttaattcctatcagtgagagaaagagaaaaggtacagtgggcatactccatcttggccaacacctgcaatttattctgggttttttggggttttttttacccttatgataatactttttaaggctagttaaatgaagcagtggtaggaatggagaatctcttctgataatacttaaaactgtggcagcagcataggaagtttacttttcaaacttctgccagctttgctaaagtacaatgtcatgtcatatgcaacttcatttcatataggtcaggagaaaccgtatatgtgtgtgcgtgcacgtgcgcgcatgcatgtgtatagaaaaagagacacagtgataaaatagatgtggcacagtgttaacaattggtgggtcaagttttctaataaaaagttagtgggaaaactctaatcttaataaactctgtgatcttagtcttaataaccctaacctgatcctcagatcaacttaatggtgattttcagaataatttaaattggtcaaacttgggcatttaaagggagagttaaataattctagccaaaacttttcatgatcttaaggtgactctctttacttctgagagaataaacatgttctttgggatatttctgcattcttcccccagcctgctcttctaatttgtttactttaacaaattggaaattttgagtctggtaaaatagtggtcacctcactaaaagttgtgcattctgctactttagacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaagggtaagtttgttaaacgttatttcggaaaactgttagtttctagtggtaaaatcatgtaagaagataatacataaatatacctgtggacacttctagtttgctgaatactgagtagcaaaaagaaggaagtcaaaggagagctaatattacagtgtgcagtaaaatcaaaatgcatcagtaattttgtgtcttaattaagaaagacctaacatttaggaagcatcaagattttctgagtttgaattgttagttgaaagaagatatgtagtaacatagcaggtgttgttaaagtgaagcttacatataccaaagcctcagagaatgatactaatatggttaagaaccctgccttcagagccctttgggaccagaaattagactctctatatacccaaagatcagcaataattttttttaattaacatggactttttttttttttgagagataggttctcgctctgttgcctgaaacgtggtagtgcaatcatagctcaccgcagcttcaaactcctaggctcaagcagttcttttgcctcagcctcccaagtagctaggattataggtgtgagccactgcatctggacaacactgactattttttagagtagttttaggttcatagcaaaattgagcagaaggtacagagaataataagcttttatttactaaatttatagcagttagacatgtaaaccaggctgtttttttaatctcttatttctttcctggtatcaatttatcaataatcagaatgttacttggtggttctagaattaggatatagggagtgtatggtcccaaaggctatttcatccagatcatgatgaagcttggttaataaccagccccacaacagagaaaacccctaataaatgggttaattttgtattctctagttccagtatatctctgctgatttccattgagagaaaatttaaaactgaagaataaaacttaggttagtttctgataaaactagataatgttataatgatgactgaaggaagatgcagaatgtcttttttggaaatttgtgaataaaagatgtggggtgactggaggagggaaaagaaggcagaatataagtaacaaagaatggataaaacgattctatttttgatttattaatttttttaaagattatttttaaaatttctttttttttttctgttgtagtggaaatactgtccttgagttgaggaagaataggtatactttatctggcatctaagttaataatgaaacattttacatgaggttttaatatttttgctcctagctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacagggtaaggactcttagatccagtgctttgctgacacaacaaagacttcacatttagggtagagaagtatttttaccatctcttttaattcctcttgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacgacagccagttatgtgagtgtggtttttggatattttgaagtgggaattattaagggtgggcagaggcacctattctacttcccaaaggcagtttcttctttatgaagatgaaagtaaccaggccaggcgcagtagctcacacctgtaatcccagcacaggctgaggcaggaggatcccttgagcctaggtgttcaagaccagcctgggcagcctagtgagaccctgtctctatttattaaaaaaaaaagtaaccagacaaaattttgtatatcctttatgtttgtattcctttgagtatgttagggttaaaagaccatttgttaatattttattaaggaataaacattaattaggtttatattttcattactgaacattgctttaggaaaatcaatggtggctattctggaagatggattgaacatacataaataagctattggaatagttcaggcaaggatattaaggggcggtatttgggcagggtagtggtaatgaaaggagaagggagcttggatgggagaggcttcagcagtagagttagaagatttgtctgatgggataatggggatgtagggaaaagataatgtgatttaaatgagacgttctcattttgtcattgatagtaatgagaaattatgatagttttccctcttatcctgctttttccttctggacatatttttcctctttcttcctaatccttagcatttctgtttttaagaaaaagtatagtagctggtggttaaataaacaagccagcctgagatttagtctaatgcttaacattgcctagttctttttttttttttttttttttttttgagatggagtctcgctgtgtcgcccaggctggagtgtggagtgcagtggtgcgatctgggctcactggaagctctgcctcccaggttcacgccattctcctgccttagcctcccaagtagctggaactacaggcatctgccaccacgcccagctaatttttttttttttttagtggacacggggtttcaccgtgttagccaggatggtctcgatctcctgacctagtgatccgcccgccttggcctcccaaagtgctggaattacaggcgtgagccactgcgcccagccctagtcctaatactaggttgaattctgtcccagtgcaagagttacctcataactaatttataactcccactacatgctaggaatgcaaaaataataattaagattttgagcaaaaattctgcctaagtgctcaggacaaggggaaggctattttttttctttttttttttttctttttaaacagagtcttgctctgttgcccagcaggctgaagtgcagtggcaccatctcagctcaccgcaacctcgacctcctggttcaacgggcatggcagcccacgtttgccatcccagcactttgggaggccaaggtaggagaatcactccaggccaggagttcgagaccagcctgggcaacatagcaaaaacctgaccctacaaaacaaatttttttttttttgagacggagtcttgctctgttgcccaggctggagtgcagtggcatgatctcagctcactgcaagctctacctcccaggttcacgccattctcctgcctcagcctcctgagtatctgggactacaggcgcctgccaccacgcctggctaattttttctattttttagtagagacgggatttcaccgtgttagccaggatggtctcgatctcctgacctcatgatccgcccacctcagcctcccaaagtgctgggattacagatgtgagccaccgcacccggtcaacaatttttttttaattagctgggtatggtggtgggtgcctgtagtcctaactactcgagtggctgaagcaggaggatcacttgagcccaagaatttgaagctacagtaagctatgatcatgccacagcactccagcctgggcaacagggcaagaacctatctctaaaaaataaatcaattataataataaagaaaaatcagcttggcatcgtggctcatgcctgtaatttcagcactttgggaggctgaggtgaaaggatcgcttgagcccaggagttcaagaccagcctgggcaacacagggagaccctgtctccacaaaaaatttaaaaattagccaagtgcagtggcttgcacctgtggtcccagctacttgggaggctagggatcacttgagcccaggagtttgtggctacggtgagctgtgactgcaccactgcactctagcctgagtacagagtgagaccttgtctcaaaaataaataacgaaaataaaaaagaaaatcctatgagcctttatagaaatggataacatacatttgtagatgtctggtttttctaatgtttcaagtcattttgtagaaacatgacttatgttaaaattaatatggtacaggaaatattaaacttattatttttgagacggagtctcactctgttgcccaggctggagtgcagtggtgcaatcttggctcactgcaacctccacctcctaagttcaagcaattctcctgcctcagcctcctgagtagctgggattacaggttcgggccaccacgcccggctgatttttgtatttttagtagagacagggtttcaccatgttggtcaggctggtctcgaactgacctcgtgatctgcctgtctcggcctcccaaagtgctgggattacaggcatgagccaccatgcccgacctaaacttatttttattttaaattcttttccatggatgttttatttgacctctccacacatttttctttaggttgcgttttgcttagtgatgtatagaagctcttcatagatgaagaaaatcagctaaaaatctataatacgagttgcaaatattttccccctactttgtccttgtcttttggcttcatgtagcagtaaccattatgcttttaattatcatacagtcaaatttaagttttctttttttttttttttttcgagacagagtcttgctctgttacccaggctggagtgcagtggcgccgtctcagctcactgtaacctccgcctcccgggttcaagcaattctcctgcctcagccacccgagtagctggcattatagacgcccgccacgacgcccagctaatttttgtatttttagtagagccatggtttcaccatattggccaggctggtctcgaactcctgacctcgagatctgcccgccttagcctcccaaagtgccgggattacaggcatgagccactgcactcagccttttaaagcttttttttctttttttttctaaacttcatcgaaatataattccgtggcttttagtatgttcacagagttgtgcaacccttaccacaatcaattttagagcatttttatcactccagaaagaaccttgtacccatacctgtaagactcgattccccaccattaccccaatccccaccctagcaaccaactgtttttttctctatagataatttaccaattctagacatctcgtgtaaataatataatatgtggtctttgtttttttttgtttgtttgttttttgtgttttagacagagtcttgctctgtcgcccaggctggagtacattggtgcaatctctgctcactgcaaccttcgcctctccagttcaagcatttctcctgtctcagccttctgagtatctgggactacaggcatgtgccaccactcctggctaacttttgtattttcagtaaagacaggctttcaccacgttggccaggctggtctcaaactcctgacctcaagtggtccgcccacctcggcttcccagaccgctgggattataggcgtgagccactgcgtccaggcagtgtatggtcttttctaactggtttctttcacttagggtagtgttttcaaggttcatccacgttgtgacatgtatcagtacttcattattttttattgccaagtagtattccgttgtgtggcttcacaacattttatttaaccattcatcagttgatacaaattttaattgttttcattttttggctattatggataatgctgctgtgaataccgtgtatacatttttgtgtggacatgtgttttcgtttttcttggctgtatacctaggagaggaattgctggatcgtgtgattaactccatgtttaatattttgaggaactgtcaaattgttttccaaaaaagctgtaccattttaccttctcacattcccctaatgtacgagtactccaattccttcccaacacttgttattatgcttttttggttattgtcattctaacagagatgtgaagtggtatttcgctggttttgatttgcattttcctggtgactaatgatgttgagcctattttcataggtttattggccttttgtatatcttctttggagaaatgactgtttaaatccttggcctatttttcctttggattacagtagtccctccttatctgtaggggatacgttccaagactccagtggatgcccgaaacttgatagtaccaaaccatttatatactatgttttatcttatacatgcactgtggccataacttttgcagtttgaggtatgacagcaaaactaactttttttccttcttcacaatttcactgatagaagattcattcttactgtaaatcttatcaacttcagcatgtgatttattttttatttttattttattttttttagtgaaagttgaggctgggcatggtggctgatgcctttaatctcagcactttggctctgggaggctggggcaggaggattgcttgagaccaggagttcaagaccagcctgagcaatatagtgagaccccatctctactaaaaataaaaatacactggctgggcatagtggcacatgcctatggtttccgttactatggaggatgaggtgggaggattgtttgtgcccaggagtctacggctgcagtgagccagggtcacgccactgtactccaccctaggcaacagattcagatcctgtctctaaaaataaaataaaacaataaaataaaagttaagaactttcacctttggcatatccaaatcatcagcatcgctactcttgtgctttggggccattattaagtataataagggttacttgaacacaagaactgcaatgctgggacagctgatctgatacgagtcagctgctaagtgactaatatgtggatgctgaacaaaaggatgattcacatcctaggtggaacaaaatgggaatatatgggatttcatcaggatagtcagaacgccttgtaatttttttttttttttttgagaccgagtctcactctgttgcccattctggagtgcagtagtgccatcgtggctcactgcaacctcagcttcccgggttcaaccgattcttgtacctcagcctcccaagtagctgagattacaggcttgtgccatcacacccaggtaatttttgtgtttttagtagagacggggtttcgccatattgcccaggctggtctcgaactcttgggctcaagtgatccacccgactcagcatcccaaaatgctgggattacaggcatgagccactgcgcctggccagaatgacttgtaatttaaaactgatgaattatttctggaatttttcacttaatatttttggaccaccattgaccatagataactgaaactgctgaaaatgaaaccatgagtaaggggaaactactctatttggttttttattgttgagtttaagagtcttttatgtattctagatacaacttcttttcggatacatgatttgcaaatattttctcccattctgggttgtcattttattttctcaatgatctcttttgaagaccaaaagttatttaaaattttgatgaaatgcaatttatctgttttttaaaattttgtccctgagctttcactgtcatatctaagaaggctctgactaatccaaagtcatgaagatttgcttttatacattttcttctaggagttttatagttttagctcttatatttaggtctgtgatccattcttagctaatttttgtgtatggtataaggaaggagtccaaattcatttttcttcatgtggatatccagtggtcccagcaccacttgttgaagactactcttttgctattgaatggtcttggcactcttgttgaaatatcagttgaccaaaatgtatgaatttatttctagactcttaattctattccattgatctttttgtctatccttatgtcaataccacacagtcttttttttttcccctacacgatctcgattactgcagatttgtagtaacttttgaaattgagaaggatgaatccaactttgttcctctttttaaagattgttttgactattctgattctcttgtaattccttatacattttaagattagcctgtcaatttctgcagaaaagccagctggaattttgatagtgattctgttgaatctgtaggttaatttaatgatattgacatcttaaaaatattaagtcttctggtccatgaacataggatgtctttccagttatgtatgtctttgaattctttcagtgttttgtaggtttcagaatacaagttttgcacttctttttctttaattaatagactttattttttagggcagtgttagctttgcagaaaaatggagtagaaagtacagagagttcccacatactccatccccacccctcaaccctgtacacagtttttcctattactaacatcatgcatgagtgtggtacatttgttataattgatgaaccaatattgatacattattattggttaaagttctttgtttacattaggattcactctaatgtgttttacagttctgtgtgttttaacaaatacataatattatctatccatcattacggtgtcattcagaattgtttcattgtcccagaaatcccctttgctccatttgttcatccctttctctctctccccaaatcccctgtaactattgatcttttcattgtctttatagttctgccctttccagaaaatcatgtagctggaatcatagtatatgtagccttttcaatctggctccttccacttaacaataaggttcctctgcatcttcttctgacacaatacctcatttatagtgctgaatgatattccattgtatagatgtgccacgatttgtttatccattcgcccacaggaggtcattttggtgacttacaagttttagcaattatgaataaggttgcggtagacattcatgtgcaggtttgtttgttttaaatagtcttgttctttcacctacgctggagtacagtagcatgatcctggctcactgcagtcctgactcctggactcaagtgatcctcccacctcatcctccctagtagctgggactacaggtgcatgccaccatggctggcttattattttttttttttaaagatggggtctcactgtgttgcccagcctggtcttgaactcctgggatcaagtgatcttcctgcgtcagcctcccagagcactgggattacaagcatgagtcaccacacccagccaggttttggtgcagacataagttttcaactcatttggctggattgtataataagactaattttagccttgtaggaaagtgccaagttatttttcaaagtagctatactgttttgcattcctaccacccatcaatgagagcttctattgttccacatccttggcagcattcagtgttgtcaatattttagattttaaccactctaataggtgtgcagcagtatcttattgttttaatttgcaattccttaatgacatctgggaagcatcttttcatatgcttactatcatctttttttttttttatatgcttattaccacttttttttttttttttttttttttcccttagagacagtgtctcactctgttgcccaggctgggctcaagcaatcctcctgccttatccatcctggtagttgggactataggtgcatgacaccatgcctggctaattttttttttgaagacagggtctcagccgggcgtggtggctcatgcttgtaatcccagtactttggaaggtgaggcaggtggatcatgaggtcaggagttcgccaacatggcaaaaccccatctctactaaaaatacaaaaattagctgggcgtggtggcaggtgcctgtaatcccagctactcgggaggcggaggcaggagaatcgcttgaacctgagaggcggaggttgcagtgaactgcgatcatgccattgcactccagcctgggtgacaagagcaagattctgtctaaaaaaaaaaaaaaaaacagggtctcactgtattgcccaggctggtcttgaactcctggcctcaagtgatcctcctgcctcagcctcccaaagtgctggaattacaggccactgtgtccaacttccatctatatgtcttctctcacttccttattttaaatttattgtgaagtattttactatttttgaagctatagtaaatagaattgttttcttaatttcattttcttttttccccttttttacatgctgccttgagatgtgatttaattttattttcagattgttcattgcaaatgggtaaaataggttgattttgtatactgatcttgtattctttgactttgatgaactcgtttgttatctaagaccatatcttctgcaaaaagagatagttttgcttcttcctttcccatctggactccttttctttgtttctcttgcctaatagccttgactagaacttctagtacagtgttgtatagaagtgacaagaatggacatccttgtcttgttcctgatcttagggggaaagcatctagccttttaccatgaagtatgatgttagtgtgggtttttcatagatgtcctctagcaggttgagcaagttggggaaactttttaagcatgtaaatgcttggaccctaccattacagtttttgattcactgagtctgggaaggaccggtatctttagttgtacaaaggtatataagaaaataaaaggtatataagttattctgatccacagggttgaaaatacctgctatatcatggttgaggtatcttatacttcattcttttaaaagctatgctgccactctgattcttccccctcagctgagcaccttggacttaatattattaggttcctaatgctatattcttaactctaattcttttggatactaaaccatgaaaaatggattgtattgcataggttaatttctttttatatactggttatgatgaggatatggtattaagatttgctttcacctataagtaatataagctacttgattatcccacttatggctaatttccttccttatcatagcagaggtggtactcagaacataattttattttccttttttttacatttcaataggttttggggaacaggtggtgtttggttacacaaataagttacttagcggttatttctgaaattttggtgcacccgtcacctgagcagtgtacactgtacccgatgtgtagtcttttaacccttactccccccatcctttcccccaaatccccaaagtccattgtatcatttttatggctttgtgtccttatagcttagctcccacttataagtgagaacatatgatgtttggttttccattcctcagttacgtcacttagaataatggtctccaattccatccaggttgcttcaaatgccatttttttgttcctttttgtggctgagtagtatttcatggtagatatataccacattttctttatccatgcattgattgatgggcatttgggctggttccatatttttgcagttgtgaattatgctgctaaaatatgcatgtgcaagtatctttttcatataatgacttcttttcctctgggtagatacccaggagtgggattgctggatcaaatggtggatctacttttagttccttaaggaatctccgtactgttttccatagtggttgtacgagtttacattccccccaacagtgtaaacgtgttcccgtttcaccacatccatgccagtgtctattattttttgatttctttattatggccattctcacaggagtaaggggttattgcgttgtggttttgatttgcatttccctgataattagtgatgctgaacattttttcatatgctcgttggccatttgtttatcttttgaaaattgtctattcatgtccttagcccactttttgataggattgtttgtttttttcttgctgatttgtttgagttcctggtagattctggatattagtcctttgtcggatgcatagatcgtgaagattttctcccactctgtgggttgtctgtttactctgctgattattccttttgctgtgcagaagctttttagtttagtttagccccatctaattatctttgtttttgttgcgtttgcttttgggttcttggtcatgaagtctttaccgaagccaatgtctaggagggtttttccagtgttatcgtctagaatttttatggtttcagatcttagatttaattaagtctttgatccaccttgagttgattttttgtataaggtgagagaggaggatctagtttcattctcctacttgtgacttgccaattatcccagcaccatttgttgaatagagtatctttccccactttacgcttttgtttgctttgtcaaagatcagttgactgtgagtatttggctttatttctgggctctctattctgttccattgatctatatgcctgtttttataccagtattatgctgttttggtgactatggccttacagcatagtttgaagtcaggtaatgtaaggcctccagatttgcagaacataattattgatggcccttgtaaattatttttagcttcttttatcaatcttattgattttttttattttgacccatatgaataatagtaattttgcttctttaggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaaggtgtgtgtaattcaagtttgtgaagaggacttaacttagttgtgtgaaggttgagctgacctattaagtctgaagaaaactaaccttatagtttgtacctttgtatgatgtttctatggtagtactgtttctttctgtgtatcagccaaaatcccactgctgccttctatggttgtactgtttctgtgtatcagccaaactcccattgctgccttccatgaaaactccttggggtgtgggggcactgagtatgtttagaagtaaaggaagaagttctgaactgtatgaacaatttatattccccaatacaataagcaagcagctatgatccctgacatgcatatatgtacattccatgcatccctattaagtacttttcctaatgttattgcttgaaatatttcactttacctttgatactttgtctgaaatttctccaagggcttatttagattaacatagtaggtcatactgcagtgatttagattatagatattcgtattgttttttaaagacattatatttctaaattaaaggaaaaggtttaaaaattgagatatggggaatttttgggaaacaggaagcagttctgattctggagcctggagtacttgaaggcaagaggtagggcagaatgggctggaaagtagggaagtaaggcatatggggcttaaggcatgagaaggtgaaggagaataaagaagggtacagaaaatgaggtaggggagggtccacttccatttagacattttttattaggatctgtaaggagaaagtaatgtttcttttatacatccgtatccagaataacctactaatatagctcagctctcttaacaggatgtggtgtttgtggggttagctgggaaacttaaccatcacttatactttgaggagcaatcttttctgagttccaggtgacaacctggaagcaaactttggtaaagcagactgttagtaagtttgaaattgccttcatttgttacactaattagtgtcatccaagattgtcaaaagtgctctgggttcaaatggaacttgtgtgtctaggtagaagagagggatggttgcaaagcaaggtgttgagtaaggcttttaaaaaaggagaaccactccagcaaagaaataggctaggagggtggccaaatatgaaccagaaaaggaactaggtatctagataaaaactgtttcctaagggaaaagcttagtctgtaccagatatatagaaggaaaatgaaagtccattttagggccaggcacagtggctcacacctgtaatcccagcactttgggaaaaaaagaccagcctgggcaacatggtgaattctcatctctgtgggaaaaagaaaaggtacattttgttttcaactagccaaagaaggacctactctagattacatgggatttaattaggaataagaaggcattgacctctgagaattttttaatactcatttctattgtgttttttttttttttaaatagagagatgggatctccctgtgttgcccaggctggtctcaaactcctgggctcaagctatccttcccaccttggcctttcaaagtgctgggattataggcatgagccaccatgcagaccttaatgcttatttctaagctggtctctgaatctatttcatgaacttgtataaattcccatctgtgtataagtttgtacccttacataaatcctcatttcaataaatgtggtttctagttactgtcaaaaactgacttcaaagacttgccaactacttactctcagggaaaaatacaagaaaagaggaagccacaatcagggcctacacaaaggttgttttttctttgcgttgcacttccaaatcattttttccctcttctttcaaaaactttagcttctttcagatttctgtcctctaattcttttctatctcctgagcctccttagtgtactcacctcagacttttcagtcacactccatcattcattaattgactaataagcacatggcttactatctatgcctctttaccctaacctgcaaaaccctgcatggccaagcatggtagcatgtgcctgtagtcccagctactcaggagagtgaggcagaaggattgagcccacaagtttgagaccagcctgggcaatatagcaagaccccatctccaaaaacaaacaaaactccatgtggcttagcctttacctacctctccaaccccatctttttctattcaccctcttactatgctgcaactacactggacttcctttggattcttagacacagtggtcttttcctgcattggggcctttgtgccacctagtttgttagcctagaatctttccccagaactttggccccttatcatttaaattacagcttaatactgtcactttatcagaatgatcttccctgatcactggtcttaagtagccctcccttggcctccatctccctacccagtcaaacattctcacgtcacctattttattctttttcctaaactgattttcttgtgtgtgtgttgcccccaaatttgaatgttagtatcacataaccaaggactttgtattatgtaccactgaaacctaagtactcagagctgtgcttggcacatagtaggtattcaatgtttttttccttttagtagaaacctgtgttgttcaaaggtattctatttttttattgaatggataaagaatagaggcctagaccacaagttgaggaccttattccacttaaatcattttcatctgtattagtaacatatatgttgaggagatgagctccaaaggcagtttttgacagaatgagttactatgaggaataatacctcaagcaactttactgtttctagccgagctattgaccagtgcagagaagagagcagaaatgcagaaacagattgaagagatggagaagaagctaaaagaaatccaaactactcagcaagaaagaacaggtgatcaggtaatttttcttttttcatacacaaaactagaatttattgaaacaaatttaaacattataaaaatatagaaggttaaagtcctcccaacccccatttagagtttctggtagtttcttagctgttagtagccggaaagttgagcgggaaagtaatttaacaggtgacttcaaatggaatttgtggcatgtgaaataagtggtgcagtttattgacttcttagttatactccaaatcattatgttattaattctggcttaagctttttattctagctatgttccattaaaatgggattgcctaaagaaatttagtatatgcctggcactgctcagttgagtacaacagtactggtttagagtaggaataaaaattattggaaatgacttttgtggtacactcattttgtactgttagtggatgtctagggaaagagtacagtaaagctaatgttagaactagaaaatagcattttctggatgggagggacattgattttgtttatttaatgcaaacagcaagaagagacgatgcctacaaaggagacaactaaactgcaaattgcttccgagtctcagaaaataccaggaatgactctatccagttctgtttgtcaagtaaactgttgtgccaggtaagactacataggtggaagggacaatgcatataggagggcatttagaaccaacctttgactctctagtgccttgaagtctccttgacgtttacagtatcgagacatggtttttgtaagtctctgtcacaacataagctttgatgctgatgagggaggacagagcattgactattttccactgaagaaacatgtttcttatagaaacaaatacatatactgtttttaaaaaacaaaatcacccatttctaccactaagagatgattaccattaacactgttctgtctcttcttttgtgttgtatttttgttttgttttataaaaatggcagcttaccattttgtaatctgcttatactattaatgcaacttgacatctattatcaaatatatttctgcaacatttttgataaccaaagcttccatcttctttaagagaatttgaattgacagtaataatttatcttagagtaaatattatatttaatggaaaagcctcttggacttttaaaaattaaacagttctttctgtgggtattgagcacatgatttaaaacaagtttctttacagagaaacttcacttgcggagaacatttggcaggaacaacctcattctaaaggtgagttgtatttgacagccttgagaagaacttgctgataacaaatgtattatgtaataaatggtaaatatttttaattatgataaagggattgaaagacagggggactaggatactaggaatttagtataagcatatgctttatgataggaaagacatttgaaagagtatttttttaaagattcctcagtgcttcaaaatatttggtttaattgtaattttaaatttacactaaccaccaaatcttatactttagttactgtacactaaacagcaaagacactaagggaagtgtttcttttcagggaaaaaaaaatttaaagctattttatactcaaattggttttcttttcttcaaaatgtgttaaaagtggtgaaacatgaatatctacttgtaaatggtttggcaaaaataaaaataaaaaacattaaaatctaattaaacctctgtttctaaccgtcaatttattggaaatataaagcatggaggaacgttgttaaacaacacagcgggatggaattggcaaaatccagcattatggggctagcaacccagtttgttcaacaaaaattccccccaaaactctatagaataaaagagatttaagaggcatttgaacagtcacagtatacggatcttaactctgcattcccaattcaaacaaactttaaaaaaatttttttttatttattaatatttttttgagactgagtctcgctctgtcgcccaggctggagtgcggtggcgcgatctcagctcactacaagctctgcctcctgggttcatgccattctcttgcctcagcctcccgactagctgggactacaggcgcccaccaccacgcccggctaatttttttttgtatttttagtagagacggggtttcatcatgttagccaggatggtctcgatctcctgacctcgtgatccgcccaccatggcctcccaaagtgctgggattacaggtgtgagccaccacacccggccaaaacatttttttaattggtaaaatatgaaacttctcactggacatttgatattatatatatattcataaattgttcattttataggtaggtatcatgttttgggattgggatttttaaaaagcctcttttagaaatatatactgaaatatttgcagataaaatgacatgtctggaatttgctttaaaataatcctgttgggttgggtttggggagtagtgacagtggtagagaatctaaatggaacaagatcatctaagtttaggtaattggtaaattgtttaatgaccttttatatgtttgaagctttttgttattaaaaaaacaggttgccttcctgctttcaaacaacacaaaatattgattaatttatctggttgtcttgaagagtaaagcatttactcctagagtatgtatctagtctctctttctctaggtcccagtgtacctttctccatttttgatgagtttcttctttcagaaaagaagaataaaaggtacgttgtttttttgtttttttggtttttttttacttaagaattttctgttattataagtgaggataaattaggggttactgttatgaaaaaaattgctaagtgaggtatgtctttttccagtcctcctgcagatcccccacgagttttagctcaacgaagaccccttgcagttctcaaaacctcagaaagcatcacctcaaatgaagatgtgtctccagatgtttgtgtaaggagcagtatccttaagttaatgtaaatgggctagtggattgtttattcaaaaccacaaaagcttaaggttaaaattgaaaccactgacttgaattaagcacatgaaaagatgctcagcattactactcaacagggaaatgcaaatcaaaaccacagtgagatactactttatatcctctaggatagctataataaaaaattacgcacagtaacaagtgttggcaaaattgtggagaaattagaacatacattactggtgggaatgtaaaatggtgtagccactttggaaaacagtttggcagctctttaaaatgttaaacacagttaccatatgatcctgcagatctctgcccaggtatatactcaaaataattgaaaacacatgttcatacaaaaaatttgtacacaaatgttcatagccgtattactcatgatagtggaaacaaccccaaatgtccatcaactgatgaatggataaacaaaatgttatgtatccataccatgaaatattatttggcaacaaaaaggaatgaagtactaatacctgtcacaacatagatgaaccttgaaaacgttatgtcaagtgaatgaagccagatacaaagaccacatactatatgatctaattttcatgaaatatccagaataggcaaaagtgtcatggattgaggttttccaggggattagagggtggtggagagtgactgctaatgggtatagggtttctttttggagtgatgaaagtattctggaattagatagtgatgatggttgtacaaccttgtgaatttactaaaaaccactgaaatatactttaaaagggtcaattttatggtatatgaattatatctcaatttttataagtagggaaaaatcactaattttaaagccttttgtacttttaattttttaaccaacatagcaaaagacatttgttcttttttatataaaataccttttttggcaatgcaaaagttatgtgggccaatcatttttcttcagtaatgttctatattaaccgctatagactaatgacataatacttaaggtaaaaagaccctgtgtagacatttaagtcaaaataaataacctgtatcattggcattttattaaagttttaaggaggaaaaatcattctcttcaaaccagcctctggaagcttgtcatgagactgaaaagaattgagtatgtttaatctgaagacttttaaggggtgatgtgagcagtagctttagtaacttaaagcagtgttttccacatcctagggaatcatttggaggaagttttttaaaagcactttttcattttagtttcttctctgttgatgtatattttatatccagtaaactgcacaaatattgtacagctagatgaatttttccatgcaattttttcccatatcaagatacagaatatttccatcaactcagaagagactagcgagtcttttgtgactaacagtgcttaagccccattccatctaggtgccattggaatttccagggaagaagtccaagcatgtatttttgtctttttaaaaatactttctcagataattctgctacagttagtctactgactgctatgaaaagacagtgatgtaagagtaattaattacatattgtgttctggagtaaaccaccagagaacatgatgaacaggctagatttggatacagtggttctagattcagctgttcaaggatatgcttaattgttaaaggagtccaacttcatttacctttttttttttttaaccagtcttttacttgaattttgttaataagtacctaccagaattttcatcccctaaaaaaatcatatttaaaatgtctaagctaatatggccataagtagtatttgcataaaatgtatagattataaacatctattttactttaatcacatatataaatacatatatatgtatatatatatttttttctttttcttttttagacagggcctcgctctgtcacccaggctggagtacagtggcatgatctcagctcactgcagcctctgcctcctgtactcaagcattcctcccacctcagcctcccaattagctgggactacaggtgtgagccaccatgcctggctaattttttattttttggagagacagggttttgccatgttgcccaagctggtctcaaactcctgtgctcaagtgatcttcccacctcagcctgcctcccaaagtgttgggattacaggtgtgagcaaatgtacctggccaaatcttttttttttttttttttttgagactgagtttcactcttgcactcaggctggagtgaagtggcgtgatctcggctcactgcagcctccgcctcctgggttcaagcaattctcctgcctcagcctcccgagtagctgggattacaggcgcccaccaccacgcccagctaatttttgtatttttagtagggacggggttttgccatgttggccaggctggtctcgagcgcctgacctcaggtgatccacccaactcagcgtcccaaagtgctgggattacaggcgtgagccactgcacccggcctataattttttttttaactatactttgtttcttccagatgtacctcccacctttagttactaagtcagaaattcaaagtatgtgtcaaattggtaatgatctagaaaattaatctctggtatccatatgggttaaatcaaataggcactatttgtatactacaggtaaatatgtaaagtggtataatctctctgaggacagctaagtaatatagataaagaactttagtgtttataaccttttgaccttacaattctacttttaggaattaatcctaagaaaattaaaggatttataaagatttatgtataaggataaagtagttttaaactagtaaaaaacagaataacctgaaagttggttaatttcttatagacccacaatgtggccattatgtttttaaagaatttttaatagcataggaaggaagaaatacaaaaagtatgagaaagagcaatacagagtatcatgaatgctacagtttcactggttgtaaaactgcttttcaaatgcatagaatatgctatgcatatatcctaccagacatacatgaattgtctttaagaaataaataaaaattaggtatgtagcatagaggaagaagacctaaaaactaggaggatagcaaatcattagaatatttactaagtgaaagcagaagaaaaatagtatttgtgctttagttcataggtgaaatttgttgaggaacaaaaccattgcccaatatttttctttgtatggagaatcttcctggtacattttttggatgaagtatagtttactgtgttcatgatataaaaacctttttatatttgcctagatattctgatatgctatttctgtaccctgtgtcactgagctaatatgtctctctcagtaaaaaagttcttcatgtattgaaatattttagctaaactttatatggtctttatttcaggatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgaggtgattggggatttacaggttttacaaaccagattgtttactctcttattctgcatgtgcttgtcagttacagtaatcagttatcaagttcttactaactgccaggtactgtgctaagtgctttacatgagagtagggctgccccagatgaagtgtcaatgggatttagtgattgatttggatgtgagggttaaaagtaaattttgatggtagagaaactaagtggtccgagaggagtatagtaccattgaggaaactttgcaaagtgtacatgactgacgaaaaggaggcatttagtttttctttaatattgagtttaaaatagtggtaggatagcttttgttaattttatgtatttatttatttattgaaatggagtctcactctgtcgcccaggctggagtgcagtggcactatcttagctcactgaaacctccgtctcccgggttcaagcgattctcctgcctcagcctcccaagtagctgggactacaggtgcgcaccatcatgcctggcttatttttatatttttagtagagacggggtttcgccatgttggccaggctggtctcaaactcctgacctcaggtgatccacccgcctcggcctctcaaagtgctgggattacaggagtgagccactgtgcctggccagcttatgtgaattttaaataggcaactagagatgtgttttttaaaaaactatcttttgatagagaggtggaaatgaactatggaatagatatgagggaatggcttatggccagggtctgacacttgttttaggtcagctaatttaactaattccagttttaggaattctttgtaattggcaaatttttgcttttaaagctacattttgagaggccagatgcagtggctcacctctgtaatcctggcactttgggaggctgagggaggcggatcatttcaggccaggagttgaagaccagcctggtcaacatggctgtactcaaaaaaacttttttttgaaactttttccctacaggcttttaagcacatttgctagcatgtattcacattgcatgatttgggtttctcttttctttgcctaaccttttcttcttgaagaaaaaaaagtccagagaaaggataaagaggaagaaagtgtcaatgttagtgtttctcaatattatggaatatagagtagatatttactataggtaaataaagcataaatccagaaatgtatgctggacatggcttattcaccaggtttagaggaggttacctagattctgatttggggaaataatggacttgaaaaatgagactattgctgagtgcattggctcttgcctgtaatcccagcactttgggaggctaaggtgggaggatcacttgaggccaggagtttaagaccagcctgggcaacaaagtgatgccttgtgtctaataaaaataaaaaaaaaaaatagctaggcatggtagcactcacccagctatcatttcctgggctcaagtgattctcccacctcagcctcccaagtagtcccagatattagcttttttgttttacaacctttcagctacttgggaggctgaggtgggaggatcacttgagcccaggaaatcaaggctgcagtgagccatgatcgcaccactgccctccagcctgggtgacggaatgagatcctgtctcaaaaataaaatgaaaagtaaaaaaaaaaaatgaggctatcaaataaattgataacaaattataaattatttaaacctaaattttattgtgttaaaaaataaaagaataacataaaattataaaatgtgtacattaaggccaggtgcagtggctcacgcctataatcccagcactttaggaggctgagacgggtggaccatctgaagtcaggagttcaagaccagtctggctaacatggtgaaaccctgtctctactaaaaatacaaaaatcagctgggcatggtggcaggtgcctgtaatcccagctactcaggaggctgagacaggagaatcacttgaacccgggaggcagaggttgcagtgagccaagatcatgcagttgtgctccagcctgggtgacaagagcaaaactccatctcaaaaaaaagaaaaatgtatacattaagaatttatgaaattataacaaagttgatatatattattcctataagaattaacttatttttgattcttttagcccaattattgaagacagtcgtgaagccacacactcctctggcttctctggttcttctgcctcggttgcaagcacctcctccatcaaatgtcttcaaattcctgagaaactagaacttactaatgagacttcaggtaggatatacataccactatatccatgcctagtgaacacttgtttatctcagcaaactgagctgtatgtttttctttttttgagacagggtctcactctgtcacccaggatggagtgcagtggcacaatcaaactcactgggctcaggtgatcctcctacctcagcctcccgagtagctgggaccacaactgtgccaccaccaatttttgtattttttgtagaggtggggtttcgccatgttgcccaggctggtctcaaactcctggcctcaaaggatcctcccgcctcagcctcccactccctgggattataggtgtgagccaccatgcccagtctatgtgtttttccttcttaaagaagttgccggccgggtgcggtggctcacgcctgtaatcccagcactttgggaggccgaggcgggtggatcacgagggtcaggagatcgagaccatcctggctaacatggggaaaccccaactctactaaaaatacaaaaaaattagccgggcatggtggcgggtgtctgtagtcccagctactctggaggctgaggcaggagaatggcgtgaacccgggaggcggagcttgcagcagtgagccgagatggcgccactgcactccagcctgggcaacagagcgagactccgtctcaaagaagttgccataaattgtgaaatttctagagtagattagtacgaagtgaacacagtttcataaacacctgagacaggtgagtgtagttaaattaacagtgctgactgtgtaatcttgattttttttttcttctactctgttataatatccattttaagcattagggtttttttggtgatatattttcacctttccctcccactggcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaagtaccattgaactcatgtcctctggttcatgacagtatacaaataagtgattatttgtacttaagcttgatgcttgagcactgtaaatattcctagattgtattttttaaaaaagcaatatagaggatgacacatcagtaacttcatgtcctaataataggaattatgtcttctcctcttgcaatctttaacaaattatttttaaaagtattctagatactactaactggcaaatacaccagtgcctctatcccttaaaccaggaggtaaaagctacagggctgtatatgttcacagtgatttttaaatggaatcaaactttctcaacaggtaatgaggattactgcattaaacgagaatacctaatatgtgaagattacaagttattctgggtggcgccaagaaactctgcagaattaacagtaataaaggtgggactgattctttataatttcagttactttgtaaataatacggattggagcaataactgtcctcatgttaccatcaaatctttctaataatctctttcaatatgtccaaatatattaagtatcctttcagtttcattttttttaggaaatctctgctgatactttctggcctgctccaatctggacaagttatacattagctttcacacaatcaccacacacaatcaccttggaatttccatttattatcatcctaggtattcacattacctttgtcttatattggatacctagtttctttttatctttgttttttaaaggacacggtctctgtcatccaggctggagtacagtagcatgatcacggctcactgcagcctcaacctcttgagctcaagcaatcctcccacctcagcctctggaatagctgggaccgtaggtgcacgccaccactcccagctaattattttttgtagagacgggggcctctctgtgttgcctaggctggtcttgaattcatggctcaagcagtcctcccaccttggcctcccaaagaactggattacaggcatctaactttgcttttgaatttttttgccattctgagtctcaaagctttgtgtgaagttatttttccttctttctggatccttataggatcttattcttgtccccactattctgaaatgtcacaattacatgccttttcataagtttgttgtcacttatgtgctaggtactcaatggccatttcaatctgttaattccctcagttctgagaaattttcttcaatgggaaaattatttttcccctcagttttctctgttctcttattctctaattccttttattagaggtgtatatggcatctttggacagaacctctaaaaatttaactttttttctcctatattctctctttgtctttttactttactttctgagtatattatcagcttaatatttttggtctttttactaggtttttatttctatatttaattttcaagagctctttttaaaattttttacccctttgtcatctgtttcttcttgttttcttttttgtctgttttgatctctctcacactacaggctttcttcaagtctttggctctctattcgtatttaagtatgggacattgaaagctctgtgtatatggaaagaccttgacagctgtggacctcaatgtaggatgatctagtttggccattttattggaaaaccctccaatctttagatcctttctcttgacctgatcatagaagtcttctccctcagagaagacttctaattttctgcctggagcatataagcctggctgctagctttctgaaatctgagtgaggaaattggtctgaagaatagaagagcagggaggtgcatcttaactgctgcatatataacatctgatatatatactttttcctgttttctatgttatttctacccccctcagtggtgcctagtgccctctagtccagagcccttctgttttatactcactaggtaataaacttctggacttcgagaataggggagaggtagttgctgggctgggctatgggagcagaggagggaagctggggtctaccttcctgtttttttgtttttttttttcttcgagacggagttttgctcttgtcaccctggctggagtgcaatggcatgattttggctcactgcaacctctgcctcccagggtcaagcgattctcctgtctcagcctcccgcgtagctgggattacaggcacccgccaccaaaagcctagctaattttttgtatttttagcagagacggggtttcaccccttcataatcattggtcaggctggtcttgaacccctgatgtcaggtaatccacacgcctcagcctcccagagtgctgggattacaggcatgagccactgcactaggcctaccttcctcttaaatgggattcaatcactcctgtcttagctccaccctcagcctcacttccatgggtaattggtgctgccagttatatagtataggaaaatagccttgtagtgtaaatgtagctcagctttctcctctgccaaaatcagtttttattctaattggattgttacctcctgttctctttccagcttatcctctttccagaatttgttgttattgtgtcttttatagtagatttatgcctttaaaaatatctctttattatttctctatcagaagggctggaaggaatgtgtttcaacctgccagccataaccatagacttaactgaacttatttttaaaatacaatgtcttacaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggtctgtaatactaaaaacataatttaaagtcctgaagtagagagatttgtgctccatttagcaaaggaatttagtacaaaattcctgtcaatcttctagaaatagaccaattcaagtataagttagaagcattgataattttctcgttattttgaccaaagatctctttggtatttttttaactttttttggtccgttgtcaagcataaataaaagtagaattgtacaatgaactcccatgaactagtcatctatgataatcttagctcatggtcactcttgttttagctatactacccccactggatagtttttaaaacccagacacaatatgtcattttactcttcggtttgttcttaagaaggtttgctatggattttgatgataatatgaattctcaaaaatggttggaatgagggtattttaaatccatttattaagtacctattttgggccaggctcatgcttgatgcccttcatcattatgtcattaaatccttacaaacaatcttatgggagatggcagtgttattaaaactgggacatagactcagtctacagaggtgcctacgttccagtagagaacaaggaagactacaaaccatcagttttcaaggtattgagtataactacgatctgccaaacttgagaaatagtgagttttctgtccttcaatttccaggatcttctccaacacagtgaatatattacccatgaaataacagtgttgattatttataaccttttgacaatagtggagatgctacacaaagcagaaatagtccatggtgacttgagtccaaggtgtctgattctcagaaacaggttggtccttttcattcttataattctgccagctgtctcttaaaacatggatagttgccacttttttttttcttttttgaggcgagggtctcactctgtcacctaggttggagtacagtggcatgatcttggctcactgcagcctccatctcccaggttcaaacgattctcccatcttaaccttgctagtagctgggaccacaggcgcgcaccaccacacctggctaattttttgtattttttggtagagatgaggtttcaccatgttgcccaggctggtctcaaactcctggcctcaagtgatctgcccacctcagcctcccaaagtgctgggattataggcgtgagccactgcacccggccaagttgccaatttttaaagccttttgataaatgccatatcgaggaacatattatgttaagagagtatttacctaaaagtcaaaaatcattaagaatagtttaaaataattcaaagaaataaacacattgaggaaatagattaaatcagataaaagaattaatcactgagtattgtgatgatatatgtcaagatgagatataaaatatgaatattttgaggaatataaagtggattgtttagtcattctttgagtgggaccagtgccactctagcgaggatgccagcaaaatcaaggcactactcagtttcatagaccaaagcttaagtcaggcctaactgacctgttagccaagagaagtgggtaaaaccagagttcaaatacaaactatgccaaggaatggggtttagtgttcaaattaaacccagtgtgtccatcaggttcaaggggtgagcacagagcaggaaataataaatgaatactaaggactgagaaaatatagatcacgttcaggcattaactaggcaaaaacagtccaacatttttgctttgtgaaaagtactagaggactactatattcttttagtgatcattggtgttatagtatttgagtaaaagcagcctggtttaaagatgctgtgtctgcccaaccctgtgtcttgggtgaggtgttaactttgtttctgaggccactggtatacactaatagctggacttactctttacatttcttctgaatacttaatctatcagaagagattgaattagactctaaattatagttaacgtggaaattaaaagaaccctcaatgtgttcctgtgattgtaaccaaaagaaccagagaatcccaccttctcccctgagatagcagagtcaaaggctttcccagacataatgtagcagcatttctcatccagggcaccataggtattttgggtgagacaattctttgtgcaggtgtgttccaagcaatgcaggatgttttatattcctattcccccccacccacccaattaagtgcaagtaacaatcccctaagccgttgtgaccaccaaaaatccccccaaatttccaagtatgagaacccctggtatattttcactctacttaacattaaaatgacagtgctgaaattcccagggctatggaaattggaagcagaggttttttctaagccttttagaattggccatttgtggtctaatgaagtacgataacccttctctcagccactagaggctctaggaaagtccatagtattaaagaggcattgctttttactttgtcactgcttatcaaatttaatcagaaatttcacatagattcataaggaattaaaagccagaaaggggccgagcacagtggctcatgcctataatcaatcccagcacttttggaggctgaggcgggcagatcacctgaggttgggagttcaagaccagcctgaccaacatggagaaaccccatcctactaaaaatacaaaattagccaggtatggtggtgcatgcctgtaatcccagctacttgggaggctgaggaaggagaattgcttgaactcaggaggcagaggttgtggtgaactgagatcgcaccattgtactccagtctgggcaacaagagcaaaattctgtctcaaaaaaaaagccagaggccgggcgcagtagctcacgcctgtaatcccagcattttgggaggccgaggcgggcggatcacgaggtcaggagatcaagaccatcctggctaacacagtgaaaccctgtctctactaaaaatacaacaagatagccagccgtggtggcaggtgcctgtagtcccagctactcaggaggctgaggcaggagaatggcgtgaacccgggaggcagagcttgcagtgagccaagatcatgccactgcactccagcctgggtgacagagcgagactccatctcaaaacaaaacaacaacaaaagccagaaagggctggatgcagtggttcacatctgcaatcccagcactttgggaggcagaggcaggaggatctcttgaggccaggagttcaagaccagcctggtcaacatagcaagaccctgtctctacaaaaataaaataaaagccagaaagaaccttttgaaattgcttagtttagttgcttactttagtttctgcatattttttgtgaggaaaatgagatccaaaaaaatggaatgtcctacccaaagtaacagtgagtgagtagctgattagagggctaggacaccttcatgcatgcttctttttattaatctatgagacattttttccctatgcctccaaagttatataaatattttacaattacactgggcatggtgactcacatctgtaatcccagcactttgggagaccaaggcagaggatcacttgagcctaggagttcaagaccagtctgggcaatataatgagacctcatctctacaaaaaattaagaaattagccaggcatggtggcacacaccagtagtcccagctactcgggaggctgagatgggaggatcgcttgaacctaggaggcagagactgcactgagctgagatcgcaccactgtactccagcctcagtgacaagagtgtagaccttgtctaagaaaccaaacaaaacacacacatgcacacactttacatatatatataaaatacatatgtatattttatatatatcagaatccacgatccctataactatatatatactatatatatatatatatatatatatttttttttttttttaattatagtatagttttatggtggccaaaaaaggttggctcttgtgccaaggaaaaatgagagcaattatcaattttaaagtaaaatacatagatcattctgtgccgtggaggtatgtaattggagtagttaaagactgtatttaggaatattgcaccaatatcaggagtttgagggaattaattgagaaaaacagacaaaaggaacacatgaaaacccactcttttcatttataaacagttcctatgtccccttggagaatagcattattgcataggatagataaacccaaggaaaacaaaattaattgataattaattagtattataaagatttttttagtaaataactggaattacaagtaagagtaagataaaatatggtgttttacaagaaattttacaatacagataggactttataaaacagacttgcattgttttccattaaactctggaaggaagaatctaaacaatacttggaaagcctatctggaatagtaaacaagaaaggctatgacacctataaaattttaatttcctccatcataattcctgtcagtgtataaatcattgcaattgtatgtgttaatgtgtacagtacagggaagaagcctgtgctctgcttccatacttactttatataatatggaagcttgataaatgtttaatggtggccatgcaccgtgattgaaatatactttgtgtcaccaaagtggtgacattccttccgcattgggtggacactgccactgctctgtcttacaggtgcattttcaaaattaaccactggagggagttgttggcatagctaagatgtacccaaggtaccttttttttttaaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtaagtgtaaaacaagcctgagcaaatatggagagggtttcttaatctctttattatctagataagctataaaagctactgtttactgataccgactcctagaatagatgacctagttttcaaatatcaccaagtcaagtaaaatgtaacatttttgtgttacagcattgaagaatatacacatacatgtgcaaacacatgactaactctgtaaccgagtgccagggccactcctactgcctaccacccatgtaatcttttataagtcattttctgtgatcttctctgtaaaatagggataacagtctctgctatgtgtttatcagaattgttatgaggagtaaatgaagtaatgtatataaaaagaacattagcacaaatgtaaagtcttttgtatggtggcattatatgcagaaattccttctaactcagctttagacataagacatttgctgattgaatatgtagcacaaacctgaactaatcatgtggaccccatttagatcacagctggagttcatgcaaactcagtaggtctacaaatttgaatgtgatagtccaaatatttcatcttttgttcttaaggataattcctagaattggctctattgatcacttctttggagagcttctccctttactgtaagggtgaggaacagtctactaaaatgtatgtcataaaataaacttagttaagcactgtaatacctttcaacttcctaccgaaataagctgccatggtagaggcagagaattattttagctgatggtgctttttgtgatttcaggtagacctgtttggtatagcagatttagcacatttactattgttcaaggaacacctacaggtcttctgggatgggtccttctggaaacttagccaaaatatttctgagtaagtattgatgaatgtcagggtctctgcctgtcccaataattttctgtttctcttgggtgctatctctgctttggcagccttagttttttaatccaaatgccatggttccagtagtttcagccagttttcattagagtatcagcagagcagctagtgcaggaaaaaggaactgcttactaaaaataagattcaaaactattcagacttcaggacatcattctgaatctagctgtatcttccagactacagctatagtatggaagcttccctgtttagatatgtgaaaagaagcatttcatgagaataattttctaactaattggtgttagccttaaattcctttttctttatttatttattttttgagacggagtctcgctctgttgcccaggctggagtgcagtggcatgatctcggctcactgcaacctctgcctcccaggttcaagtgattctcctgcttcagcctcctgagtagctgggattacaggcgtgcgccaccatgcctggctcatttttgtatttttagtagagatgcggtttcactacgttggccaggctgatctcgaactcctgaccttgtgatccgcccgcctcggcctcccaaagtgctaggattacaggtgtgagccaccgtgtctggcctaaattcctttttaatagcaattattaccaaaagttaataagcatcctttgaaaagacttacatttctaaactatatgctaattttaggctattttttatttaataagtggatagaaccaaaccagataactgactctcctggagaagaagtaagtggtctcttaataagcactgcttggtctcagaaccttagtactccctcaagcctgctcataaaacttactaagtcagccgggcatggtggctcacacctgtaatcacagcactttgggaggccgaggcagattacctgaggtcaggagtttgagagcagcctgggcaacatggcgaaaccttgtctctactcaaaatacaagaaaattagctgggtgtggtggcacatgcctgtaatcctagctacttgggaagctgaggcacgggaatcacttgaacctgggaggcagaggttgcagtgagctgagatcgcgccactgcactccacccagggcaacagagtgagactccgtctcaaaaaaaactaagtatctacgttccactttagcttatcttagcaaataagttcccagcctgtcacctattgttatattctttggttaaaaaaaaaaatgagtgttgaagatttaatgccccttctctattttcatctttgaataattgaattgtacttttctcttcatttaattcagaacttggccagtgttgtctcttacatgaacttttaaaaataggcttgaaatacaatgtaagacatataggatggatataggcatgtccacttggctatggtccaggcaggtctggctaacacaagcagaaacaagtggggtcagttggggtttcctaacagccctgccttatctaataagggaagtttctctgatcaaaagaaaataataagaagcaaaggtacaaacatattaagcagtagttagtttagtcaagcttacgattatcagagaattgtaaagaagatccactactggggtaggagaaaggagctgtagcctttttaatgacctagactctaggaaagttagaggaaataaaattcctttttcttctatttgtagaagaaaagtgctatgtcttagtacacagaggaaatttatagatttagatgagagatcttctttccctttatgtgcattgtatcttggcttttcccactatggtagcccttttttgtagttcttccctgggctttcaaaggactatttgaatgatctctaaccctagagttctaggtattaccttacaccattttggtgcataaatgtaccactgagttaaactaaaaggaattataattttcatatgcctaatcttgatggaaatggttttatatatttttaggctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaa

SEQ ID NO: 648 - DNA, 60060 bp, Homo sapiens
aaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtaagtgtaaaacaagcctgagcaaatatggagagggtttcttaatctctttattatctagataagctataaaagctactgtttactgataccgactcctagaatagatgacctagttttcaaatatcaccaagtcaagtaaaatgtaacatttttgtgttacagcattgaagaatatacacatacatgtgcaaacacatgactaactctgtaaccgagtgccagggccactcctactgcctaccacccatgtaatcttttataagtcattttctgtgatcttctctgtaaaatagggataacagtctctgctatgtgtttatcagaattgttatgaggagtaaatgaagtaatgtatataaaaagaacattagcacaaatgtaaagtcttttgtatggtggcattatatgcagaaattccttctaactcagctttagacataagacatttgctgattgaatatgtagcacaaacctgaactaatcatgtggaccccatttagatcacagctggagttcatgcaaactcagtaggtctacaaatttgaatgtgatagtccaaatatttcatcttttgttcttaaggataattcctagaattggctctattgatcacttctttggagagcttctccctttactgtaagggtgaggaacagtctactaaaatgtatgtcataaaataaacttagttaagcactgtaatacctttcaacttcctaccgaaataagctgccatggtagaggcagagaattattttagctgatggtgctttttgtgatttcaggtagacctgtttggtatagcagatttagcacatttactattgttcaaggaacacctacaggtcttctgggatgggtccttctggaaacttagccaaaatatttctgagtaagtattgatgaatgtcagggtctctgcctgtcccaataattttctgtttctcttgggtgctatctctgctttggcagccttagttttttaatccaaatgccatggttccagtagtttcagccagttttcattagagtatcagcagagcagctagtgcaggaaaaaggaactgcttactaaaaataagattcaaaactattcagacttcaggacatcattctgaatctagctgtatcttccagactacagctatagtatggaagcttccctgtttagatatgtgaaaagaagcatttcatgagaataattttctaactaattggtgttagccttaaattcctttttctttatttatttattttttgagacggagtctcgctctgttgcccaggctggagtgcagtggcatgatctcggctcactgcaacctctgcctcccaggttcaagtgattctcctgcttcagcctcctgagtagctgggattacaggcgtgcgccaccatgcctggctcatttttgtatttttagtagagatgcggtttcactacgttggccaggctgatctcgaactcctgaccttgtgatccgcccgcctcggcctcccaaagtgctaggattacaggtgtgagccaccgtgtctggcctaaattcctttttaatagcaattattaccaaaagttaataagcatcctttgaaaagacttacatttctaaactatatgctaattttaggctattttttatttaataagtggatagaaccaaaccagataactgactctcctggagaagaagtaagtggtctcttaataagcactgcttggtctcagaaccttagtactccctcaagcctgctcataaaacttactaagtcagccgggcatggtggctcacacctgtaatcacagcactttgggaggccgaggcagattacctgaggtcaggagtttgagagcagcctgggcaacatggcgaaaccttgtctctactcaaaatacaagaaaattagctgggtgtggtggcacatgcctgtaatcctagctacttgggaagctgaggcacgggaatcacttgaacctgggaggcagaggttgcagtgagctgagatcgcgccactgcactccacccagggcaacagagtgagactccgtctcaaaaaaaactaagtatctacgttccactttagcttatcttagcaaataagttcccagcctgtcacctattgttatattctttggttaaaaaaaaaaatgagtgttgaagatttaatgccccttctctattttcatctttgaataattgaattgtacttttctcttcatttaattcagaacttggccagtgttgtctcttacatgaacttttaaaaataggcttgaaatacaatgtaagacatataggatggatataggcatgtccacttggctatggtccaggcaggtctggctaacacaagcagaaacaagtggggtcagttggggtttcctaacagccctgccttatctaataagggaagtttctctgatcaaaagaaaataataagaagcaaaggtacaaacatattaagcagtagttagtttagtcaagcttacgattatcagagaattgtaaagaagatccactactggggtaggagaaaggagctgtagcctttttaatgacctagactctaggaaagttagaggaaataaaattcctttttcttctatttgtagaagaaaagtgctatgtcttagtacacagaggaaatttatagatttagatgagagatcttctttccctttatgtgcattgtatcttggcttttcccactatggtagcccttttttgtagttcttccctgggctttcaaaggactatttgaatgatctctaaccctagagttctaggtattaccttacaccattttggtgcataaatgtaccactgagttaaactaaaaggaattataattttcatatgcctaatcttgatggaaatggttttatatatttttaggctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaacatgtcatgtagtttttgcaaactaaaataacagatggcttaactttgcagagatgaactattttgccatggaaatttatatatcctagacttcgaattgttacaatagggttgtgatgagacagagtagccaactatttctttaggtgggtctgaccttccaataagtggtctagactgaaaagtaggtaagatgatatgcataagaccaaatatccttcaatttcaagtggcatgattgtatacatggcttatgttttaatgttttcacttttttggagacagggtgtcctctgttgcccaggctatagccttgatttcccaggctctggcaattttcccacctcagcctcccaagtagttgggagcacaggcgcacaccaccacatctggctaattttttgtatttttgtagagatgggatttcgccacagtgcccaggctggtctcaaactcctgggctcaagtgatctgcccacctcggctgcccaaagtgctgagattacaggcgtgagccaccatgcccggccctaatgctttcacttttatccaccaagctccttggtctatttatataatctagtggcactgctgctggggtcttttgattaggaatgtgactgttagaaagtaaaagcaaatgtgttaaacagggtttagcaacctttcagaaatggaataatcaccattctattacatgcagaatgacttggagggggcaagggtcagtgaaggaataaaaggaaattttgcttgaaagatttgaggaagcaggaggtcagaataaaacgataactttgaagtatgaaatagtttggaagagaataggcctagataaagtattggactcccaaagggaagcgtgaattacacctggcctcagggatagggaagaaaattggtagaaaaaggcaatgaaaattatccaactatcagccgggcaccgtgactcatgcctgtaatcccagcactttgggaggccaaggagggagattcatgtgagaccaggagtttgagagctgcccgggcaacaaagtgagccccatctctacaaaaaataaaaataaacataaattagttgggtgcagtggcacttgcctatagtcctagctgcttgggaagctgaggcgaaaggattgcttgagcctgggagttcaaggtttagtgagcatgattgcgccattgcactcttgctccgggcgacagaacaagactctgcctctaacaaaaaaaggaaagaaaattatctaattatctatttcatatctaaataccaaaattatctaatgttcctccttgctagtgccttattttttttttactctagttgtcactgttactgctctaagattgctggaaagcaaaaaatcctacgtatgtctcaactaaaaatatttaagcatatatagttgaagcactgcaacatgacttggatctgaaagataatcaacttagaaatatttgctcttaaccaaaatacagctctccaaacattctcacatttgcttcttatactgatgatgtaaaatgatatatctgtatcttttacataatcaagcccctctcctctctgctctcctcatttctcagttcactgtgttgacacatgaagttattactctgagactggacagaaaatttagatttattcttaatataggcttagctactatgtagtgaatagcaaccttgacagcaggctgctgtgaagtaaagctttgtttctggagtaggctgtgaggaaagggaggggaatctgaggaaactactttgttagagaacttgcatctgttttgccacccctcccttccattccaatctcttccaaccccagccctttgtagagaggagaaaagtttacctgaccatttaggacttacaattgtcttaggttttcagtttgcctaagcataaaaccacaaagtgagatcctttacatttcccttatattttatgcttatttgtcttgggagaaggaagcctttcctttttggcagaagtttcaaatggttcttatttcttgtctcactaaggcagtaatagcatagtgatggacctggttgggtagtgggggacagctgaaaaggcaggagttttacttttgtttgaaaagagaccacatcacatatagcatctcaccattcacaaagtgtacatccaccgatactactccactgttagagccttcgtcctcctatggcagtagtataagaaaccttccaccaagtcagagtgctctaactgatgccaaacctaaacctggaaataaagattttcctggagcagtaagacttcagactgttggttgagctattatctcaaggtagataagaaagcctttcagaaggtgagcacaaggttctttgaaataactcattggtgtctttaagctgaagcctttaagcaaagacagcaaagaaattgcatctgaaaatgaggaattcttccaactgcaccagttctttctaatgtgccaaaattagcttctaatttggctcctaaaataaaggtttccctagtgaggagaatgcatttaaaaaaattttttttgtaatatggcaaacttctaccttaacggggtccttggttctaccagagacataagaagctatgaatatttaataggacaaagatggcattttaagtcagtatgtgaaaagattatttaataactggtgttaaaacaatggattaggctgggtgtggtggctcgcacctgtaatcccaacactttgggaggctgaggcgggtggattacctgagtcaggagttcgtgaccagcctggccaacatagtgaaaccccgtctcttctaaaaatacaaaattagccatgcgtggtggtgcatgcctataatcccagctacttgggaggctgaggcaggagaatcgcttgaacccaggaggtggaggttgcagttagccaagatcatgccattgtactccaacctgggcaacaagagtgaaactctgtctcaaaaaaaaaaaaaaaaagaaaaaacaacccacaatggattaaagcttgaactctatctccattgacactactagttcatatagcaccttcgtgcaaattagaaaaggccccttcctttagtggattcagtacctcccaatgcaccataccttgactgaatttcagtccccacttaccccctcagcctggtacccttgtgcagcaaatacattgtgcagtcttatgcattgatcttgcctgtttcactgcttatccccaaaataattttggagaaatcagaaattttaatcaaaatacaatgtaatagatggttttgcaatcttttgcctgtgtgacataaaagcaagatataaaccagaagattgctattactatagtagataaaaaattaaatataggatggatacctatcctcccctccaaaaaaattaaaaccataaattcaaactaggaacatttactggcaacaaatatttacatctttttttgcctcgactcagggatcttgctttgtcgcccaggctgcaatgcagtggtaagaagatcaactcctggtttcaggcctcccaagtagctgggagtctcggtgcacgccaccacacctggctaatttttttaatctttagtagagacaaagtcttgctgtgttgtccaggcttgcatccactttcatctggtctcatgactctgttgttcctacccacctccagccaaatcagaaccctccaaagactttaccatggcctataagaccccaccctatctgaccccactctctctgacctcctcccggactcccctcttcctcacccacactgctgtaggcggcctccttgttgcttctcaaatgtgccaactaatttccctctccctctctttaaagccttttggcttttaaggccagttgttttttggccttgttttccttgatcttcatgtaaattactccctttcttcctttcaggtaggtgtcttctccaatctccactctatcagagaggctgtccctgaccattctgtacactgcacagaatagcatcccatcccacacacactgctatcactttctatccctttttaccctcctttatttttctattgcacctgtcaccgcctcgtgcgtgtgtctgtgttgtgtgtgtgcgtgtatacatacacttttttttctttatctctctactagaatttaaactccttaagggtggggattttctttgtttcctgtttgactgcactgtctagaacagtgcctgaatgaataaaactgttttacctaaagtacaaaaaactcttaaaaataaaaaattgataaaagaaacaaaggacatgaacaatccactaaaacattttaatggctcatatacatgagatgttcattcctaattaaataaaatgcaaaataaatgagaaattgtcatacactctaaatggttgaaaattgtatttgtaaggatgataagaaacaggcattcatatattattaattgggatgcagattggtacattattagaagttgatttggcaaaagtcacttaaatattccctttagctgagaaattttcctaagaatttatctcacaaaagcattgacacaggagctcagagaaagcactgtttctaacacttgtcctgtctgcttccaagactcgacagtccccagagggataatccacgtgacagaccccaggaaggtagtgcttgcactagtgcagaggcgctggcaagccatctctgtaggcttcagggtgcctcaccattggcagggaacgcccttccaatttgccatgagcccttgtagatggcagaacctgagagataggcagacattttcagcctatgtagggaaaaaagccgtggggaaaaagtgattgcctttggtggggagagtgtatgggagtggagagaggaaagaatgaaggctcttacttttcaatttgtacatttataagcattttgaattttctgaccatgtacatgaattgcttttttaaaaaatgtactgggttaatctaggctaagaaattataggccatgtttttgccatcttttccctcctctatgttgtaaaaactaagccttgttaagtgttcgttttttaaaaaactgggactttggaaagctttattatctaaacatgaaagcaaggttgatatggaattcaaatgaaagtaaaaataattttaaatcattgaagataatatatctgagcttttatttttagtatatgaaaattcatgtttaaatgttttatactgttctattagagatatgctttgtaacattaccatcttcctactattacaacttcctatgtctgtgaacaaattatgtatcaaattatgtaaagtccaactcttttcaacacaaaatacattttttatggctttcatataaaaacttgagttttcacaaagtgatgtatgtttaagaaaagaacaaacagtgatgaacttaggctaaacttctatagacatgtgctttttttccatcaaaacatattacttccaataatcttgctccttagaggcttgtgcggcaaacctttgacttatgaatagtatcatcctgtaaattcatgttagcctttccataggaaattgtggttgtcctgtcaaactgctagtttttaagccccttgtgagcaggggactatgtgtctattaattttatatactcccagaaatgagctcatgggtcttaaaaataagtagtgaattaaaatattggaaaagagcagccacaagttcagaaagtagttacattggcaccttggtgagagggaaagatatctgagtgagtctctagatgtagctgaaggtgtaatctcactttcatttttagtatgccactttatacatgtttctttaacatgtaataattgactgctgaccttacattgcaatacacttcactgtcctgtttacacctttttcaattaaatgttattttcacaagtatattccactgaaatgtgtactgtatttcctattaaattgcatcagtcttgaaattaaagtgaggatggcatttcataaaaaaataccagttaaaatctgtggacaaaaagatatgcattttatttgttttcttttttaaaactttttttttttttttggcattttaaagcctagctgtcttcccacccccccgcatccccccaccaagagatggggtttcaccatgttgcccaggctggtctcgaactcctgagctcaagcagtttgcccaccttggcctcccgaaatgctgggactacaggcatgagccaccgtgcctggcccttatttgtttccttttgcattttaaacaaaattgaaaaatctgataaccctagaacaaagtgataacacaatttaaaaagatgacaagcatgaagcttcagtgatattgtctcattcaaggaaatgatagctaagggtgaatgagtgtgcagtgagtccagagtcccagcgagtccagggggtcaggctggcagaaatatgagtgaggcagagtagacaaaagctaactagcgtggccaggagagaccttttcagaccaactgtaccccatcactgaacagatataaaagccattgcttaggactcactcagaccggcatgttcaatatcctagcatatggaccagtggttgaggttccatggtataggccattgggggcagctgcatagctcctccctgtaccattcctctgctccattttattatgtattgcgttggacttgtctctatgtatggccttacctctccaactcatatgagtttgttgggggcaagttttttttttttttttttttgagatggagtttcactcttgttgcccaggctggagtgcaatggcgcaatctcggttcactgcaacctccgccttctaggttcaagtgattctcctgcctcagcctcctgagcagctgggattataggcatccaccaacatgcccaactaattttgtatttttagtagaggcagggttctccacattggtcaggctggtcttgaactcccgacctcaagtgatccacccccgtcagcctcccaaagtgctgggattacaggcgtgagccactgcacccggccagcaagttctctttttatgccctggttaggacttcagtatagtgctcacattataaggggttgactttacaggcccaaggtctgcttagaaccttctcagcattgagatggctctctgcctatggtaccaaagcaaacactagcatggtggctagaaattctgcctttagccagaatatctggacttgaatcctagctgtgtagcagtggacaagttaacctctctgagccagtgtcatctataaaatgaggataactgaagtgcctactttacggagtattgagaactgaagctttaagtacgcatacttgtagatgtttgtattgatttagttctaatgtttaatggcctaaggttctctggaaacctctcaagtaatttgagatctcagctggttgatcggagccttactatcttttgacttaatgtgcacagtgtagctaaacctgtgatataataaaggtaagtgaaacatgtagtattctgtaatttagagataagggaaaattagttgtttctatcaggataagtttcagggaaccaaatatttgtacttaaagagatagtccttaagatcagccaaataccaaggtatcaggaaagtccatccagtccccattctcattccacaaggccgtttcagcccagaggacctctggcttgcagctgggctgcttctgtgccatgttcagagtgcagagatctttaaaaggctgacttgggtcctgtttgctccaaggtaccaggcagggtcttgctgcccaccagccacttacaggtgcatctcagtcttcccctctccaaccaggagaaatggctttctagcttaggggcatggcctactgatcccatttaaggcatctagtcccttcctgagactcttgttgctagagcatctagccacacaacaatgttgcggtcaacagtgaacctcatatctgactgtggtctcataagatataataccaaaaatttactgtaccttttctatgtttaaatatgtttactttttacttttattattttttgagacaaggtctcactctgttgcaggctggagtgtggtgacatgatcagagctcacttcagctccatcttctaggcttaagcgattctcccacctaagcctcccaagtagctgggactacaggtgtgtgctaccacacctggctaactttctttttttaaaattagagacggtgtttcacaatgttgcctaggcgggtctcaaactcctgaactcaagggatcctcccacctcggcctcccaaagtgctggtattacaggtatgagcaactgcctgcagcctaaatatgtttagatacacaaatgcatacctttgtgtcacaactgcctactgtattcagtacagtaacgtgctgtgcaggttgtagcctaggggcaagaggctacaccatatagtctaggtgtgtagtaggtttagaccatctaagtttgtgtaactacactctgatgtttgcacaatgaaactacctaacaacgcatttctcagaatgtatctctctcattaagctagtatctgtcattaagcaatgcacgactgtatttctattttatgctctcctacatccctcacctgagccaatgaataaaaggcgatcacttgcttaataggaaaaaggaaaggggaaaataataggaagccctgtgaactcaattcaggaactggaaaacctgggctcaacagctgcttagattaggtcactgcctttgcttgcccatctaaactattactgatggctcctaccccaaagggttcttatgagaatgaacacaagacaggaggtgagcatggaagttccttggcttagaacaagcagtgtctgcttccccagcatccagcccagggcaaggcacatgggaggcagtaggagctggtgcaaaccactggtgaatctaagccactgttgagagagatgcctgacattcttattcactcaggcctgcagctgcaacctgttgactcctgttttactctttgttgaacacagaaatgtgttcatttttgccctccagggcagcaaataatatcttggaatgtggcaaaaaagataagcccctatatattaagttttactgtggcctccacagtgatgatggataccacgaagaatataacaaaatgtaaggcatgctcactcccttcagagagcttataatttggagaaacaggccacaacactttttttttttttttttttttttttttgagacggagtctcgctctgtcgcccaggctggagtgcagtggcgcgatctcggctcactgcaagctctgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaggccacaacacttaaaagccaagataatatatgagagaaataagtcagtcaaaaacggacatctcgagggaagccatgagcagtagctgatggagtggagcggtgtatatgttagactgaactaagggctagtgtggcatgataggggctggagctggcttatattaggtagttttcagctgcagaaaaacccagaagaacaaccaaaatatcttaagtggtaagaatatctgttatttcacataacagcaaacctggagctcagaagttcatgcggggcccaagttgtttccacctgcctattcctccgtcctcagcatgctggcttttgtcctcgagctggttcccttgtgggtctcagttggctaccacagttccaagttcctgaacaacttggagcagcataagaaaactttctcccaaaaccctcccagctggcttcctcgcgtgtctcttggccagattgtcacatatgtgagcctacaccaatccctggcaaagggaagggcgttaccaagattggtttaaacttaagattcacccctaagggctggggctggggaggggcctttcgctgggtacacagttaggagaggagtgtacattctaataaattgggtttcttccagcaagggtggtgagatggatttagaaaggcaaccaagctgggcatggtggttcacacctgtaatcccagctactcacgaggctgaggtgggaggatcagttgatcccaggagtttgaggttactgtgagctatgatggcaccaatacactccagcctgtgtgacagagaaagacctcattttttattttattttttcttaaaaagcaagcaagtgtctgctatataggtaatgttgttgggaaggagaaaggaaggatttggtaacacaatagcatcctaaactctgaaacggatcgcctgggttcaaacccatgtcttgtcatttaatgacctgagtaagtaagttaacaccacaatgccttagttgcatcatctctgaaatgggattataatggttcctacccagattataaatttcatggggacagggtctcatcttgctcactgagttctccccagcacctagcagaaagcattgtacctagcaggtactcggtagatatttgttgaatgggttaattgtattgtgaggattaaatgagttagtgtatggcaagggttcagcacagcacataatctaaagtatgtgctcaaaaaaatagtgtttcactgcaggctttgtagagacctttggaaccctctttgagtggtccccaatctttctggcaccagggaccagtcgcatgaaagacagtttttccacagatgggggatggtgggggatggtttcggggtgaaactaaattctcaacctagatcccttgcatgcgtagttcacaatagtgttcgcatgcctatgaaaatctaatgccccttgcaggaggcagagctcaggcagtaatgcatgcttgcctgctgctcacctcctactatgcagcccggttcctatcaggccacagaccagtaccagtccacagcccaggggctggggacccctggggtgtcttctggctcctttgcactacctatgccaccaggcttagcagcagtcctagaaacaggtgtatcaagaagactctgctcctggtgggctggggctgagatggcagaggcccatcccatcatatgccagaaagaggacacacttgtgagtccaggacttgggactctacagtttgcagctctgctcagactggcttctgggcagctcctcactttgccattaactcctcagagtcaagccccagatgccccttggaccagccccactcctaaggtcatctggtcagggtctgcaggggtgacgctttcactgacaaaaggattttaattttggtcctatccctagtgtagtcccagccagtctttggtagtcacccacttttcctgctctgacagagatgggccagcccctcccataggggctgctcccgggaaaggctcatccacaggctaggcctctgccgggcctgctgccagccactgagcctttggcgattgagagctgactcccgactgaggtgtaggcctccgtccagccagcacaaagggaggcacatcccttgcagcagtacccacagcccctgtcacggcaggctgtggccagaccctgattgagtggctccctctcagccatctgttcagtcacccagaaacaagtcaagtcaaagctcccagtgagttcctgcctcagccatttggtgtcacaaggaaagccagggcgttgccacttcctgatttgggacaagatgtgtaaatgcattgagcctcagactccttatctgtagaacttggggtaatgataactacttcatggtgttttaagaattccatggaatcacagatggaaagagcctagatgtactatgcctgactcgttggagacttcacataaaagggttttcagctgctgccacccccatcttttaagtattttcacaattccatacacctgttcctggcaaaaagaatttcattccctgttcacttacttgaaaacccctcttcttttttttcgagagagagggtctcactgtgttgcccaggctggagtgcaatggccaaatctcagctcactgcagcctcaacctcccacgtagatgggactacagatgtgcaccaccatgcctggctaattttattttttgtgagacgaggtctgttgcccaggctggagtgcaatggccaaatctcagctcactgcagcctcaacctcccaagtagatgggactacagatgtgcaccaccatgcctggctaattttattttttgtgagacgaggtctcactgttgcctaggctggtctcgaattcctggactccagcaatcctcccgccttggcctcccaaagtgccaggattaaggcacgagccaccacgcccagcctgaaaacccgttttcctgagggaaaactgttctggaagtcaacagcagagtcgcttgccagggccacttctaatattgatgagattctggcctgtgctcccctccctcatatcttgtgtagcattgtgactagagattgggtaaaaagggaagaccttgccaaatgttgcccacctgctaccctctccggctgtctgctgacgttggccacttgagtctcttgtcactgactgtgcccacccttggcccctgccagcatcctccacacaccttgcccacaggaggacagctggagcagggccacaggggagggcatgcaagggacctatctgacaaggccctgaaacttccttcccactgaggaccccaggacttgacctagtcatcccccactttgctgccaatactttgggagcaggcagatgtccaggaagcgtctgttcctctgtaccctccctgccaaggaaggagcttgagaaaaatctcttgaaggtagagcccctgcttctggcctagctctcccggaggcgcagggctgacgagtgccgccaaggtaagaccagctctggagtgtgggatatacaggccttcagtggcaacacctgctcattaatcaagcccttcctttccggaacctgccctggcttgggatggtgggaaggaaggagaacagaatctgttcctcccttcctggccctgcggtgagaggcgctgactagtgtaggtgggtggagacaggcccatcagaaggcctgagtgaggcaccctctgtacatgcagcacaagcgggtgtggagtgtggggaagcatctaaagatctagaaaaatttggcagcaaaggaattttacccacacactggagccctaggctttgtttctaaaagtttttattattctttaggaaaacttgggaagcactagtttatgaaaatttttagaacttcattgctacatggcctttccaaacacatccccagatggtttctttaaaaccatgcagtgggacaaggttgatataaacagttgttccagctgaatccaactcaccaaaacggtgcaggtgaggcaaattacttttgagactgcaagtactgtatatgtccattaacaaaaacacagtaaaagactttaagaaattgtaaggacactggcttgactgattcatgcggctgcaaatccctgggagccaagattcaaaggcagaaatgtctgtggtgacagcaccaccactgcctttgtccaaattacagatctgtcacactcagagcttgctgctagcatggggctgccgtcggcagcaaagggaacttcatggatctgtgaggaggaacagctgagttcctgactgcctttaattttctctgaggctttgctgagtcacctaatctcttggggctgtggttttctcacctgtagaaggagggacagggctgatatccctagagtgcctttcagctctgggattcacgcattctaaggagggtggctagagcacagaacctctaaagatgttcattcattccttcaacaaagtttacatgagcacctgccatgtgctaagcaccagggccgaccactggcccaaaaacacaggcatctgctggcctgcccactgcagcagcagccatacctttgcaggccggtggagcccccctttctacagcctgtggaaaaaatggttctaaatttgcagatcctctcatcaaatcaggaagtcaagaaacatgatagaatagaggaactggtctcagtttgcacaggccatcagtttcacaagacaggaatcgaatatcaacagtggctgattatcacactcaggaattgaaaataattagaaaaagaggcaaagatgctgtggcaatcattggctggtcccctttggtctccagcacccattcccctttggtttagtaacagcaccctaactttcctccctatatcgtgtgataacagaagcactctctccaggataccctccctgagagacaggcatatgacctgagccagccaatcagactccttccctgcaaggatgcactaggtggacagcatggtgggagcatctctcatccaggcaggggtgatctgtgggactgcagtcagtcctgttgcttagagaccccaggactgccatagcttctgtcctggacttgattctccaggctaacagagaacctgactgatgcagattcaggagagctggtttgtttagttctcagttcctttcatgaaatggctattatctctgctagctactatagcagaaatctggaaaacatgatttttcttgatttatgaaattgttgatgtttcttcaggaatttccgcctgcttctcataaactggcagaaacttagaaatgttacatttcttaaagagagtcattgtaattattatctgaataagatgatagtgttttgaatttaacgtaataaactctatctcctgccttagtgccttcacatcttcatgttgcccctccctctaacaacatttctgaaaatttgaaagacatgaaggaagaaaaagtgttttccatatccccacattgccttaaagtggactttgcagaggaaaatgttcaaatatacaagttttaggtactcttcatagctcttggttttctattattagggtttgtttgtttgtttgtttgtttgttttgagactgagtctcgctctgttgcccaggctggaatgcaatggcacagtctgctcactgcaatctccacctcccgggttcgagcaattctccgcctcagcctcctgagtagctgagattacaggtgcccaccaccacacccagctaatttttgtattcttagtagagacggggtttcgccatgttggccaggctggtctcgaactcctgacgtcaggtgatccacccacctcggcctcccaaagtgctgggattacaggcgtgtgccactgcgtctggcctattattagttttaaaaacatacattcctttatttttacttttgtattgtttaaatacaacagtacatgttcactgaaacaatgcaagagtgtaaaaagtccaaagtgaaagacccctctcaccaccactcctatttccaaggataaccacattgacagtttgcggtttaaacatacagatatagaaatatctttaaataaaaaaacttatatgagattatgccatctcattttcaagttaacattgataaacctggtctttttgctcaactatcgtggtcatccttcctcatacatacgtatgtacatgcataccggtacacacatagctggtacatacataccgactgacaaaactcattcattttaaggctgcagatacttcattgcatggggatgtaccatcctgtatagatctgtcacccaattaatctgcccaattgatgcacattttggtggcttcaaattctttgcagttacaaacagtgctaccatgaatattcttatacaaatatcttcaggccgatgtgcaactatttcttaacttggattcctagaagtgcatttgctggatcaagtacatacacattttgaaattttggtcaagactgtaaaattgccctccaagaagactgtaccaattcactctcccacctgccatttttttttcactgtataatgacagggagtggtatatcccttttgttttagtttgcatttcctggatcattccttagtgagacagagcagaagtggattatttataagtttacacacaaaattacattgagatacaaaaagaagaaaaatacagagttcctctccaaaaggaactgataacctagttaaagggaaaatgtttcatattgaccacaaattgaactttttttttcttttgagacagagtctcgctctgtcgcgcaggctgaagtgcagtggcacaatcttggctcactgcaacctccgcctcccgggttcaagcaattctcctgcctcagcctcccaagtagctgggattacaggcatgtgccaccacgcccagctaatttttgtatttttagtggaatgaggtttcaccatgttggccaggctggtctcaatctcttgacctcatggtccacccgcctcagcctctcaaagtgctgggattacaggcgtgagccactgtgcctggccacaaattgaaattcttatgtttaatgccatgacatctaacactgcgttcaatcaaaatgtctacgcatgcagcttgagacctttgcacagaaggtgcctagggtcatgatttgggaagattaatctgccatcagtggaggggtggataaaaactaatgtttattgggatcaagatgagcagtctctgtgccagaaactttattcctttaatttccacagccctgtgaggcaggtgaaatcatccccattttatggatgaggaaattgaagttcaattggttcaataacatgccaaaggtcactcaactgatgaacagtggagctgagatgcggaagactgaagactcacagcctggacttttaaccaaacaccacatggcttcgctacagaagaaagttagaaagttttcaaaaataaaatgtagagccaagtgccaccttggatataagggactgggggacgggaagaggcaagaactcccaggcttccctctggctgtcaatagctagtgggtcctggcagtgggagctgggccatcagaggtggcgcctgaagtggggcaggcacaaaatgggttttcgggcaagcatttgcccaggtgatggtcaaagccacagaaaaaaggtgttttgatggagtggtggctgagtgtggggagagatgagcaggggaccaagcctggagcttgggcagcccacgattggacactaggagaagaaaagaagccagtggaggagacactgaggctagggatggggagggcactgtggaaggctgggctccacctggcgctccggggagctggcaggggggcacatcaaggagctcaagctgcctcaccagcaaatgcctctgtttctgaccaggggcaatgaaataaagggacccggttgagtaactggtttctggtccctgccagcccaggaagccagcacccaccctgccttacatcccatgtgccactctcagccttcgaagcaaaaccagctgagaccagcacctgccagatctgaatgcgcagctccaagttctggggggtgggggtgggggtgagccaaggaggtctggcttctctagggcaagggtaggaaggacagcagggaggctcaccctgagcccggcaggcagcccttcctcctcctccccttcagcaaagaaaggcagataaaaacgtgtttttataaatagctccagccccagctgatttgtaaattcagtgggttttttgtgtcaatgacatcaccttcctccccatggcaacccccgacgatatcaaaattgccaagcaacgttggagcagctcggcgccccaaacgagcaggtcgatgcctgaggatttaatggagaaatcccaaagtgagccggggcgcgcggtggaggaggggcgcgccgcagccggggccgctgggccctgatgggcgggagcggggtggagcggcctcgcctgccaggcagccctgggcgcggggctcggcggccacactctggagacagccacggtccaggcaggtgggggagggcgctgctcccgtcctgatgtgccaggagccgccagcagccatccaggtgactaagccggcccactagcactgagtcaccgcccgcctcgagctgttcttgcttctcctttgcatctgattattttgggagctggaaacttggagctgcacctgagtcccgccccttctagctctcccctccctaccttgggctccaggaagatgggacttgctgtgagtctgctgccaccccctaaagatatggaagacgctgtgggggccagaagtgcccggggggctgtggcagcaggcagagtgcaatagcagatatggtggtcaggctgcctgtgtgtgtcctctggaggtgttgggacagaagggcagtcttgtccgagctgactggagtcctcccgggctggctctgaactcatctcccacggggatgtttcggtaaaggagtggcttctggggtcggagtggcatttggagagcgaggctggattggcttaggctggcctgggcaggtaggtggctctgtgttgggtgtggacccacgtgtgtgtgagtgcgagagtgtgtaagccagtgtgtgtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccaggtaggaagccgtccggaggggctggccagggtgagagcccatcactggggggctggacagcccatcagctgccccttcattctggcaggcctgggtaccaaggaaacagcttcctaccaagaaccatgtcactctcttatgcagggccagtcagcacccatgtgcgtctctgctgagctcacagggacacattcagtgagaagggtgctggccagggtacggcttccccatgatcaggacccagcgggtgccaccctcaagcccctggtccccacagggcatgccccagtgtgtgtcaggaggaggggggaggtcccttctcccccacacagctggcagctttgcgggcaccagtgagtaagctgccagagggagggaggctgtgtgcccacagtggcaggacaataccaaccaggagccttcaagagaagaggctgggtgagaaaagcactgaggttttcttttcctttttttttttttttttttttctattttgcctgaagggagtgccgcttcctgggctagagacaagcaccagcctgcagtggagaacgcaggaccccgctgcccagaaggagcagccacggtaaggtccccactgccgctgcgtgctccggattcctgggctagggacgggggtgccaaggtgtccaggctgcctcccacctgggacagggaggctaactccacagctgtgggttcctgggtcaaggggctccactccccacccggcctgccaccttctttccagattgattgtgaaacagtccaatcccagctggtctctggctccctagctagagggagaggtgcttgtttctactcttcctgccccagctgggccaagccagtgccaccgggacacccctatccaaggcccctctcactttaccacctctgggacatttcccttgtgtattcattccacaaatatttagggagcactgctgggtcccaggctccaagtcacaccctttggctgggtttgacctggcacagattctgactctgaaactcagcatcagggcaggttcagggagctgcctggccaagcacggtcactcctcacaggccttggtctccccacccctgctgcagggtggatgacctggtcagctttggggacatcgggcccagtgagctcgggtttataaagcactgggccccaccgggaagcaaggctaacgtcttgtggtctccagttatcctttccctggcattgtacaccaagaggtttgtgccgttctgcctggggtcttcctgaggctggttctggtgggaactgggctgcaggaggagaggatgagcttaggagccgtgtggcccccaggcctggtgggcctgggactcagccccacgggagctcatctagctggggttgaggcctttggggcaagcaaggagtcccctctgcaggcaggcttccctggcggttgtcctggcccaggcttggaggtggcacctgggagccctagtgacagagcgcctggtcagggaagggtcggcaccagaggcaagcccttctgggagcagctgatttggatggaagctctgtgcacctgagagggggagtgtggggactgcacggcctctccagtgccccgaggacaaactgatgctttgtgagtgctctgggccctcccggacttgccagacacagggagggtgcagtgggtggggtctccagccaaggaaagcccgctctgtgcacaactcctaaggatgaccaaaaagtcccctgccctggaggagcacatgtgctcagagtcaggaggaacccataagtgtctctcatgccagtgaattcccacacctggctcctggatgaggagaatgacccagctgtgggggtatctcatgctgcctcacaaaaggtgactctgtgcctaggagtcttccatgcatgcagagctgagcaggggctgctgcccagttggggtcagaggggcggaggctgtcgagcactaggtagacagcaggccagcagcgggcagcaggttgggccaggagggagcagagagtaggggccagggcaggctgagcaggaaaggaaaaggctgcctggggtcctgagggctcagggaggactccagacagctggccttcttatgccagcccgcttctgtgggagaggccctctgcgtaggtgactgggcagggaagaggctaagacactgaaagattgaattcctcacccaaatggcccagagatgcccaccgcacacagtgtcctgggtgcagaaggcaggaaggactcatgggaggctgtcctgtggactgaagcagaaagtccttcccgtaagatgcgctcgtcgccctgagcaggaaggcccaggctgcggaagcagtgcctgagacctgagcagcaggaaggacaccagtaaagctcatcaggaggcatctggccgcctgcacctaccgggcctcaaggagagagcttatttctgggagcctccttggtagaaagaggtggactagccagcaggttggggaggagcattgcaaatggaagcttctgagggcagaatgagttctgaacttgctgaagccaaggctggccctcctgcccagggcgagcagtctgcctgggcctgggaagttgtccccttctgaggaggtgccctccaccccaccagagctcagccctaggggccaggaagggctaaagcgagaagagtgagatgtgagataaaggggaccgtgtctcttcctgggagggtgtggggtccaggcagcaccttgttctggcgcacaggctgccaagcagatgacagccatggcctgactactaggtgcaagcactggtggcaggaagagggggtggacaaagcaggacagagctcttgccctggggatgctcatagccctgcagcagagcagtggaaaggaaagctgagctgagcgtggggccaaccgcgccagaaacaagcggagccacaaagccaccatcagcccccaggtggcttcgtccttttgccaactctgggtccaactcatcgctgaagttggcagccatgacccatccagcccagataatttataaatttacaccaatactgggcaacggttcttaacatagaactttataaagatggacaaaaaagataagttgagaatgacaaacaaaggaagaagcagcttctatctgcagttgcaggaggaggtgaaggctcggggagatagaccagggcgggaagaggcaggatggtggttggttaacatgaagtcagcagcatgagcctcaggcccggtgctgcctcttcctggtgactcgggcaagttacttcatgtctctgggtctcaatttcctctcctgtccaacagagataattatagtacctatgagttagggttgttgagaggattaaataagataataagtgaatgctctgaatggcatgactggcacatacgtacatgttcagcaagagataactattatcaccgtgatgataactggtgtcagaggaacaaagtgccaggagagaccataccttgttcgggggaatcaggaaaggcttcacggaggaggtgactttgaaagaaccctcctctgaggagaaacaaaagctctcagaatgcccaggaaagctgggaagaaacaataatgccaggtctatttttttcccaaatagcatattgtttgtccactgaggctttctaaggaataacttgagactcctctttctggggtctagacttggaggtcttgaggacttgaagtgggctgcccctagtgaagggatcgagagccgggctgtggccctggccctactccttttggggactggaagcttttttcacatgctggtcctaactgcatgaggaactgtgttctgctgagccccatctaaagcatacacttggtgatgtggcaggcagaggggccagacaaggccacggcaggctcctggatcactctggcaagtagcttagaaatgcctagtaatcgtgggcaaggtgcagtggctcacgcctgtaatcccagcactttgggaggctgaggtaggcagatcacaagatcaagagatccagaccatcctggccaacatggtgaaccccgtctctactaaaaaatacaaaaaattagctggacgtggtggcgcgtgcctgtagtcccagctacccgggaggctgaggcaggggaatcgcttgaacccaggaggcggaggttgtagtgagctgggatcgtgccactgcactccagcctggccacagagcaagactctgtctcaaaaaaaaaaaaaaaaggccagtaatcgtgaggttccatctcagagacttttgttttctctttttttctttttatttttttttttgagacagagtttcgctcttgttgcccaggctggagtgcagtggcacgatcttggctctctgcaacctccgcctccctggttcaagcgattctcctgcctcagcctcccaagtaggtgggattacaagcacccaccaccatgcccggctgatttttgtatttttagtagagatggggtttcactatgttggccaggctagtctcgaactcctgacctcaggtgatccgccgacctcagcctcccaaagtgctgggattacagatgtgagccaccacacccagcctgctttttctacaaaggattatctgttctatgaatttaggaaaggtaatcctaaagcttattcacctaagaaaaacaaggcaaccccagagcatgacaggctttcttgggctgggggaactcacatgtgaaaaaacaggttccctcataactacatgagaggccgcaactgcctcagccccagcaaagggacacctctgctggccagcatttcctacaaaacctcatcacgacacatcaggcagggcagagacccaagtattcacatagggccagtgatgactttttttgacacctgtggattctccgtggcaacctattccccaaaagtgctgcctcggtcagccaatcccagtgtctctctgcctaggcaacaatctcttgtgctctggtctgcccacagcctccatgcactcagctctttgggcctcttgctaaggggctggaagcagagctgtgtccttcaggctgtcaaggacctggtgagggatcctctgggtgtccagggaagcaggttcagaaagctcagttcagctggtgctgtattttgatctctgatcccagtgcagcggggaccagcctactcaactcagtgcagatagcaacaaaccagtcaccttgcccaagacctcctgctgcctgcctgcctgcctggtgaccaggactcctaaaggctgcagcagcagcagcagagttaaaactttaaaaccgggaggactggttctgtggctcagcttcctggcctggagaggctctagcctccattttctttctttcagcttatggaattgtgcaagaaagcacagagggtggagggagcgaggggaccagttatgccacagcctcctgcaccaccagagcacagtctcagatcagcaaagaggagctctgaggaggaaaaggctgccccaggaaagagctggccatctcagattgctgtagcacattcaagccaaagggagtccccggaggatgtttcgtccagcccccataattttagagcgggaaacagaggtccagagaaggaaagtgggtcctgaggccacacagctaactaatggcagagtcagtttccagcccagggatccccagctgcctgcccagcactcttgctacccaggctgaacccccacccccgtgctaccaaggggcccatgcaggagcaggcagcagccactgggtaacttgatggcttgggagaggcggcctggcctgacacattgggaggctgggcaggtccccgctttgctcctattgtgctatttgggtgcctcctgccatccccctgcattctgctagacctgaaaccacagcccagcccacgcttgtcagtcaagtgcttcccgaggataaactttgcacacagcacccaggccactcttggggaccaggccactctctgttgaagagatctaactaatttataaattgattgattgaagttctttttgtcccaggtaacttcatgtcttaggccaaagaagggagtcatgatgagtgccagagatgaaacggagattctggggcaaagggtaggggaggcacctgggaggccctgttcttcaggtgatcttctcattagtgtagacttttgaccccaggcagacatttacatgtccaatagccaccatcagaggtcagttcccagaagcaggaggcctgtcacttgccaccggtcaccaggcccaagctagacaagaagactttttctattccactagagtggatcttgctgatgatgtgtctgggatccagaaaggtggggagaagtagaggtctcagctcctggggagggatggagccagccccgggggaagaatgcaaggccgccagtgagcaggcattcagggctcctgtcgaggagagggtggtcaggacaggaggaggggctgcctcatggatgatgaggtccatcatcctagcagaggctgttgtaccagccactgacgagggtgtggcagtggtgttaccagaaccctgctatgtcagcgttcaaatacatgtcccagcaggccaaccacccctgcagcagtcaaggggttctgtccggtgtgtgccagaatgctagggaagagaggaccctgagaaggatggcagcatggcacagacacgccatgtggcagttagacaggtcatgccttctgacccagggcacatgcagaggtccacagactctgaggccagctagttagtgttcccagggggctgcacagcccagagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaaaatgagtgtccttaccacagatctggctcttgctgttccccagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggcccagggtatcagcagggcacatctgtacagcagccgggcggggacccatggacttttccaaaacacctaaccaggccctagacagtgctaccccctggcgctgggctctctttccggaacccggggtgaacagacctgttgggttgatttagtagcaagtggtagccttgttttctggacgaatcctgggattctactccatggcacatcaaaccaagctccagtgtgcatgcccagggtcggggaggggagctttctccttggtcccttctgcagctgtgagggctgagggttaagaacctttcaccccgtttgggggtgctgctcctccatagccctgtaccccaatgctctagacttcattattccaccaccttccccagggcgggaggtactctttccattacatgcatcaggaaactgaggccagagacatgctgtaagtcttgcgaggcaagagggctcccgtccgcaggactccatggctctgcagctagactccgtcaacttccctcctgcctggggaccccaagggcctggcagtgtcagctccctcggctcacacttccagatgctcggaggttcagaggtttgcacctccctcttggtcccatcagcagagagagatgggtggtcccatcagggtgaggagcaggaagaagcaggtgctggacagcctggaggagagggggaggaagggattttctcccaagagtgcctctctcccaggcttcgggctccagggtgagtgggcagcgacccctctaggagccccagctccacagggctcctcctgccaagcatccagcacacgtgcccccacctccccggcaggtcctgcttgagggcctgaggcgactgggccatctgggtctgtgaagggcagatgtgggatgcaggaacttcaggcagggtgctggcttgtggccaggaaagcctagcacctgattcctagcagggaactcagtgacagagtgggggaacctgagggcccctctgcccctcacacccagtgccatgtgggggtcctcgcgtgttacacagaaataggaagggacggtcctcctacccgcaccccagccctcttgtgtctcacgtgacagcctgcctgggcagtgatttttttaaaacacaaatgccttatattaaggtctgagttggtctctccccactgcccgttcaaacattccatggcaccagcagcctctaagcagcagagttgagagaaccagctttggggtcggatacacttccgttcaaattccagctcctcccctcagtaactggcttacttagtctttctggactggataacaaaatactatggactggtggcttataaacaacagaaatttatttctcacagttctggaagctgagaagcccaagagcaaggtgctggcagatccggtgtctggtgagggcctgcttccaggttcagagctggctgtctttttgctataacctcacatgatggaaagggccagggatctctctgggggcctctttcataaaggcatgaatcccattcatgagggctctgctttcgtgacttaatcacctgccaacaaccccgcctcctaataccctcatattagtgattaggtttcaacagatgaatcttgggggacataggtttcaacagatgaatcttggggggacacaaacattcagtctatagcagtaattatgagaccttcatctgttctttaaccactccgagcctcagtttcctcatttgtaaaatgcgaataataattgtacaggacttccatcccagggttcttgtgaagactaagggaggtagcacaggtacatagctttgtacggggcctggcccacgggaagcatgccatcattggcagccattactatttctattattaggggagggctgagtcgcccagaggaaggagtctgaacggagtaaaagagcttgttagtcgccttcctcatccccagaaaacttttcaagtcatggagcagaaagatgcagggaagggataatgtgtttgtctttctaaaccacaagctgatccctatctttcctctttggccctagcccgagcactcagccctggctgttggcactcagatgttacaacaggccccgacagccacaggctgagggataaccgggaagtgcctgccccacccgatgtgcccaccttgctgccctcccagaccatactggcctgccaatgcctctgagatggcaccactccaagagccatgtccccctgtgaaatgtctgttttgggtgtctcttccagagatcctacccaatttgtagaatgggagtgcctggacaattccttcaaccagaaggtctgtgccagcagccaaggctcctcaaaggaggatgtgcctggagccccctgtgctcagcacggcaacctgggaacaaggccagagggtggcacatggatgctgcaggagacactgtccccagactgctcctgacacttcctgtgctgttgttctgccctttcctcctgggcagggctgagctgggcacggatcagaggagaatagagaagggggagagtcacacacaggaattaatcactcaggacctaccctgaatggatgattcagtgtgtatccccagctgtctcaatgtgtggggagaggggtggcaacggggcggatcgtgcaacccggtgcagctgaacctcatgtagacgagactggaagtgcagaaaactggcgttgtgatggacctgagggattccctagtctagtcttgtatccagttctctggcctacccaactgacggttattcttgaatacctccagtgatgggggactcattacctccttggtcagtctaacttgaccttctgcctctctcaaggccccaaacccactgtagctcccaaggggtgggaggaacccagggtttcctagagttattctctatagggtgaggatgggacttggctagtcgccattctagggtacctaagcctggattcaaaccaaattgaataccagttcatttctggtaataatctaacattcatactttattgtagttctgttcaaaagtactgcttggagctgtgatttgggtatataaggcatttgtagtcaaagaaaataattcacatatgcattcatgaatcagtaaaaataatttagggtgtcgattctaggttagacaatataatgctttcattctagctttggttcatggttcatttcaaatcctcagcaaccaatctctgccacctccacgcagcacattctgcttctgcagccagcattcgaccagtgtacccatgtccttgggtaacgaatctgtggggggagccattctggtatcacctggtccccctcccactgccccctcatccaaggcctagcagtcagcttcctgggtgaccacaggaggtcagagtttgtctaagcgggtcaggcctacagtattgtccactcagaggaaagagaaagaatccgcgtgggaaagacacaaagaggaggaggaggaggcgacagagtaaggggaggagaacagaaactaaatataaatatgtgttggggatgttggggatggcagcagggtatggttagctggctggctcccacaccactgtcccacagcacagagggccagcatctgcacctggcaccatgctttccctaggaaagccgagggcattgggcttgtggtgcagccacacagggtacagacctgtttgggactgtcaggttcccacgggttgcctgagctctattaggtgggcgccttagagtaaattgtgtgaaaccaatacagcctataatgcaaaagattgagccgtgagtagattgatgcgtctaaagaatcagtgaacaaaaataagtggccatagtgacctcagttaatcattgaagtctgaggtgcccaacaatgatttttaaaatccctgcactgtccttggtccccgctctgtgacactggcagtcacccagccaccacttgacggcagccatttggagtccacatgtactgagtttccaagccagaacttcctcagcactcagccagaacacagcctttctctgggggcccaagacaaggagagcaaaggtcttctcacttctttatctggggaagagatgagtgattcctgtcccttcccccagtatagaaaacaccctgtaccccaaaagaaacatggcacaggggcagccaggagtgagccccttggaatggccattctgatcttaggcagggactgctgaggacaagcagaggatgccgactctgggacaaaatcacaggcggaggggctccgaaacaggccctagccgctctgggggtgcgggtctcctgccctaggactctcaggctagaaagtcctcaggactcaggactgcgcaagggctgacaagggaactggaatcccttaaatcccgctttcctgcctgcgcaaggggctaccccagcacagtcttggggccctgtccacatgggacagatcatccaaggtgacaggttttccgactcccgcgtgggctctccaggatgtgtgggtgggcacacgcggcccgctcaggtccgggagagtcggcccgcggctctggagcgtgcatctgcgatgccagtgaacgaggtgattacacacagccggcgctcagctgattctccaggtcgggtctccgcgaggcggccactgggccgtggagccgcaggcaggtccccgcggctgtggccaggccagggcccggaggcgaagggcgggcgggaactggggccaagcaggtggagagaaagagttgagcagcacggcgcccctcgggcagaggggctcctggccaaggccccagcgacacttggcaacttctcccgcgctctgggttcgccgccgcgtcctacctgaggccacaccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggtgagtgagcgagcggcccccggccctagagccttctgcacccattttgaagagcaggcagggagggacagtgggcaggcaggtggccctcctgggctggctccttcctggtactgctaggcagcggaggtggtcccttccaggtgccgtctctcgatccttagtgggtgcatgttaagtcacttacaccactttgccccatggccccacggtaggctggtagacgtcaagacctcaaatggcccgccctgcccccgggcccatcttcaggtctgatgcctgtcctgggtgagggtgtcaccgcggcagagtgcagggaattcatgccggggaagaggttcccaaacaggaagggtggtggcaggcccagtggctgtgcagggcagggtgggaggcagccgtgggagactcccgcaggagttacaggtgaagctgccgctccacacatcccagcccaccgctcattccccagatctccagacctgctcaggtggcatccgatctggagtgtaggtgctgctgggagcactggaggctaagccatgaagagctcccagggtgtaggttgcgttttctgtatcttgccccattctggtggttttttgggggcttttctgacttgtttttctgggtgaagggggcagaggggctcaggtctgtgtccatgctcgtttttggtggccggtgtggcataggttgccgcattggataagaaaacgcctggttccatgcaaggtgaggttcagcctgcagtgccatgaattctcctccatagtatataggacagtggccgaagacacatttggaaccgaagagagtggggtttgaatctatccagactttgcctttgactccttagacaagttgcttcacttctctacaaacttataaatggcctcatctgtaaaatgggaatgcgaatgccttcctcctcattaggcggttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatgttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcagtagctacaattagccattagatgtactaataaaaagcacctagcacagtctatccatgtggtgggcactttataagcatacctttcttttcttgcctcctccttctctctccagctccctgctgtctttaaaatgggcccaggaaagcaggttcagcccaactcacaatggtgttgtgagtgtaaagttgtgagtgttaaggaggtgaaatagaggtctggaaagttaagagctgtagaaaaaaaggcaatcttgtgattagggatgccagaggttccttctgcttagcatagggttccaatgccagaggttccaatgcttagcatagggtcctagctaggcattgaggaccctatgctaaggactcagacctctgtgtgcagaggctgttgagaatctagggtaggccgggcgcggtggctcacgcctgttgacacaagtgactgaatgagctgtattactgtattcttttaaacagcagcccattatctctcccctggggattcactggggccagtggtatgggaatagtgacaaaggcagagagcccaaacattttggcaggttgcatgtcatgctgtctgccctggcccatgctgcatctgtctgggtccctcaagtgggacagcagagcctcagggtcctgctcatcctcccagggcctctccgcacttcagcacactgaccctgagcaggttgtttgaatcttgtgggcatccacatgagggccacaacctgcgtctaggaccctcctcccccgcaggtgacagctgagcagaaaagcagatgaaatttccttcccccgtgtattttgggagccaggatagggtgctggggtgccacctctcctgactctcaagtcacgtgaagaggagcagatggcagactcggaccccagtagaggctgaggtgagacagagttcagctccacacaaggatcagcgaggggacagaggggacagaaggcaggggctgcagggggagcttttcatcgctgaatgagttctagcagagtgcgggcagcctcctgttgggaatgccagagggactgaactttgggccaaggggaaggtcagaccccgtcaggagtgccacagatcctgcactaccatctcttctggctgcagaaggttggcctagagcaacacctgtttggaagaagcaaactaaaccacacaggagtgaggatttcctctcgtttaccatggtccccagagcctggagtagagtaggtccataatagatactttctgaataaaggaatactataatttcccagctgggcacggtggtatgctcctctagtcctgaccactcaagcgactgaggtgggagggtgggttgaggccagacgttcgaggctgcagtaagctctgatcgcgccactgcatttcagcctgggcgactgagtgagactctgtctctaaaaaaaaattttttttttgaaacaaacttctgaaagtaaagtttgagaaaaatccttctggccaatgagaatattccagtgaaaggctgtcttctgttcgcggtaattctcagccaaggggtcaggtgaggcctgtcacctgtcagaatgtgtgtgggatgacagttcccaaagggggttacaaagaggtcaagaaaccctgctgcaggtctcagcatgtcagggcccagccctggaggtgacagggtcctctggaggccactctgacaggttggtgatggtagtagagtgctttcctaagttttgtagcactcggggctcacctctgtcttggggctgtgattctaggataggcccttccccagagtgtcttggatgggcctgagaataacagagggtggtggtaggagcagatggccactgcagccaagttcacatcaggtcctgggtcagactcgtgtctgccccttctttgcctctcggcttgaatgagtcacttagtctctccttctctgcataatggagacagtactagtgctacctcacaggcttgtggcgaggagatcacatgtgtgaaatgctcagcccagagcctgctacttccgtcttatgctaggctcttcctgagtgacgaccgtgagaaatatccaaagctcctccgtgagcaggaacagatgctccccctcactgtgcctggagaagctggcagaggtgaattaatccatcccttgtcatctacaaaaatgtcgaggcctacgtaaggcgagtaggccaaggtcacaagccgggacttaggaacaccaagcccaaggtccacgctgagccagcactcgggcttgtggcccaggacttgagccctggtaagcagaccctgagcctcactgtgagaaagcctgggcctgccgcccccctctcaccccctggcaccttgagcaacccaggagctggcccactaggcagcggcctcctctcttcccagtcgcccgcaaatggcagggaattccaccagcttcatttctaacagcttcccagcaatcccagcgcttacacagccagcccaacgctgacccctccgggtggctgcaaacccctttagactcactttctggaagccagcttcccagcctcagcgcgttcttgtgaatcccttcggtgggctgtgtcctttccttgaaagggactcagtatgcgcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaacggcaggcatcctctgtagtgccaccctgcatctgtggggccctgatggctctggtggccctggcatcccagggcctggcccatggatgtctcctctccagggaggagacgttgaggagggtggcccacccacagtgcagctgcttttctcatctgtggacactagaccagccaagcctcagtgccatgctctgggaatccccttgtctctgtggaacagtagcatccgccacaaaacttactcaccccctcctcaagccaagcctgtgggtcgcctggcttcaggctgagcccctacagaggggctgtggatgcatcctgtgctggacagaacacacgcctgctgtttctgtagcttttcctagatgccaggccctgaccatcacagcccccaccatgacctcttggaaacattttactcaccccttgctgagtggaaaaacacctggttccttgcaagataagggtcagcctgcaagttaggacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctgtggcctcaggcaagctattgaacctctttgagcctcatctggatttgtggataacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatcccccgatgcagtcatgcgttagccagcaggaagatgcctgcagacatccagaagagaaaagttcaaagcagtcctcacacacggcagtgcctttccagcctgaggtggaatcttcagtgtggcctccctcccctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcctggtgtcttcttggaggaaagctcctcccctagatgaattgcgtgcagatggagatgctagaggggcgacagtaacagctggcatggcctgtttgacttaaccttggggccccatggctggtgcagcagccacctccctcagcccagtggccttggagacatggatgggaaaaggagccctggaaatggcaagcggaggccctggctgaccgggtgggagtgctctgaggacacagcctgatgctggggagaggcagggcatgttttgtcctgggtgattcactcgcgatgactggggcaacactggtcccgttcaggtggatgaacgtctcttaggcactcagcctccatggatcactcttctctgtatttaaaaatattttgtttttggccggacgcggtggctcacgcctgtaatcccagcactttgggaggctgaaggcgggtggatcacctgaggtcaggagttcaagatcagcccagccaacatggtgaaaccctatctctactaaaaatacaaaaattagccggacgtggtggtgcacacctatagtctcagctacttgggaggctgaggcaggagaatcacttgaacctggaaggcagaggttgcagtgagccaagatcgcaccactgtactccagcctgggcaacagagtgaaacgctgtctcaaaaaaaaaaaaaaaaaaaaaaaattgtttttttttagagaagcaatccgtcgtctttaaggaaaacttagaaaaagagtagaaagatagaatagaaggagatcacctgtagccccaccaggtaaatgggacaactaatatgttgatgtatttccttcaaatagccattgtattcacactgcattgacaaattaccattggcaaaatctttaaaaaccccctacccctaatctatatcatcaagaattccactttcgccaaagtaaaccttgatagtttaatttgtgtctgggacccatgactgtggacaggtttaggccccagcaggtcgtgggatccaggagagaccaccaaatcgggcccctcataatgatcacactagacctgagggaggtgagagtcaggctacgggtacccgccgtcactcccaccagctttattattttacctttcacattgaggtttgtgatctgtctgcataattttggagtatgatatgagctcattcttccgggtttattttttttccatgcagatatcaaattacttcagctacatttattaaaaacatcatccattcccccagcatgttgcagggtcacctttgtcattaatcaaatgacctcataagagtgggtctatttttggattctctcttctgttccattggtctatttgtcaattccgtactaaatttgccaatttttgcctatttgcctattgcctatttgccaattccatactaaattaattattgtagctttctaataaatcttaatatctatttagtacaatcctccaacttcgttcattaagattgtcttggctattcctggttctttatatttctgtatacattttagaatcagttcatcaatttctaccaaaggaaatatgctgggattttgtttgagatttaaattaatctgcaggttaacttgggaataattgacatctttacagtattgaaccttctcatctatgaacattctttaatatctttaataatgttttgtattttccaatataaggactttgtatttttttgttagatttattctagatattttgtatttttaatgtaaaatgatatctttttaaaaatttcatttttttttttgagacagagtctcgctctgtcgcccaggctggaatgcagtggcctgatctcagctcactgcaagctccgcctcccaggttcacgccattctcctgcctcagcctcctgagtagctgggactacaggtgcccaccaccacacccggctaatgttttgtagttttagtagagacggggtttcaccgtgttagccaggatgatctctatctcctgacctcgtgattcgcccacctcggcctcccaaagtgctgggattacaggcgtgagccaccgcgcctggccctttttaaaaatttcatgttgttactggtatgtagaaatccagttgattttttaaaatattgaccttgagcctgggcacggtggctcatgcctgtaatcccagcactttgggaggctgaggcgggtggatcatgaagtcaagagatcgagaccatcctggccaacatggtgaaaccccatctctactaaaaatacaaaaattagctgggcgtgatggcgtgcgcctgtagtcccagctactcagtaggctaaggcaggagaatcacttgaacccgggaggcagagattgcagtgagctgagatcacaccactgcactccagcccgggcaagacagcgagactccatctcaaaaaatatatatatatatattgaccttgaatcagggaccttctaaattcactcccttaatcccagttttatgtagattctcccgcattttctacttacacagttatgttgtcccacacagtgttggcctcaccacatttcagatgagtcctagctgcctccctttaggtggttgattggttgattttccagacctaagtgatggcctctggtttctaaagctctactccctagcccccaaagcctgagctcagctgattgcttctgccaactcccaccctcaccatcaccactcctggccctgggacaccctctgggctgtccttctttcttctccagcctccctgctgcctctgggaagaacttgttccggaatggctcactattagaatggactcaagagaggctcccagagtcagagaccatttgctaaagatgctctccctgtgcatccccacagcaaaagctgagcgcttgggtggggcaggggagttggggagagggctgttctggggtgggtggtggggggcggattcaccagctcttcttcagctgcagtctgtgtccctgcacctccagaagatttcacagagctagggaggagggcgaaacaggcagctcaactaatccagggatagcaggtctatccaagggactgggggaatagacctgctgaataaagactcttctgtagcaaaaggcaaaggctgtaatcccagcactttgggagaccaaggcaggtggatcatttgaagtcagaagttcgagaccagcctggccaacatggtgaaatcccgtctctactaaaaatacaaaaattagccgggtatgttggtgggtgcctgtaatctcagctattcaggaggctgaggcaagagaatcacttgaacccgggaggtggaggttgcagtgagcccagatggtgccactacactccagtctgggcgacagggcggcaagactccttctcaaaaacaacaacaacaacaacaaacaacaacaaaaaaggcaaaggccaaaaggaggaggacaaattttaccaaaccatgatgtatatatggcgaggtccccaggtcccagacccctgacatcaggcatgacccctttgactggtaagtctgagcagaaagtggtttggtgttactcccagacttgtatctgcccaagtgccagtgtctggagggcctgagcttcaagacagggattcaaagagaggtgacatcacaagagaaacaaccgtcatgtatggggactctgcttacttcacacaccctaaaccctatgagctgtctttcattaacccccctggctcagatcatttcagttatttgttcaaaatctctccaaattattagtgggagactccctacaactcatctgcaactcacacaggttgttttattccaaagggcttggtctgtaagggtcctgtacatgtggctctacctctagggggtgttcggtggatcccgaacctcaagacccagaagcatggctgacattgagatgtgacgtgggctctgattgagtcacgcatggtgaattcctagtggggaaccactggctgtccagggtccctgcctttctgccagctgcctcccagatctgcgacctccttcagaacctgccaaaatgactaggaaaatgctgtttccatagcaagagccaaaagagaacatgacggccctgcactccagatcttcgggcggatgagtaatccaagctttcagttcaagaatcatgtttcagtttcttgaagcctggaagtgaccttttcagatacataagaacccagtgagctgttctgagcctcttcagatccaaaagcattcaagaggcagccctggccctgtctgccatcaacatgtgatcccaggtccgggatcccctgaaggcgaaactagagcaaccctttggaagtgtccctccccttcccaggcccccagttccccactctcagatctacccatgctatccattgcaagcctgtgtcacttctgtgtatgcagctcagcacgaccttaggcaaagccagaatcagcaaggcacgggacacaggcttgattgcaggttaagtgttttattgtttgttttttgagacagagtctcattctgttgcccaggctggagtgcagtggggcaatctcagctcactgcagcctcagcctcctgggttcaagcgattctcctccctcaaccccatgggtatccgggactacaggcacgtgccaccaggcccggctaatttctttgtatttttagtcaagacaggttttcaccatgttggccaagctggtctcaaactcctgacctcaggtgatccacccgcctcggcctcccagagtactaggattacaggcatgaaccaccatgcccggcccaggtgatgttttacatagagctccaataccagagagaagagtgtcaaggggaggtggtgctctctgccttctctggagagctttacccctaagttagctgcccctcacccaccccaggctatcctcttggctcagggcctttctggaattgaggtaaagcacatggtaaccatgaaggccctttgggggctccctgatacataatagtcccacaccgggcagcatgtctgtgatcagctggttggctttttattaacgtatcatattaacaggttcaaccatcctgggacaaagctgagttgtaataaaaaaaaaaagccaacaaaaaaataactttaatatactgttggattcaattcgatagttttaagattttcatagttacgttcctaaatgatattgagtcaaattttccttttcttgcactctccttatctggttttaagaatcaaggtcatactcgtttcataaaacaagcttgctaactttcctccctctttccccatttttaaaattcgttgacagacagtggaatgatacttgtaatgggctttggattttataaaaacacacccccagagtctgcctgctccataggggacttggcacaggcaagaagacacctcttttccttgtttatagtctgcactggcttatttatggcacgtttgttgtttctgggactgttctgctgggagccagccatttccctgaggaagcagagatggaggtggagggaagccctaggcttctaggggagctgtgctgggggaggggagggagccctgaacctggtgccccaggccctgctgcagccacccctctttcccgggagggagctcaaccttactctgcacttacaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaaggtaagaggggccggcagggatgaggttcagcctctcccagtactcagacaaccatgcctggctaaacctcagaaaggcccctggaggaaccacctacttcacagctatcagttaatcagctgttttaactccctgcctgtcagcctgccattctctccctgggtaagccagggcgaaggaggctggggagaccctctctgcagggtggtggggttgccagattcagcacatgaaaatgtgagatgctcaattgcatttgtatttcagatgacaacgaatagtcttttaggacgtgtcccattcaatatttggacctgcagccccatagggactgagggctctcccagaccaggagaattttagttgtgagggtcacgactagtagacccaagagcctggtagaaggtggggtcaggggccctatcagggtttggaggctgcgaagccagtgtgtgtggaggagcccccggcctggtgtctcttcctcagagggctgggcacatctctcccagccacccgtggagctagagaatggagccccgccccctgagctccagctccctggcccagccgaccacacccctgggcatgctggatgcagccccatggcactcaccatctgctctgctgacgctgggccttctccccgcatccctgcatccagcacaggcgggacccacggtgggccctgataaattatggaaaaattaatgggtggatgacacagcagggaaggtccttaggtggtcctccccagggcccccagggacattctctgaccctgatctcccagccacccctccctgccacaattgggcagctcccacacactcttttctcttccccctacagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaaggtaagtcaggagcctggcctgcaggtgtccactggggagtgggtgtagggacacaggccttgcctagccttccccttggaggactggcaaagaggctccctggactgcttccgcctaaggcggcagaaatgtgcacggtaacctcttctctaaggagggtggctcgcctcctccttccctcccttcctttccttcttttctctgtggctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtgagaaaggaaagggtgaagggagcccccgtggtgacatttcttggcaggcagagtggagcgcacctttttgcttcttccaggccctccagcatcctgttgatagtgacagtaacctcttttcccatttggcagaggaggagactgatagagagagggtgagtcacccccaggcatgatggagagtgagtcagagaaggaaggtggggagtgctctggggctgcctgtccggcccgggccctcttggctcatgactcttgcgtatgaaggctttacaagcacagcagccacttgttctttagctccttcctgggagggtcaaaggcagtcctaagaaacggctgctgacagtggcatgggtaatggagcctcccctccctcctgggagggctttaagacaagcctgggtactcccctgtcatcggtggggtgagtgtggcccagcctgcacagggtgtgggtttggggatgacccggactacaacctctctgggtcactgcctgccagctgaggtactcagagaaagttctgggcggccgcgcgtggtggctcacgtctgtagtcccagcactttgggaggccaaggtggatgggtcacgaggtcaggagatcgagaccatcctcgctaacacggtgaaaccccgtctctactaaaaatacaaaaaaaattagccgggcgcggtggcgggcgcctgtagtccaagctactcaggaggctgaggcaggagaatggcgtgaacccgggaggcagagcttgccgtgagctgagatcgcaccactgcactccagcctgggggacagacagagcgagactccgtctcaaaaaaaaaagagaaagttctgagctttgtgcactctagtcccctactaggttaaaggacagtgggttgggatccccatgggttgtggcttgatgtatctgtgagaggaacacgagcatctgtgagctgcagggtgtctggaaggctgtgcccctggggagactcagccagaaaaccaacgtaagatcaggacagtgcaccctgctgggaaggtgagattcggagcttgacctccctctgtctctcaggagtcctgctgcgaggcctcagggatttggagaaaggggttgtcaacactgggctgggcactcatttgcatctttctgggctcctgccagcaccccacagcagggggagaggcctgtccatccctgcacaatgtactgagtactcaccatgggccactgctgctgggtatgccgggatgtcccccatacttgtgggagcaggcggtagttatctcgagctcagcaacaccatacttccaaatccaggggagtggtttccttctgggcaactcagacacatctttcaagatttctactctgaagccaagcctctcaatggcaagctgagaccccccgagctgctccgggccggggcttctcagcgtcctcactgcaggcgctcaggtcagtccatcctttgtggtgggctctccttgcactgtagcagcctccctggcctctactcactagaagttggtggtaccctcggttggaataaccaaaaatgcctccagacactgccaaatgtcactcgagcacacccattaagaaccactgccttaagcaaattcaataacagatggggagcatcagccttcctcctcctcctccaccaccacctaccccaggagtccccagatcaagccagcagcccttggcactggggctgactctggacacttgcagcagcttccataacagcagttaggccacagaggccatgcagtgtgccaggcatggctgcaggagggtctgagtatagactccagggctcctgtacctagccccaggcagtgaggcctggagtcactctagctaaagagatcaggaagacagggcgtgggggcacagagaccaaagaggcaagacagttttttaggagcttgcagggattagacatgttccacttagagtcagaagggcaaacattggttaagcacctaccgtgtactccgatatatgtcaaggatacatggcaccagtgggattgcagcatgggagtcagcagccacgggcgtcctgcgggttccagtgcctacaggacaaccaaacaacccacagggttatgaggattacatgagatagtacgttgaaggcacttgtcaaagtggtaagccctcaataaatggctttattagtagtatttgagatggcgtctccctctttcgcccaggctggagtgcagtggcacaatcttggctcactgcaacctccacctcctgggttcaagtgatcctcccaccttagcctcccaagtagctgggattacaggcacgctccaccatacccaactaatttttgtatttttagaagagatggggtttcaccatgttgcccaggctggtcttgaactcctgacctcaagtgatccacctgccttggcctcccaaagtgctgggattacaggcacctgagccaccatgccaggccggctttattatttttaaaaatattatgccatggcctctcccctttaggatacttaaggtatagccccctaagcccacagctggggagccatggctcagggcgggaaatgaggcattgctgtaaatgtatgcatgactcttctagtggctttcttcccaagaggtctatcacatgagtaacttcagaattaatccagagcctgtaacaattaattaattctgttgtcgtgtccccctttccctttcttgtgtggcctcacaagtttcatctggtccttgcttgtgattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacctggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgggcctcctaggacccagggaccttgttcaaatgcagtctctgctctaggctcccaccgaatcaggctctgaggcgggaagtctgcggtttctctagctccccagatctctgcacacgtccctgcattgtagtggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagcttctttcctgtgaaggtcaagcacacactcgggtgggcaggcaggtgtgggggtggcagaagtctgccccagcatggctgtcggccagcaggagtgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggcttacatgatgggtttggagaagttcctagaaggctttttctgcatcccctgaagcatccctctccaggtgccctttaaaaacacgtaatccctgggaggggtcatggtgcatatcaccgctccttggggagaacccaaagatgggcgggcacctttcctgtcagaaagagcagaagggcttgggctcggaaaagcaagaagcctcgcaggcttccagggctgggcctgagcagggctcactgggggcccaggctgcccctcagctccaccttcccttcctccctccctgccagagccaatgaggataggccccctaccttctcctccctcccgggggctccttagccaggagtttcatgccagggaggaagtggaaggactcctttagggggtccttaagacatctccccatccctggcctcaaggcttgggtttggctggacctaccctcctaactccagatctctctggcaccagattcccagcccaggggagacacctgagaaccccccagatggtgacacacctctgtggtcctctgtcagggacataacctcccagcacagatttgcaaactccctgctgcaggcacaggcagggctatcgggccccaggtgtggctcccctgccttggttcagggagtggagacacagttgcccactgctccccaccccactgccaggcctcttctgcccccatgggtcctggggtgggggagccttgggagtgaagaatgcctctgacccagattcttcaagcagcctctgagctcagaggaagagtctgcctcacggcagcctccctggggtctagctgtcaatcgcccaggaagaaatacccagcgcaggacccggcggggagctggccttctctgtcttcccaggtgcagcagagcgagtgtaaggagctgtcttgggcctgcccagcctggtgccctgcgggggactgctggcacaggactgtgactgggcttcagctctgtctgaaaatctttgctcagagcacctccctagtttgatctgataccccgcctgaccctgccagagtccagaggtcacggcggccagcccctgcctccgggaaggttattccaaatgctcccacagccctgacccttcctgttgctttgtccctgcagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtgggaggacagggtgggacacagacgggggcgttggggatgggcagtgagcagccagccaggctggacatctgtgagcaggggcagtgggtggccatgcgtctgggcactgtgcctggcactcaggcccccgcctgcccccaggtggtgatcatgcgggactaccagcacttcaacgtggtggagatgtacaagagctacctggtgggcgaggagctgtgggtgctcatggagttcctgcagggaggagccctcacagacatcgtctcccaagtcaggtgggcagctgggagggctggaccctgagtgcaggctgccctcaccatggccctgccagggcaatgtggtcttctgcctgtggcccagaagacttgggatgcctgggctcccctgcctgctggggtaactgagacccaggggtcttgggagtggagaagagaaggatagcttctagccaaagctcaggccccagttttcaccagggctatggcctgactgtgctgccaaacagattgcctgggagctgtggggcctagcaccagggactcctactctgctcagccaccccacgacctgccagagctaacgttctctttcatcgggtggccccaccttcctgtccaggctgaatgaggagcagattgccactgtgtgtgaggctgtgctgcaggccctggcctacctgcatgctcagggtgtcatccaccgggacatcaagagtgactccatcctgctgaccctcgatggcagggtaggtcccatcctgtccctggcacagccacgctcccacttcctcctgatccaccactcactcccttttcaaccgcaggtgaagctctcggacttcggattctgtgctcagatcagcaaagacgtccctaagaggaagtccctggtgggaaccccctactggatggctcctgaagtgatctccaggtctttgtatgccactgaggtaaccgttccctccaccccccagacctcccaaaagcaacttggcaactggcagctcttctgctgtggcccctccagtgagctcaccaaaagcagccctggttttcagagtcccacctagtcaacacccttccccctttcgatggggctgctcttacccagtgactttgctgccaggaacgagtcctgcaagtgctttcctcagctcaagggcagaatggggtatggccgggcctcctatgtatgatggcctttctctgagtgactgacagctgtgtccctataggcagtggtcactcatgcaggcagtaactggccacagggcaggtgaccaggggaggaaggagacagacccaccaaggagagctggggccagctgtcccccctccaccactgctgccaccagaacgcagctaccaatgggccagggtctggccatggggtcagggacattttcctcctgcaggtggatatctggtctctgggcatcatggtgattgagatggtagatggggagccaccgtacttcagtgactccccagtgcaagccatgaagaggctccgggacagccccccacccaagctgaaaaactctcacaaggtcagttggcacacaagggtgcgacctcgcagaccccattcctcctgaggcaaggggaccagaacctgggctcccagcatctcccttccactgaagccacagggtctgggctcctggaaaaggctcctctttccccacacaaaacccgcacctgggtgtggagccgcatctacgcacaagttcgcatgtgcgctccgacaagtcgcctcccacggctgtggcaggagagttgctgcttggcagaagggttgctgcttggcaggcactggtcggaagcccagtggggcccatgagcagggaaagccaggacaccagcaatccctgctgtccagggagggatccggagaagcttcactgagcacaaacccttctaacccgtgtcgggagatccataccatgattcgatgtccctgtccatcacggcgagtcggctcatgctccatcgttgcacaccccgacacagctaagccacagcgttccccttaaagccagtataagtgcatggaagtgtatacatgtaaccctttttgccaaatcggccccaaccccgcaggccttactgtggacgccccctgctggcaggtcagcacggggctgctaagtggcaccgccatctggtggccaaaacaagaaatgtctcagagggctgaagcctctcctctaaaatagcaaaaaaacaagagttctgtggccccaacacaaagctggatgggaggaccaacaggaaacatcttccaagacaactggtccttggagcccgcaccgctaaccccaaaattagcatataaagatctccagttggctaattcctcagaggatgtagccttctgcccaagactcagcctcatcccaagatactggctcaaaatgaaccaagataagcccttgctttagactcttaaggcctagagcaacaaagaaatcttccttttcaggtctcactttattttctatttttcagagtacttcctcatccttgacttgtttgtttctgttgttgttggttttttttttttttttttttttggagatggagtctctctctgttgctcaggctggaatgcagtggtgcgatctcagctcactgcaacctccgcctcctgggttcaagcaattctcctgcctcagcctcctgagtagctgggattacaggcacgtgccaccatgctcaactaatttttgtatttttagtagagacagggtttcgccatgttggtcaggctggtctacgaactcctgacctcgtaatctgcccaacttggcctcccaaagtgctgggattacaggcttgagccactgcgcccagcgacctgtttttaaaatctcaaaagccctatgtggcagacagggcaagcatactttatcactagcccattttacagatgagaaaactgaggcctagagaaaactgtgacttgcctgagatcacggatagagccagatctggatcactgatgccaatcctctgccccttccacagagctatagcatctgaatgctgagagccttgagggggtggggagggacaagggaacaggaagttaaaaaaccagcgaattcatgactttcaaacaatgataagtccaggcaatcaggtcaccccgaagtgactgcaaattgtggcttcatcttactgccctgcctctacaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 649 - DNA, 60060 bp, Homo sapiens; identical to SEQ ID NO: 648

SEQ ID NO: 650 - DNA, 38397 bp, Homo sapiens
aaacgagcaggtcgatgcctgaggatttaatggagaaatcccaaagtgagccggggcgcgcggtggaggaggggcgcgccgcagccggggccgctgggccctgatgggcgggagcggggtggagcggcctcgcctgccaggcagccctgggcgcggggctcggcggccacactctggagacagccacggtccaggcaggtgggggagggcgctgctcccgtcctgatgtgccaggagccgccagcagccatccaggtgactaagccggcccactagcactgagtcaccgcccgcctcgagctgttcttgcttctcctttgcatctgattattttgggagctggaaacttggagctgcacctgagtcccgccccttctagctctcccctccctaccttgggctccaggaagatgggacttgctgtgagtctgctgccaccccctaaagatatggaagacgctgtgggggccagaagtgcccggggggctgtggcagcaggcagagtgcaatagcagatatggtggtcaggctgcctgtgtgtgtcctctggaggtgttgggacagaagggcagtcttgtccgagctgactggagtcctcccgggctggctctgaactcatctcccacggggatgtttcggtaaaggagtggcttctggggtcggagtggcatttggagagcgaggctggattggcttaggctggcctgggcaggtaggtggctctgtgttgggtgtggacccacgtgtgtgtgagtgcgagagtgtgtaagccagtgtgtgtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccaggtaggaagccgtccggaggggctggccagggtgagagcccatcactggggggctggacagcccatcagctgccccttcattctggcaggcctgggtaccaaggaaacagcttcctaccaagaaccatgtcactctcttatgcagggccagtcagcacccatgtgcgtctctgctgagctcacagggacacattcagtgagaagggtgctggccagggtacggcttccccatgatcaggacccagcgggtgccaccctcaagcccctggtccccacagggcatgccccagtgtgtgtcaggaggaggggggaggtcccttctcccccacacagctggcagctttgcgggcaccagtgagtaagctgccagagggagggaggctgtgtgcccacagtggcaggacaataccaaccaggagccttcaagagaagaggctgggtgagaaaagcactgaggttttcttttcctttttttttttttttttttttctattttgcctgaagggagtgccgcttcctgggctagagacaagcaccagcctgcagtggagaacgcaggaccccgctgcccagaaggagcagccacggtaaggtccccactgccgctgcgtgctccggattcctgggctagggacgggggtgccaaggtgtccaggctgcctcccacctgggacagggaggctaactccacagctgtgggttcctgggtcaaggggctccactccccacccggcctgccaccttctttccagattgattgtgaaacagtccaatcccagctggtctctggctccctagctagagggagaggtgcttgtttctactcttcctgccccagctgggccaagccagtgccaccgggacacccctatccaaggcccctctcactttaccacctctgggacatttcccttgtgtattcattccacaaatatttagggagcactgctgggtcccaggctccaagtcacaccctttggctgggtttgacctggcacagattctgactctgaaactcagcatcagggcaggttcagggagctgcctggccaagcacggtcactcctcacaggccttggtctccccacccctgctgcagggtggatgacctggtcagctttggggacatcgggcccagtgagctcgggtttataaagcactgggccccaccgggaagcaaggctaacgtcttgtggtctccagttatcctttccctggcattgtacaccaagaggtttgtgccgttctgcctggggtcttcctgaggctggttctggtgggaactgggctgcaggaggagaggatgagcttaggagccgtgtggcccccaggcctggtgggcctgggactcagccccacgggagctcatctagctggggttgaggcctttggggcaagcaaggagtcccctctgcaggcaggcttccctggcggttgtcctggcccaggcttggaggtggcacctgggagccctagtgacagagcgcctggtcagggaagggtcggcaccagaggcaagcccttctgggagcagctgatttggatggaagctctgtgcacctgagagggggagtgtggggactgcacggcctctccagtgccccgaggacaaactgatgctttgtgagtgctctgggccctcccggacttgccagacacagggagggtgcagtgggtggggtctccagccaaggaaagcccgctctgtgcacaactcctaaggatgaccaaaaagtcccctgccctggaggagcacatgtgctcagagtcaggaggaacccataagtgtctctcatgccagtgaattcccacacctggctcctggatgaggagaatgacccagctgtgggggtatctcatgctgcctcacaaaaggtgactctgtgcctaggagtcttccatgcatgcagagctgagcaggggctgctgcccagttggggtcagaggggcggaggctgtcgagcactaggtagacagcaggccagcagcgggcagcaggttgggccaggagggagcagagagtaggggccagggcaggctgagcaggaaaggaaaaggctgcctggggtcctgagggctcagggaggactccagacagctggccttcttatgccagcccgcttctgtgggagaggccctctgcgtaggtgactgggcagggaagaggctaagacactgaaagattgaattcctcacccaaatggcccagagatgcccaccgcacacagtgtcctgggtgcagaaggcaggaaggactcatgggaggctgtcctgtggactgaagcagaaagtccttcccgtaagatgcgctcgtcgccctgagcaggaaggcccaggctgcggaagcagtgcctgagacctgagcagcaggaaggacaccagtaaagctcatcaggaggcatctggccgcctgcacctaccgggcctcaaggagagagcttatttctgggagcctccttggtagaaagaggtggactagccagcaggttggggaggagcattgcaaatggaagcttctgagggcagaatgagttctgaacttgctgaagccaaggctggccctcctgcccagggcgagcagtctgcctgggcctgggaagttgtccccttctgaggaggtgccctccaccccaccagagctcagccctaggggccaggaagggctaaagcgagaagagtgagatgtgagataaaggggaccgtgtctcttcctgggagggtgtggggtccaggcagcaccttgttctggcgcacaggctgccaagcagatgacagccatggcctgactactaggtgcaagcactggtggcaggaagagggggtggacaaagcaggacagagctcttgccctggggatgctcatagccctgcagcagagcagtggaaaggaaagctgagctgagcgtggggccaaccgcgccagaaacaagcggagccacaaagccaccatcagcccccaggtggcttcgtccttttgccaactctgggtccaactcatcgctgaagttggcagccatgacccatccagcccagataatttataaatttacaccaatactgggcaacggttcttaacatagaactttataaagatggacaaaaaagataagttgagaatgacaaacaaaggaagaagcagcttctatctgcagttgcaggaggaggtgaaggctcggggagatagaccagggcgggaagaggcaggatggtggttggttaacatgaagtcagcagcatgagcctcaggcccggtgctgcctcttcctggtgactcgggcaagttacttcatgtctctgggtctcaatttcctctcctgtccaacagagataattatagtacctatgagttagggttgttgagaggattaaataagataataagtgaatgctctgaatggcatgactggcacatacgtacatgttcagcaagagataactattatcaccgtgatgataactggtgtcagaggaacaaagtgccaggagagaccataccttgttcgggggaatcaggaaaggcttcacggaggaggtgactttgaaagaaccctcctctgaggagaaacaaaagctctcagaatgcccaggaaagctgggaagaaacaataatgccaggtctatttttttcccaaatagcatattgtttgtccactgaggctttctaaggaataacttgagactcctctttctggggtctagacttggaggtcttgaggacttgaagtgggctgcccctagtgaagggatcgagagccgggctgtggccctggccctactccttttggggactggaagcttttttcacatgctggtcctaactgcatgaggaactgtgttctgctgagccccatctaaagcatacacttggtgatgtggcaggcagaggggccagacaaggccacggcaggctcctggatcactctggcaagtagcttagaaatgcctagtaatcgtgggcaaggtgcagtggctcacgcctgtaatcccagcactttgggaggctgaggtaggcagatcacaagatcaagagatccagaccatcctggccaacatggtgaaccccgtctctactaaaaaatacaaaaaattagctggacgtggtggcgcgtgcctgtagtcccagctacccgggaggctgaggcaggggaatcgcttgaacccaggaggcggaggttgtagtgagctgggatcgtgccactgcactccagcctggccacagagcaagactctgtctcaaaaaaaaaaaaaaaaggccagtaatcgtgaggttccatctcagagacttttgttttctctttttttctttttatttttttttttgagacagagtttcgctcttgttgcccaggctggagtgcagtggcacgatcttggctctctgcaacctccgcctccctggttcaagcgattctcctgcctcagcctcccaagtaggtgggattacaagcacccaccaccatgcccggctgatttttgtatttttagtagagatggggtttcactatgttggccaggctagtctcgaactcctgacctcaggtgatccgccgacctcagcctcccaaagtgctgggattacagatgtgagccaccacacccagcctgctttttctacaaaggattatctgttctatgaatttaggaaaggtaatcctaaagcttattcacctaagaaaaacaaggcaaccccagagcatgacaggctttcttgggctgggggaactcacatgtgaaaaaacaggttccctcataactacatgagaggccgcaactgcctcagccccagcaaagggacacctctgctggccagcatttcctacaaaacctcatcacgacacatcaggcagggcagagacccaagtattcacatagggccagtgatgactttttttgacacctgtggattctccgtggcaacctattccccaaaagtgctgcctcggtcagccaatcccagtgtctctctgcctaggcaacaatctcttgtgctctggtctgcccacagcctccatgcactcagctctttgggcctcttgctaaggggctggaagcagagctgtgtccttcaggctgtcaaggacctggtgagggatcctctgggtgtccagggaagcaggttcagaaagctcagttcagctggtgctgtattttgatctctgatcccagtgcagcggggaccagcctactcaactcagtgcagatagcaacaaaccagtcaccttgcccaagacctcctgctgcctgcctgcctgcctggtgaccaggactcctaaaggctgcagcagcagcagcagagttaaaactttaaaaccgggaggactggttctgtggctcagcttcctggcctggagaggctctagcctccattttctttctttcagcttatggaattgtgcaagaaagcacagagggtggagggagcgaggggaccagttatgccacagcctcctgcaccaccagagcacagtctcagatcagcaaagaggagctctgaggaggaaaaggctgccccaggaaagagctggccatctcagattgctgtagcacattcaagccaaagggagtccccggaggatgtttcgtccagcccccataattttagagcgggaaacagaggtccagagaaggaaagtgggtcctgaggccacacagctaactaatggcagagtcagtttccagcccagggatccccagctgcctgcccagcactcttgctacccaggctgaacccccacccccgtgctaccaaggggcccatgcaggagcaggcagcagccactgggtaacttgatggcttgggagaggcggcctggcctgacacattgggaggctgggcaggtccccgctttgctcctattgtgctatttgggtgcctcctgccatccccctgcattctgctagacctgaaaccacagcccagcccacgcttgtcagtcaagtgcttcccgaggataaactttgcacacagcacccaggccactcttggggaccaggccactctctgttgaagagatctaactaatttataaattgattgattgaagttctttttgtcccaggtaacttcatgtcttaggccaaagaagggagtcatgatgagtgccagagatgaaacggagattctggggcaaagggtaggggaggcacctgggaggccctgttcttcaggtgatcttctcattagtgtagacttttgaccccaggcagacatttacatgtccaatagccaccatcagaggtcagttcccagaagcaggaggcctgtcacttgccaccggtcaccaggcccaagctagacaagaagactttttctattccactagagtggatcttgctgatgatgtgtctgggatccagaaaggtggggagaagtagaggtctcagctcctggggagggatggagccagccccgggggaagaatgcaaggccgccagtgagcaggcattcagggctcctgtcgaggagagggtggtcaggacaggaggaggggctgcctcatggatgatgaggtccatcatcctagcagaggctgttgtaccagccactgacgagggtgtggcagtggtgttaccagaaccctgctatgtcagcgttcaaatacatgtcccagcaggccaaccacccctgcagcagtcaaggggttctgtccggtgtgtgccagaatgctagggaagagaggaccctgagaaggatggcagcatggcacagacacgccatgtggcagttagacaggtcatgccttctgacccagggcacatgcagaggtccacagactctgaggccagctagttagtgttcccagggggctgcacagcccagagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaaaatgagtgtccttaccacagatctggctcttgctgttccccagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggcccagggtatcagcagggcacatctgtacagcagccgggcggggacccatggacttttccaaaacacctaaccaggccctagacagtgctaccccctggcgctgggctctctttccggaacccggggtgaacagacctgttgggttgatttagtagcaagtggtagccttgttttctggacgaatcctgggattctactccatggcacatcaaaccaagctccagtgtgcatgcccagggtcggggaggggagctttctccttggtcccttctgcagctgtgagggctgagggttaagaacctttcaccccgtttgggggtgctgctcctccatagccctgtaccccaatgctctagacttcattattccaccaccttccccagggcgggaggtactctttccattacatgcatcaggaaactgaggccagagacatgctgtaagtcttgcgaggcaagagggctcccgtccgcaggactccatggctctgcagctagactccgtcaacttccctcctgcctggggaccccaagggcctggcagtgtcagctccctcggctcacacttccagatgctcggaggttcagaggtttgcacctccctcttggtcccatcagcagagagagatgggtggtcccatcagggtgaggagcaggaagaagcaggtgctggacagcctggaggagagggggaggaagggattttctcccaagagtgcctctctcccaggcttcgggctccagggtgagtgggcagcgacccctctaggagccccagctccacagggctcctcctgccaagcatccagcacacgtgcccccacctccccggcaggtcctgcttgagggcctgaggcgactgggccatctgggtctgtgaagggcagatgtgggatgcaggaacttcaggcagggtgctggcttgtggccaggaaagcctagcacctgattcctagcagggaactcagtgacagagtgggggaacctgagggcccctctgcccctcacacccagtgccatgtgggggtcctcgcgtgttacacagaaataggaagggacggtcctcctacccgcaccccagccctcttgtgtctcacgtgacagcctgcctgggcagtgatttttttaaaacacaaatgccttatattaaggtctgagttggtctctccccactgcccgttcaaacattccatggcaccagcagcctctaagcagcagagttgagagaaccagctttggggtcggatacacttccgttcaaattccagctcctcccctcagtaactggcttacttagtctttctggactggataacaaaatactatggactggtggcttataaacaacagaaatttatttctcacagttctggaagctgagaagcccaagagcaaggtgctggcagatccggtgtctggtgagggcctgcttccaggttcagagctggctgtctttttgctataacctcacatgatggaaagggccagggatctctctgggggcctctttcataaaggcatgaatcccattcatgagggctctgctttcgtgacttaatcacctgccaacaaccccgcctcctaataccctcatattagtgattaggtttcaacagatgaatcttgggggacataggtttcaacagatgaatcttggggggacacaaacattcagtctatagcagtaattatgagaccttcatctgttctttaaccactccgagcctcagtttcctcatttgtaaaatgcgaataataattgtacaggacttccatcccagggttcttgtgaagactaagggaggtagcacaggtacatagctttgtacggggcctggcccacgggaagcatgccatcattggcagccattactatttctattattaggggagggctgagtcgcccagaggaaggagtctgaacggagtaaaagagcttgttagtcgccttcctcatccccagaaaacttttcaagtcatggagcagaaagatgcagggaagggataatgtgtttgtctttctaaaccacaagctgatccctatctttcctctttggccctagcccgagcactcagccctggctgttggcactcagatgttacaacaggccccgacagccacaggctgagggataaccgggaagtgcctgccccacccgatgtgcccaccttgctgccctcccagaccatactggcctgccaatgcctctgagatggcaccactccaagagccatgtccccctgtgaaatgtctgttttgggtgtctcttccagagatcctacccaatttgtagaatgggagtgcctggacaattccttcaaccagaaggtctgtgccagcagccaaggctcctcaaaggaggatgtgcctggagccccctgtgctcagcacggcaacctgggaacaaggccagagggtggcacatggatgctgcaggagacactgtccccagactgctcctgacacttcctgtgctgttgttctgccctttcctcctgggcagggctgagctgggcacggatcagaggagaatagagaagggggagagtcacacacaggaattaatcactcaggacctaccctgaatggatgattcagtgtgtatccccagctgtctcaatgtgtggggagaggggtggcaacggggcggatcgtgcaacccggtgcagctgaacctcatgtagacgagactggaagtgcagaaaactggcgttgtgatggacctgagggattccctagtctagtcttgtatccagttctctggcctacccaactgacggttattcttgaatacctccagtgatgggggactcattacctccttggtcagtctaacttgaccttctgcctctctcaaggccccaaacccactgtagctcccaaggggtgggaggaacccagggtttcctagagttattctctatagggtgaggatgggacttggctagtcgccattctagggtacctaagcctggattcaaaccaaattgaataccagttcatttctggtaataatctaacattcatactttattgtagttctgttcaaaagtactgcttggagctgtgatttgggtatataaggcatttgtagtcaaagaaaataattcacatatgcattcatgaatcagtaaaaataatttagggtgtcgattctaggttagacaatataatgctttcattctagctttggttcatggttcatttcaaatcctcagcaaccaatctctgccacctccacgcagcacattctgcttctgcagccagcattcgaccagtgtacccatgtccttgggtaacgaatctgtggggggagccattctggtatcacctggtccccctcccactgccccctcatccaaggcctagcagtcagcttcctgggtgaccacaggaggtcagagtttgtctaagcgggtcaggcctacagtattgtccactcagaggaaagagaaagaatccgcgtgggaaagacacaaagaggaggaggaggaggcgacagagtaaggggaggagaacagaaactaaatataaatatgtgttggggatgttggggatggcagcagggtatggttagctggctggctcccacaccactgtcccacagcacagagggccagcatctgcacctggcaccatgctttccctaggaaagccgagggcattgggcttgtggtgcagccacacagggtacagacctgtttgggactgtcaggttcccacgggttgcctgagctctattaggtgggcgccttagagtaaattgtgtgaaaccaatacagcctataatgcaaaagattgagccgtgagtagattgatgcgtctaaagaatcagtgaacaaaaataagtggccatagtgacctcagttaatcattgaagtctgaggtgcccaacaatgatttttaaaatccctgcactgtccttggtccccgctctgtgacactggcagtcacccagccaccacttgacggcagccatttggagtccacatgtactgagtttccaagccagaacttcctcagcactcagccagaacacagcctttctctgggggcccaagacaaggagagcaaaggtcttctcacttctttatctggggaagagatgagtgattcctgtcccttcccccagtatagaaaacaccctgtaccccaaaagaaacatggcacaggggcagccaggagtgagccccttggaatggccattctgatcttaggcagggactgctgaggacaagcagaggatgccgactctgggacaaaatcacaggcggaggggctccgaaacaggccctagccgctctgggggtgcgggtctcctgccctaggactctcaggctagaaagtcctcaggactcaggactgcgcaagggctgacaagggaactggaatcccttaaatcccgctttcctgcctgcgcaaggggctaccccagcacagtcttggggccctgtccacatgggacagatcatccaaggtgacaggttttccgactcccgcgtgggctctccaggatgtgtgggtgggcacacgcggcccgctcaggtccgggagagtcggcccgcggctctggagcgtgcatctgcgatgccagtgaacgaggtgattacacacagccggcgctcagctgattctccaggtcgggtctccgcgaggcggccactgggccgtggagccgcaggcaggtccccgcggctgtggccaggccagggcccggaggcgaagggcgggcgggaactggggccaagcaggtggagagaaagagttgagcagcacggcgcccctcgggcagaggggctcctggccaaggccccagcgacacttggcaacttctcccgcgctctgggttcgccgccgcgtcctacctgaggccacaccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggtgagtgagcgagcggcccccggccctagagccttctgcacccattttgaagagcaggcagggagggacagtgggcaggcaggtggccctcctgggctggctccttcctggtactgctaggcagcggaggtggtcccttccaggtgccgtctctcgatccttagtgggtgcatgttaagtcacttacaccactttgccccatggccccacggtaggctggtagacgtcaagacctcaaatggcccgccctgcccccgggcccatcttcaggtctgatgcctgtcctgggtgagggtgtcaccgcggcagagtgcagggaattcatgccggggaagaggttcccaaacaggaagggtggtggcaggcccagtggctgtgcagggcagggtgggaggcagccgtgggagactcccgcaggagttacaggtgaagctgccgctccacacatcccagcccaccgctcattccccagatctccagacctgctcaggtggcatccgatctggagtgtaggtgctgctgggagcactggaggctaagccatgaagagctcccagggtgtaggttgcgttttctgtatcttgccccattctggtggttttttgggggcttttctgacttgtttttctgggtgaagggggcagaggggctcaggtctgtgtccatgctcgtttttggtggccggtgtggcataggttgccgcattggataagaaaacgcctggttccatgcaaggtgaggttcagcctgcagtgccatgaattctcctccatagtatataggacagtggccgaagacacatttggaaccgaagagagtggggtttgaatctatccagactttgcctttgactccttagacaagttgcttcacttctctacaaacttataaatggcctcatctgtaaaatgggaatgcgaatgccttcctcctcattaggcggttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatgttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcagtagctacaattagccattagatgtactaataaaaagcacctagcacagtctatccatgtggtgggcactttataagcatacctttcttttcttgcctcctccttctctctccagctccctgctgtctttaaaatgggcccaggaaagcaggttcagcccaactcacaatggtgttgtgagtgtaaagttgtgagtgttaaggaggtgaaatagaggtctggaaagttaagagctgtagaaaaaaaggcaatcttgtgattagggatgccagaggttccttctgcttagcatagggttccaatgccagaggttccaatgcttagcatagggtcctagctaggcattgaggaccctatgctaaggactcagacctctgtgtgcagaggctgttgagaatctagggtaggccgggcgcggtggctcacgcctgttgacacaagtgactgaatgagctgtattactgtattcttttaaacagcagcccattatctctcccctggggattcactggggccagtggtatgggaatagtgacaaaggcagagagcccaaacattttggcaggttgcatgtcatgctgtctgccctggcccatgctgcatctgtctgggtccctcaagtgggacagcagagcctcagggtcctgctcatcctcccagggcctctccgcacttcagcacactgaccctgagcaggttgtttgaatcttgtgggcatccacatgagggccacaacctgcgtctaggaccctcctcccccgcaggtgacagctgagcagaaaagcagatgaaatttccttcccccgtgtattttgggagccaggatagggtgctggggtgccacctctcctgactctcaagtcacgtgaagaggagcagatggcagactcggaccccagtagaggctgaggtgagacagagttcagctccacacaaggatcagcgaggggacagaggggacagaaggcaggggctgcagggggagcttttcatcgctgaatgagttctagcagagtgcgggcagcctcctgttgggaatgccagagggactgaactttgggccaaggggaaggtcagaccccgtcaggagtgccacagatcctgcactaccatctcttctggctgcagaaggttggcctagagcaacacctgtttggaagaagcaaactaaaccacacaggagtgaggatttcctctcgtttaccatggtccccagagcctggagtagagtaggtccataatagatactttctgaataaaggaatactataatttcccagctgggcacggtggtatgctcctctagtcctgaccactcaagcgactgaggtgggagggtgggttgaggccagacgttcgaggctgcagtaagctctgatcgcgccactgcatttcagcctgggcgactgagtgagactctgtctctaaaaaaaaattttttttttgaaacaaacttctgaaagtaaagtttgagaaaaatccttctggccaatgagaatattccagtgaaaggctgtcttctgttcgcggtaattctcagccaaggggtcaggtgaggcctgtcacctgtcagaatgtgtgtgggatgacagttcccaaagggggttacaaagaggtcaagaaaccctgctgcaggtctcagcatgtcagggcccagccctggaggtgacagggtcctctggaggccactctgacaggttggtgatggtagtagagtgctttcctaagttttgtagcactcggggctcacctctgtcttggggctgtgattctaggataggcccttccccagagtgtcttggatgggcctgagaataacagagggtggtggtaggagcagatggccactgcagccaagttcacatcaggtcctgggtcagactcgtgtctgccccttctttgcctctcggcttgaatgagtcacttagtctctccttctctgcataatggagacagtactagtgctacctcacaggcttgtggcgaggagatcacatgtgtgaaatgctcagcccagagcctgctacttccgtcttatgctaggctcttcctgagtgacgaccgtgagaaatatccaaagctcctccgtgagcaggaacagatgctccccctcactgtgcctggagaagctggcagaggtgaattaatccatcccttgtcatctacaaaaatgtcgaggcctacgtaaggcgagtaggccaaggtcacaagccgggacttaggaacaccaagcccaaggtccacgctgagccagcactcgggcttgtggcccaggacttgagccctggtaagcagaccctgagcctcactgtgagaaagcctgggcctgccgcccccctctcaccccctggcaccttgagcaacccaggagctggcccactaggcagcggcctcctctcttcccagtcgcccgcaaatggcagggaattccaccagcttcatttctaacagcttcccagcaatcccagcgcttacacagccagcccaacgctgacccctccgggtggctgcaaacccctttagactcactttctggaagccagcttcccagcctcagcgcgttcttgtgaatcccttcggtgggctgtgtcctttccttgaaagggactcagtatgcgcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaacggcaggcatcctctgtagtgccaccctgcatctgtggggccctgatggctctggtggccctggcatcccagggcctggcccatggatgtctcctctccagggaggagacgttgaggagggtggcccacccacagtgcagctgcttttctcatctgtggacactagaccagccaagcctcagtgccatgctctgggaatccccttgtctctgtggaacagtagcatccgccacaaaacttactcaccccctcctcaagccaagcctgtgggtcgcctggcttcaggctgagcccctacagaggggctgtggatgcatcctgtgctggacagaacacacgcctgctgtttctgtagcttttcctagatgccaggccctgaccatcacagcccccaccatgacctcttggaaacattttactcaccccttgctgagtggaaaaacacctggttccttgcaagataagggtcagcctgcaagttaggacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctgtggcctcaggcaagctattgaacctctttgagcctcatctggatttgtggataacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatcccccgatgcagtcatgcgttagccagcaggaagatgcctgcagacatccagaagagaaaagttcaaagcagtcctcacacacggcagtgcctttccagcctgaggtggaatcttcagtgtggcctccctcccctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcctggtgtcttcttggaggaaagctcctcccctagatgaattgcgtgcagatggagatgctagaggggcgacagtaacagctggcatggcctgtttgacttaaccttggggccccatggctggtgcagcagccacctccctcagcccagtggccttggagacatggatgggaaaaggagccctggaaatggcaagcggaggccctggctgaccgggtgggagtgctctgaggacacagcctgatgctggggagaggcagggcatgttttgtcctgggtgattcactcgcgatgactggggcaacactggtcccgttcaggtggatgaacgtctcttaggcactcagcctccatggatcactcttctctgtatttaaaaatattttgtttttggccggacgcggtggctcacgcctgtaatcccagcactttgggaggctgaaggcgggtggatcacctgaggtcaggagttcaagatcagcccagccaacatggtgaaaccctatctctactaaaaatacaaaaattagccggacgtggtggtgcacacctatagtctcagctacttgggaggctgaggcaggagaatcacttgaacctggaaggcagaggttgcagtgagccaagatcgcaccactgtactccagcctgggcaacagagtgaaacgctgtctcaaaaaaaaaaaaaaaaaaaaaaaattgtttttttttagagaagcaatccgtcgtctttaaggaaaacttagaaaaagagtagaaagatagaatagaaggagatcacctgtagccccaccaggtaaatgggacaactaatatgttgatgtatttccttcaaatagccattgtattcacactgcattgacaaattaccattggcaaaatctttaaaaaccccctacccctaatctatatcatcaagaattccactttcgccaaagtaaaccttgatagtttaatttgtgtctgggacccatgactgtggacaggtttaggccccagcaggtcgtgggatccaggagagaccaccaaatcgggcccctcataatgatcacactagacctgagggaggtgagagtcaggctacgggtacccgccgtcactcccaccagctttattattttacctttcacattgaggtttgtgatctgtctgcataattttggagtatgatatgagctcattcttccgggtttattttttttccatgcagatatcaaattacttcagctacatttattaaaaacatcatccattcccccagcatgttgcagggtcacctttgtcattaatcaaatgacctcataagagtgggtctatttttggattctctcttctgttccattggtctatttgtcaattccgtactaaatttgccaatttttgcctatttgcctattgcctatttgccaattccatactaaattaattattgtagctttctaataaatcttaatatctatttagtacaatcctccaacttcgttcattaagattgtcttggctattcctggttctttatatttctgtatacattttagaatcagttcatcaatttctaccaaaggaaatatgctgggattttgtttgagatttaaattaatctgcaggttaacttgggaataattgacatctttacagtattgaaccttctcatctatgaacattctttaatatctttaataatgttttgtattttccaatataaggactttgtatttttttgttagatttattctagatattttgtatttttaatgtaaaatgatatctttttaaaaatttcatttttttttttgagacagagtctcgctctgtcgcccaggctggaatgcagtggcctgatctcagctcactgcaagctccgcctcccaggttcacgccattctcctgcctcagcctcctgagtagctgggactacaggtgcccaccaccacacccggctaatgttttgtagttttagtagagacggggtttcaccgtgttagccaggatgatctctatctcctgacctcgtgattcgcccacctcggcctcccaaagtgctgggattacaggcgtgagccaccgcgcctggccctttttaaaaatttcatgttgttactggtatgtagaaatccagttgattttttaaaatattgaccttgagcctgggcacggtggctcatgcctgtaatcccagcactttgggaggctgaggcgggtggatcatgaagtcaagagatcgagaccatcctggccaacatggtgaaaccccatctctactaaaaatacaaaaattagctgggcgtgatggcgtgcgcctgtagtcccagctactcagtaggctaaggcaggagaatcacttgaacccgggaggcagagattgcagtgagctgagatcacaccactgcactccagcccgggcaagacagcgagactccatctcaaaaaatatatatatatatattgaccttgaatcagggaccttctaaattcactcccttaatcccagttttatgtagattctcccgcattttctacttacacagttatgttgtcccacacagtgttggcctcaccacatttcagatgagtcctagctgcctccctttaggtggttgattggttgattttccagacctaagtgatggcctctggtttctaaagctctactccctagcccccaaagcctgagctcagctgattgcttctgccaactcccaccctcaccatcaccactcctggccctgggacaccctctgggctgtccttctttcttctccagcctccctgctgcctctgggaagaacttgttccggaatggctcactattagaatggactcaagagaggctcccagagtcagagaccatttgctaaagatgctctccctgtgcatccccacagcaaaagctgagcgcttgggtggggcaggggagttggggagagggctgttctggggtgggtggtggggggcggattcaccagctcttcttcagctgcagtctgtgtccctgcacctccagaagatttcacagagctagggaggagggcgaaacaggcagctcaactaatccagggatagcaggtctatccaagggactgggggaatagacctgctgaataaagactcttctgtagcaaaaggcaaaggctgtaatcccagcactttgggagaccaaggcaggtggatcatttgaagtcagaagttcgagaccagcctggccaacatggtgaaatcccgtctctactaaaaatacaaaaattagccgggtatgttggtgggtgcctgtaatctcagctattcaggaggctgaggcaagagaatcacttgaacccgggaggtggaggttgcagtgagcccagatggtgccactacactccagtctgggcgacagggcggcaagactccttctcaaaaacaacaacaacaacaacaaacaacaacaaaaaaggcaaaggccaaaaggaggaggacaaattttaccaaaccatgatgtatatatggcgaggtccccaggtcccagacccctgacatcaggcatgacccctttgactggtaagtctgagcagaaagtggtttggtgttactcccagacttgtatctgcccaagtgccagtgtctggagggcctgagcttcaagacagggattcaaagagaggtgacatcacaagagaaacaaccgtcatgtatggggactctgcttacttcacacaccctaaaccctatgagctgtctttcattaacccccctggctcagatcatttcagttatttgttcaaaatctctccaaattattagtgggagactccctacaactcatctgcaactcacacaggttgttttattccaaagggcttggtctgtaagggtcctgtacatgtggctctacctctagggggtgttcggtggatcccgaacctcaagacccagaagcatggctgacattgagatgtgacgtgggctctgattgagtcacgcatggtgaattcctagtggggaaccactggctgtccagggtccctgcctttctgccagctgcctcccagatctgcgacctccttcagaacctgccaaaatgactaggaaaatgctgtttccatagcaagagccaaaagagaacatgacggccctgcactccagatcttcgggcggatgagtaatccaagctttcagttcaagaatcatgtttcagtttcttgaagcctggaagtgaccttttcagatacataagaacccagtgagctgttctgagcctcttcagatccaaaagcattcaagaggcagccctggccctgtctgccatcaacatgtgatcccaggtccgggatcccctgaaggcgaaactagagcaaccctttggaagtgtccctccccttcccaggcccccagttccccactctcagatctacccatgctatccattgcaagcctgtgtcacttctgtgtatgcagctcagcacgaccttaggcaaagccagaatcagcaaggcacgggacacaggcttgattgcaggttaagtgttttattgtttgttttttgagacagagtctcattctgttgcccaggctggagtgcagtggggcaatctcagctcactgcagcctcagcctcctgggttcaagcgattctcctccctcaaccccatgggtatccgggactacaggcacgtgccaccaggcccggctaatttctttgtatttttagtcaagacaggttttcaccatgttggccaagctggtctcaaactcctgacctcaggtgatccacccgcctcggcctcccagagtactaggattacaggcatgaaccaccatgcccggcccaggtgatgttttacatagagctccaataccagagagaagagtgtcaaggggaggtggtgctctctgccttctctggagagctttacccctaagttagctgcccctcacccaccccaggctatcctcttggctcagggcctttctggaattgaggtaaagcacatggtaaccatgaaggccctttgggggctccctgatacataatagtcccacaccgggcagcatgtctgtgatcagctggttggctttttattaacgtatcatattaacaggttcaaccatcctgggacaaagctgagttgtaataaaaaaaaaaagccaacaaaaaaataactttaatatactgttggattcaattcgatagttttaagattttcatagttacgttcctaaatgatattgagtcaaattttccttttcttgcactctccttatctggttttaagaatcaaggtcatactcgtttcataaaacaagcttgctaactttcctccctctttccccatttttaaaattcgttgacagacagtggaatgatacttgtaatgggctttggattttataaaaacacacccccagagtctgcctgctccataggggacttggcacaggcaagaagacacctcttttccttgtttatagtctgcactggcttatttatggcacgtttgttgtttctgggactgttctgctgggagccagccatttccctgaggaagcagagatggaggtggagggaagccctaggcttctaggggagctgtgctgggggaggggagggagccctgaacctggtgccccaggccctgctgcagccacccctctttcccgggagggagctcaaccttactctgcacttacaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaaggtaagaggggccggcagggatgaggttcagcctctcccagtactcagacaaccatgcctggctaaacctcagaaaggcccctggaggaaccacctacttcacagctatcagttaatcagctgttttaactccctgcctgtcagcctgccattctctccctgggtaagccagggcgaaggaggctggggagaccctctctgcagggtggtggggttgccagattcagcacatgaaaatgtgagatgctcaattgcatttgtatttcagatgacaacgaatagtcttttaggacgtgtcccattcaatatttggacctgcagccccatagggactgagggctctcccagaccaggagaattttagttgtgagggtcacgactagtagacccaagagcctggtagaaggtggggtcaggggccctatcagggtttggaggctgcgaagccagtgtgtgtggaggagcccccggcctggtgtctcttcctcagagggctgggcacatctctcccagccacccgtggagctagagaatggagccccgccccctgagctccagctccctggcccagccgaccacacccctgggcatgctggatgcagccccatggcactcaccatctgctctgctgacgctgggccttctccccgcatccctgcatccagcacaggcgggacccacggtgggccctgataaattatggaaaaattaatgggtggatgacacagcagggaaggtccttaggtggtcctccccagggcccccagggacattctctgaccctgatctcccagccacccctccctgccacaattgggcagctcccacacactcttttctcttccccctacagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaaggtaagtcaggagcctggcctgcaggtgtccactggggagtgggtgtagggacacaggccttgcctagccttccccttggaggactggcaaagaggctccctggactgcttccgcctaaggcggcagaaatgtgcacggtaacctcttctctaaggagggtggctcgcctcctccttccctcccttcctttccttcttttctctgtggctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtgagaaaggaaagggtgaagggagcccccgtggtgacatttcttggcaggcagagtggagcgcacctttttgcttcttccaggccctccagcatcctgttgatagtgacagtaacctcttttcccatttggcagaggaggagactgatagagagagggtgagtcacccccaggcatgatggagagtgagtcagagaaggaaggtggggagtgctctggggctgcctgtccggcccgggccctcttggctcatgactcttgcgtatgaaggctttacaagcacagcagccacttgttctttagctccttcctgggagggtcaaaggcagtcctaagaaacggctgctgacagtggcatgggtaatggagcctcccctccctcctgggagggctttaagacaagcctgggtactcccctgtcatcggtggggtgagtgtggcccagcctgcacagggtgtgggtttggggatgacccggactacaacctctctgggtcactgcctgccagctgaggtactcagagaaagttctgggcggccgcgcgtggtggctcacgtctgtagtcccagcactttgggaggccaaggtggatgggtcacgaggtcaggagatcgagaccatcctcgctaacacggtgaaaccccgtctctactaaaaatacaaaaaaaattagccgggcgcggtggcgggcgcctgtagtccaagctactcaggaggctgaggcaggagaatggcgtgaacccgggaggcagagcttgccgtgagctgagatcgcaccactgcactccagcctgggggacagacagagcgagactccgtctcaaaaaaaaaagagaaagttctgagctttgtgcactctagtcccctactaggttaaaggacagtgggttgggatccccatgggttgtggcttgatgtatctgtgagaggaacacgagcatctgtgagctgcagggtgtctggaaggctgtgcccctggggagactcagccagaaaaccaacgtaagatcaggacagtgcaccctgctgggaaggtgagattcggagcttgacctccctctgtctctcaggagtcctgctgcgaggcctcagggatttggagaaaggggttgtcaacactgggctgggcactcatttgcatctttctgggctcctgccagcaccccacagcagggggagaggcctgtccatccctgcacaatgtactgagtactcaccatgggccactgctgctgggtatgccgggatgtcccccatacttgtgggagcaggcggtagttatctcgagctcagcaacaccatacttccaaatccaggggagtggtttccttctgggcaactcagacacatctttcaagatttctactctgaagccaagcctctcaatggcaagctgagaccccccgagctgctccgggccggggcttctcagcgtcctcactgcaggcgctcaggtcagtccatcctttgtggtgggctctccttgcactgtagcagcctccctggcctctactcactagaagttggtggtaccctcggttggaataaccaaaaatgcctccagacactgccaaatgtcactcgagcacacccattaagaaccactgccttaagcaaattcaataacagatggggagcatcagccttcctcctcctcctccaccaccacctaccccaggagtccccagatcaagccagcagcccttggcactggggctgactctggacacttgcagcagcttccataacagcagttaggccacagaggccatgcagtgtgccaggcatggctgcaggagggtctgagtatagactccagggctcctgtacctagccccaggcagtgaggcctggagtcactctagctaaagagatcaggaagacagggcgtgggggcacagagaccaaagaggcaagacagttttttaggagcttgcagggattagacatgttccacttagagtcagaagggcaaacattggttaagcacctaccgtgtactccgatatatgtcaaggatacatggcaccagtgggattgcagcatgggagtcagcagccacgggcgtcctgcgggttccagtgcctacaggacaaccaaacaacccacagggttatgaggattacatgagatagtacgttgaaggcacttgtcaaagtggtaagccctcaataaatggctttattagtagtatttgagatggcgtctccctctttcgcccaggctggagtgcagtggcacaatcttggctcactgcaacctccacctcctgggttcaagtgatcctcccaccttagcctcccaagtagctgggattacaggcacgctccaccatacccaactaatttttgtatttttagaagagatggggtttcaccatgttgcccaggctggtcttgaactcctgacctcaagtgatccacctgccttggcctcccaaagtgctgggattacaggcacctgagccaccatgccaggccggctttattatttttaaaaatattatgccatggcctctcccctttaggatacttaaggtatagccccctaagcccacagctggggagccatggctcagggcgggaaatgaggcattgctgtaaatgtatgcatgactcttctagtggctttcttcccaagaggtctatcacatgagtaacttcagaattaatccagagcctgtaacaattaattaattctgttgtcgtgtccccctttccctttcttgtgtggcctcacaagtttcatctggtccttgcttgtgattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacctggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgggcctcctaggacccagggaccttgttcaaatgcagtctctgctctaggctcccaccgaatcaggctctgaggcgggaagtctgcggtttctctagctccccagatctctgcacacgtccctgcattgtagtggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagcttctttcctgtgaaggtcaagcacacactcgggtgggcaggcaggtgtgggggtggcagaagtctgccccagcatggctgtcggccagcaggagtgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggcttacatgatgggtttggagaagttcctagaaggctttttctgcatcccctgaagcatccctctccaggtgccctttaaaaacacgtaatccctgggaggggtcatggtgcatatcaccgctccttggggagaacccaaagatgggcgggcacctttcctgtcagaaagagcagaagggcttgggctcggaaaagcaagaagcctcgcaggcttccagggctgggcctgagcagggctcactgggggcccaggctgcccctcagctccaccttcccttcctccctccctgccagagccaatgaggataggccccctaccttctcctccctcccgggggctccttagccaggagtttcatgccagggaggaagtggaaggactcctttagggggtccttaagacatctccccatccctggcctcaaggcttgggtttggctggacctaccctcctaactccagatctctctggcaccagattcccagcccaggggagacacctgagaaccccccagatggtgacacacctctgtggtcctctgtcagggacataacctcccagcacagatttgcaaactccctgctgcaggcacaggcagggctatcgggccccaggtgtggctcccctgccttggttcagggagtggagacacagttgcccactgctccccaccccactgccaggcctcttctgcccccatgggtcctggggtgggggagccttgggagtgaagaatgcctctgacccagattcttcaagcagcctctgagctcagaggaagagtctgcctcacggcagcctccctggggtctagctgtcaatcgcccaggaagaaatacccagcgcaggacccggcggggagctggccttctctgtcttcccaggtgcagcagagcgagtgtaaggagctgtcttgggcctgcccagcctggtgccctgcgggggactgctggcacaggactgtgactgggcttcagctctgtctgaaaatctttgctcagagcacctccctagtttgatctgataccccgcctgaccctgccagagtccagaggtcacggcggccagcccctgcctccgggaaggttattccaaatgctcccacagccctgacccttcctgttgctttgtccctgcagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtgggaggacagggtgggacacagacgggggcgttggggatgggcagtgagcagccagccaggctggacatctgtgagcaggggcagtgggtggccatgcgtctgggcactgtgcctggcactcaggcccccgcctgcccccaggtggtgatcatgcgggactaccagcacttcaacgtggtggagatgtacaagagctacctggtgggcgaggagctgtgggtgctcatggagttcctgcagggaggagccctcacagacatcgtctcccaagtcaggtgggcagctgggagggctggaccctgagtgcaggctgccctcaccatggccctgccagggcaatgtggtcttctgcctgtggcccagaagacttgggatgcctgggctcccctgcctgctggggtaactgagacccaggggtcttgggagtggagaagagaaggatagcttctagccaaagctcaggccccagttttcaccagggctatggcctgactgtgctgccaaacagattgcctgggagctgtggggcctagcaccagggactcctactctgctcagccaccccacgacctgccagagctaacgttctctttcatcgggtggccccaccttcctgtccaggctgaatgaggagcagattgccactgtgtgtgaggctgtgctgcaggccctggcctacctgcatgctcagggtgtcatccaccgggacatcaagagtgactccatcctgctgaccctcgatggcagggtaggtcccatcctgtccctggcacagccacgctcccacttcctcctgatccaccactcactcccttttcaaccgcaggtgaagctctcggacttcggattctgtgctcagatcagcaaagacgtccctaagaggaagtccctggtgggaaccccctactggatggctcctgaagtgatctccaggtctttgtatgccactgaggtaaccgttccctccaccccccagacctcccaaaagcaacttggcaactggcagctcttctgctgtggcccctccagtgagctcaccaaaagcagccctggttttcagagtcccacctagtcaacacccttccccctttcgatggggctgctcttacccagtgactttgctgccaggaacgagtcctgcaagtgctttcctcagctcaagggcagaatggggtatggccgggcctcctatgtatgatggcctttctctgagtgactgacagctgtgtccctataggcagtggtcactcatgcaggcagtaactggccacagggcaggtgaccaggggaggaaggagacagacccaccaaggagagctggggccagctgtcccccctccaccactgctgccaccagaacgcagctaccaatgggccagggtctggccatggggtcagggacattttcctcctgcaggtggatatctggtctctgggcatcatggtgattgagatggtagatggggagccaccgtacttcagtgactccccagtgcaagccatgaagaggctccgggacagccccccacccaagctgaaaaactctcacaaggtcagttggcacacaagggtgcgacctcgcagaccccattcctcctgaggcaaggggaccagaacctgggctcccagcatctcccttccactgaagccacagggtctgggctcctggaaaaggctcctctttccccacacaaaacccgcacctgggtgtggagccgcatctacgcacaagttcgcatgtgcgctccgacaagtcgcctcccacggctgtggcaggagagttgctgcttggcagaagggttgctgcttggcaggcactggtcggaagcccagtggggcccatgagcagggaaagccaggacaccagcaatccctgctgtccagggagggatccggagaagcttcactgagcacaaacccttctaacccgtgtcgggagatccataccatgattcgatgtccctgtccatcacggcgagtcggctcatgctccatcgttgcacaccccgacacagctaagccacagcgttccccttaaagccagtataagtgcatggaagtgtatacatgtaaccctttttgccaaatcggccccaaccccgcaggccttactgtggacgccccctgctggcaggtcagcacggggctgctaagtggcaccgccatctggtggccaaaacaagaaatgtctcagagggctgaagcctctcctctaaaatagcaaaaaaacaagagttctgtggccccaacacaaagctggatgggaggaccaacaggaaacatcttccaagacaactggtccttggagcccgcaccgctaaccccaaaattagcatataaagatctccagttggctaattcctcagaggatgtagccttctgcccaagactcagcctcatcccaagatactggctcaaaatgaaccaagataagcccttgctttagactcttaaggcctagagcaacaaagaaatcttccttttcaggtctcactttattttctatttttcagagtacttcctcatccttgacttgtttgtttctgttgttgttggttttttttttttttttttttttggagatggagtctctctctgttgctcaggctggaatgcagtggtgcgatctcagctcactgcaacctccgcctcctgggttcaagcaattctcctgcctcagcctcctgagtagctgggattacaggcacgtgccaccatgctcaactaatttttgtatttttagtagagacagggtttcgccatgttggtcaggctggtctacgaactcctgacctcgtaatctgcccaacttggcctcccaaagtgctgggattacaggcttgagccactgcgcccagcgacctgtttttaaaatctcaaaagccctatgtggcagacagggcaagcatactttatcactagcccattttacagatgagaaaactgaggcctagagaaaactgtgacttgcctgagatcacggatagagccagatctggatcactgatgccaatcctctgccccttccacagagctatagcatctgaatgctgagagccttgagggggtggggagggacaagggaacaggaagttaaaaaaccagcgaattcatgactttcaaacaatgataagtccaggcaatcaggtcaccccgaagtgactgcaaattgtggcttcatcttactgccctgcctctacaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 651 - DNA, 37691 bp, Homo sapiens
gggcaggtaggtggctctgtgttgggtgtggacccacgtgtgtgtgagtgcgagagtgtgtaagccagtgtgtgtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccaggtaggaagccgtccggaggggctggccagggtgagagcccatcactggggggctggacagcccatcagctgccccttcattctggcaggcctgggtaccaaggaaacagcttcctaccaagaaccatgtcactctcttatgcagggccagtcagcacccatgtgcgtctctgctgagctcacagggacacattcagtgagaagggtgctggccagggtacggcttccccatgatcaggacccagcgggtgccaccctcaagcccctggtccccacagggcatgccccagtgtgtgtcaggaggaggggggaggtcccttctcccccacacagctggcagctttgcgggcaccagtgagtaagctgccagagggagggaggctgtgtgcccacagtggcaggacaataccaaccaggagccttcaagagaagaggctgggtgagaaaagcactgaggttttcttttcctttttttttttttttttttttctattttgcctgaagggagtgccgcttcctgggctagagacaagcaccagcctgcagtggagaacgcaggaccccgctgcccagaaggagcagccacggtaaggtccccactgccgctgcgtgctccggattcctgggctagggacgggggtgccaaggtgtccaggctgcctcccacctgggacagggaggctaactccacagctgtgggttcctgggtcaaggggctccactccccacccggcctgccaccttctttccagattgattgtgaaacagtccaatcccagctggtctctggctccctagctagagggagaggtgcttgtttctactcttcctgccccagctgggccaagccagtgccaccgggacacccctatccaaggcccctctcactttaccacctctgggacatttcccttgtgtattcattccacaaatatttagggagcactgctgggtcccaggctccaagtcacaccctttggctgggtttgacctggcacagattctgactctgaaactcagcatcagggcaggttcagggagctgcctggccaagcacggtcactcctcacaggccttggtctccccacccctgctgcagggtggatgacctggtcagctttggggacatcgggcccagtgagctcgggtttataaagcactgggccccaccgggaagcaaggctaacgtcttgtggtctccagttatcctttccctggcattgtacaccaagaggtttgtgccgttctgcctggggtcttcctgaggctggttctggtgggaactgggctgcaggaggagaggatgagcttaggagccgtgtggcccccaggcctggtgggcctgggactcagccccacgggagctcatctagctggggttgaggcctttggggcaagcaaggagtcccctctgcaggcaggcttccctggcggttgtcctggcccaggcttggaggtggcacctgggagccctagtgacagagcgcctggtcagggaagggtcggcaccagaggcaagcccttctgggagcagctgatttggatggaagctctgtgcacctgagagggggagtgtggggactgcacggcctctccagtgccccgaggacaaactgatgctttgtgagtgctctgggccctcccggacttgccagacacagggagggtgcagtgggtggggtctccagccaaggaaagcccgctctgtgcacaactcctaaggatgaccaaaaagtcccctgccctggaggagcacatgtgctcagagtcaggaggaacccataagtgtctctcatgccagtgaattcccacacctggctcctggatgaggagaatgacccagctgtgggggtatctcatgctgcctcacaaaaggtgactctgtgcctaggagtcttccatgcatgcagagctgagcaggggctgctgcccagttggggtcagaggggcggaggctgtcgagcactaggtagacagcaggccagcagcgggcagcaggttgggccaggagggagcagagagtaggggccagggcaggctgagcaggaaaggaaaaggctgcctggggtcctgagggctcagggaggactccagacagctggccttcttatgccagcccgcttctgtgggagaggccctctgcgtaggtgactgggcagggaagaggctaagacactgaaagattgaattcctcacccaaatggcccagagatgcccaccgcacacagtgtcctgggtgcagaaggcaggaaggactcatgggaggctgtcctgtggactgaagcagaaagtccttcccgtaagatgcgctcgtcgccctgagcaggaaggcccaggctgcggaagcagtgcctgagacctgagcagcaggaaggacaccagtaaagctcatcaggaggcatctggccgcctgcacctaccgggcctcaaggagagagcttatttctgggagcctccttggtagaaagaggtggactagccagcaggttggggaggagcattgcaaatggaagcttctgagggcagaatgagttctgaacttgctgaagccaaggctggccctcctgcccagggcgagcagtctgcctgggcctgggaagttgtccccttctgaggaggtgccctccaccccaccagagctcagccctaggggccaggaagggctaaagcgagaagagtgagatgtgagataaaggggaccgtgtctcttcctgggagggtgtggggtccaggcagcaccttgttctggcgcacaggctgccaagcagatgacagccatggcctgactactaggtgcaagcactggtggcaggaagagggggtggacaaagcaggacagagctcttgccctggggatgctcatagccctgcagcagagcagtggaaaggaaagctgagctgagcgtggggccaaccgcgccagaaacaagcggagccacaaagccaccatcagcccccaggtggcttcgtccttttgccaactctgggtccaactcatcgctgaagttggcagccatgacccatccagcccagataatttataaatttacaccaatactgggcaacggttcttaacatagaactttataaagatggacaaaaaagataagttgagaatgacaaacaaaggaagaagcagcttctatctgcagttgcaggaggaggtgaaggctcggggagatagaccagggcgggaagaggcaggatggtggttggttaacatgaagtcagcagcatgagcctcaggcccggtgctgcctcttcctggtgactcgggcaagttacttcatgtctctgggtctcaatttcctctcctgtccaacagagataattatagtacctatgagttagggttgttgagaggattaaataagataataagtgaatgctctgaatggcatgactggcacatacgtacatgttcagcaagagataactattatcaccgtgatgataactggtgtcagaggaacaaagtgccaggagagaccataccttgttcgggggaatcaggaaaggcttcacggaggaggtgactttgaaagaaccctcctctgaggagaaacaaaagctctcagaatgcccaggaaagctgggaagaaacaataatgccaggtctatttttttcccaaatagcatattgtttgtccactgaggctttctaaggaataacttgagactcctctttctggggtctagacttggaggtcttgaggacttgaagtgggctgcccctagtgaagggatcgagagccgggctgtggccctggccctactccttttggggactggaagcttttttcacatgctggtcctaactgcatgaggaactgtgttctgctgagccccatctaaagcatacacttggtgatgtggcaggcagaggggccagacaaggccacggcaggctcctggatcactctggcaagtagcttagaaatgcctagtaatcgtgggcaaggtgcagtggctcacgcctgtaatcccagcactttgggaggctgaggtaggcagatcacaagatcaagagatccagaccatcctggccaacatggtgaaccccgtctctactaaaaaatacaaaaaattagctggacgtggtggcgcgtgcctgtagtcccagctacccgggaggctgaggcaggggaatcgcttgaacccaggaggcggaggttgtagtgagctgggatcgtgccactgcactccagcctggccacagagcaagactctgtctcaaaaaaaaaaaaaaaaggccagtaatcgtgaggttccatctcagagacttttgttttctctttttttctttttatttttttttttgagacagagtttcgctcttgttgcccaggctggagtgcagtggcacgatcttggctctctgcaacctccgcctccctggttcaagcgattctcctgcctcagcctcccaagtaggtgggattacaagcacccaccaccatgcccggctgatttttgtatttttagtagagatggggtttcactatgttggccaggctagtctcgaactcctgacctcaggtgatccgccgacctcagcctcccaaagtgctgggattacagatgtgagccaccacacccagcctgctttttctacaaaggattatctgttctatgaatttaggaaaggtaatcctaaagcttattcacctaagaaaaacaaggcaaccccagagcatgacaggctttcttgggctgggggaactcacatgtgaaaaaacaggttccctcataactacatgagaggccgcaactgcctcagccccagcaaagggacacctctgctggccagcatttcctacaaaacctcatcacgacacatcaggcagggcagagacccaagtattcacatagggccagtgatgactttttttgacacctgtggattctccgtggcaacctattccccaaaagtgctgcctcggtcagccaatcccagtgtctctctgcctaggcaacaatctcttgtgctctggtctgcccacagcctccatgcactcagctctttgggcctcttgctaaggggctggaagcagagctgtgtccttcaggctgtcaaggacctggtgagggatcctctgggtgtccagggaagcaggttcagaaagctcagttcagctggtgctgtattttgatctctgatcccagtgcagcggggaccagcctactcaactcagtgcagatagcaacaaaccagtcaccttgcccaagacctcctgctgcctgcctgcctgcctggtgaccaggactcctaaaggctgcagcagcagcagcagagttaaaactttaaaaccgggaggactggttctgtggctcagcttcctggcctggagaggctctagcctccattttctttctttcagcttatggaattgtgcaagaaagcacagagggtggagggagcgaggggaccagttatgccacagcctcctgcaccaccagagcacagtctcagatcagcaaagaggagctctgaggaggaaaaggctgccccaggaaagagctggccatctcagattgctgtagcacattcaagccaaagggagtccccggaggatgtttcgtccagcccccataattttagagcgggaaacagaggtccagagaaggaaagtgggtcctgaggccacacagctaactaatggcagagtcagtttccagcccagggatccccagctgcctgcccagcactcttgctacccaggctgaacccccacccccgtgctaccaaggggcccatgcaggagcaggcagcagccactgggtaacttgatggcttgggagaggcggcctggcctgacacattgggaggctgggcaggtccccgctttgctcctattgtgctatttgggtgcctcctgccatccccctgcattctgctagacctgaaaccacagcccagcccacgcttgtcagtcaagtgcttcccgaggataaactttgcacacagcacccaggccactcttggggaccaggccactctctgttgaagagatctaactaatttataaattgattgattgaagttctttttgtcccaggtaacttcatgtcttaggccaaagaagggagtcatgatgagtgccagagatgaaacggagattctggggcaaagggtaggggaggcacctgggaggccctgttcttcaggtgatcttctcattagtgtagacttttgaccccaggcagacatttacatgtccaatagccaccatcagaggtcagttcccagaagcaggaggcctgtcacttgccaccggtcaccaggcccaagctagacaagaagactttttctattccactagagtggatcttgctgatgatgtgtctgggatccagaaaggtggggagaagtagaggtctcagctcctggggagggatggagccagccccgggggaagaatgcaaggccgccagtgagcaggcattcagggctcctgtcgaggagagggtggtcaggacaggaggaggggctgcctcatggatgatgaggtccatcatcctagcagaggctgttgtaccagccactgacgagggtgtggcagtggtgttaccagaaccctgctatgtcagcgttcaaatacatgtcccagcaggccaaccacccctgcagcagtcaaggggttctgtccggtgtgtgccagaatgctagggaagagaggaccctgagaaggatggcagcatggcacagacacgccatgtggcagttagacaggtcatgccttctgacccagggcacatgcagaggtccacagactctgaggccagctagttagtgttcccagggggctgcacagcccagagcctgtgagttttgtgcatctggagctaaggtgttctgcccaaagtgttggaggtgggcctcaggcaacaaataccctgcttcctcacatccccttttcttccttggagcttgggcctgggccctcacctagtcaggcacaggcctccactcccccacactcacctgtccttcctgaaagtcagccactgggctccacgcaggggtgtcacagtcagagccctgctccagcctcagacctggggcagtcactggaaactcagaagagagaagacaagacaatgaaagtttcccattcaaggaggcatccagctgttagttctgccagcaaaaatgccagccagagagctaaactgccagcaaaagatatttggatggaactttggaggccattaagagcaggcactgcaaagcaattgtagcgaaaagatattaaatgaatccatcacgtctctaaaatgagtgtccttaccacagatctggctcttgctgttccccagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggcccagggtatcagcagggcacatctgtacagcagccgggcggggacccatggacttttccaaaacacctaaccaggccctagacagtgctaccccctggcgctgggctctctttccggaacccggggtgaacagacctgttgggttgatttagtagcaagtggtagccttgttttctggacgaatcctgggattctactccatggcacatcaaaccaagctccagtgtgcatgcccagggtcggggaggggagctttctccttggtcccttctgcagctgtgagggctgagggttaagaacctttcaccccgtttgggggtgctgctcctccatagccctgtaccccaatgctctagacttcattattccaccaccttccccagggcgggaggtactctttccattacatgcatcaggaaactgaggccagagacatgctgtaagtcttgcgaggcaagagggctcccgtccgcaggactccatggctctgcagctagactccgtcaacttccctcctgcctggggaccccaagggcctggcagtgtcagctccctcggctcacacttccagatgctcggaggttcagaggtttgcacctccctcttggtcccatcagcagagagagatgggtggtcccatcagggtgaggagcaggaagaagcaggtgctggacagcctggaggagagggggaggaagggattttctcccaagagtgcctctctcccaggcttcgggctccagggtgagtgggcagcgacccctctaggagccccagctccacagggctcctcctgccaagcatccagcacacgtgcccccacctccccggcaggtcctgcttgagggcctgaggcgactgggccatctgggtctgtgaagggcagatgtgggatgcaggaacttcaggcagggtgctggcttgtggccaggaaagcctagcacctgattcctagcagggaactcagtgacagagtgggggaacctgagggcccctctgcccctcacacccagtgccatgtgggggtcctcgcgtgttacacagaaataggaagggacggtcctcctacccgcaccccagccctcttgtgtctcacgtgacagcctgcctgggcagtgatttttttaaaacacaaatgccttatattaaggtctgagttggtctctccccactgcccgttcaaacattccatggcaccagcagcctctaagcagcagagttgagagaaccagctttggggtcggatacacttccgttcaaattccagctcctcccctcagtaactggcttacttagtctttctggactggataacaaaatactatggactggtggcttataaacaacagaaatttatttctcacagttctggaagctgagaagcccaagagcaaggtgctggcagatccggtgtctggtgagggcctgcttccaggttcagagctggctgtctttttgctataacctcacatgatggaaagggccagggatctctctgggggcctctttcataaaggcatgaatcccattcatgagggctctgctttcgtgacttaatcacctgccaacaaccccgcctcctaataccctcatattagtgattaggtttcaacagatgaatcttgggggacataggtttcaacagatgaatcttggggggacacaaacattcagtctatagcagtaattatgagaccttcatctgttctttaaccactccgagcctcagtttcctcatttgtaaaatgcgaataataattgtacaggacttccatcccagggttcttgtgaagactaagggaggtagcacaggtacatagctttgtacggggcctggcccacgggaagcatgccatcattggcagccattactatttctattattaggggagggctgagtcgcccagaggaaggagtctgaacggagtaaaagagcttgttagtcgccttcctcatccccagaaaacttttcaagtcatggagcagaaagatgcagggaagggataatgtgtttgtctttctaaaccacaagctgatccctatctttcctctttggccctagcccgagcactcagccctggctgttggcactcagatgttacaacaggccccgacagccacaggctgagggataaccgggaagtgcctgccccacccgatgtgcccaccttgctgccctcccagaccatactggcctgccaatgcctctgagatggcaccactccaagagccatgtccccctgtgaaatgtctgttttgggtgtctcttccagagatcctacccaatttgtagaatgggagtgcctggacaattccttcaaccagaaggtctgtgccagcagccaaggctcctcaaaggaggatgtgcctggagccccctgtgctcagcacggcaacctgggaacaaggccagagggtggcacatggatgctgcaggagacactgtccccagactgctcctgacacttcctgtgctgttgttctgccctttcctcctgggcagggctgagctgggcacggatcagaggagaatagagaagggggagagtcacacacaggaattaatcactcaggacctaccctgaatggatgattcagtgtgtatccccagctgtctcaatgtgtggggagaggggtggcaacggggcggatcgtgcaacccggtgcagctgaacctcatgtagacgagactggaagtgcagaaaactggcgttgtgatggacctgagggattccctagtctagtcttgtatccagttctctggcctacccaactgacggttattcttgaatacctccagtgatgggggactcattacctccttggtcagtctaacttgaccttctgcctctctcaaggccccaaacccactgtagctcccaaggggtgggaggaacccagggtttcctagagttattctctatagggtgaggatgggacttggctagtcgccattctagggtacctaagcctggattcaaaccaaattgaataccagttcatttctggtaataatctaacattcatactttattgtagttctgttcaaaagtactgcttggagctgtgatttgggtatataaggcatttgtagtcaaagaaaataattcacatatgcattcatgaatcagtaaaaataatttagggtgtcgattctaggttagacaatataatgctttcattctagctttggttcatggttcatttcaaatcctcagcaaccaatctctgccacctccacgcagcacattctgcttctgcagccagcattcgaccagtgtacccatgtccttgggtaacgaatctgtggggggagccattctggtatcacctggtccccctcccactgccccctcatccaaggcctagcagtcagcttcctgggtgaccacaggaggtcagagtttgtctaagcgggtcaggcctacagtattgtccactcagaggaaagagaaagaatccgcgtgggaaagacacaaagaggaggaggaggaggcgacagagtaaggggaggagaacagaaactaaatataaatatgtgttggggatgttggggatggcagcagggtatggttagctggctggctcccacaccactgtcccacagcacagagggccagcatctgcacctggcaccatgctttccctaggaaagccgagggcattgggcttgtggtgcagccacacagggtacagacctgtttgggactgtcaggttcccacgggttgcctgagctctattaggtgggcgccttagagtaaattgtgtgaaaccaatacagcctataatgcaaaagattgagccgtgagtagattgatgcgtctaaagaatcagtgaacaaaaataagtggccatagtgacctcagttaatcattgaagtctgaggtgcccaacaatgatttttaaaatccctgcactgtccttggtccccgctctgtgacactggcagtcacccagccaccacttgacggcagccatttggagtccacatgtactgagtttccaagccagaacttcctcagcactcagccagaacacagcctttctctgggggcccaagacaaggagagcaaaggtcttctcacttctttatctggggaagagatgagtgattcctgtcccttcccccagtatagaaaacaccctgtaccccaaaagaaacatggcacaggggcagccaggagtgagccccttggaatggccattctgatcttaggcagggactgctgaggacaagcagaggatgccgactctgggacaaaatcacaggcggaggggctccgaaacaggccctagccgctctgggggtgcgggtctcctgccctaggactctcaggctagaaagtcctcaggactcaggactgcgcaagggctgacaagggaactggaatcccttaaatcccgctttcctgcctgcgcaaggggctaccccagcacagtcttggggccctgtccacatgggacagatcatccaaggtgacaggttttccgactcccgcgtgggctctccaggatgtgtgggtgggcacacgcggcccgctcaggtccgggagagtcggcccgcggctctggagcgtgcatctgcgatgccagtgaacgaggtgattacacacagccggcgctcagctgattctccaggtcgggtctccgcgaggcggccactgggccgtggagccgcaggcaggtccccgcggctgtggccaggccagggcccggaggcgaagggcgggcgggaactggggccaagcaggtggagagaaagagttgagcagcacggcgcccctcgggcagaggggctcctggccaaggccccagcgacacttggcaacttctcccgcgctctgggttcgccgccgcgtcctacctgaggccacaccctgaaatcaaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggtgggttccccggctgccccggaggttcgcggcgagaggacgggcctcccaacacgcgcagcccccttcctgggtgcccatgccccgaagttcgggaccagccggcgccaggcgaggggccttgggcgcaggcatctggagctccgcgtccctggagcgggacctccctccgcgggcgcccgcccggcgcggggcattcgcgtccccgagagggcgcagcagtggggcctgcgagctggggccgggtggccgcgccgggtcggagtgtggctggagaggggccgccccggaagcggtgctgcgcccaacgtccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggtgagtgagcgagcggcccccggccctagagccttctgcacccattttgaagagcaggcagggagggacagtgggcaggcaggtggccctcctgggctggctccttcctggtactgctaggcagcggaggtggtcccttccaggtgccgtctctcgatccttagtgggtgcatgttaagtcacttacaccactttgccccatggccccacggtaggctggtagacgtcaagacctcaaatggcccgccctgcccccgggcccatcttcaggtctgatgcctgtcctgggtgagggtgtcaccgcggcagagtgcagggaattcatgccggggaagaggttcccaaacaggaagggtggtggcaggcccagtggctgtgcagggcagggtgggaggcagccgtgggagactcccgcaggagttacaggtgaagctgccgctccacacatcccagcccaccgctcattccccagatctccagacctgctcaggtggcatccgatctggagtgtaggtgctgctgggagcactggaggctaagccatgaagagctcccagggtgtaggttgcgttttctgtatcttgccccattctggtggttttttgggggcttttctgacttgtttttctgggtgaagggggcagaggggctcaggtctgtgtccatgctcgtttttggtggccggtgtggcataggttgccgcattggataagaaaacgcctggttccatgcaaggtgaggttcagcctgcagtgccatgaattctcctccatagtatataggacagtggccgaagacacatttggaaccgaagagagtggggtttgaatctatccagactttgcctttgactccttagacaagttgcttcacttctctacaaacttataaatggcctcatctgtaaaatgggaatgcgaatgccttcctcctcattaggcggttgtggggagtaactgcctcatcagcctccagctgctatgttgggaagggctaagccactccaagttctcccatcctggagagctttgagggcagtctggctgtttggcaagctattgtcagagggtattagagcaaagcaataggaataaagtaaaggtaggggtccttggagggcgagtagtgagagaccctaattcagggtctctggacctcgtggtgacccagggaaggggccattcctggaagaggatctggcttgggcatcagaaacagcagcgccccctgcacatcacacatgttcatgtgttcatgggtgaccctggaacctcaactgttgcctgggatagagggagcctctggcttgagcttccagtcccatctctgttctgcatagctgtgtgatccagagcaggtcacttgacttctctgggcactgggcattgtggatgagcctggagtttggagtcggagagatctgactttgaatcccagctccacacttactgtcttggacaattacttctctctgagcctcagtttcttcatctgtaaaacagagctcgcagtagctacaattagccattagatgtactaataaaaagcacctagcacagtctatccatgtggtgggcactttataagcatacctttcttttcttgcctcctccttctctctccagctccctgctgtctttaaaatgggcccaggaaagcaggttcagcccaactcacaatggtgttgtgagtgtaaagttgtgagtgttaaggaggtgaaatagaggtctggaaagttaagagctgtagaaaaaaaggcaatcttgtgattagggatgccagaggttccttctgcttagcatagggttccaatgccagaggttccaatgcttagcatagggtcctagctaggcattgaggaccctatgctaaggactcagacctctgtgtgcagaggctgttgagaatctagggtaggccgggcgcggtggctcacgcctgttgacacaagtgactgaatgagctgtattactgtattcttttaaacagcagcccattatctctcccctggggattcactggggccagtggtatgggaatagtgacaaaggcagagagcccaaacattttggcaggttgcatgtcatgctgtctgccctggcccatgctgcatctgtctgggtccctcaagtgggacagcagagcctcagggtcctgctcatcctcccagggcctctccgcacttcagcacactgaccctgagcaggttgtttgaatcttgtgggcatccacatgagggccacaacctgcgtctaggaccctcctcccccgcaggtgacagctgagcagaaaagcagatgaaatttccttcccccgtgtattttgggagccaggatagggtgctggggtgccacctctcctgactctcaagtcacgtgaagaggagcagatggcagactcggaccccagtagaggctgaggtgagacagagttcagctccacacaaggatcagcgaggggacagaggggacagaaggcaggggctgcagggggagcttttcatcgctgaatgagttctagcagagtgcgggcagcctcctgttgggaatgccagagggactgaactttgggccaaggggaaggtcagaccccgtcaggagtgccacagatcctgcactaccatctcttctggctgcagaaggttggcctagagcaacacctgtttggaagaagcaaactaaaccacacaggagtgaggatttcctctcgtttaccatggtccccagagcctggagtagagtaggtccataatagatactttctgaataaaggaatactataatttcccagctgggcacggtggtatgctcctctagtcctgaccactcaagcgactgaggtgggagggtgggttgaggccagacgttcgaggctgcagtaagctctgatcgcgccactgcatttcagcctgggcgactgagtgagactctgtctctaaaaaaaaattttttttttgaaacaaacttctgaaagtaaagtttgagaaaaatccttctggccaatgagaatattccagtgaaaggctgtcttctgttcgcggtaattctcagccaaggggtcaggtgaggcctgtcacctgtcagaatgtgtgtgggatgacagttcccaaagggggttacaaagaggtcaagaaaccctgctgcaggtctcagcatgtcagggcccagccctggaggtgacagggtcctctggaggccactctgacaggttggtgatggtagtagagtgctttcctaagttttgtagcactcggggctcacctctgtcttggggctgtgattctaggataggcccttccccagagtgtcttggatgggcctgagaataacagagggtggtggtaggagcagatggccactgcagccaagttcacatcaggtcctgggtcagactcgtgtctgccccttctttgcctctcggcttgaatgagtcacttagtctctccttctctgcataatggagacagtactagtgctacctcacaggcttgtggcgaggagatcacatgtgtgaaatgctcagcccagagcctgctacttccgtcttatgctaggctcttcctgagtgacgaccgtgagaaatatccaaagctcctccgtgagcaggaacagatgctccccctcactgtgcctggagaagctggcagaggtgaattaatccatcccttgtcatctacaaaaatgtcgaggcctacgtaaggcgagtaggccaaggtcacaagccgggacttaggaacaccaagcccaaggtccacgctgagccagcactcgggcttgtggcccaggacttgagccctggtaagcagaccctgagcctcactgtgagaaagcctgggcctgccgcccccctctcaccccctggcaccttgagcaacccaggagctggcccactaggcagcggcctcctctcttcccagtcgcccgcaaatggcagggaattccaccagcttcatttctaacagcttcccagcaatcccagcgcttacacagccagcccaacgctgacccctccgggtggctgcaaacccctttagactcactttctggaagccagcttcccagcctcagcgcgttcttgtgaatcccttcggtgggctgtgtcctttccttgaaagggactcagtatgcgcaaacagcccaaactcactctaggccaggtctggagggtcaggtgggtgaccacgtgggataccaccacttctggtgaaaagcggggtgacgggttaggaggacagctgaggtgggctcataacgtctccaaaggcagttcccaaagaggagttctggaaatgccagagcatgtttgaaacaggcaggtacattcccaagtggtctgtctcgcacagcaatgctcatttgaatgcccatgctctggcttgaggtttaacggcaggcatcctctgtagtgccaccctgcatctgtggggccctgatggctctggtggccctggcatcccagggcctggcccatggatgtctcctctccagggaggagacgttgaggagggtggcccacccacagtgcagctgcttttctcatctgtggacactagaccagccaagcctcagtgccatgctctgggaatccccttgtctctgtggaacagtagcatccgccacaaaacttactcaccccctcctcaagccaagcctgtgggtcgcctggcttcaggctgagcccctacagaggggctgtggatgcatcctgtgctggacagaacacacgcctgctgtttctgtagcttttcctagatgccaggccctgaccatcacagcccccaccatgacctcttggaaacattttactcaccccttgctgagtggaaaaacacctggttccttgcaagataagggtcagcctgcaagttaggacagccccaggccccctggcctctgactcacaggtcagcccaggaaagaattcagcaggcttcttccctggaggggccagccctgtcctacatacctcacgcacatcttgcccgtttctgttcataaagacctccagagagggagaagaaccacagctgactcagtccggggtaagcatggtggacggagcaggggctctggaatcagatctgggttcaaacctcaactcagtcatttcctggttctgtggcctcaggcaagctattgaacctctttgagcctcatctggatttgtggataacaattccttctctcagggttgctgtgagggttaaatgagctaaccctcggaaggggcttagcacataataggtgctcaagaaaagtttcttccctttctgtgtctgagattgctgctcctccaacaccactgtcccgcccctcagtgaccccaggtacatagctccttgaactgtccaccagctccgccctcaggtttactgggggtagcagcatttcctccagaaagtgtgtgccaggaaccgtcggtccccactggccaggctccggctggaggaagccccacagcaggggagcttccttcttgaactggtttgggctggacccttccctcccaggccttgggcatcccccgatgcagtcatgcgttagccagcaggaagatgcctgcagacatccagaagagaaaagttcaaagcagtcctcacacacggcagtgcctttccagcctgaggtggaatcttcagtgtggcctccctcccctgtgttaaggcgaagtgtcagccaggaggggctggggctgtgcccgagctggccaccccgttctgcttgtttccacttcagggtcttaggctcacatcacttctttcaagctgggcaggagaaacggcagggtctggctctctgagggggagtccccttccttcctcctcctggtgtcttcttggaggaaagctcctcccctagatgaattgcgtgcagatggagatgctagaggggcgacagtaacagctggcatggcctgtttgacttaaccttggggccccatggctggtgcagcagccacctccctcagcccagtggccttggagacatggatgggaaaaggagccctggaaatggcaagcggaggccctggctgaccgggtgggagtgctctgaggacacagcctgatgctggggagaggcagggcatgttttgtcctgggtgattcactcgcgatgactggggcaacactggtcccgttcaggtggatgaacgtctcttaggcactcagcctccatggatcactcttctctgtatttaaaaatattttgtttttggccggacgcggtggctcacgcctgtaatcccagcactttgggaggctgaaggcgggtggatcacctgaggtcaggagttcaagatcagcccagccaacatggtgaaaccctatctctactaaaaatacaaaaattagccggacgtggtggtgcacacctatagtctcagctacttgggaggctgaggcaggagaatcacttgaacctggaaggcagaggttgcagtgagccaagatcgcaccactgtactccagcctgggcaacagagtgaaacgctgtctcaaaaaaaaaaaaaaaaaaaaaaaattgtttttttttagagaagcaatccgtcgtctttaaggaaaacttagaaaaagagtagaaagatagaatagaaggagatcacctgtagccccaccaggtaaatgggacaactaatatgttgatgtatttccttcaaatagccattgtattcacactgcattgacaaattaccattggcaaaatctttaaaaaccccctacccctaatctatatcatcaagaattccactttcgccaaagtaaaccttgatagtttaatttgtgtctgggacccatgactgtggacaggtttaggccccagcaggtcgtgggatccaggagagaccaccaaatcgggcccctcataatgatcacactagacctgagggaggtgagagtcaggctacgggtacccgccgtcactcccaccagctttattattttacctttcacattgaggtttgtgatctgtctgcataattttggagtatgatatgagctcattcttccgggtttattttttttccatgcagatatcaaattacttcagctacatttattaaaaacatcatccattcccccagcatgttgcagggtcacctttgtcattaatcaaatgacctcataagagtgggtctatttttggattctctcttctgttccattggtctatttgtcaattccgtactaaatttgccaatttttgcctatttgcctattgcctatttgccaattccatactaaattaattattgtagctttctaataaatcttaatatctatttagtacaatcctccaacttcgttcattaagattgtcttggctattcctggttctttatatttctgtatacattttagaatcagttcatcaatttctaccaaaggaaatatgctgggattttgtttgagatttaaattaatctgcaggttaacttgggaataattgacatctttacagtattgaaccttctcatctatgaacattctttaatatctttaataatgttttgtattttccaatataaggactttgtatttttttgttagatttattctagatattttgtatttttaatgtaaaatgatatctttttaaaaatttcatttttttttttgagacagagtctcgctctgtcgcccaggctggaatgcagtggcctgatctcagctcactgcaagctccgcctcccaggttcacgccattctcctgcctcagcctcctgagtagctgggactacaggtgcccaccaccacacccggctaatgttttgtagttttagtagagacggggtttcaccgtgttagccaggatgatctctatctcctgacctcgtgattcgcccacctcggcctcccaaagtgctgggattacaggcgtgagccaccgcgcctggccctttttaaaaatttcatgttgttactggtatgtagaaatccagttgattttttaaaatattgaccttgagcctgggcacggtggctcatgcctgtaatcccagcactttgggaggctgaggcgggtggatcatgaagtcaagagatcgagaccatcctggccaacatggtgaaaccccatctctactaaaaatacaaaaattagctgggcgtgatggcgtgcgcctgtagtcccagctactcagtaggctaaggcaggagaatcacttgaacccgggaggcagagattgcagtgagctgagatcacaccactgcactccagcccgggcaagacagcgagactccatctcaaaaaatatatatatatatattgaccttgaatcagggaccttctaaattcactcccttaatcccagttttatgtagattctcccgcattttctacttacacagttatgttgtcccacacagtgttggcctcaccacatttcagatgagtcctagctgcctccctttaggtggttgattggttgattttccagacctaagtgatggcctctggtttctaaagctctactccctagcccccaaagcctgagctcagctgattgcttctgccaactcccaccctcaccatcaccactcctggccctgggacaccctctgggctgtccttctttcttctccagcctccctgctgcctctgggaagaacttgttccggaatggctcactattagaatggactcaagagaggctcccagagtcagagaccatttgctaaagatgctctccctgtgcatccccacagcaaaagctgagcgcttgggtggggcaggggagttggggagagggctgttctggggtgggtggtggggggcggattcaccagctcttcttcagctgcagtctgtgtccctgcacctccagaagatttcacagagctagggaggagggcgaaacaggcagctcaactaatccagggatagcaggtctatccaagggactgggggaatagacctgctgaataaagactcttctgtagcaaaaggcaaaggctgtaatcccagcactttgggagaccaaggcaggtggatcatttgaagtcagaagttcgagaccagcctggccaacatggtgaaatcccgtctctactaaaaatacaaaaattagccgggtatgttggtgggtgcctgtaatctcagctattcaggaggctgaggcaagagaatcacttgaacccgggaggtggaggttgcagtgagcccagatggtgccactacactccagtctgggcgacagggcggcaagactccttctcaaaaacaacaacaacaacaacaaacaacaacaaaaaaggcaaaggccaaaaggaggaggacaaattttaccaaaccatgatgtatatatggcgaggtccccaggtcccagacccctgacatcaggcatgacccctttgactggtaagtctgagcagaaagtggtttggtgttactcccagacttgtatctgcccaagtgccagtgtctggagggcctgagcttcaagacagggattcaaagagaggtgacatcacaagagaaacaaccgtcatgtatggggactctgcttacttcacacaccctaaaccctatgagctgtctttcattaacccccctggctcagatcatttcagttatttgttcaaaatctctccaaattattagtgggagactccctacaactcatctgcaactcacacaggttgttttattccaaagggcttggtctgtaagggtcctgtacatgtggctctacctctagggggtgttcggtggatcccgaacctcaagacccagaagcatggctgacattgagatgtgacgtgggctctgattgagtcacgcatggtgaattcctagtggggaaccactggctgtccagggtccctgcctttctgccagctgcctcccagatctgcgacctccttcagaacctgccaaaatgactaggaaaatgctgtttccatagcaagagccaaaagagaacatgacggccctgcactccagatcttcgggcggatgagtaatccaagctttcagttcaagaatcatgtttcagtttcttgaagcctggaagtgaccttttcagatacataagaacccagtgagctgttctgagcctcttcagatccaaaagcattcaagaggcagccctggccctgtctgccatcaacatgtgatcccaggtccgggatcccctgaaggcgaaactagagcaaccctttggaagtgtccctccccttcccaggcccccagttccccactctcagatctacccatgctatccattgcaagcctgtgtcacttctgtgtatgcagctcagcacgaccttaggcaaagccagaatcagcaaggcacgggacacaggcttgattgcaggttaagtgttttattgtttgttttttgagacagagtctcattctgttgcccaggctggagtgcagtggggcaatctcagctcactgcagcctcagcctcctgggttcaagcgattctcctccctcaaccccatgggtatccgggactacaggcacgtgccaccaggcccggctaatttctttgtatttttagtcaagacaggttttcaccatgttggccaagctggtctcaaactcctgacctcaggtgatccacccgcctcggcctcccagagtactaggattacaggcatgaaccaccatgcccggcccaggtgatgttttacatagagctccaataccagagagaagagtgtcaaggggaggtggtgctctctgccttctctggagagctttacccctaagttagctgcccctcacccaccccaggctatcctcttggctcagggcctttctggaattgaggtaaagcacatggtaaccatgaaggccctttgggggctccctgatacataatagtcccacaccgggcagcatgtctgtgatcagctggttggctttttattaacgtatcatattaacaggttcaaccatcctgggacaaagctgagttgtaataaaaaaaaaaagccaacaaaaaaataactttaatatactgttggattcaattcgatagttttaagattttcatagttacgttcctaaatgatattgagtcaaattttccttttcttgcactctccttatctggttttaagaatcaaggtcatactcgtttcataaaacaagcttgctaactttcctccctctttccccatttttaaaattcgttgacagacagtggaatgatacttgtaatgggctttggattttataaaaacacacccccagagtctgcctgctccataggggacttggcacaggcaagaagacacctcttttccttgtttatagtctgcactggcttatttatggcacgtttgttgtttctgggactgttctgctgggagccagccatttccctgaggaagcagagatggaggtggagggaagccctaggcttctaggggagctgtgctgggggaggggagggagccctgaacctggtgccccaggccctgctgcagccacccctctttcccgggagggagctcaaccttactctgcacttacaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaaggtaagaggggccggcagggatgaggttcagcctctcccagtactcagacaaccatgcctggctaaacctcagaaaggcccctggaggaaccacctacttcacagctatcagttaatcagctgttttaactccctgcctgtcagcctgccattctctccctgggtaagccagggcgaaggaggctggggagaccctctctgcagggtggtggggttgccagattcagcacatgaaaatgtgagatgctcaattgcatttgtatttcagatgacaacgaatagtcttttaggacgtgtcccattcaatatttggacctgcagccccatagggactgagggctctcccagaccaggagaattttagttgtgagggtcacgactagtagacccaagagcctggtagaaggtggggtcaggggccctatcagggtttggaggctgcgaagccagtgtgtgtggaggagcccccggcctggtgtctcttcctcagagggctgggcacatctctcccagccacccgtggagctagagaatggagccccgccccctgagctccagctccctggcccagccgaccacacccctgggcatgctggatgcagccccatggcactcaccatctgctctgctgacgctgggccttctccccgcatccctgcatccagcacaggcgggacccacggtgggccctgataaattatggaaaaattaatgggtggatgacacagcagggaaggtccttaggtggtcctccccagggcccccagggacattctctgaccctgatctcccagccacccctccctgccacaattgggcagctcccacacactcttttctcttccccctacagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaaggtaagtcaggagcctggcctgcaggtgtccactggggagtgggtgtagggacacaggccttgcctagccttccccttggaggactggcaaagaggctccctggactgcttccgcctaaggcggcagaaatgtgcacggtaacctcttctctaaggagggtggctcgcctcctccttccctcccttcctttccttcttttctctgtggctgttgtgttgtttcccatttctgtcagtatttgttcccaagtgtgtggccataggaaaagctggatttgcctagtccaggggcagcaggaggccgacttgtggcatgtgtgactgcttcagacgcacatttttcttgtgagaaaggaaagggtgaagggagcccccgtggtgacatttcttggcaggcagagtggagcgcacctttttgcttcttccaggccctccagcatcctgttgatagtgacagtaacctcttttcccatttggcagaggaggagactgatagagagagggtgagtcacccccaggcatgatggagagtgagtcagagaaggaaggtggggagtgctctggggctgcctgtccggcccgggccctcttggctcatgactcttgcgtatgaaggctttacaagcacagcagccacttgttctttagctccttcctgggagggtcaaaggcagtcctaagaaacggctgctgacagtggcatgggtaatggagcctcccctccctcctgggagggctttaagacaagcctgggtactcccctgtcatcggtggggtgagtgtggcccagcctgcacagggtgtgggtttggggatgacccggactacaacctctctgggtcactgcctgccagctgaggtactcagagaaagttctgggcggccgcgcgtggtggctcacgtctgtagtcccagcactttgggaggccaaggtggatgggtcacgaggtcaggagatcgagaccatcctcgctaacacggtgaaaccccgtctctactaaaaatacaaaaaaaattagccgggcgcggtggcgggcgcctgtagtccaagctactcaggaggctgaggcaggagaatggcgtgaacccgggaggcagagcttgccgtgagctgagatcgcaccactgcactccagcctgggggacagacagagcgagactccgtctcaaaaaaaaaagagaaagttctgagctttgtgcactctagtcccctactaggttaaaggacagtgggttgggatccccatgggttgtggcttgatgtatctgtgagaggaacacgagcatctgtgagctgcagggtgtctggaaggctgtgcccctggggagactcagccagaaaaccaacgtaagatcaggacagtgcaccctgctgggaaggtgagattcggagcttgacctccctctgtctctcaggagtcctgctgcgaggcctcagggatttggagaaaggggttgtcaacactgggctgggcactcatttgcatctttctgggctcctgccagcaccccacagcagggggagaggcctgtccatccctgcacaatgtactgagtactcaccatgggccactgctgctgggtatgccgggatgtcccccatacttgtgggagcaggcggtagttatctcgagctcagcaacaccatacttccaaatccaggggagtggtttccttctgggcaactcagacacatctttcaagatttctactctgaagccaagcctctcaatggcaagctgagaccccccgagctgctccgggccggggcttctcagcgtcctcactgcaggcgctcaggtcagtccatcctttgtggtgggctctccttgcactgtagcagcctccctggcctctactcactagaagttggtggtaccctcggttggaataaccaaaaatgcctccagacactgccaaatgtcactcgagcacacccattaagaaccactgccttaagcaaattcaataacagatggggagcatcagccttcctcctcctcctccaccaccacctaccccaggagtccccagatcaagccagcagcccttggcactggggctgactctggacacttgcagcagcttccataacagcagttaggccacagaggccatgcagtgtgccaggcatggctgcaggagggtctgagtatagactccagggctcctgtacctagccccaggcagtgaggcctggagtcactctagctaaagagatcaggaagacagggcgtgggggcacagagaccaaagaggcaagacagttttttaggagcttgcagggattagacatgttccacttagagtcagaagggcaaacattggttaagcacctaccgtgtactccgatatatgtcaaggatacatggcaccagtgggattgcagcatgggagtcagcagccacgggcgtcctgcgggttccagtgcctacaggacaaccaaacaacccacagggttatgaggattacatgagatagtacgttgaaggcacttgtcaaagtggtaagccctcaataaatggctttattagtagtatttgagatggcgtctccctctttcgcccaggctggagtgcagtggcacaatcttggctcactgcaacctccacctcctgggttcaagtgatcctcccaccttagcctcccaagtagctgggattacaggcacgctccaccatacccaactaatttttgtatttttagaagagatggggtttcaccatgttgcccaggctggtcttgaactcctgacctcaagtgatccacctgccttggcctcccaaagtgctgggattacaggcacctgagccaccatgccaggccggctttattatttttaaaaatattatgccatggcctctcccctttaggatacttaaggtatagccccctaagcccacagctggggagccatggctcagggcgggaaatgaggcattgctgtaaatgtatgcatgactcttctagtggctttcttcccaagaggtctatcacatgagtaacttcagaattaatccagagcctgtaacaattaattaattctgttgtcgtgtccccctttccctttcttgtgtggcctcacaagtttcatctggtccttgcttgtgattacattgataaaagctccctccctgtggagacaggcagtgaagccaacgaaaggatgctagagaccagaccttgccaggctgaagaccaagccagctccccagactccccagcctatgtcccagactctgcttgtgctgggctcctggctgggccatccctcccccagcctccagacgcaggctccgccctgagcccagccagcacctgcagcagcagcagcagcacagggacctggcctgtggagacagggaagaaacccctacctcagcctgtccacgtggtacccacacatcctcagagtagagctggcccatgcagaagccctcaaggccaggaggggaatgatctcattttacagcctttcttaggagcttcaggatgagaggtcatcagagccacctcaggaggagctttaggtggtccccaagcttctgccccgacccacctggatgggtgcctggagagcatgttttctgagttaagtccacactcaggccagcaggcagcttccttagagccccgagcctttctacaggttgactgtgtgatgcagtgagccctgccccacttccctccctgtccctgcctggtgacgtctcatggaacctctgttcccaggacctggtatcacagcctcagtcatggccatgcgccctccacccccctcacagccctcccagaggctccctgaggccgtaagatcatactgcccacttatgcagagtttctcaaagtatgttccatgggcctcctaggacccagggaccttgttcaaatgcagtctctgctctaggctcccaccgaatcaggctctgaggcgggaagtctgcggtttctctagctccccagatctctgcacacgtccctgcattgtagtggagacaggctcagagaggatgacttgcctaaggctcatcacagggcagagcagcccagggctgggccccaggtcctgacagcccagtccaggggtcccactgctccactacacagtggatggtgacagtgtcacagtgtcacagtggatggtgacagtcaggtgctggcgaggacatgggagaatgtttactgtccaaatgtactcatcagggatggagtgagtccaggcagtcctgggaggattgctagcttctttcctgtgaaggtcaagcacacactcgggtgggcaggcaggtgtgggggtggcagaagtctgccccagcatggctgtcggccagcaggagtgcctattccaccctaagcaggccagggacttggctggagagtagaagccctgaagctgcggggggtcggggaaggaagggagtgagggttgccaaagacactgaaaagactctggtggggcccaaggcccagatttggggtttggggtccctgagcaagcatcccagcccaaacttactgcttgagatttcctgtaagttgtttcagctatgggatcaggaccaggacccactgggcacctaagacaatggcttacatgatgggtttggagaagttcctagaaggctttttctgcatcccctgaagcatccctctccaggtgccctttaaaaacacgtaatccctgggaggggtcatggtgcatatcaccgctccttggggagaacccaaagatgggcgggcacctttcctgtcagaaagagcagaagggcttgggctcggaaaagcaagaagcctcgcaggcttccagggctgggcctgagcagggctcactgggggcccaggctgcccctcagctccaccttcccttcctccctccctgccagagccaatgaggataggccccctaccttctcctccctcccgggggctccttagccaggagtttcatgccagggaggaagtggaaggactcctttagggggtccttaagacatctccccatccctggcctcaaggcttgggtttggctggacctaccctcctaactccagatctctctggcaccagattcccagcccaggggagacacctgagaaccccccagatggtgacacacctctgtggtcctctgtcagggacataacctcccagcacagatttgcaaactccctgctgcaggcacaggcagggctatcgggccccaggtgtggctcccctgccttggttcagggagtggagacacagttgcccactgctccccaccccactgccaggcctcttctgcccccatgggtcctggggtgggggagccttgggagtgaagaatgcctctgacccagattcttcaagcagcctctgagctcagaggaagagtctgcctcacggcagcctccctggggtctagctgtcaatcgcccaggaagaaatacccagcgcaggacccggcggggagctggccttctctgtcttcccaggtgcagcagagcgagtgtaaggagctgtcttgggcctgcccagcctggtgccctgcgggggactgctggcacaggactgtgactgggcttcagctctgtctgaaaatctttgctcagagcacctccctagtttgatctgataccccgcctgaccctgccagagtccagaggtcacggcggccagcccctgcctccgggaaggttattccaaatgctcccacagccctgacccttcctgttgctttgtccctgcagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtgggaggacagggtgggacacagacgggggcgttggggatgggcagtgagcagccagccaggctggacatctgtgagcaggggcagtgggtggccatgcgtctgggcactgtgcctggcactcaggcccccgcctgcccccaggtggtgatcatgcgggactaccagcacttcaacgtggtggagatgtacaagagctacctggtgggcgaggagctgtgggtgctcatggagttcctgcagggaggagccctcacagacatcgtctcccaagtcaggtgggcagctgggagggctggaccctgagtgcaggctgccctcaccatggccctgccagggcaatgtggtcttctgcctgtggcccagaagacttgggatgcctgggctcccctgcctgctggggtaactgagacccaggggtcttgggagtggagaagagaaggatagcttctagccaaagctcaggccccagttttcaccagggctatggcctgactgtgctgccaaacagattgcctgggagctgtggggcctagcaccagggactcctactctgctcagccaccccacgacctgccagagctaacgttctctttcatcgggtggccccaccttcctgtccaggctgaatgaggagcagattgccactgtgtgtgaggctgtgctgcaggccctggcctacctgcatgctcagggtgtcatccaccgggacatcaagagtgactccatcctgctgaccctcgatggcagggtaggtcccatcctgtccctggcacagccacgctcccacttcctcctgatccaccactcactcccttttcaaccgcaggtgaagctctcggacttcggattctgtgctcagatcagcaaagacgtccctaagaggaagtccctggtgggaaccccctactggatggctcctgaagtgatctccaggtctttgtatgccactgaggtaaccgttccctccaccccccagacctcccaaaagcaacttggcaactggcagctcttctgctgtggcccctccagtgagctcaccaaaagcagccctggttttcagagtcccacctagtcaacacccttccccctttcgatggggctgctcttacccagtgactttgctgccaggaacgagtcctgcaagtgctttcctcagctcaagggcagaatggggtatggccgggcctcctatgtatgatggcctttctctgagtgactgacagctgtgtccctataggcagtggtcactcatgcaggcagtaactggccacagggcaggtgaccaggggaggaaggagacagacccaccaaggagagctggggccagctgtcccccctccaccactgctgccaccagaacgcagctaccaatgggccagggtctggccatggggtcagggacattttcctcctgcaggtggatatctggtctctgggcatcatggtgattgagatggtagatggggagccaccgtacttcagtgactccccagtgcaagccatgaagaggctccgggacagccccccacccaagctgaaaaactctcacaaggtcagttggcacacaagggtgcgacctcgcagaccccattcctcctgaggcaaggggaccagaacctgggctcccagcatctcccttccactgaagccacagggtctgggctcctggaaaaggctcctctttccccacacaaaacccgcacctgggtgtggagccgcatctacgcacaagttcgcatgtgcgctccgacaagtcgcctcccacggctgtggcaggagagttgctgcttggcagaagggttgctgcttggcaggcactggtcggaagcccagtggggcccatgagcagggaaagccaggacaccagcaatccctgctgtccagggagggatccggagaagcttcactgagcacaaacccttctaacccgtgtcgggagatccataccatgattcgatgtccctgtccatcacggcgagtcggctcatgctccatcgttgcacaccccgacacagctaagccacagcgttccccttaaagccagtataagtgcatggaagtgtatacatgtaaccctttttgccaaatcggccccaaccccgcaggccttactgtggacgccccctgctggcaggtcagcacggggctgctaagtggcaccgccatctggtggccaaaacaagaaatgtctcagagggctgaagcctctcctctaaaatagcaaaaaaacaagagttctgtggccccaacacaaagctggatgggaggaccaacaggaaacatcttccaagacaactggtccttggagcccgcaccgctaaccccaaaattagcatataaagatctccagttggctaattcctcagaggatgtagccttctgcccaagactcagcctcatcccaagatactggctcaaaatgaaccaagataagcccttgctttagactcttaaggcctagagcaacaaagaaatcttccttttcaggtctcactttattttctatttttcagagtacttcctcatccttgacttgtttgtttctgttgttgttggttttttttttttttttttttttggagatggagtctctctctgttgctcaggctggaatgcagtggtgcgatctcagctcactgcaacctccgcctcctgggttcaagcaattctcctgcctcagcctcctgagtagctgggattacaggcacgtgccaccatgctcaactaatttttgtatttttagtagagacagggtttcgccatgttggtcaggctggtctacgaactcctgacctcgtaatctgcccaacttggcctcccaaagtgctgggattacaggcttgagccactgcgcccagcgacctgtttttaaaatctcaaaagccctatgtggcagacagggcaagcatactttatcactagcccattttacagatgagaaaactgaggcctagagaaaactgtgacttgcctgagatcacggatagagccagatctggatcactgatgccaatcctctgccccttccacagagctatagcatctgaatgctgagagccttgagggggtggggagggacaagggaacaggaagttaaaaaaccagcgaattcatgactttcaaacaatgataagtccaggcaatcaggtcaccccgaagtgactgcaaattgtggcttcatcttactgccctgcctctacaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca
